United States Patent 11,596,699 (RNA ENCODING AN ANTIBODY) - sequence listing, part 9

SEQ ID NO: 49403 - RNA, 384 nt, Artificial Sequence
  derived and/or modified sequence opt6 from anti-HIV-1_HeavyChain
agucauacaguagaacaaaguggaagugcaaugaaaaaaccaggagcaaguguaagaguaaguuguuggacaagugaagacauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaaguagagacagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguuca

SEQ ID NO: 49404 - RNA, 384 nt, Artificial Sequence
  derived and/or modified sequence opt6 from anti-HIV-1_HeavyChain
agacauacauggaauaaaaguggaagcggaguaaaaaaaccaggagcaaguguaagaguaucauguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49405 - RNA, 384 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagugaagauauauuugaaagaacagaauuaauacauuggguaagacaagcaccaggacaaagauuagaauggauaggauggguaaaaacaguaacaggagcaguaaauuuuggaaguccaaauuuuagacauagaguaaguuuaacaagagacagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49406 - RNA, 384 nt, Artificial Sequence
  derived and/or modified sequence opt6 from anti-HIV-1_HeavyChain
ucacaugauuuagaacaaucaggaucagcaaugaaaaaaccaggagcaucaguaagaguaucaugcuggacaucagaagauauauuugacacaacagaacuaauauacuggguaagacaagcaccaggacaaggauuagaauggauaggauggguaaaaauaguaagcggaacaguaaacuuugcaucauuagauuucagaaacagaauaagucuaucaagagauagagauuuaucaacagcacauauggacauaagaggauuaagacaagaugacacagcaacauauuuuugcgcaagacaaaaauuugaaucaagauauagcggagaccaaggaucauauuuugaccuauggggaagaggaacauuaauaauaguaucaagu

SEQ ID NO: 49407 - RNA, 384 nt, Artificial Sequence
  derived and/or modified sequence opt6 from anti-HIV-1_HeavyChain
agacauacauggaaugaaaguggaaguggaguaaaaaaaccaggagcaagcguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacaacaacauauuuuugugcaagacaaaaauuugaaaguagauauacaggaggacaaggaugguauuuugauuuauggggaagaggaacacauauaguaguaaguagu

SEQ ID NO: 49408 - RNA, 384 nt, Artificial Sequence
  derived and/or modified sequence opt6 from anti-HIV-1_HeavyChain
agacauacaugggaacaaguauggaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggacuaacacaaggagauacagcaacauauuuuugugcaagacaaaaauuugaaaguagauauacaggaggacaaggaugguauuuugauuuauggggaagaggaacacauauaguaguaagcagu

SEQ ID NO: 49409 - RNA, 384 nt, Artificial Sequence
  derived and/or modified sequence opt6 from anti-HIV-1_HeavyChain
caaagccaucuagaacaaucaggaucagcaaugaaaaaaccaggagcaucaguaacaguaucaugcuggacaucagaagauauauuugacacaacagaacuaauauacuggguaagacaagcaccaggacaaggacuagaauggauaggauggguaaaaauaguaagcggaacaguaaacuuugcaucauuagauuucagaaacagaauaucacuaucaagagauagagaucuaucaacagcauacauggacauaagaggacuaacacaagaugacacagcaacauacuuuugcgcaagacaaaaauuugcaucgagauauagcggagaccaaggaucauacuuugacuuauggggaagaggaacauuaauaguaguaucaagc

SEQ ID NO: 49410 - RNA, 384 nt, Artificial Sequence
  derived and/or modified sequence opt6 from anti-HIV-1_HeavyChain
agacaugauuuagaacaaaguggaaguggaguaaaaaaaccaggagcaaguguaagaguaaguuguuggaguagugaagauauauuugaaagaacagaauuaauacauuggguaagacaagcaccaggacaaggacuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaagcagauauacaggaggacaaggaugguauuuugauuuauggggaagaggaacacauauaguaguaaguagu

SEQ ID NO: 49411 - RNA, 384 nt, Artificial Sequence
  derived and/or modified sequence opt6 from anti-HIV-1_HeavyChain
guaacaacauggaauaaaucaggaucagcaaugaaaaaaccaggagcaucaguaagaguaucaugcuggacaucagaagauauauuugacacaacagaauuaauauacuggguaagacaagcaccaggaagaggacuagaauggauaggauggguaaaaacaguaagcggaacaguaaacuuuggaaguagcgauuucagaaacagaauaucacuaacaagagauagagaucuaucaacagcacacauggacauaagaggacuaacacaagaugacacagcaacauacuuuugcgcaagacaaaaauuugaaucacuauauagcgaugaccaaggaucauacuuugacuuauggggaagaggaacauuaauaauaguaucaagu

SEQ ID NO: 49412 - RNA, 384 nt, Artificial Sequence
  derived and/or modified sequence opt6 from anti-HIV-1_HeavyChain
agacauacauggaauaauacaggaaguggaguaaaaaaaccaggagcaagcguaagaguaagcuguuuagcaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaagcuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49413 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuuagcaagugaagauauauuugaaagaacagaauuaauauauuggguaagacaagcaccaggaagaggaccagaauggauaggauggguaaaaacaguaaguggaacaguaaauuuuggaaguagugauuuuagaaauagaauaaguuuaacaagagauagagauuuaaguacagcacauauggauauaagaggauuaacacaagaugauacagcaacauauuuuugugcaagacaaaaauuugaaaguuuauauagugaugaucaaggaaguuauuuugauuuauggggaagaggaacauuaauaauaguaaguagu

SEQ ID NO: 49414 - RNA, 384 nt, Artificial Sequence
  derived and/or modified sequence opt6 from anti-HIV-1_HeavyChain
agacauacauggaauaauacaggaaguggaguaaaaaaaccaggagcaaguguaagaguaaguuguuggacaagugaugauauauuugaaagaacagaauuaauacauuggguaagacaagcaccaggacaaggauuagaauggauaggauggguaaaaacaguaaguggaacaguaaauuuugcaaguuuagauuuuagaaauagaauaagucuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49415 - RNA, 384 nt, Artificial Sequence
  derived and/or modified sequence opt6 from anti-HIV-1_HeavyChain
ggaacaccaggaaauaaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguuca

SEQ ID NO: 49416 - RNA, 384 nt, Artificial Sequence
  derived and/or modified sequence opt6 from anti-HIV-1_HeavyChain
ggaacaccaggaagugaaaguggaaguggaguaaaaagaccaggagcaagcguaagaguaagcuguuggacaagugaagauauauuugaaacaacagaauuaauacauuggguaagacaagcaccaggacaaggauuagaauggauaggauggguaaaaacaguaaguggagcaguaaauuuuggaaguuuaaauuuuagacauagaguaaguuuaacaagagauagagauuuauuuacagcacauauggauauaagaggauuaacacaaggagauacagcaacauauuuuugugcaagacaaaaauuugaaaguagguauacaggaggacaaggaugguauuuugauuuauggggaagaggaacacauauaguaguaaguagu

SEQ ID NO: 49417 - RNA, 384 nt, Artificial Sequence
  derived and/or modified sequence opt6 from anti-HIV-1_HeavyChain
guaacaccaggaacaaacuuaggauuaagaaugaaaaaaccaggagcaucaguaagaguaucaugcuggacaucagaagauauauuugacacaacagaacuaauauacuggguaagacaagcaccaggacaaggauuagaauggauaggauggguaaaaauaguaaguggaacaguaaacuuugcaucacuagauuucagaaacagaauaucacuaucaagagauagagaucuaucaacagcauacauggacauacgaggacuaacacaagaugacacagcaacauacuuuugcgcaagacaaaaauuugcaucaagauauagcggagaccaaggaucauacuuugacuuauggggaagaggaacauuaauaguaguaucaagc

SEQ ID NO: 49418 - RNA, 384 nt, Artificial Sequence
  derived and/or modified sequence opt6 from anti-HIV-1_HeavyChain
agacaugauuuagaacaaaguggagcaggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagacacagcaacauacuuuugugcaagacaaaaauuugaaaguagauauacaggaggacaaggaugguauuuugaucuauggggaagaggaacacauauaguaguaaguagu

SEQ ID NO: 49419 - RNA, 384 nt, Artificial Sequence
  derived and/or modified sequence opt6 from anti-HIV-1_HeavyChain
caaguacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaagucuaacaccagauagagauuuauuuacagcacauauggauauaagaggauuaacacaaggagauacagcaacauauuuuugugcaagacaaaaauuugaaaguagauauacaggaggacaaggaugguauuuugaucuauggggaagaggaacacauauaguaguaaguagu

SEQ ID NO: 49420 - RNA, 384 nt, Artificial Sequence
  derived and/or modified sequence opt6 from anti-HIV-1_HeavyChain
ggaacaacaugggaacaaaguggaaguggaguaaaaaaaccaggagcaaguguaagaguaaguuguuggacaagcgaagauauauuugaaaaaagugaauuaauacauuggguaagacaagcaccaggacaaggauuagaauggauaggauggguaaaaacaguaacaggggcaguaaauuuuggaaguuuagauuuuagacauagaauaucauuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49421 - RNA, 384 nt, Artificial Sequence
  derived and/or modified sequence opt6 from anti-HIV-1_HeavyChain
agucaugauuuagaacaaaguggaagugaauggaaaaaaccaggagcaaguguaagaguaaguuguuggacaagugaagauauauuugauacaacagaacuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49422 - RNA, 384 nt, Artificial Sequence
  derived and/or modified sequence opt6 from anti-HIV-1_HeavyChain
caaagcagaccaggaaacaaaagcggaagcgcaaugaaaaaaccaggagcaagcguaagaguaagcuguuggacaagcgaagacauauucgaaagaacagaauuacuauggguaagacaagcaccaggaagaggacuagaauggauaggauggguaaaaacaguaagcggaacaguaaacuuuggaucaagcgauuucagaaacaggauaucacuaacaagagauagagaucuaucaacagcacacauggacauaagaggacuaacacaagaugacacagcaacauacuuuugcgcaagacaaaaauuugaaucacuauauagcgaugaccaaggaucauacuuugacuuguggggaagaggaacauuaauaauaguaucgagc

SEQ ID NO: 49423 - RNA, 384 nt, Artificial Sequence
  derived and/or modified sequence opt6 from anti-HIV-1_HeavyChain
ggaacaacauggaguaaaaguggaaguggaguaaaaaaaccaggagcaaguguaagaguaaguuguuggacaagugaagauauauuugaaagaacagaauuaauauauuggguaagacaagcaccaggacaaggauuagaauggauaggauggguaaaaauaguaaguggaacaguaaauuuugcaaguuuagauuuuagaaauagaauaaguuuaaguagagauagagauuuaaguacagcacauauggauauaagaggauuaacacaagaugauacagcaacauauuuuugugcaagacaaaaauuugcaaguagauauaguggagaucaagggaguuauuuugacuuauggggaagaggaacauuaauaauaguaaguagu

SEQ ID NO: 49424 - RNA, 387 nt, Artificial Sequence
  derived and/or modified sequence opt6 from anti-HIV-1_HeavyChain
caagcacacuuagaacaaagcggaagcggaguaaaaaaaccaggagcaaguguaagaguaagcuguuggacaagugaagacauacuaagaaaaaaaagaguagacucaguaggaugcgauacagcaccaggacaaggacuagaauggauaggauggguaaaaacaguaacaggagcaguaaacuuuggaucaagugauuucagacaaagaguaucacuaacaagagauagagauuuauuuacagcacacauggacauaagaggacuaacacaagaugacacagcaacauacuuuugcgcaagacaaaaauuugcaucaagauauagcggagaccaaggaucauauuuugacuuauggggaagaggaacauuaauaguaguaucaagc

SEQ ID NO: 49425 - RNA, 387 nt, Artificial Sequence
  derived and/or modified sequence opt6 from anti-HIV-1_HeavyChain
aaagcacauuuaggaaauaaaaguggaaguggaguaaaaaaaccaggggcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacacauggauauaagaggauuaacacaaggagauacagcaacauauuuuugugcaagacaaaaauuugaaagcagauauacaggaggacaaggaugguauuuugauuuauggggaagaggaacacauauaguaguaaguagu

SEQ ID NO: 49426 - RNA, 384 nt, Artificial Sequence
  derived and/or modified sequence opt6 from anti-HIV-1_HeavyChain
acaacaguaggaacaauauuaggaagagcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaagcggaacaguaaauuuugcaaguuuagauuuuagaaauagaauaagucuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49427 - RNA, 384 nt, Artificial Sequence
  derived and/or modified sequence opt6 from anti-HIV-1_HeavyChain
caaagccaucuagaacaaucaggaucagcaaugaaaaaaccaggagcaucaguaaaaguaucaugcuggacaucagaagauauauuugacacaacagaacuaauauacuggguaagacaagcaccaggacaaggacuagaauggauaggauggguaaaaauaguaagcggaacaguaaacuuugcaucacuagauuucagaaacagaauaucacuaucaagagauagagauuuaucgacagcauacauggacauaagaggacuaacacaagaugacacagcaacauacuuuugcgcaagacaaaaauuugcaucaagauauagcggggaccaaggaucauacuuugacuuauggggaagaggaacauuaauaguaguaucaagc

SEQ ID NO: 49428 - RNA, 387 nt, Artificial Sequence
  derived and/or modified sequence opt6 from anti-HIV-1_HeavyChain
caaagccaucuagaacaaguauggguaugucaaaguaaaaaaccaggagcaagcguaagaguaagcuguuggacaagugaagacauauuugauacaacagaauuaauauauuggguaagacaagccccaggacaaggauuagaauggauaggauggguaaaaauaguaaguggaacaguaaauuucgcaaguuuagacuuuagaaauagaauaaguuuaaguagagacagagacuuaagcacagcacauauggauauaagaggacuaacacaagacgauacagcaacauauuucugugcaagacaaaaauucgcaagcagauacucaggagaucaaggaaguuauuucgauuuauggggaagaggaacacuaauaauaguaaguuca

SEQ ID NO: 49429 - RNA, 384 nt, Artificial Sequence
  derived and/or modified sequence opt6 from anti-HIV-1_HeavyChain
agacauacaguagaacaaagcggaaguggaguaaaaaaaccaggagcaaguguaagaguaaguuguuggaguagugaagauauauuugaaagaacagaauuaauacauuggguaagacaagcaccaggacaaggauuagaauggaugggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49430 - RNA, 384 nt, Artificial Sequence
  derived and/or modified sequence opt6 from anti-HIV-1_HeavyChain
caaagucauuuagaacaaagcggaagugcaaugaaaaaaccaggagcaaguguaagaguaaguuguagugcaagagaagauauauuugauacaacagaauuaauauauuggguaagacaagcaccaggacaaggauuagaauggauaggauggguaaaaauaguauguggaacaguaaauuuugcaaguuuagauuuuagaaauagaauaagcuuaaguagagacagagauuuaaguacagcacauauggauauaagaggauuaacacaagaugauacagcaacauauuuuugugcaagacaaaaauuugcaaguagauauaguggagaucaaggaaguuauuuugauuuauggggaagaggaacauuaauaauaguaucaagu

SEQ ID NO: 49431 - RNA, 387 nt, Artificial Sequence
  derived and/or modified sequence opt6 from anti-HIV-1_HeavyChain
gaaguacaaagaggaggaagaguaguaggaagagauguaaaaaaaccaggagcaagcguaagaguaaguuguuggacaagcgaagauauauuucauacagaauuaauauauuggguaagacaagcaccaggacaaggauuagaauggauaggauggguaaaaauaguaaguggaacaguaaauuuugcaaguuuagauuuuagaaauagaauaaguuuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49432 - RNA, 384 nt, Artificial Sequence
  derived and/or modified sequence opt6 from anti-HIV-1_HeavyChain
ggaacaacauggaaugaaaguggaaguggaguaaaaaaaccaggagcaaguguaagaguaccauguuggaguagugaagauauauuugaaagaacagaauuaauacauagaguaagacaagcaccaggacaaggauuagaauggauaggauggguaaaaacaguaacaggagcaguaaauuuuggaaguccaaauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49433 - RNA, 384 nt, Artificial Sequence
  derived and/or modified sequence opt6 from anti-HIV-1_HeavyChain
agaaguaauuggguacaaucgggagcagacguaaaaaaaccaggggcaucaguaaaaaguucaugcuggacaucagaagauauauuugauacaacagaacuaauauacuggguaagacaagcaccaggacaaggacuagaauggauaggauggguaaaaauaguaagcggaacaguaaacuuugcaucauuagauuucagaaacagaauaucacuaucaagagauagagauuuaucaacagcauacauggacauaagaggauuaacacaagaugacacagcaacauacuuuugcgcaagacaaaaauuugcaucaagauauaguggagaccaaggaucauauuuugauuuauggggaagaggaacauuaauaguaguaucaagc

SEQ ID NO: 49434 - RNA, 384 nt, Artificial Sequence
  derived and/or modified sequence opt6 from anti-HIV-1_HeavyChain
ccaguacaauuaguacaaaguggagcagaaguaaaaaaaccaggagcaucaguaaaaguaaguuguuggacaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaucauuaacaagagauagagauuuauuuacagcacauauggauauaagaggauuaacacaaggagauacagcaacauauuuuugugcaagacaaaaauuugaaucaagauauacaggaggacaaggaugguauuuugauuuauggggaagaggaacacauauaguaguaaguagu

SEQ ID NO: 49435 - RNA, 399 nt, Artificial Sequence
  derived and/or modified sequence opt6 from anti-HIV-1_HeavyChain
agggaauauuuagaacaaaguggaggaggaguaaaaaaauuaggagcaaguguaagaguaaguuguagagcaagugaagauuuauuuggagaugaagcaauauaugaugaugaauuaauacauugguuaagacaaguaccaggacaaagaccagaauggaugggauggauaagaccaaaaacaggagcaagaaaucaagcaagacaauuucaaccaagaauaaauuuaaguagagauagagcauuaaauacagcauauuuagauuuaaguaguuuaacaagcgcagauagugcaacauauuuuugugcaagacaaacauuuaaaccagauuuuuauuuugcagaucaaggauggaguuuuaauuuauggggaagaggagcaagaguaauaguaaguagu

SEQ ID NO: 49436 - RNA, 399 nt, Artificial Sequence
  derived and/or modified sequence opt6 from anti-HIV-1_HeavyChain
caaguacaauuaguacaaucaggaacagaaguaaaaaaaccaggagcaucacuaagaguaucaugcagagcaucagaagaucuauuuggagauaaaauaauauaugacgaugaaguaauacauugguuaagacaacuaccaggacaaagaccagaauggaugggauggauaagaccaaaaucaggagcaagaaaucaagcaagacaauuccaaccaagaauaucacuaacaagagauagagcacuaucaacagcauaccuagacuuaaacucacuaacaucagcagacucaggaacauacuuuugcgcaagacaaacauuuaaaccagacuuuuacuuugcagaucaaggauggucauucaaucuauggggaagaggagcacacuuuauaguaagcuca

SEQ ID NO: 49437 - RNA, 399 nt, Artificial Sequence
  derived and/or modified sequence opt6 from anti-HIV-1_HeavyChain
caagcacaucuagaacaaucaggaucaggaguaaaaaaaccaggagcaucaguaagaguaucaugcagagcaucagaagaucuauuuggagaugaaauaauauaugacgaugaaguaauacauugguuaagacaaguaccaggacaaagaccagaauggaugggauggauaagaccaaaaacaggagcaagaaaucaagcaagacaauuccaaccaagaauaucacuaacaagagauagagcacuaucaacagcauacuuagacuuaaacucauuaacaagcgcagacucaggaacauacuuuugcgcaagacaaacauuuaaaccagacuuuuacuuugcagaucaaggguggucauucaauuuauggggaaggggagcacacuuuauaguaagcuca

SEQ ID NO: 49438 - RNA, 399 nt, Artificial Sequence
  derived and/or modified sequence opt6 from anti-HIV-1_HeavyChain
ggaaauauauggagugaaagcggaggaggaguaaaaaaaccaggagcaaguguaagaguaaguuguagagcaagugaagauuuauuuggagaugaaauaauauaugaugaugaaguaauacauugguuaagacaaguaccaggacaaagaccagaauggaugggauggauaagaccaaaaaauggaggaagaaaucaagcaagacaauuucaaccaagaauaaguuuaacaagagauagagcauuaaauacagcauaucuagauuuaaauaguuuaacaagugcagauaguggaacauauuuuugugcaagacaaacauuuaaaccagauuuuuauuuugcagaucaaggauggaguuuuaauuuauggggaagaggagcaagaguaauaguaaguagu

SEQ ID NO: 49439 - RNA, 399 nt, Artificial Sequence
  derived and/or modified sequence opt6 from anti-HIV-1_HeavyChain
caaguacaauuaguacaaucaggagcagaaguaaaaaaaccaggagcaucacuaagaguaccaugcagagcaucagaagaucuauuuggagaugaaauaauauaugacgaugaaguaauacauugguuaagacaaguaccaggacaaagaccagaauggaugggauggauaagaccaaaaacaggagcaagaaaucaagcaagacaauuccaaccaagaauaucacuaacaagagauagagcacuaucaacagcauacuuagacuuaaacucauuaacaagcgcagacucaggaacauacuuuugcgcaagacaaacauuuaaaccagacuuuuacuuugcagaucaaggauggucauucaaucuauggggaagaggagcacacuuuauaguaagcuca

SEQ ID NO: 49440 - RNA, 390 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagugcaaguagaagugca

SEQ ID NO: 49441 - RNA, 393 nt, Artificial Sequence
  derived and/or modified sequence opt6 from anti-HIV-1_HeavyChain
caagcacauuuagaacaaagcggaaguggaguaaaaaaauuaggagcaaguguaagaguaaguuguuggacaagugaagauauauuugaaagaacagaauuaauacauuggguaagacaagcgccaggacaaggauuagaauggauaggauggguaaaagcaguaaguggagcaguaaauuauggaaguuuagauuuuagacauagaguaagucuaacaagagauagagauuuaaguacagcacauauggauauaagaggauuaacacaagaugauacagcaacauauuuuugugcaagacaaaaauuugcaagaggagaucaaggaugguuuuuugaucuauggggaagaggaacauuaauaguaguaaguagugcaaguacaagaaguaca

SEQ ID NO: 49442 - RNA, 414 nt, Artificial Sequence
  derived and/or modified sequence opt6 from anti-HIV-1_HeavyChain
caaguacaauuaguacaaaguggagcagaaguaaaaaaaccaggugcaaguguaacaguaaguuguaaagcaaguagauauacauuuauaaauuauuauauacauuggguaagacaagcaccaggacaaggacuagaauggauaggauggguaaaaccaguaaguggagcaguaaauuuuggaucaccaaauuuuagacauagaguaucauuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagugcaucaacaaaaggaccaaguguauuuccacaugauuuaaga

SEQ ID NO: 49443 - RNA, 414 nt, Artificial Sequence
  derived and/or modified sequence opt6 from anti-HIV-1_HeavyChain
caaguacaauuaguacaaaguggagcagaaguaaaaaaaccaggagcaaguguaaaaguaaguuguaaagcaaguggauauacaauaacaagacauuauaugcauuggguaagacaagcaccaggacaaggauuagaauggauaggauggguaaaaacaguaacaggagcaguaaauuuuggaucaccaaauuuuagacauagaguaucauuaacaagagauagagaucuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguucagcaucaacaaaaggaccaaguguauuuccacaugauuuaaga

SEQ ID NO: 49444 - RNA, 408 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagugaagauauauuugaaaaaagugaauuaauacauuggguaagacaagcaccaggacagggauuagaauggauaggauggguaaaaacaguaacaggagcaguaaauuuuggaaguccaaauuuuaggcauagaguaaguuuaacaagagauagagauuuauuuacagcacauauggauauaagaggacuaacacaaggagauacagcaacauauuuuugugcaagacaaaaauauuaugcaggaggacaaggaugguauuuugaucuauggggaagaggaacauuaauaguaguaaguagugcaaguacaaaaggaccaagugaugaucuaaga

SEQ ID NO: 49445 - RNA, 411 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaagcuuaacaagagauagagauuuauuuacagcacauauggauauaagaggauuaacacaaggagauacagcaacauauuuuugcgcaagacaaaaauuugaaagaggaggacaaggauggauauuugauuuauggggaagaggaacauuaauagcaguaaguagugcaaguacaaaaggaccaaguguauaugauuuaaga

SEQ ID NO: 49446 - RNA, 417 nt, Artificial Sequence
  derived and/or modified sequence opt6 from anti-HIV-1_HeavyChain
caaguacaauuaguacaaaguggaaguggagugaaaaaaccaggagcaaguguaagaguaaguuguuggacaagcgaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugaucuauggggaagaggaacauuaauaguaguaaguagugcaaguacaaaaggaccaaguguauuuccacaugauuuaaga

SEQ ID NO: 49447 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguccaaauuuuagacacagaguaagucuaacaagagauagagauuuauuuacagcacauauggauauaagaggauuaacacaaggagauacagcaacauauuuuugugcaagacaaaaauuugaaaggggaggacaaggaugguauuuugauuuauggggaagaggaacauuaauaguaguaaguagugcaaguacaaaaggaccaaguguauuuccaacaauauaugua

SEQ ID NO: 49448 - RNA, 417 nt, Artificial Sequence
  derived and/or modified sequence opt6 from anti-HIV-1_HeavyChain
caaguacaauuagaacaaaguggaaguggaguaaaaaaauuaggagcaaguguaagaguaaguuguuggacaagugaagauauauuugaagaugaauuaauacauuggguaagacaagcaccaggacaaggacuagaauggauaggauggguaaaagcaguaaguggagcaguaaauuauggaucauuagauuuuagacauagaguaucauuaacgagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguucaggauuacaucaaggaccaauaggauuaccaccaagauuaucaaga

SEQ ID NO: 49449 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagugcaaguccaagagcacauagaaguaguccaacaauaugugua

SEQ ID NO: 49450 - RNA, 417 nt, Artificial Sequence
  derived and/or modified sequence opt6 from anti-HIV-1_HeavyChain
caagcacauuuagaacaaaguggaaguggagugaaaaaaccaggagcaaguguaagaguaaguuguuggacaagugaagauauauuugaaagaacagaauuaauacauuggguaaggcaagcaccaggacaaggauuagaauggauaggauggguaaaaacaguaacaggagcaguaaauuuuggaaguagugauuuuagacaaagaguaaguuuaacaagagauagagaucuauuuacagcacauauggauauaagaggacuaacacaaggagauacagcaacauauuuuugugcaagacaaaaauuuuaugcaggaggacaaggaugguauuuugauuuauggggaagaggaacauuaauaguaguaaguagugcaaguacaaaaggaccaaguguauuuccacaugaucuaaga

SEQ ID NO: 49451 - RNA, 414 nt, Artificial Sequence
  derived and/or modified sequence opt6 from anti-HIV-1_HeavyChain
caaguacauuuaguacaaaguggagcagaaguaaaaagaccaggagcaagcgugaaaguaaguuguaaagcaaguggauauacauuuacagauuauuuuauacauuggguaagacaagcaccaggacaaggacuagaauggauaggauggguaaaaacaguaaguggagcaguaaauuuuggaucauuaaauuuuagacacagaguaucauuaacaagagauagagauuuauuuacagcacacauggauauaagaggauuaacacaaggagauacagcaacauauuuuugugcaagacaaaaauuugcaagaggagaucaaggaugguuuuuugauuuauggggaagaggaacauuaauaguaguaagcucagcaucaacaaaaggaccaagcguauuuccacaugauuuaaga

SEQ ID NO: 49452 - RNA, 420 nt, Artificial Sequence
  derived and/or modified sequence opt6 from anti-HIV-1_HeavyChain
caaguacaauuaguacaaaguggagcagaaguaaaaaaaccaggagcaagcguaaaaguaaguuguaaagcaaguggauauauauuuacaggaaguuauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggguuuuuuuuugauuuauggggaagaggaacaagaguaauaguaaguagugcaaguacaaaaggaccaaguguauuuccacaugauuuaaga

SEQ ID NO: 49453 - RNA, 417 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagcgaagauauauuugaaaaaagugaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggacgaggaacauuaauaguaguaaguagugcaagcacaaaaggaccaaguguauuuccacaugauuuaaga

SEQ ID NO: 49454 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaggaagugaauuaauacauuggguaagacaagcaccaggacaaggauuagaauggauaggauggguaaaaacaguaacaggagcagugaauuuuggaaguccaaauuuuagacauagaguaagucuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaagcagugcaaguacaaaaggaccaaguguauuuccacaugauuuaaga

SEQ ID NO: 49455 - RNA, 420 nt, Artificial Sequence
  derived and/or modified sequence opt6 from anti-HIV-1_HeavyChain
caaguacaauuaguacaaucaggagcagaaguaaaaaaaccaggagcaucaguaaaaguaucaugcaaagcaucaggauauacauuuacaggauacuauauacauuggguaagacaagcaccaggacaaggauuagaauggaugggauggauaaauccaaacucaggagcaacaaauuacgcacaaaaauuucaaggaagauuaacaauagcaagagauacaucaauaucaacagcauacauggacuuaagaaauuuaagauucgaugacacagcaguauacuuuugcgcaagaaaaacagcaggagauguaaguggagauaacagaggauauuucuuugacuuauggggaagaggaaguagaguaauaguaucaagugcaagcacaaaaggaccaucaguauuuccacaugacuuaaga

SEQ ID NO: 49456 - RNA, 414 nt, Artificial Sequence
  derived and/or modified sequence opt6 from anti-HIV-1_HeavyChain
caagcacaucuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagugcaaguacaaaaggaccaaguguauuucaugauuuaaga

SEQ ID NO: 49457 - RNA, 414 nt, Artificial Sequence
  derived and/or modified sequence opt6 from anti-HIV-1_HeavyChain
caagcaacauuagaacaaaguggaaguggaguaaaaaaaccaggagcaaguguaagaguaaguuguuggucaagcgaagauauauuuaaaacagaauuaauacauuggguaagacaagcaccaggacaaggauuagaauggauaggauggguaaaagcaguaaguggagcaguaaauuauggaucauuagauuuuagacauagaguaucauuaacaagagauagagauuuaucaacagcacauauggauauaagaggauuaacacaagaugacacagcaacacauuuuugugcaagacaaaaauuugcaagaggagaucaaggaugguuuuuugauuuauggggaagaggaacacuaauaguaguaaguucagcaucaacaaaaggaccaaguguauuuccaacaauauaugua

SEQ ID NO: 49458 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaucauguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugcaagcacaaaaggaccaaguguauuuccaacaauaugugua

SEQ ID NO: 49459 - RNA, 414 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagugcaaguccaagagcacauagaagcaguccaagaagugca

SEQ ID NO: 49460 - RNA, 414 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuuaaaagugaauuaauacauuggguaagacaagcaccaggacaaggauuagaauggauagguuggguaaaaacaguaacaggagcaguaaauuuuggaucaagugauuuuagacaaagaguaucauuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguucagcaucaacaaaaggaccaaguguauuuccaacaauaugugua

SEQ ID NO: 49461 - RNA, 414 nt, Artificial Sequence
  derived and/or modified sequence opt6 from anti-HIV-1_HeavyChain
caagcacauuuagaacaaaguggaccaggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagaucuauuuacagcacauauggauauaagaggauuaacacaagaugauacagcaauauauuuuugugcaagacaaaaauuugcaagaggagaucaaggaugguuuuuugauuuauggggaagaggaacauuaauaguaguaaguagugcaaguacaaaagcacacagaaguaguccaagaaguaca

SEQ ID NO: 49462 - RNA, 420 nt, Artificial Sequence
  derived and/or modified sequence opt6 from anti-HIV-1_HeavyChain
caaguacaauuaguacaaagcggagcugaaaugaaaaaaccaggagcaaguguaaaauuaagcuguaugacaaguggauauguauucacagacuuuuauauacacuggguaagacaagcaccaggacaaggacuagaauggaugggauggauaaauccaggaacaggaggaacaauaucagcaccaagauuucuaggaagaguaacauuaacuagagacacaaguauaagugcagcauauauagaaauaaauagaguaacaauagacgauacagcaacauauuucugugcaagacaaaaauuugcaagcagauacucaggagaucaaggaagcuauuuugauuuauggggaagaggaacacuaauaguaguaaguucagcaucaacaaaaggaccauuaggacuaccaccaagaagugca

SEQ ID NO: 49463 - RNA, 414 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaccagaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagugcaaguccaagagcacauagaaguaguccaagaagugca

SEQ ID NO: 49464 - RNA, 414 nt, Artificial Sequence
  derived and/or modified sequence opt6 from anti-HIV-1_HeavyChain
caagcacauuuggaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaccaguaacaggagcaguaaauuuagcaccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugacuuauggggaagaggaacacuaauaguaguaaguucagcaucaacaaaaggaccaagcguauuuccacaugauuuaaga

SEQ ID NO: 49465 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaagcaguuaguggagcaguaaauuauggaaguuuagauuuuagacauagaguaaguuuaacaagagauagagauuuaaguacagcacauauggauauaagaggacuaacacaagaugauacagcaacauauuuuugugcaagacaaaaauuugcaagaggagaucaaggaugguuuuuugauuuauggggaagaggaacacuaauaguaguaaguagugcaaguacaaaaggaccaaguguauuuccacaugauuuaaga

SEQ ID NO: 49466 - RNA, 414 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagugaagauauauuugaaagaagugaauuaauacauuggguaagacaagcaccaggacaaggauuggaauggauaggauggguaaaaacaguaacaggagcaguaaauuuuggaaguccaaauuuuagacaaagaguaaguuuaacaagagauagagauuuauuuacagcacauauggauauaagaggacuaacacaaggagauacggcaacauauuuuugugcaagacaaaaauuuuaugcaggaggacaaggaugguauuuugauuuauggggaagaggaacacuaauaguaguaaguagugcaagcacaaaagcacauagaaguaguccaagaagcaca

SEQ ID NO: 49467 - RNA, 414 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagugaagauauauuuaaaagugaauuaauacauuggguaagacaagcaccaggacaaggauuagaauggauaggauggguaaaaacuguaacaggagcaguaaauuuuggaucaagugauuuuagacaaagaguaucauuaacaagagauagagaucuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguucagcaucaacaaaaggaccaaguguauuuccaacaauaugugua

SEQ ID NO: 49468 - RNA, 414 nt, Artificial Sequence
  derived and/or modified sequence opt6 from anti-HIV-1_HeavyChain
caagcacauuuagaacaaagcgggaguggaguaaaaaaauuaggagcaaguguaagaguaaguuguuggacaagcgaagauauauuuaaaacagaauuaauacauuggguaagacaagcaccaggacaaggauuagaauggauaggauggguaaaagcaguaaguggagcaguaaauuauggaucauuagauuuuagacauagaguaucauuaacaagagauagagauuuaucaacagcacauauggauauaagaggauuaacacaagaugauacagcaacauauuuuugugcaagacaaaaauuugcaagaggagaucaaggaugguuuuuugauuuauggggaagaggaacauuaauaguaguaaguucagcaucaacaaaaggaccaaguguauuuccacaugauuuaaga

SEQ ID NO: 49469 - RNA, 417 nt, Artificial Sequence
  derived and/or modified sequence opt6 from anti-HIV-1_HeavyChain
caagcacauuuagaacaaucaggaaguggaguaaaaaaaccaggagcaucaguaagaguaucauguuggacaucagaagauauauuugaaaaaagcgaauuaauacauuggguaagacaagcaccaggacaaggauuagaauggauaggauggguaaaaacaguaacaggagcaguaaauuuuggaucaagugauuuuagacaaagaguaucauuaacaagagauagagauuuauuuacagcgcauauggauauaagaggacuaacacaaggagauacagcaacauauuuuugugcaagacaaaaauuuuaugcaggaggacaaggaugguauuuugauuuauggggaagaggaacauuaauaguaguaaguucagcaucaacaaaaggaccaaguguauuuccaacaauauaugua

SEQ ID NO: 49470 - RNA, 417 nt, Artificial Sequence
  derived and/or modified sequence opt6 from anti-HIV-1_HeavyChain
caagcacauuuagaacaaucaggaucaggaguaaaaaaaccagggacaucaguaagaguaucauguuggacaucagaagauauauuugaaagaacagaauuaauacauuggguaagacaagcaccaggacaaggauuagaauggauaggauggguaaaaacaguaacaggagcaguaaauuuuggaucaccaaauuuuagacauagaguaucauuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacacuaauaguaguaaguucagcaucaacaaaaggaccaaguguauuuccaacaauaugugua

SEQ ID NO: 49471 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagacauauuugaaaaaagugaauuaauacauuggguaagacaagcaccaggacaagggcuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagugcaaguacaaaaggaccaaguguauuuccacaaauauaugua

SEQ ID NO: 49472 - RNA, 417 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaaaaagugaauuaauacauuggguaagacaaacaccaggacaaggauuagaauggauaggauggguaaaaacaguaacaggagcaguaaauuuuggaaguagugauuuuagacaaagaguaagcuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagugcaaguacaaaaggaccaaguguauuuccaacaauauaugua

SEQ ID NO: 49473 - RNA, 417 nt, Artificial Sequence
  derived and/or modified sequence opt6 from anti-HIV-1_HeavyChain
caagcacaucuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaagcccaaauuuuagacaaagaguaagcuuaacaagagauagagauuuauuuacagcacauaugggaauaagaggauuaacacaaggagauacagcaacauauuuuugugcaagacaaaaauuugaaagaggaggacaaggauggauauuugauuuauggggaagaggaacauuaauagcaguaaguagugcaaguacaaaaggaccaagcguauuuccaacaauauaugua

SEQ ID NO: 49474 - RNA, 417 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaaguacaaaaggaccaaguguauuuccacaugauuuaaga

SEQ ID NO: 49475 - RNA, 417 nt, Artificial Sequence
  derived and/or modified sequence opt6 from anti-HIV-1_HeavyChain
caagcacaucuagaacaaagcggaaguggaguaaaaaaaccaggagcaaguguaagaguaaguuguuggacaagugaagauauauuugaaagaacagaauuaauacauuggguaagacaagcaccaggacaaggacuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaaggggaggacaaggauggauauuugauuuauggggaagaggaacauuaauagcagugaguagugcaaguacaaaaggaccaaguguauuuccaagaagugcagua

SEQ ID NO: 49476 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggaugaaaauaguaaguggagcaguaaauuuuggaaguccaaauuuuagacaaagaguaaguuuaacaagggauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagugcaagcacaaaaggaccaaguguauuuccacaugauuuaaga

SEQ ID NO: 49477 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaucagaagauauaagugaaggaagcgaauuaauacauuggguaagacaagcaccaggacaaggauuagaauggauaggauggguaaaaacaguaacaggagcaguaaauuuuggaagugcauauuuuagacauagagugaguuuaacaagagauagagauuuauuuacagcacauauggauauaagaggauuaacacaaggagauacagcaacauauuuuugugcaagacaaaaauuuuauaaaggaggacaaggaugguauuuugauuuauggggaagagggacauuaauaguaguaaguagcgcaaguacaaaaggaccaaguguauuuccaacaauaugugua

SEQ ID NO: 49478 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaacaggagcaguaaauuauggaaguuuagauuuuagacauagaguaaguuuaacaagagauagagaucuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaagcagcgcaaguacaaaaggaccaaguguauuuccacaugauuuaaga

SEQ ID NO: 49479 - RNA, 417 nt, Artificial Sequence
  derived and/or modified sequence opt6 from anti-HIV-1_HeavyChain
caagcacauuuagaacaaaguggaaguggagugaaaaaaccaggagcaaguguaagaguaagcuguuggaguagugaagauauauuugaaagaacagaauuaauacauuggguaagacaagcaccaggacaaggauuagaauggauuggauggguaaaaauaguuaguggagcaguaaauuuuggaaguccaaauuuuagacaaagaguaagcuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguucagcaaguacaaaaggaccaaguguauuuccaacaauauaugua

SEQ ID NO: 49480 - RNA, 417 nt, Artificial Sequence
  derived and/or modified sequence opt6 from anti-HIV-1_HeavyChain
caagcacauuuagaacaaaguggaaguggaguaaaaagaccgggagcaaguguaagaguaaguuguuggacaagugaagauauauuugaaacaacagaauuaauacauuggguaagacaagcaccaggacaaggacuagaauggauaggauggguaaaaacaguaaguggagcaguaaauuuuggaucauuaaauuuuagacauagaguaaguuuaacaagagauagagauuuauuuacagcacauauggauauaaggggauuaacacaaggagauacagcaacauauuuuugugcaagacaaaaauuugcaagaggagaucaaggaugguuuuuugauuuauggggaagaggaacauuaauaguaguaaguagugcaaguacaaaaggaccaaguguauuuccaacaauaugugua

SEQ ID NO: 49481 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuaggaaguccaaauuuuagacauagaguaagucuaacgagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagcgcaaguacaaaaggaccaaguguauuuccacaugauuuaaga

SEQ ID NO: 49482 - RNA, 417 nt, Artificial Sequence
  derived and/or modified sequence opt6 from anti-HIV-1_HeavyChain
caagcacauuuagaacaaaguggaaguggaguaaaaaaauuaggagcaaguguaagaguaagcuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggacuaacacaagaugauacagcaacauauuuuugugcaagacaaaaauuugaaagaggaggacaaggauggauauuugauuuauggggaagaggaacauuaauagcaguaaguagugcaaguacaaaaggaccaaguguauuuccaacaauaugugua

SEQ ID NO: 49483 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagacauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugcaagcacaaaaggaccaagcguuuuuccacaugauuuagua

SEQ ID NO: 49484 - RNA, 417 nt, Artificial Sequence
  derived and/or modified sequence opt6 from anti-HIV-1_HeavyChain
caagcacaucuagaacaaagcggaaguggaguaaaaaaaccaggagcaaguguaagaguaaguuguuggaguagugaagauauauuugaaagaacagaauuaauacauuggguaagacaagcaccaggacaaggacuagaauggauaggauggguaaaagcaguaaguggagcaguaaauuauggaagcuuagauuuuagacacagaguaaguuuaacaagagauagagauuuauuuacagcacauauggauauaagaggauuaacacaagaugauacagcaacauauuuuugugcaagacaaaaauuugcaagaggagaucaagggugguuuuuugauuuauggggaagaggaacauuaauaguaguaaguagugcaaguacaaaaggaccaaguguauuuccaacaauauaugua

SEQ ID NO: 49485 - RNA, 420 nt, Artificial Sequence
  derived and/or modified sequence opt6 from anti-HIV-1_HeavyChain
caaguacauuuagaacaaaguggaaguggaguaaaaaaaccaggagcaccaguaagaguaaguuguuggaguagugaagauauauuugaaagaacagaauuaauacauuggguaagacaagcaccaggacaaggauuagaauggauaggauggguaaaaacagugacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagugcaaguacaaaagcacauagcguacuaccaccaagaaguagagua

SEQ ID NO: 49486 - RNA, 417 nt, Artificial Sequence
  derived and/or modified sequence opt6 from anti-HIV-1_HeavyChain
caagcacauuuagaacaaaguggaaguggaguaaaaaaaccaggagcauuaguaagaguaaguuguuggacaagugaagauauauuugaaaaaagugaauuaauacauuggguaagacaagcaccaggacaaggauuagaauggauaggaugggugaaaacaguaacaggagcaguaaauuuuggaucaagugauuuuagacaaagaguaaguuuaacaagagauagagaucuauuuacagcacauauggacauaagaggauuaacacaaggagauacagcaacauauuuuugugcaagacaaaaauuuuaugcaggaggacaagggugguauuuugauuuauggggaagaggaacauuaauaguaguaaguagugcaaguacaaaaggaccaaguguauuuccacaugauuuaaga

SEQ ID NO: 49487 - RNA, 414 nt, Artificial Sequence
  derived and/or modified sequence opt6 from anti-HIV-1_HeavyChain
caaguacaauuaguacaaaguggagcagaaguaaaaaaaccaggagcaaguguaaaaguaaguugucaaguaaguggauauacauuaacagaauuaaguaugcauuggguaagacaagcaccaggacaaggauuagaauggauaggauggguaaaaacaguaacaggagcaguaaauuuuggaucaccaaauuuuagacauagaguaucauuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguucagcaucaacaaaaggaccaagcguauuuccacaugauuuaaga

SEQ ID NO: 49488 - RNA, 414 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuuaaaacagaauuaauacauuggguaagacaagcaccaggacaaggauuagaauggauaggauggguaaaaauaguaaguggagcaguaaauuuuggaagcccaaauuuuagacaaagaguaucauuaacaagagauagagauuuauuuacagcacauauggauauaagaggacuaacacaaggagauacagcaacauauuuuugugcaagacaaaaauuugaaagaggaggacaaggauggauauuugauuuauggggaagaggaacauuaauagcaguaagcucagcaucaacaaaaggaccaaguguauuuccacaugauuuaaga

SEQ ID NO: 49489 - RNA, 417 nt, Artificial Sequence
  derived and/or modified sequence opt6 from anti-HIV-1_HeavyChain
caagcacauuuagaacaaaguggaaguggaguaaaaaaacuaggagcaaguguaagaguaagcuguuggacaagugaagauauauuugaaagaacagaacuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaaguacaaaaggaccaaguguauuuccaacaauaugugua

SEQ ID NO: 49490 - RNA, 417 nt, Artificial Sequence
  derived and/or modified sequence opt6 from anti-HIV-1_HeavyChain
caagcacauuuagaacaaucaggaucaggaguaaaaaaaccaggagcaucaguaagaguaaguuguuggacaucagaagauauauuugaaaaaagugaauuaauacauuggguaagacaagcaccaggacaagggcuagaauggguaggauggguaaaaacaguaacaggagcaguaaauuuuggaucaagugauuuuagacaaagaguaucauuaacaagagauagagaucuauuuacagcacauauggauauaagaggacuaacacaaggagauacagcaacauauuuuugugcaagacaaaaauuuuaugcaggaggacaagggugguauuuugaucuauggggaagaggaacauuaauaguaguaaguucagcaucaacaaaaggaccaaguguauuuccacaugauuuaaga

SEQ ID NO: 49491 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuugaaagaggagggcaaggaugguauuuugaucuauggggaaggggaacauuaauaguaguaaguagugcaucaacaaaaggaccaaguguauuuccaacaauaugugua

SEQ ID NO: 49492 - RNA, 417 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaaguacaaaaggaccaaguguauuuccacaaauaugugua

SEQ ID NO: 49493 - RNA, 414 nt, Artificial Sequence
  derived and/or modified sequence opt6 from anti-HIV-1_HeavyChain
caagcacauuuagaacaaaguggaagugggguaaaaaaaccaggugcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggacaucaaauaucagauagaguaucauuaacaccagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguucagcaucaacaaaaggaccaaguguauuuccaacaauaugugua

SEQ ID NO: 49494 - RNA, 417 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaaaaagugaauuaauacauuggguaaggagagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagugcaaguacaaaagcacauagaaguaguccaacaauaugugua

SEQ ID NO: 49495 - RNA, 417 nt, Artificial Sequence
  derived and/or modified sequence opt6 from anti-HIV-1_HeavyChain
caagcacaucuagaacaaaguggaaguggaguaaaaaaauuaggagcaaguguaagaguaaguuguuggacaagugaagauauauuugaaagaacagaauuaauacauuggguaagacaagcaccaggacaaggacuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaccaacaaaaggaccaaguguauuuccaacaauaugugua

SEQ ID NO: 49496 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaucauguuggacaagugaagauauauuugaaagaacagaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuaugggguagaggaacauuaauaguaguaaguagugcaaguacaaaaggaccaaguguauuuccacaaauauaugua

SEQ ID NO: 49497 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaaaaagugaauuaauacauuggguaagacaagcaccaggacaaggauuagaauggauaggauggguaaaaacaguaacaggagcaguaaauuuuggaaguagcgauuuuagacaaagaguaagcuuaacaagaggaagagauuuauuuacagcacauauggacauaagaggacuaacacaaggagauacagcaacauauuuuugugcaagacaaaaauuuuaugcaggaggacaaggaugguauuuugauuuauggggaagaggaacauuaauaguaguaaguagugcaaguacaaaaggaccaaguguauuuccaacaauaugugua

SEQ ID NO: 49498 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaaguacaaaaggaccaaguguguuuccacaugaucaugua

SEQ ID NO: 49499 - RNA, 417 nt, Artificial Sequence
  derived and/or modified sequence opt6 from anti-HIV-1_HeavyChain
caagcacaucuagaacaaaguggaagcggaguaaaaaaaccaggagcaaguguaagaguaaguuguuggacaagcgaagauauauucgaaagaacagaauuaauacauuggguaagacaagcaccaggacaaggacuagaauggauaggauggguaaaaacaguaacaggagcaguaaauuuuggaagcccaaauuuuagacauagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagugcaaguacaaaagggccaaguguauuuccacaaauaugugua

SEQ ID NO: 49500 - RNA, 417 nt, Artificial Sequence
  derived and/or modified sequence opt6 from anti-HIV-1_HeavyChain
caagcacaucuagaacaaaguggaaguggaguaaaaaaaccaggagcaagcguaagaguaaguuguuggacaagugaagauauauuugaaagaacagaauuaauacauuggguaagacaagcaccgggacaaggauuagaauggauaggauggguaaaaauaguaaguggagcaguaaauuuuggaaguccaaauuuuagacaaagaguaagcuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauaguaguaaguagugcaaguacaaaaggaccaaguguauuuccaacaauaugugua

SEQ ID NO: 49501 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguugggcaagugaagauauauuugaaagaacagaauuaauacauuggguaagacaagcaccaggacaaggacuagaauggauaggauggguaaaaacaguaacaggagcaguaaauuuuggaaguccaaauuuuagacauagaguaaguuuaacaagagauagagauuuauuuacagcgcauauggauauaagaggauuaacacaaggagauacagcaacauauuuuugugcaagacaaaaauuuuaugcaggaggacaaggaugguauuuugauuuauggggaagaggaacacuaauaguaguaaguagugcaaguacaaaaggaccaaguguauuuccacaugauuuauua

SEQ ID NO: 49502 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauacuuuugugcaagacaaaaauuugaaagaggaggacaaggauggauauuugauuuauggggaagaggaacauuaauagcaguaagcagugcaaguacaaaaggaccaagcguauuuccacaugauuuaaga

SEQ ID NO: 49503 - RNA, 417 nt, Artificial Sequence
  derived and/or modified sequence opt6 from anti-HIV-1_HeavyChain
caagcacauuuagaacaaaguggaagcggaguaaaaaaaccaggagcaaguguaagagugaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaaguacaaaaggaccaucaguauuuccacaugauuuaaga

SEQ ID NO: 49504 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaagugaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauauuaugcaggaggacaaggaugguauuuugauuuauggggaagaggaacauuaauaguaguaaguucagcaagcacaaaaggaccaaguguauucccaacaauauguaga

SEQ ID NO: 49505 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaucagaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggacuaacacaaggagauacagcaacauauuuuugugcaagacaaaaauuugaaagaggaggacaaggaugguauuuugaucuauggggaagaggaacauuaauaguaguaaguagugcaaguacaaaaggaccaaguguauuuccacaugauuuaaga

SEQ ID NO: 49506 - RNA, 417 nt, Artificial Sequence
  derived and/or modified sequence opt6 from anti-HIV-1_HeavyChain
caagcacauuuagaacaaaguggaaguggaguaaaaaaacuaggagcaaguguaagaguaagcuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaagcuuaacaagggauagagauuuauuuacagcacauauggauauaagaggauuaacacaagaugauacagcaacauauuuuugugcaagacaaaaauuugcaagaggagaucaaggaugguuuuuugauuuaugggggaggggaacauuaauaguaguaaguagugcaaguacaaaaggaccaucaguauuuccaacaauauaugua

SEQ ID NO: 49507 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaucauguuggacaucagaagauauauuugaaaaaagugaauuaauacauuggguaagacaagcaccaggacaaggauuagaauggauaggauggguaaaaacaguaacaggagcaguaaauuuuggaucaagugauuuuagacaaagaguaaguuuaacaagagauagagauuuauuuacagcacauauggauauaagaggauuaacacaaggagauacagcaacguauuuuugugcaagacaaaaauuuuauaaaggaggacaaggaugguauuuugauuuauggggaagaggaacauuaauaguaguaucaagugcaagcacaaaaggaccaaguguauuuccacaugaucuaaga

SEQ ID NO: 49508 - RNA, 417 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggaacaguaaauuuuggaaguuuaaauuuuagacaaagaguaaguuuaacaagagauagagaccuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaaguacaaaaggaccaaguguauuuccacaugauuuaaga

SEQ ID NO: 49509 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggccaagugaagauauauuugaaaaaagcgaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcgcauauggauauaagaggauuaacacaaggagauacagcaacauauuuuugugcaagacaaaaauuugaaagaggaggacaaggauggauauuugauuuauggggaagaggaacauuaauagcaguaaguagugcaaguacaaaaggaccaaguguauuuccacaugauuuaaga

SEQ ID NO: 49510 - RNA, 417 nt, Artificial Sequence
  derived and/or modified sequence opt6 from anti-HIV-1_HeavyChain
caagcacaucuagaacaaaguggaaguggagugaaaagaccaggagcaaguguaagaguaagcuguuggacaagugaagauauauuugaaacaacagaauuaauacauuggguaagacaagcaccaggacaaggauuagaauggauaggauggguaaaaacaguaaguggagcaguaaauuuuggaaguuuaaauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguucagcaucaacaaaaggaccaaguguauuuccacaugauuuaagg

SEQ ID NO: 49511 - RNA, 417 nt, Artificial Sequence
  derived and/or modified sequence opt6 from anti-HIV-1_HeavyChain
caagcacauuuagaacaaaguggaaguggaguagaaaaaccaggagcaaguguaagaguaaguuguuggacgagugaagauauauuugaaagaagugaauuaauacauuggguaagacaagcaccaggacaaggauuagaauggauaggauggguaaaaacagugacaggagcaguaaauuucggaaguccaaauuuuagacauagaguaaguuuaacaagagauagagauuuauuuacagcacauauggauauaagaggauuaacacaaggagauacagcaacauauuuuugugcaagacaaaaauauuaugcaggaggacaaggaugguauuuugauuuauggggaagaggaacauuaauaguaguaaguagugcaaguacaaaaggaccaaguguauuuccacaugauuuaaga

SEQ ID NO: 49512 - RNA, 417 nt, Artificial Sequence
  derived and/or modified sequence opt6 from anti-HIV-1_HeavyChain
caagcgcauuuagaacaaaguggaaguggaguaaaaaaaccaggagcaaguguaagaguaaguuguuggacaagugaagauauauuugaaagaacggaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagcgcaaguacaaaaggaccaaguguauuuccacaugauuuaaga

SEQ ID NO: 49513 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaagcccaaauuuuagacauagaguaaguuuaacaagagacagaaauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugcaagcacaaaaggaccaaguguauuuccacaugauuuaaga

SEQ ID NO: 49514 - RNA, 417 nt, Artificial Sequence
  derived and/or modified sequence opt6 from anti-HIV-1_HeavyChain
caagcacauuuagaacaaaguggaaguggaguaaaaaaaccaggggcaaguguaagaguaagcuguuggacaucagaagauauauuugaaagaacagaauuaauacauuggguaagacaagcaccaggacaaggauuagaauggauaggauggguaaaaauaguaaguggagcaguaaauuuuggaaguccaaauuuuagacaaagaguaagucuaacaagagauagagauuuauuuacagcacauauggauauaagaggacuaacacaaggagauacagcaacauauuuuugugcaagacaaaaauuuuaugcaggaggacaaggaugguauuuugauuuauggggaagaggaacauuaauaguaguaagcagugcaucaacaaaaggaccaaguguauuuccacaugauuuaaga

SEQ ID NO: 49515 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaagaacagaauuaauacauuggguaagacaagcaccaggacaaggacuagaauggauaggauggguaaaaacaguaacaggagcaguaaauuauggaaguuuaaauuuuagaaguagaauaaguuuaacaagagauagagaucuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagugcaaguacaaaaggaccaaguguauuuccacaugauuuaaga

SEQ ID NO: 49516 - RNA, 417 nt, Artificial Sequence
  derived and/or modified sequence opt6 from anti-HIV-1_HeavyChain
caaagucauuuagaacaaucaggaagcgcaaugaaaaaaccuggagcaucaguaagaguaucauguuggacaucagaagauauauuugauacaacagaauuaauauauuggguaagacaagcaccaggacaaggauuagaauggauaggauggguaaaaauaguaaguggaacaguaaacuuugcaucauuagauuuuagaaauagaauaaguuuaucaagagauagagauuuaaguacagcacauauggauauaagaggauuaacacaaggagauacagcaacauauuuuugugcaagacaaaaauuuuaugcaggaggacaaggaugguauuuugauuuauggggaagaggaacauuaauaguaguaaguucagcaucaacaaaaggaccaaguguauuuccacaugauuuaaga

SEQ ID NO: 49517 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaauagaacuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugcaagcacaaaaggaccaaguguauuuccacaugaucuaaga

SEQ ID NO: 49518 - RNA, 417 nt, Artificial Sequence
  derived and/or modified sequence opt6 from anti-HIV-1_HeavyChain
caagcacauuuagaacaaaguggaaguggaguaaaaaaauuaggagcaagcguaagaguaaguuguuggacaagcgaagauauauuugaaagaacagaauuaauacauuggguaagacaagcaccaggacaaggauuagaauggauaggauggguaaaagcaguaaguggagcaguaaauuauggaaguuuagauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguucagcaaguacaaaaggaccaaguguauuuccacaugauuuaaga

SEQ ID NO: 49519 - RNA, 417 nt, Artificial Sequence
  derived and/or modified sequence opt6 from anti-HIV-1_HeavyChain
caagcacauuuagaacaaaguggaagcggaguaaaaaaaccaggagcaagcguaagaguaaguuguuggaguagugaagauauauuugaaagagcagaauuaauacauuggguaagacaagcaccaggacaaggauuagaauggauaggauggguaaaaacaguaacaggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagugcaaguacaaaaggaccaaguguauuuccacaugauuuaaga

SEQ ID NO: 49520 - RNA, 417 nt, Artificial Sequence
  derived and/or modified sequence opt6 from anti-HIV-1_HeavyChain
caagcacauuuagaacaaagcggaaguggaguaaaaaaaccaggagcaaguguaagaguaagcuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaaguacaaaaggaccaaguguauuuccgcaugauuuaaga

SEQ ID NO: 49521 - RNA, 417 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaagcuuagauuuuagaaauagaauaaguuuaaguagagauagagauuuaaguacagcacauauggauauaagaggacuaacacaagaugauacagcaacauauuuuugugcaaggcaaaaauuugaaagaggaggacaaggaugguauuuugauuuauggggaagaggaacauuaauaguaguaaguagugcaaguacaaaaggaccaaguguauuuccacaugauuuaaga

SEQ ID NO: 49522 - RNA, 417 nt, Artificial Sequence
  derived and/or modified sequence opt6 from anti-HIV-1_HeavyChain
caagcacauuuagaacaaucaggaucaggaguaaaaaaaccaggagcaucaguaagaguaucauguuggaguucagaagauauauuugaaagaacagaauuaauacauuggguaagacaagcaccaggacaaggacuagaauggauaggauggguaaaaacaguaacaggagcaguaaauuuuggaucacuagauuuuagacauagaauaucauuaacaagagauagagauuuauuuacagcacauauggauauaagaggacuaacacaaggagauacagcaacauauuuuugugcaagacaaaaauuuuaugcaggaggacaaggaugguauuuugauuuauggggaagaggaacauuaauaguaguaaguucagcaucaacaaaaggaccaagcguauuuccacaugauuuaaga

SEQ ID NO: 49523 - RNA, 417 nt, Artificial Sequence
  derived and/or modified sequence opt6 from anti-HIV-1_HeavyChain
caagcacauuuagaacaaucaggaucaggaguaaaaaaaccaggagcaucaguaagaguaagcuguuggacaagcgaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggacauaagaggauuaacacaagaugauacagcaauauauuuuugugcaagacaaaaauuugcaagaggagaucaaggaugguuuuuugauuuauggggaagaggaacauuaauaguaguaaguagugcaaguacaaaaggaccaaguguauuuccgcaugauuuaaga

SEQ ID NO: 49524 - RNA, 417 nt, Artificial Sequence
  derived and/or modified sequence opt6 from anti-HIV-1_HeavyChain
caagcacauuuagaacaaaguggaaguggaguaaaaggaccaggagcaaguguaagaguaaguuguuggacaagugaagauauauuugaaacaacagaauuaauacauuggguaagacaagcaccaggacaaggauuagaauggauaggauggguaaaaacaguaaguggagcaguaaauuuuggaaguuuaaauuuuagacauagaguaucauuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacacuaauaguaguaaguagugcaaguacaaaaggaccaaguguauuuccacacgauuuaaga

SEQ ID NO: 49525 - RNA, 417 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagugaagauauauuugaaggaagugaauuaauacauuggguaagacaagcaccaggacaaggauuagaauggauaggguggguaaaaacaguaacaggagcaguaaauuuuggaagugcauauuuuagacauagaguaccauuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaaguagugcaaguacaaaaggaccaaguguauuuccacaugauuuaaga

SEQ ID NO: 49526 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaagaacagaauuaauacauuggguaagacaagcaccagggcaaggacuagaauggauaggauggguaaaaacaguaacaggagcaguaaauuuuggaagcccgaauuuuagacauagaguaagcuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugcaaguacaaaaggaccaaguguauuuccacaugauuuaaga

SEQ ID NO: 49527 - RNA, 417 nt, Artificial Sequence
  derived and/or modified sequence opt6 from anti-HIV-1_HeavyChain
caagcacauuuagaacaaaguggaaguggaguaaaaaaaguaggagcaaguguaagaguaaguuguuggacaagcgaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguagugaguagugcaaguacaaaaggaccaaguguauuuccacaugauuuaaga

SEQ ID NO: 49528 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuaggcauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaucaacaaaaggaccaaguguauuuccacaugauuuaaga

SEQ ID NO: 49529 - RNA, 417 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugaaagaacagaauuaauauauuggguaagacaagcaccaggaagaggauuagaauggauaggauggguaaaaacaguaaguggaacaguaaauuuuggaagcagugauuuuagaaauagaauaagucuaacaagagauagagauuuaaguacagcacauauggauauaagaggguuaacacaagaugauacagcaacauauuuuugugcaagacaaaaauuugcaagaggagaucaaggaugguuuuuugauuuauggggaagaggaacauuaauaguaguaaguagugcaaguacaaaaggaccaagcguauuuccacaugauuuaaga

SEQ ID NO: 49530 - RNA, 417 nt, Artificial Sequence
  derived and/or modified sequence opt6 from anti-HIV-1_HeavyChain
caagcacauuuagaacaaagugaaaguggaguaaaaaaauuaggagcaaguguaagaguaagcuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagaucuauuuacagcacauauggauauaagaggauuaacacaagaugauacagcaacauauuuuugugcaagacaaaaauuugcaagaggagaucaaggaugguuuuuugaucuauggggaagaggaacauuaauaguaguaaguagugcaaguacaaaaggaccaaguguauuuccacaugauuuaaga

SEQ ID NO: 49531 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagcgcaaguacaaaaggaccaaguguauuuccaacaacauuaaga

SEQ ID NO: 49532 - RNA, 417 nt, Artificial Sequence
  derived and/or modified sequence opt6 from anti-HIV-1_HeavyChain
caagcacauuuagaacaaaguggaagcggaguaaaaaaaguaggagcaaguguaagaguaagcuguuggacaagugaagauauauuugaaagaacagaauuaauacauuggguaagacaagcaccaggacaaggauuagaauggauaggauggguaaaaacaguaacaggagcaguaaauuuuggaaguagugauuuuagacaaagaguaaguuuaacaagagauagagaucuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagugcgaguacaaaaggaccaaguguauuuccacaugauuuaaga

SEQ ID NO: 49533 - RNA, 420 nt, Artificial Sequence
  derived and/or modified sequence opt6 from anti-HIV-1_HeavyChain
caagcaagaccaggagcaaauagaggaucaggaguaaaaaaaccaggagcaucaguaagaguaaguuguuggacaucagaagauauauuugaaagaacagaauuaauacauuggguaagacaagcaccaggacaaggauuagaauggauaggauggguaaaaauaguaaguggagcaguaaauuuuggaucaccaaauuuuagacaaagaguaucauuaacaagagauagagauuuauuuacagcacauauggauauaagaggauuaacacaaggagauacagcaacauauuuuugugcaagacaaaaauuugaaaggggaggacaaggauggauauuugauuuauggggaagaggaacauuaauagccguaaguucagcaucaacaaaaggaccaucaguauuuccacaugauuuaaga

SEQ ID NO: 49534 - RNA, 417 nt, Artificial Sequence
  derived and/or modified sequence opt6 from anti-HIV-1_HeavyChain
caagcacaucuagaacaaagcggaaguggaguaaaaaaaccaggagcaaguguaagaguaaguuguuggacaagugaagauauauuugaaagaagugaauuaauacauuggguaagacaagcaccaggacaaggauuagaauggauaggauggguaaaaacaguaacaggagcaguaaauuuuggaaguccaaauuuuagacauagaguaagccuaacaagagauagagauuuauuuacagcacauauggauauaagaggacuaacacaaggagauacagcaacauauuuuugugcaagacaaaaauauuaugcagguggacaaggaugguauuuugauuuauggggaagaggaacauuaauaguaguaaguagugcaaguacaaaaggaccaaguguauuuccacaugauuuaaga

SEQ ID NO: 49535 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaggaagugaauuaauacauuggguaagacaagcaccaggacaaggauuagaauggauaggauggguaaaaacaguaacaggagcaguaaauuuuggaagugcauauuuuagacauagaguaaguuuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaaguagugcaagcacaaaaggaccaaguguguuuccacaugauuuaaga

SEQ ID NO: 49536 - RNA, 417 nt, Artificial Sequence
  derived and/or modified sequence opt6 from anti-HIV-1_HeavyChain
caagcacauuuagaacaaaguggaaguggaguaaaaaaauuaggagcaucaguaagaguaagcuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacacuaauaguaguaaguagcgcaaguacaaaaggaccaaguguauuaccaccaagaagugca

SEQ ID NO: 49537 - RNA, 417 nt, Artificial Sequence
  derived and/or modified sequence opt6 from anti-HIV-1_HeavyChain
caagcacaucuagaacaaucaggaucaggaaugaaaaaaccaggagcaucaguaagaguaucauguuggaguagugaagauauauuugaaagaacagaauuaauacauuggguaagacaagcaccaggacaaggauuagaauggauaggauggguaaaaacaguaacaggagcaguaaauuuuggaucaagugauuuuagacaaagaguaucauuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguucagcaucaacaaaaggaccaaguguauuuccacaugauuuaaga

SEQ ID NO: 49538 - RNA, 417 nt, Artificial Sequence
  derived and/or modified sequence opt6 from anti-HIV-1_HeavyChain
caagcacauuuagaacaaaguggaaguggaguaaaagaaccaggaacaaguguaagaguaagcuguuggacaagugaagauauauuugaaagaacagaauuaauacauuggguaagacaagcaccaggacaaggauuagaauggauaggauggguaaaaacaguaacgggagcaguaaauuuuggaaguccaaauuuuagacauagaguaaguuuaacaagagacagagaccuauuuacagcacauauggauauaagaggauuaacacaaggagauacagcaacauauuuuugugcaagacaaaaauuugaaagaggaggacaaggauggauauuugauuuaugggggagaggaacacuaauagcaguaaguagugcaagcacaaaaggaccaucaguauuuccacaaacauuaaga

SEQ ID NO: 49539 - RNA, 417 nt, Artificial Sequence
  derived and/or modified sequence opt6 from anti-HIV-1_HeavyChain
caaagucauuuagaacaaucaggaucagcaaugaaaaaaccaggagcaucaguaagaguaucauguuggacaagugaagauauauuugauacaacagaauuaauauauuggguaagacaagcaccaggacaaggauuagaauggauaggauggguaaaaauaguaaguggaacaguaaauuuugcaucauuagauuuuagacauagaguaucauuaacaagagauagagauuuaucaacagcacauauggauauaagagggcuaacacaagaugauacagcaacauauuuuugugcaagacaaaaauuugcaagaggagaucaaggaugguuuuuugauuuauggggaagaggaacacuaauaguaguaaguucagcuucaacaaaaggaccaaguguauuuccacaugauuuaaga

SEQ ID NO: 49540 - RNA, 417 nt, Artificial Sequence
  derived and/or modified sequence opt6 from anti-HIV-1_HeavyChain
caagcacauuuagaacaaaguggaagcggaguaaaaaaaccaggagcaaguguaagagugaguuguuggacaagugaagauauauuugaaacaacagaauuaauacauuggguaagacaagcaccaggacaaggauuagaauggauaggauggguaaaaacaguaaguggagcaguaaauuuuggaaguuuaaauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagcgcaaguacaaaaggaccaaguguauuuccacaugauuuaaga

SEQ ID NO: 49541 - RNA, 417 nt, Artificial Sequence
  derived and/or modified sequence opt6 from anti-HIV-1_HeavyChain
caagcacauuuagaacaaaguggaaguggaguaaaaaaaguaggagcaucaguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagacagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagcgcaaguacaaaaggaccaaguguauuuccacaugaucuaaga

SEQ ID NO: 49542 - RNA, 417 nt, Artificial Sequence
  derived and/or modified sequence opt6 from anti-HIV-1_HeavyChain
caggcacauuuagaacaaaguggagcaggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaagcuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacacuaauaguaguaaguagcgcaagcacaaaaggaccaaguguauuuccacaugauuuaaga

SEQ ID NO: 49543 - RNA, 417 nt, Artificial Sequence
  derived and/or modified sequence opt6 from anti-HIV-1_HeavyChain
caagcacauuuagaacaaaguggaaguggaguaaaaaaaccaggggcaaguguaagaguaaguuguuggacaagugaagauauauuugaaagaacagaauuaauacauuggguaagacaagcaccaggacaaggacuagaauggauaggauggguaaaaacaguaacaggagcaguaaauuacggaaguuuaaauuuuagaaguagaauaaguuuaacaagagauagagauuuauuuacagcacauauggauauaagaggauuaacagaaggagauacagcaacauauuuuugugcaagacaaaaauuuuaugcagggggacaaggaugguauuuugauuuauggggaagaggaacauuaauaguaguaaguagugcaaguacaaaaggaccaaguguauuuccacaugauuuaaga

SEQ ID NO: 49544 - RNA, 417 nt, Artificial Sequence
  derived and/or modified sequence opt6 from anti-HIV-1_HeavyChain
caagcacauuuagaacaaaguggaagcggaguaaaaaaaccaggagcaagcguaagaguaagcuguuuagcaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagacagagacuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagcgcaagcacaaaaggaccaaguguauuuccacaugaucuaaga

SEQ ID NO: 49545 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcagugaauuuuggaaguuuagauuuuagacauaggauaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagugcaaguacaaaaggaccaaguguauuuccacaugauuuaaga

SEQ ID NO: 49546 - RNA, 417 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcaccaggacaaggauuagaauggauaggaugggugaaaacaguaacaggagcaguaaauuuuggaaguccaaauuuuagacaaagaguaagcuuaacaagagacagagauuuauuuacagcacauauggauauaagaggacuaacacaaggagauacagcaacauauuuuugugcaagacaaaaauuugaaagaggaggacaaggaugguauuuugauuuauggggaagaggaacauuaauaguaguaaguagugcaaguacaaaaggaccaaguguauuuccacaugauuuaaga

SEQ ID NO: 49547 - RNA, 417 nt, Artificial Sequence
  derived and/or modified sequence opt6 from anti-HIV-1_HeavyChain
caaguacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaacuuuagacauagaguaagcuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugcaaguacaaaaggaccaaguguauuuccacaugauuuaaga

SEQ ID NO: 49548 - RNA, 417 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagugaagauauauuugaaagaacggaauuaauacauuggguaagacaagcaccaggacaaggacuagaauggauaggaugggugaaaacaguaaguggagcaguaaauuuuggaaguccaaauuuuagacaaagaguaaguuuaacaagagauagagauuuauuuacagcacauauggauauaagaggauuaacacaaggagauacagcaacauauuuaugugcaagacaaaaauuugaaagaggaggacaaggauggauauuugauuuauggggaaggggaacauuaauagcaguaagcagugcaaguacaaaaggaccaaguguauuuccacaugauuuaaga

SEQ ID NO: 49549 - RNA, 417 nt, Artificial Sequence
  derived and/or modified sequence opt6 from anti-HIV-1_HeavyChain
caaagucauuuagaacaaucaggaucagcaaugaaaaaaccaggagcaaguguaagaguaaguuguuggacaucagaagauauauuugaaaggacagaacuaauauauuggguaagacaagcaccaggaagaggauuagaauggauaggauggguaaaaacaguaagcggaacaguaaauuuuggaaguagugauuuuagacauagaguaaguuuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaaguucagcaaguacaaaaggaccaaguguguuuccacaugauuuaaga

SEQ ID NO: 49550 - RNA, 417 nt, Artificial Sequence
  derived and/or modified sequence opt6 from anti-HIV-1_HeavyChain
caagcacauuuagaacaaucaggaucaggaguaaaaaaaccaggagcaucaguaagaguaucauguuggacaagugaagauauauuugaaaaaagugaauuaauacauuggguaagacaagcaccaggacaaggauuagaauggauaggauggguaaaaacaguaacaggagcaguaaauuuuggaucaagugauuuuagacaaagaguaucauuaacaccagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguucagcaucaacaaaaggaucaaguguauuuccacaugauuuaaga

SEQ ID NO: 49551 - RNA, 417 nt, Artificial Sequence
  derived and/or modified sequence opt6 from anti-HIV-1_HeavyChain
caagcacauuuagaacaaucaggaucaggaguaaaaaaaccaggagcaucaguaagaguaucauguuggacaucagaagauauauuugaaaaaagugaauuaauacauuggguaagacaagcaccaggacaaggauuagaauggauaggauggguaaaaacaguaacaggagcaguaaauuuuggaucaagugauuuuagacaaagaguaucauuaacaccagauagagaucuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguucagcaucaacaaaaggaccaaguguauuuccacaugauuuaaga

SEQ ID NO: 49552 - RNA, 417 nt, Artificial Sequence
  derived and/or modified sequence opt6 from anti-HIV-1_HeavyChain
caagcacauuuagaacaaaguggaaguggaguaaaaaaauuaggagcaaguguaagaguaagcuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagaucuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagcgcaaguacaaaaggaccaaguguauuuccacaugauuuaaga

SEQ ID NO: 49553 - RNA, 417 nt, Artificial Sequence
  derived and/or modified sequence opt6 from anti-HIV-1_HeavyChain
caaguacauuuagaacaaagcggaagcggaguaaaaaaauuaggagcaagcguaagaguaaguuguuggacaucagaagauauauuugaaagaacagaauuaauacauuggguaagacaagcaccaggacaaggauuagaauggauaggauggguaaaagcaguaagcggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacacuaauaguaguaaguucagcaaguacaaaaggaccaaguguauuuccacauagaaguaca

SEQ ID NO: 49554 - RNA, 420 nt, Artificial Sequence
  derived and/or modified sequence opt6 from anti-HIV-1_HeavyChain
caaguauauauggaacaagcaggagcaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguagugcaaguacaaaaggaccaaguguauuuacaauauaugua

SEQ ID NO: 49555 - RNA, 417 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagcgcaaguacaaaaggaccaaguguauuuccacaugauccagca

SEQ ID NO: 49556 - RNA, 417 nt, Artificial Sequence
  derived and/or modified sequence opt6 from anti-HIV-1_HeavyChain
caagcacauuuagaacaaucaggaaguggaguaaaaaaacuaggagcaaguguaagaguaaguuguuggacaagugaagauauauuugaaagaacagaauuaauacauuggguaagacaagcaccaggacaaggacuagaauggauaggauggguaaaagcaguaaguggagcaguaaauuauggaagcuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaaguacaaaaggaccaaguguauuaccaccaagaaguaca

SEQ ID NO: 49557 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggucaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaagcuuaacaagagauagagauuuauuuacagcacauauggauauaagaggacuaacacaagaugauacagcaacauauuuuugugcaagacaaaaauuugcaagaggagaucaaggaugguuuuuugauuuauggggaagaggaacauuaauaguaguaaguagugcaaguacaaaaggaccaaguguauuuccacaugauuuaaga

SEQ ID NO: 49558 - RNA, 417 nt, Artificial Sequence
  derived and/or modified sequence opt6 from anti-HIV-1_HeavyChain
caagcacauuuagaacaaaguggaagugaauggaaaaaauuaggagcaaguguaagaguaaguuguuggacaagcgaagauauauuugaaagaacagaauuaauacauuggguaagacaagcaccaggacaaggauuagaauggauaggauggguaaaagcaguaaguggagcaguaaauuauggaagcuuagauuuuagacauagaguaagcuuaacaagagauagagauuuaaguacagcacauauggauauaagaggauuaacacaagaugauacagcaacauauuuuugugcaagacaaaaauuugcaagaggagaucaaggaugguuuuuugaucuauggggaagaggaacauuaauaguaguaaguagugcaaguacaaaaggaccuaguguauuuccacaugauuuaaga

SEQ ID NO: 49559 - RNA, 417 nt, Artificial Sequence
  derived and/or modified sequence opt6 from anti-HIV-1_HeavyChain
caagcacaucuagaacaaaguggaucagaaguaaaaaaaccaggagcaucaguaagaguaucauguuggacaucagaagauauauuugaaaaaagcgaauuaauacauuggguaagacaagcaccuggacaaggacuagaauggauaggauggguaaaaacaguaacaggagcaguaaauuuuggaucaagugauuuuagacaaagaguaucauuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacacuaauaguaguaaguucagcaucaacaaaaggaccaaguguauuuccacaugauuuaaga

SEQ ID NO: 49560 - RNA, 417 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacgagcgaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagacagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaucaagugcaaguacaaaaggaccaaguguauuuccacaugauuuaaga

SEQ ID NO: 49561 - RNA, 417 nt, Artificial Sequence
  derived and/or modified sequence opt6 from anti-HIV-1_HeavyChain
caagcacaucuugaacaaaguggaaguggaguaaaaaaaccaggagcaaguguaagaguaaguuguuggacaagugaagauauauuaagaaaaagugaacuaauacauuggguaagacaagcaccaggacaaggacuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagugcaucaacaaaaggaccgaguguauuuccacaugauuuaaga

SEQ ID NO: 49562 - RNA, 417 nt, Artificial Sequence
  derived and/or modified sequence opt6 from anti-HIV-1_HeavyChain
caagcacauuuagaacaaagugcaagcggaguaaaaagaccaggagcaaguguaagaguaagcugucuagcaagugaagauauauuugaaagaagugaauuaauauauuggguaagacaagcaccaggacaaggauuagaauggauaggauggguaaaaauaguaaguggagcaguaaauuucggaaguccaaauuuuagacaaagaguaagucuaacaagagacagagacuuauuuacagcacauauggauauaagaggacuaacacaaggagauacagcaacauauuuuugugcaagacaaaaauuugaaagaggaggacaaggauggauauuugauuuauggggaagaggaacauuaauagcaguaaguagugcaaguacaaaaggaccaucaguauuuccacaugacuuaaga

SEQ ID NO: 49563 - RNA, 417 nt, Artificial Sequence
  derived and/or modified sequence opt6 from anti-HIV-1_HeavyChain
caagcacauuuagaacaaaguggaaguggaguaaaaagaccaggagcaucgguaagaguaaguuguuggacaagugaagauauauuugaaacaacagaauuaauacauuggguaagacaagcaccaggacaaggauuagaauggauaggauggguaaaaacaguaacaggagcaguaaauuuuggaagcgcauauuuuagacauagaguaaguuuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaagcagugcaaguacaaaaggaccaaguguauuuccacaugauuuaaga

SEQ ID NO: 49564 - RNA, 417 nt, Artificial Sequence
  derived and/or modified sequence opt6 from anti-HIV-1_HeavyChain
caagcacauuuagaacaaagugcaaguggaguaaaaagaccaggagcaaguguaagaguaaguuguuggacaagugaagauauauuugaaagaagugaauuaauauauuggguaagacaagcaccaggacaaggauuagaauggauaggauggguaaaaacaguaaguggagcaguaaauuuuggaaguacagauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugcaaguacaaaaggaccaaguguauuuccacaugauuuaaga

SEQ ID NO: 49565 - RNA, 417 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacgcaagaugauacagcaacauauuuuugugcaaggcaaaaauuugcaagaggagaucaaggaugguuuuuugauuuauggggaagaggaacauuaauaguaguaaguagugcaaguacaaaaggaccaaguggauuaccaccaagaagugca

SEQ ID NO: 49566 - RNA, 417 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaaguagagauagagauuuaaguacagcacauauggauauaagaggauuaacacaaggagauacagcaacauauuuuugugcaagacaaaaauuugaaagaggaggacaaggauggauauuugaucuauggggaagaggaacauuaauagcaguaaguagugcaaguacaaaaggaccaaguguauuuccauuaagaagugca

SEQ ID NO: 49567 - RNA, 423 nt, Artificial Sequence
  derived and/or modified sequence opt6 from anti-HIV-1_HeavyChain
caaguacaaauggaacaagcaggagcaggaaugaaaaaaccaggagcaaguaugacaguaagcuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagagcaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaucaagugcaaguacaaaaggaccaaguguauuuccacaugauuuaaga

SEQ ID NO: 49568 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagcgaagauauauuugaaagaacagaauuaauacauuggguaagacaagcaccaggacaaggauuagaauggauaggauggguaaaaacaguaacaggagcaguaaauuuuggaagcuuagauuuuagacauagaauaaguuuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacguuaauaguaguaaguagcgcaaguacaaaaggaccaaguguauuuccacaaauauguaga

SEQ ID NO: 49569 - RNA, 414 nt, Artificial Sequence
  derived and/or modified sequence opt6 from anti-HIV-1_HeavyChain
caagcacauuuagaacaaaguggagcaggaguaaaaaaaccaggagcaaguguaagaguaagcuguuggacaagcgaagauauauuugaaaaaucagaauuaauacauuggguaagacaagcaccaggacaaggauuagaauggauaggauggguaaaaacaguaacaggagcaguaaauuuaguacaucaaauaucagacagaguaucacuaacaagagauagagauuuaucaacagcacauauggacauaagaggacuaacacaagaugacacagcaacauauuuuugugcaagacaaaaauuugcaagaggagaucaaggaugguuuuucgauuuauggggaagaggaacauuaauaguaguaaguucagcaucaacaaaaggaccaagcguauuuccacaugauuuaaga

SEQ ID NO: 49570 - RNA, 420 nt, Artificial Sequence
  derived and/or modified sequence opt6 from anti-HIV-1_HeavyChain
caagcacauuuagaacaaaguggaagcggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaaguacaaaaggaccaagcggguuaccaccaagacuaugugua

SEQ ID NO: 49571 - RNA, 417 nt, Artificial Sequence
  derived and/or modified sequence opt6 from anti-HIV-1_HeavyChain
caagcaagauuagaacaaaguggaaguggaguaaaaaaaccaggagcaaguguaagaguaaguuguuggacaagugaagauauauuugaaggaagugaauuaauacauuggguaagacaagcaccaggacaaggauuagaauggauaggauggguaaaaacaguaacaggagcaguaaauuuuggaagugcauauuuuagacauagaguaaguuuaacaagagauagagauuuauuuacagcacauauggauauaagaggauuaacacaaggagauacagcaacauauuuuugcgcaagacaaaaauuugcaagaggagaucaaggaugguuuuuugauuuauggggaagaggaacauuaauaguaguaaguagugcaaguacaaaaggaccaaguguauuuccacaugauagugca

SEQ ID NO: 49572 - RNA, 414 nt, Artificial Sequence
  derived and/or modified sequence opt6 from anti-HIV-1_HeavyChain
caaguacaauuaguacaaaguggagcagaaguaaaaaaaccaggaaguaguguaaaaguaaguuguaaaguaaguggaggaguauuuacaaguuaugcaguaacauggguaagacaagcaccaggacaaggauuagaauggauaggauggguaaaagcaguaagcggagcaguaaauuauggaucauuagauuuuagacauagaguaucauuaacaagagauagagauuuauuuacagcacauauggauauaagaggauuaacacaagaugauacagcuauauauuuuugugcaagacaaaaauuugcaagaggagaucaaggaugguuuuuugauuuauggggaagaggaacauuaauaguaguaaguucagcaucaacaaaaggaccaaguguauuuccacaugauuuaaga

SEQ ID NO: 49573 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggggcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagugcaaguacaaaaggaccaaguguauuuccacaugauuuaaga

SEQ ID NO: 49574 - RNA, 417 nt, Artificial Sequence
  derived and/or modified sequence opt6 from anti-HIV-1_HeavyChain
caaagucauuuagaacaaucaggaucagcaaugaaaaaaccaggagcaucaguaacaguaucaugcuggacaagugaagauauauuugauacaacagaauuaauauacuggguaagacaagcaccaggacaaggacuagaauggauaggauggguaaaaauaguaaguggaacaguaaacuuugcaucacuagauuucagaaacagaauaucacuaucaagagauagagauuuaucaacagcacacauggacauaagaggauuaacacaagaugacacagcaacauacuuuugugcaagacaaaaauuugcaucaagauauagcggagaccaaggaaguuacuuugacuuauggggaagaggaacauuaauaauaguaucaagugcaaguacaaaaggaccaucagacgaucuaaga

SEQ ID NO: 49575 - RNA, 414 nt, Artificial Sequence
  derived and/or modified sequence opt6 from anti-HIV-1_HeavyChain
caaguacaauuaguacaaaguggagcagaaguaaaaaaaccaggagcaaguguaaaaguaaguuguaaaucaaguggauauucauuuacaagauuugauauaacauggguaagacaagcaccaggacaaggauuagaauggauaggauggguaaaaacaguaaguggagcaguaaauuuuggaucacuaaauuuuagacauagaguaucauuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaagcucagcaucaacaaaaggaccaaguguauuuccacaugauuuaaga

SEQ ID NO: 49576 - RNA, 420 nt, Artificial Sequence
  derived and/or modified sequence opt6 from anti-HIV-1_HeavyChain
caagcacaucuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagugcaaguacaaaaggaccaauaggguuaccaccaagauuaugugua

SEQ ID NO: 49577 - RNA, 417 nt, Artificial Sequence
  derived and/or modified sequence opt6 from anti-HIV-1_HeavyChain
caagcacauuuagaacaaagcggagcgggaguaaaaaaaccaggagcaaguguaagaguaagcuguuggacaagugaagauauauuugaaagaacagaauuaauacauuggguaagacaagcaccaggacaaggacuagaauggauaggauggguaaaaacaguaacaggagcaguaaauuuuggaucaccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagcgcaaguacaaaaggaccaagcguauuuccacaugauuuaaga

SEQ ID NO: 49578 - RNA, 420 nt, Artificial Sequence
  derived and/or modified sequence opt6 from anti-HIV-1_HeavyChain
caagcacauuuagaacaaaguggaagcggagugaaaaaauuaggagcaaguguaagaguaaguuguuggacaagugaagacauauuugaaagaacagaauuaauacauuggguaagacaagcaccaggacaaggauuagaauggauaggauggguaaaagcaguaucaggagcaguaaauuauggaagucuagauuuuagacauagaguaagcuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaaguacaaaaggaccaaguggaccaaguccagaaauaugugua

SEQ ID NO: 49579 - RNA, 417 nt, Artificial Sequence
  derived and/or modified sequence opt6 from anti-HIV-1_HeavyChain
caagcacauuuagaacaaaguggagcaggaguaaaaagaccaggagcaagcguaagaguaaguuguuggacaagugaagauauauuugaaacaacugaacuaauacauuggguaagacaagcaccaggacaaggauuagaauggauaggauggguaaaaacaguaaguggagcaguaaauuuuggaaguuuaaauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagugcaaguacaaaaggaccaaguguauuuccacaugauuuaaga

SEQ ID NO: 49580 - RNA, 417 nt, Artificial Sequence
  derived and/or modified sequence opt6 from anti-HIV-1_HeavyChain
agagcacauuuagaacaaagcggaaguggaguaaaaaaauuaggagcaaguguaagaguaaguuguuggacaagugaagauauauuugaaagaacagaauuaauacauuggguaagacaagcaccaggacaaggacuagaauggauaggauggguaaaagcaguaaguggagcagcaaauuauggaagcccaaauuuuagacaaagaguaaguuuaacaagagacagagacuuauuuacagcacauauggauauaagaggauuaacacaaggagauacagcaacauauuuuugugcaagacaaaaauuugaaagaggaggacaaggauggauauuugauuuauggggaagaggaacauuaauagcaguaucaagcgcaaguacaaaaggaccaaguguauuuccacaugauuuaaga

SEQ ID NO: 49581 - RNA, 417 nt, Artificial Sequence
  derived and/or modified sequence opt6 from anti-HIV-1_HeavyChain
caaguacauuuagaacaaucaggaaguggaguaaaaaaauuaggagcaucaguaagaguaucauguuggacaucagaagauauauuugaaagaacagaauuaauacauuggguaagacaagcaccaggacaaggauuagaauggauaggauggguaaaagcaguaaguggagcaguaaauuauggaucauuagauuuuagacauagaguaucauuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacacuaauaguaguaagcucagcaucaacaaaaggaccaaguguauuuccacaugauuuaaga

SEQ ID NO: 49582 - RNA, 417 nt, Artificial Sequence
  derived and/or modified sequence opt6 from anti-HIV-1_HeavyChain
agagcacauuuagaacaaaguggaaguggaguaaaaaaaccaggagcaaguguaagaguaagcuguuggacaagugaagauauauuugaaagaacagaauuaauacauuggguaagacaagcaccaggacaaggauuagaauggauaggauggguaaaaauaguaaguggagcaguaaauuucggaaguccaaauuuuagacaaagagcaaguuuaacaagagacagagacuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagugcaagcacaaaaggaccaaguguauuuccaacaauauaugua

SEQ ID NO: 49583 - RNA, 414 nt, Artificial Sequence
  derived and/or modified sequence opt6 from anti-HIV-1_HeavyChain
caaguacaauuaguacaaagugaagcagaaguaaaaaaaccaggagcaaguguaaaaauaaguugugcaacaagcggauaugcauuuacauuauauuauuuacauuggguaagacaagcaccaggacaaggauuagaauggauaggauggguaaaaacaguaacaggagcaguaaauuuuggaucagcauauuuuagacauagaguaucauuaacaagagauagagauuuauuuacagcacauauggauauaagaggauuaacacaaggagauacagcaacauauuuuugugcaagacaaaaauuuuauaaaggaggacaaggaugguacuuugauuuauggggaagaggaacauuaauaguaguaaguucagcaucaacaaaaggaccaaguguauuuccacaugauuuaaga

SEQ ID NO: 49584 - RNA, 420 nt, Artificial Sequence
  derived and/or modified sequence opt6 from anti-HIV-1_HeavyChain
caagcacauccagaacaaaguggaagcggaguaaaaaaaccaggagcaaguguaagaguaaguuguuggacaagugaagauauauuugaaagaacagaauuaauacauuggguaagacaagcaccaggacaaggguuagaauggauaggauggguaaaaauaguaaguggagcaguaaauuuuggaaguccaaauuuuagacaaagaguaaguuuaacaagagauagagauuuauuuacagcacauauggauauaaggggauuaacacaaggagauacagcaacauauuuuugugcaagacaaaaauuugaaagaggaggacaaggauggauauuugaucuauggggaagaggaacauuaauagcaguaaguagugcaaguacaaaaggaccaaguggauuaccaccaagauuaugugua

SEQ ID NO: 49585 - RNA, 417 nt, Artificial Sequence
  derived and/or modified sequence opt6 from anti-HIV-1_HeavyChain
caagcacauuuagaacaaaguggaaguggagugaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagaucuauuuacagcacauauggauauaagaggauuaacacaaggagauacagcaacauauuuuugugcaagacaaaaauuugaaagaggaggacaaggaugguauuuugaucuauggggaagaggaacauuaauaguaguaaguagugcaaguacaaaaggaccaaguguauuuccaccaagaaguaca

SEQ ID NO: 49586 - RNA, 417 nt, Artificial Sequence
  derived and/or modified sequence opt6 from anti-HIV-1_HeavyChain
caagcacauuuagaacaaaguggaaguggaguaaaaagaccaggagcaaguguaagaguaaguuguuggacaagugaagauauauuugaaaaaucagaauuaauacauuggguaagacaagcaccaggacaaggauuagaauggauaggauggguaaaaacaguaacaggagcaguaaauuuuggaaguccaaauuuuagacauagaguaaguuuaacaagagacagagauuuauuuacagcacauauggauauaagaggauuaacacaaggagacacagcaacauauuuuugugcaagacaaaaauuugaaagaggaggacaaggaugguauuuugauuuauggggaagaggaacauuaauaguaguaaguagugcaagcacaaaaggaccaucaguauuuccacaugauuuaaga

SEQ ID NO: 49587 - RNA, 417 nt, Artificial Sequence
  derived and/or modified sequence opt6 from anti-HIV-1_HeavyChain
ggagcacauuuagaacaaucaggaucaggaguaaaaaaaccaggagcaucaguaagaguaucauguuggacaucagaagauauauuugaaaaaagugaauuaauacauuggguaagacaagcaccaggacaaggauuagaauggauaggauggguaaaaacaguaacaggagcaguaaauuuuggaucaagugauuuuagacaaagaguaucauuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguucagcaucaacaaaaggaccaaguguguuuccacaugauuuaaga

SEQ ID NO: 49588 - RNA, 417 nt, Artificial Sequence
  derived and/or modified sequence opt6 from anti-HIV-1_HeavyChain
agacaugauuuagaacaaagcggaaguggaguaaaaaaaccaggagcaaguguaagaguaaguuguuggacaagugaagauauauuugaaagaacagaauuaauacauuggguaagacaagcaccaggacaaggauuagaauggauaggauggguuaaaauaguaaguggagcaguaaauuuuggaaguccaaauuuuagacaaagaguaagucuaacaagagauagagauuuauucacagcacauauggauauaagaggauuaacacaaggagauacagcaacauauuuuugugcaagacaaaaauuugaaagaggaggacaaggauggauauuugauuuauggggaagaggaacauuaauagcaguaaguagugcaaguacaaaaggaccaaguguauuuccacaugauuuaaga

SEQ ID NO: 49589 - RNA, 420 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaagucuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagugcaaguacaaaaggaccaaguguaacaauauaugua

SEQ ID NO: 49590 - RNA, 414 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagcgaauuaauacauuggguaagacaagcaccaggacaaggauuagaauggauaggauggguaaaaacaguaacaggagcaguaaauuuuggaucaagugauuuuagacaaagaguaagcuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagugcaaguccaggaccaauaggaccaaguccaagaagugca

SEQ ID NO: 49591 - RNA, 417 nt, Artificial Sequence
  derived and/or modified sequence opt6 from anti-HIV-1_HeavyChain
caagcacauuuagaacaaagugcaaguggaguaaaaagaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguucagauuuuagacaaagaguaaguuuaacaagagauagagauuuauuuacagcacauauggauauaagaggauuaacacaaggagauacagcaacauauuuuugugcaagacaaaaauuuuaugcgggaggacaaggaugguauuuugauuuauggggaagaggaacauuaauaguaguaaguagugcaaguacaaaaggaccaaguguauuuccacaugauuuaaga

SEQ ID NO: 49592 - RNA, 417 nt, Artificial Sequence
  derived and/or modified sequence opt6 from anti-HIV-1_HeavyChain
caaguacaauuaguacaaaguggagcagaaguaaaaaaaccaggagcaucaguaagaguaucauguuggacaucagaagauauauuugaaaaaagugaauuaauacauuggguaagacaagcaccaggacaaggauuagaauggauaggauggguaaaaacaguaacaggagcaguaaauuuuggaucaagugauuuuagacaaagaguaucauuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacacuaauaguaguaaguucagcaucaacaaaaggaccaaguguauucccaacaauauaugua

SEQ ID NO: 49593 - RNA, 417 nt, Artificial Sequence
  derived and/or modified sequence opt6 from anti-HIV-1_HeavyChain
caagcacaucuagaacaaaguggaaguggaguaaaaaaaccaggagcaagcguaagaguaaguuguuggacaagugaagauauauuugaaaggacagaauuaauacauuggguaagacaagcaccaggacaaggauuagaaagaauaggauggguaaaaacaguaacaggagcaguaaauuuuggaagcccaaauuuuagacauaggguaagucuaacaagggauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugcgaguacaaaaggaccaaguguauuuccaacaauaugugua

SEQ ID NO: 49594 - RNA, 420 nt, Artificial Sequence
  derived and/or modified sequence opt6 from anti-HIV-1_HeavyChain
caaagucauuuagaacaaucaggaucagcaaugaaaaaaccaggagcaucaguaagaguaucauguuggacaucagaagauauauuugauacaacagaauuaauacauuggguaagacaagcaccaggacaaggauuagaauggauaggauggguaaaaacaguaucaggagcaguaaauuuuggaucauuaaauuuuagacauagaguaucauuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguucagcaucaacaaauggaccaauaggaccaucaccaacagauuuaaga

SEQ ID NO: 49595 - RNA, 417 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacaauggguaagacaagcaccaggacaaggauuagaauggaugggauggguaaaagcaguaaguggagcaguaaauuauggaaguuuagauuuuagacauaggguaaguuuaacacgagauagagauuuauuuacagcacauauggauauaagaggauuaacacaagacgauacagcaacauauuuuugugcaagacaaaaauuugcaagaggagaucaaggaugguuuuuugauuuauggggaagaggaacauuaauaguaguaaguagugcaucaacaaaaggaccaagcguauuuccacaugauuuaaga

SEQ ID NO: 49596 - RNA, 417 nt, Artificial Sequence
  derived and/or modified sequence opt6 from anti-HIV-1_HeavyChain
caaagucauuuagaacaaucaggaucagcaaugaaaaaaccaggagcaucaguaagaguaucauguuggacaucagaagauauauuugauacaacagaauuaauauauuggguaagacaagcaccaggacaaggauuagaauggauaggauggguaaaagcaguaaguggagcaguaaauuauggaucacuagauuuuagacauagaguaucacuaacaagagauagagauuuaucaacagcacauauggauauaagaggauuaacacaagaugauacagcaacauauuuuugugcaagacaaaaauuugcaagaggagaucaaggaugguuuuuugauuuauggggaagaggaacauuaauaguaguaaguucagcaucaacaaaaggaccaaguguauuuccacaugauuuaaga

SEQ ID NO: 49597 - RNA, 417 nt, Artificial Sequence
  derived and/or modified sequence opt6 from anti-HIV-1_HeavyChain
caagcacaucuagaacaaucaggaaguggaguaaaaaaauuaggagcaaguguaagaguaagcuguuggacaagugaagauauauuugaaagaacagaauuaauacauuggguaagacaagcaccaggacaaggacuagaauggauaggauggguaaaagcaguaagcggagcaguaaauuauggaaguuuagauuuuagacauagaguaagucuaacaagagauagagauuuaaguacagcacauauggauauuagaggauuaacacaagaugauacagcaacguauuuuugugcaagacaaaaauuugcaagaggggaucaaggaugguuuuuugauuuauggggaagaggaacauuaauaguaguaagcagugcaaguacaaaaggaccaaguguauuuccaacuauauaugua

SEQ ID NO: 49598 - RNA, 417 nt, Artificial Sequence
  derived and/or modified sequence opt6 from anti-HIV-1_HeavyChain
caagcacaucuagaacaaaguggaaguggaguaaaaaaaccaggagcaagcguaagaguaagcuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaagucuaacaagagacagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugcaaguacaaaaggaccaucaguauuuccacaugauccaaga

SEQ ID NO: 49599 - RNA, 423 nt, Artificial Sequence
  derived and/or modified sequence opt6 from anti-HIV-1_HeavyChain
caaguauauauggaacaagcaggagcaggaaugaaaaaaccaggagcaaguaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagcgcaaguacaaaaggaccaaguguauuuccacaugauuuaaga

SEQ ID NO: 49600 - RNA, 423 nt, Artificial Sequence
  derived and/or modified sequence opt6 from anti-HIV-1_HeavyChain
caaguauauauggaacaagcaggaggaggaaugaaaaaaccaggagcaaguaugacaguaaguuguaaaacagcagaugaagauauauuugaugcagcauauaugcauuggguaagacaagcaagaggacaaacauuugaaugguuaggauggaugaaaccaguaacaggagcaguaaauuaugcaagacaauuucaaggaagaguaaguuuuuauaggacaagagaauuaggaauagcauauauggauuuaagagauuuaaaauuugaugauacggcaguauauuuuugugcaagaaaaacaaaaggagauguaaguggagaugauagaggauuuuuuuuugauuuauggggaagaggaacaagaguaauaguaaguagugcaaguacaaaaggaccaaguguauuuccaacaauauaugua

SEQ ID NO: 49601 - RNA, 423 nt, Artificial Sequence
  derived and/or modified sequence opt6 from anti-HIV-1_HeavyChain
caaguauauauggaacaagcaggagcaggaguaaaaaaaccaggagcaaguguaacacuaaguuguaaaacagcagaugaagauguauuugaugcagcauauaugcauuggguaagacaagcaccaggacaaacauuugaaugguuaggauggaugaaaccaguaacaggagcgguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugaucuauggggaagaggaaguagaguaauaguaagcagcgcaaguacaaaaggaccaaguguauuuccaacaauauaugua

SEQ ID NO: 49602 - RNA, 423 nt, Artificial Sequence
  derived and/or modified sequence opt6 from anti-HIV-1_HeavyChain
caaguauauaguggagcaggaagaggaggaguaaaaaaaccaggagcaagcguaacauuaaguuguaaaacagcagaugaagauguauuugaugcagcauauaugcauuggguaagacaagcaccaggacaaacauuugaaugguuaggauggaugaaaccaguaacaggagcaguaaauuaugcgagaaaauuucaaggaagaguaaguuuuuauagaacaagagaauuaggaauagcauauauggaucuaagaaauuuaagauuugaugauacggcaguauauuuuugugcaagaaaaacagcaggagauguaaguggagauaaaagaggauuuuuuuuugauuuauggggaagaggaaguagaguaauaguaagcagugcaaguacaaaaggaccaagcguauuuccaacaauauaugua

SEQ ID NO: 49603 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagacauauuugaaagaacagaauuaauacauuggguaagacaagcaccaggacaaggauuagaauggauaggauggguaaaaacaguaaguggagcaguaaauuuuggaaguccaaauuuuagacauagaguaucauuaacaagagauagagaucuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugcauuuacaaaaggaccaaguguauuuccacaugauuuaaga

SEQ ID NO: 49604 - RNA, 414 nt, Artificial Sequence
  derived and/or modified sequence opt6 from anti-HIV-1_HeavyChain
caaguacaauuaggacaaagcggagcagaaaugaaaaaaccaggaucaaguguaaaaguaaguuguaaagcaaguggaggaacauuuaggcauaguccaauaaguuggguaagacaagcaccaggacaaggauuagaauggauaggauggguaaaagcaguaaguggagcaguaaauuauggaucauuagauuucagacauagaguaucauuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguucagcaucaacaaaaggaccaaguguauuuccacaugauuuaaga

SEQ ID NO: 49605 - RNA, 417 nt, Artificial Sequence
  derived and/or modified sequence opt6 from anti-HIV-1_HeavyChain
caaagucauuuagaacaaaguggaucagcaaugaaaaaaccaggagcaaguguaagaguaaguuguuggacaagcgaagauauauuugauacaacagaauuaauauauuggguaagacaagcaccaggacaaggauuagaauggauaggauggguaaaaacaguaacaggagcaguaaauuuuggaucaccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagugcaagcacaaaaggaccaaguguauuuccacaugauuuaaga

SEQ ID NO: 49606 - RNA, 423 nt, Artificial Sequence
  derived and/or modified sequence opt6 from anti-HIV-1_HeavyChain
caaguauauauggaacaagcaggagcaggaguaaaaaaaccaggagcaagcguaacauuaaguuguaaaacagcagaugaagauguauuugaugcagcauauaugcauuggguaagacaagcaccaggacaaacauuugagugguuaggauggaugaaaccaguaacaggagcaguaucauaugcaagaaaauuucaaggaagaguaaguuuuuauaugacaagagaacuaggaauggcauauauggauuuaagaaauuuaagauuugaugauacagcaguauauuuuugugcaagaaaaacggcaggagauguaaguggagauaauagaggauauuuuuuugaucuauggggaagaggaagcuggguaauaguaaguagugcaaguacaaaaggaccaaguguauuuccacaugauuuaaga

SEQ ID NO: 49607 - RNA, 423 nt, Artificial Sequence
  derived and/or modified sequence opt6 from anti-HIV-1_HeavyChain
caaguauauauggaacaagcaggaggaggaguaaaaaaaccaggagcaaguguaacacuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaucaagaguaauaguaaguagugcaaguacaaaaggaccaaguguauuuccaacaauaugugua

SEQ ID NO: 49608 - RNA, 417 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaacuaauacauuggguaagacaagcaccaggaagaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaaguacaaaaggaccaaguguauuuccacaugauuuaaga

SEQ ID NO: 49609 - RNA, 423 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugacacagcaguauauuuuugugcaagaaaaacagcaggagauguaaguggagauaaaagaggauuuuuuuuugauuuauggggaagaggaaguagaguaauaguaaguagugcaaguacaaaaggaccaaguguauuuccaacaauauaugua

SEQ ID NO: 49610 - RNA, 423 nt, Artificial Sequence
  derived and/or modified sequence opt6 from anti-HIV-1_HeavyChain
caaguauuuauggaacaagcaggagcaggaaugaaaaaaccaggagcaagcaugacaguaaguuguaaaacagcagaugaagauguauuugacgcagcauauaugcauuggguaagacaagcaccaggacaaacauuugaaugguuaggauggaugaaaccaguaacaggagcaguaaauuaugcaagaaaauuucaaggaagagugaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagugcaaguacaaaaggaccaaguguauuuccacaugauuuaaga

SEQ ID NO: 49611 - RNA, 423 nt, Artificial Sequence
  derived and/or modified sequence opt6 from anti-HIV-1_HeavyChain
caaguauauauggaacaagcaggagcaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauugggaauagcauauauggauuuaagaaauuuaagauuagaugauacagcaguauauuuuugugcaagaaaaacagcaggagauguaagcggagauaaaagaggauuuuuuuuugauuuauggggaagaggaaguagaguaauaguaaguucagcaaguacaaaagggccaaguguauuuccacaugauuuaaga

SEQ ID NO: 49612 - RNA, 420 nt, Artificial Sequence
  derived and/or modified sequence opt6 from anti-HIV-1_HeavyChain
caaagccauuuagaacaaucaggaucagcaaugaaaaaaccaggagcaucaguaagaguaucaugcuggacaucagaagauauauuugaaagaacagaacuaauauacuggguaagacaagcaccaggaagaggacuagaauggauaggauggguaaaaacaguaagcggaacaguaaacuuuggaucaagcgauuucagaaauagaauaucauuaacaagagauagagaucuaucaacagcacacauggacauaagaggauuaacacaagaugacacagcaacauacuuuugcgcaagacaaaaauuugaaucacuauauagcgaugaccaaggaucauacuuugacuuauggggaagaggaacauuaauaauaguaucaagcgcaaguacaaaaggaccaucaguauuuccaacaaua

SEQ ID NO: 49613 - RNA, 423 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcugaugaagauguauuugaugcagcauauaugcauuggguaagacaagcaccaggacaaacauuugaaugguuaggauggaugaaaccaguaacgggagcaguaucauaugcaagaaaauuucaaggaagaguaaguuuuuauaugacaagagaauuaggaauggcauauauggauuuaagaaauuuaagauuugaugauacggcaguauauuuuugugcaagaaaaacagcaggagauguaaguggagauaauagaggauauuuuuuugauuuauggggaagaggaaguagaguaauaguaaguagugcaaguacaaaaggaccaaguguauuuccaacaauaugugua

SEQ ID NO: 49614 - RNA, 417 nt, Artificial Sequence
  derived and/or modified sequence opt6 from anti-HIV-1_HeavyChain
caagcacauuuagaacaaucaggaucaggaguaaaaaaaccaggagcaucaguaagaguaaguuguuggacaucagaagauauauuugaaaaaagcgaauuaauacauuggguaagacaagcaccaggacaaggauuagaauggauaggauggguaaaaacaguaacaggagcaguaaauuuuggaucaagugauuuuagacaaagaguaucacuaacaagagauagagauuuauuuacagcacauauggauauaagaggauuaacacaaggagauacagcaacauauuuuugugcaagacaaaaauauuaugcaggaggacaaggaugguauuuugauuuauggggaagaggaacauuaauaguaguaaguucagcaucaacaaaaggaccaaguguauuuccacaugauuuaaga

SEQ ID NO: 49615 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaaggcaagcaccaggacaaggacuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaagcagcgcaaguacaaaaggaccaaguguauuuccacaugacuuaaga

SEQ ID NO: 49616 - RNA, 423 nt, Artificial Sequence
  derived and/or modified sequence opt6 from anti-HIV-1_HeavyChain
caaguauauaugggagcaggaagaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagugcaaguacaaaaggaccaaguguauuuccaacaauauaugua

SEQ ID NO: 49617 - RNA, 423 nt, Artificial Sequence
  derived and/or modified sequence opt6 from anti-HIV-1_HeavyChain
caaguauauauggaacaagcaggaggaggaaugaaaaaaccaggagcaaguaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaagcuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugaucuauggggaagaggaacaagaguaauaguaaguagugcaaguacaaaaggaccaaguguauuuccaacaauaugugua

SEQ ID NO: 49618 - RNA, 423 nt, Artificial Sequence
  derived and/or modified sequence opt6 from anti-HIV-1_HeavyChain
caaguauauauggaacaagcaggaggaggaaugaaaaaaccaggagcaaguaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaaggggaacaagaguaauaguaaguagugcaaguacaaaaggaccaaguguauuuccacaugauuuaaga

SEQ ID NO: 49619 - RNA, 423 nt, Artificial Sequence
  derived and/or modified sequence opt6 from anti-HIV-1_HeavyChain
caaguauauauggaacaagcaggagcaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaaaaguaaguuuuuauagaacaagagaauuaggaauagcauauauggauuuaagaaauuuaagauuugaugauacagcaguauauuuuugcgcaagaaaaacagcaggagauguaaguggagauaaaagaggauuuuuuuuugauuuauggggaagaggaagcagaguaauaguaaguagugcaaguacaaaaggaccaaguguauuuccacaugauuuaaga

SEQ ID NO: 49620 - RNA, 423 nt, Artificial Sequence
  derived and/or modified sequence opt6 from anti-HIV-1_HeavyChain
caaguauauauggaacaagcaggagcaggaguaaaaaaaccaggagcaaguguaacacuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaaguagaguaaguuuuuauggaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagcgcaaguacaaaaggaccaaguguauuuccacaugauuuaaga

SEQ ID NO: 49621 - RNA, 420 nt, Artificial Sequence
  derived and/or modified sequence opt6 from anti-HIV-1_HeavyChain
caaggacauacaguagaacaaagcggaaguggaguaaaaaaauuaggagcaaguguaagaguaagcuguuggacaagugaagauauauuugaaacaacagaauuaauacauuggguaaggcaagcaccaggacaaggauuagaauggauaggauggguaaaaacaguaaguggagcaguaaauuuuggaaguuuaaauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguucagcaaguacaaaaggaccaaguguauuuccacaugauuuaaga

SEQ ID NO: 49622 - RNA, 420 nt, Artificial Sequence
  derived and/or modified sequence opt6 from anti-HIV-1_HeavyChain
caagcaacaccauggucaaauuuaggaagaggaguaaaaaaauuaggagcaaguguaagaguaaguuguuggacaagugaagauauauuugaaagaacagaacuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugaucuauggggaagaggaacauuaauaguaguaaguagugcaaguacaaaaggaccaaguguauuuccacaugauuuaaga

SEQ ID NO: 49623 - RNA, 423 nt, Artificial Sequence
  derived and/or modified sequence opt6 from anti-HIV-1_HeavyChain
caaguauuuauggaacaagcaggagcaggaaugaaaaaaccaggagcaaguaugacaguaagcuguaaaacagcagaugaagauguauuugaugcggcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauagugaguagugcaucaacaaaaggaccaaguguauuuccacaugauuuaaga

SEQ ID NO: 49624 - RNA, 423 nt, Artificial Sequence
  derived and/or modified sequence opt6 from anti-HIV-1_HeavyChain
caaguauauauggaacaaaguggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaucauaugcaagaaaauuucaaggaagaguaaguuuuuauagaacgagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaaguagaguaauaguaaguagugcaaguacaaaaggaccaaguguauuuccacaugauuuaagg

SEQ ID NO: 49625 - RNA, 423 nt, Artificial Sequence
  derived and/or modified sequence opt6 from anti-HIV-1_HeavyChain
caaguauauauggaaagaggaagaggaggaguaaaaaaaccaggagcaucaguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacggcaggagauguaaguggagauaaaagaggauuuuucuuugauuuauggggaagaggaaguagaguaauaguaaguagugcaaguacaaaaggaccaaguguauuuccacaugauuuaaga

SEQ ID NO: 49626 - RNA, 423 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaagauuucaaggaagaguaaguuuuuauaugacaagagaauuaggaauggcauauauggauuugagaaauuuaagauuugaugauacagcaguauauuuuugugcaagaaaaacagcaggagauguaaguggagauaauagaggauauuuuuuugauuuauggggaagaggaaguagaguaauaguaaguagugcaaguacaaaaggaccaaguguauuuccaacaauaugugua

SEQ ID NO: 49627 - RNA, 423 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggaucuaagaaauuuaagauuugaugauacagcaguauauuuuugugcaagaaaaacagcaggagauguaaguggagauaauagaggauauuuuuuugauuuauggggaagaggaaguagaguaauaguaaguagugcaaguacgaaaggaccaaguguauuuccacaugauuuaaga

SEQ ID NO: 49628 - RNA, 423 nt, Artificial Sequence
  derived and/or modified sequence opt6 from anti-HIV-1_HeavyChain
caaguauuuauggaacaagcaggaggaggaaugaaaaaaccaggagcaaguaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagugcaaguacaaaaggaccaaguguauuuccacaugauuuaaga

SEQ ID NO: 49629 - RNA, 423 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcaccaggacaaggacuagaauggauaggauggguaaaaacaguaacaggagcaguaaauuuuggaagucuagauuuuagacauagaauaaguuuaacaagagauagagauuuauuuacagcacauauggauauaagaggauuaacacaaggagauacagcaacauauuuuugugcaagacaaaaauuugcaaguagauauaguggagaucaaggaaguuauuuugauuuauggggaagaggaacauuaauaguaguaaguagugcaaguacaaaaggaccaaguguauuuccacaugauuua

SEQ ID NO: 49630 - RNA, 423 nt, Artificial Sequence
  derived and/or modified sequence opt6 from anti-HIV-1_HeavyChain
caaguauuuauggaacaagcaggagcgggaaugaaaaaaccaggagcaaguaugacaguaagcuguaaaacagcagaugaagauguauuugaugcagcauauaugcauuggguaagacaagcaccaggaccagauuuagaauggcuaggauggaugaaaccaguaacaggagcaguaaauuaugcaagaaaauuucaaggaagaguaaguuuuuauagaacaagagaauuaggaauagcauauauggauuuaagagauuuaagauuugaugauacagcaguauauuuuugugcaagaaaaacagcaggagauguaaguggagauaaaagaggauuuuuuuuugauuuauggggaagaggaaguagaguaauaguaaguagugcaaguacaaaagcacauagaaguaguccaacaauaugugua

SEQ ID NO: 49631 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagugcaaguacaaaaggaccaaguguauuuccacaugauuuaaga

SEQ ID NO: 49632 - RNA, 423 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacgggagcaguaaguuaugcaagaaaauuucaaggaagaguaaguuuuuauaugacaagagaacuaggaauggcauauauggauuuaagaaauuuaagauuuaaugauacagcaguauauuuuugugcaagaaaaacagcaggagauguaaguggagauaauagaggauauuuuuuugauuuauggggaagaggaaguagaguaauaguaaguagugcaaguacaaaaggaccaagcguauuuccacaugauuuaaga

SEQ ID NO: 49633 - RNA, 423 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugacgcagcauauaugcauuggguaagacaagcaccaggacaaacauuugaaugguuaggauggaugaaaccaguaacaggagcaguaaauuaugcaagaaaauuucaaggaagaguaagcuuuuauagaacaagagaauuaggaauagcauauauggauuuaagaaauuuaagauuugaugauacagcaguauauuuuugugcaagaaaaacagcaggagauguaaguggagauaauagaggauauuuuuuugauuuauggggaagaggaaguaggguaauaguaaguagugcaaguacaaaaggaccaaguggacuaccacaugauuuaagg

SEQ ID NO: 49634 - RNA, 423 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugauggaacagcaguauauuuuugugcaagaaaaacagcaggagauguaaguggagauaaaagaggauuuuuuuuugauuuauggggaagaggaaguagaguaauaguaaguagugcaaguacaaaaggaccaaguguauuuccacaugauuuaaga

SEQ ID NO: 49635 - RNA, 423 nt, Artificial Sequence
  derived and/or modified sequence opt6 from anti-HIV-1_HeavyChain
caaguauauauggaacaagcaggaggaggaguaaaaaaaccaggagcaagcguaacauuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuuugauuuauggggaagaggaagcagaguaauaguaaguagugcaaguacaaaaggaccaaguguauuuccacaugauuuaaga

SEQ ID NO: 49636 - RNA, 423 nt, Artificial Sequence
  derived and/or modified sequence opt6 from anti-HIV-1_HeavyChain
caaguacaauuaguacaaagcggagcagaaguaaaaaaaccaggagcaaguuuaaaaguaagcuguaaagcaagcggauacacauucacagacuauuacauacacuggguaagacaagcaccaggacaaggacuagaauggauaggauggguaaaaauaguaagcggaacaguaaacuuugcaucacuagauuucagaaacagaauaucacuaucaagagauagagaucucucaacagcauacauggacauaagaggacuaacacaagaugacacagcaacauacuuuugcgcaagacaaaaauuugcaucaagauauagcggagaccaaggaucauacuuugacuuauggggaagaggaacauuaauaguaguaucgagugcuaguacaaaaggaccaucaguauuuccacaugacuuaaga

SEQ ID NO: 49637 - RNA, 423 nt, Artificial Sequence
  derived and/or modified sequence opt6 from anti-HIV-1_HeavyChain
caagcacauuuagaacaaucaggaucaggaguaaaaaaaccaggagcaucaguaagaguaucauguuggaguucagaagauauauuugaaagaacagaacuaauacauuggguaagacaagcaccaggacaaggauuagaauggauaggauggguaaaaacaguaacaggagcaguaaauuuuggaaguuuagauuuuagacauagaauaucauuaacaagagacagagauuuauuuacagcacauauggauauaagaggauuaacacaaggagauacagcaacauauuuuugugcaagacaaaaauuugaaucaagauauacaggaggacaaggaugguauuuugauuuauggggaagaggaacacuaauaguaguaucaagugcaaguacaagagcacauagaagcccacaugauuuaaga

SEQ ID NO: 49638 - RNA, 426 nt, Artificial Sequence
  derived and/or modified sequence opt6 from anti-HIV-1_HeavyChain
caagcacauuuagaacaaaguggaaguggagugaaaaaaccaggagcaaguguaagaguaagcuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacaaagaguaagucuaacaagagauagagauuuauuuacagcacauauggauauaagaggauuaacacaaggagauacagcaacauauuuuugugcaagacaaaaauuugaaaguagauauacaggaggacaaggaugguauuuugauuuaugggggagaggaacacauauaguaguaaguagugcaaguacaaaaggaccaaguguauuuccacaugauuuaaga

SEQ ID NO: 49639 - RNA, 426 nt, Artificial Sequence
  derived and/or modified sequence opt6 from anti-HIV-1_HeavyChain
caaguacaauuaguacaaagcggagcagaaguaaaaaaaccaggagcaaguguaagaguaaguuguuggacaagugaagauauauuugauacaacagaauuaauauauuggguaagacaagcaccaggacaaggauuagaauggauaggauggguaaaaauaguaucaggaacaguaaauuuugcaaguuuagauuuuagaaauagaauaaguuuaaguagagauagagauuuaaguacagcauauauggauauaagaggauuaacacaagaugauacagcaacauauuuuugugcaagacaaaaauuugcaagcagauauucaggagaucaaggaaguuauuuugauuuauggggaagaggaacauuaauaguaguaaguagugcaaguacaaaaggaccaaguguauuuccacaaauaugugua

SEQ ID NO: 49640 - RNA, 426 nt, Artificial Sequence
  derived and/or modified sequence opt6 from anti-HIV-1_HeavyChain
caaagccaucuagaacaaucaggaucagcaaugaaaaaaccaggagcaucaguaagaguaucaugcuggacaucagaagauauauuugaaagaacagaacuaauauacuggguaagacaagcaccaggaagaggauuagaauggauaggauggaugaaaacaguaagcggaacaguaaacuuuggaucaagcgauuucagaaacagaauaucacuaacaagagauagagaucuaucaacagcacacauggacauaagaggacuaacacaagaugacacagcaacauacuuuugcgcaagacaaaaauuugaaucauuauauagugaugaccaaggaucauacuuugacuuauggggaagaggaacauuaauaauaguaucaagcgcaagcacaaaagcacacagaagcucaccaacaacauuaaga

SEQ ID NO: 49641 - RNA, 423 nt, Artificial Sequence
  derived and/or modified sequence opt6 from anti-HIV-1_HeavyChain
caaagccaucuagaacaaucaggaucagcaaugaaaaaaccaggagcaucaguaagaguaucaugcuggacaucagaagauauauuugacacaacagaacuaauauacuggguaagacaagcaccaggacaaggacuagaauggauaggauggguaaaaauaguaagcggaacaguaaacuuugcaucacuagauuucagaaacagaauaucacuaucaagagauagagauuuaucaacagcacacauggacauaagaggacuaacacaagaugacacagcaacauacuuuugcgcaagacaaaaauuugcaucaagauauaguggagaccaaggaucauacuuugacuuauggggaagaggaacauuaauaauaguaucaagcgcaagcacaaaaggaccaucaguauuuccaagaagcgca

SEQ ID NO: 49642 - RNA, 423 nt, Artificial Sequence
  derived and/or modified sequence opt6 from anti-HIV-1_HeavyChain
caagcacaccuagaacaaagcggaaguggaguaaaaaaaccaggagcaaguguaagaguaagcuguuggacaagcgaagacauauucgaaaaaucagaauugauacauuggguaagacaagcaccaggacaaggauuagaauggauaggauggguaaaaacaguaacaggagcaguaaauuucggacaccaaauaucagacagaguaucacuaucaagagauagagaucuaucaacagcauacauggacauaagaggauuaacacaagaugacacagcaacauacuuuugcgcaagacaaaaauuugcaucaagauauagcggagaccaaggaucauacuuugacuuauggggaagaggaacauuaauaguaguaucaagcgcaagcacaaaaggaccaucaguauuuccacaugauuuaaga

SEQ ID NO: 49643 - RNA, 423 nt, Artificial Sequence
  derived and/or modified sequence opt6 from anti-HIV-1_HeavyChain
caaagucaucuagaacaaaguggaucagcaaugaaaaaaccaggagcaucaguaagaguaucauguuggacaucagaagauauauuugacacaacagaauuaauauacuggguuagacaagcaccaggacaaggauuagaauggauaggauggguaaaaauaguaaguggaacaguaaauuuugcaucauuagauuuuagaaacagaauaucacuaucaagagauagagauuuaucaacagcacauauggacauaagaggacuaacgcaagaugacacagcaacauacuuuugcgcaagacaaaaauuugcaucaagauauaguggggaccaaggaucauacuuugauuuauggggaagaggaacauuaauaauaguaucaagugcaagcacaagagcacauagaaguucaccaagaagcgca

SEQ ID NO: 49644 - RNA, 426 nt, Artificial Sequence
  derived and/or modified sequence opt6 from anti-HIV-1_HeavyChain
caagcacauuuagaacaaaguggaaguggaguaaaaaaaccaggagcgaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacauagaauaaguuuaacaagagauagagauuuauuuacagcacauauggauauaagaggauuaacacaaggagauacagcaacauauuuuugugcaagacaaaaauuugaaagcagauauacaggaggacaaggaugguauuuugaucuauggggaagaggaacacauauaguaguaaguagcgcaaguacaaaaggaccaaguguauuuccacaugauuuaaga

SEQ ID NO: 49645 - RNA, 426 nt, Artificial Sequence
  derived and/or modified sequence opt6 from anti-HIV-1_HeavyChain
caaucacaccuagaacaaucaggaucagcaaugaaaaaaccaggagcaucaguaagaguaucaugcuggacaucagaagacauauucgacacaacagaauuaauauacuggguaagacaagccccaggacaaggacuagaauggauaggauggguaaaaauaguaucaggaacaguaaacuucggaagcucagacuucagaaacagaauaucacuaacaagagacagagaccuaucaacagcacacauggacauaagaggacuaacacaagacgacacagcaacauacuucugcgcaagacaaaaauucgaaucacuauacucagacgaccaaggaucauacuucgaccuauggggaagaggaacacuaauaauaguaucaucagcaucaacaaaaggaccaucaguauucccaacaauauacgua

SEQ ID NO: 49646 - RNA, 426 nt, Artificial Sequence
  derived and/or modified sequence opt6 from anti-HIV-1_HeavyChain
caaagccauuuagaacaaaguggaucagcaaugaaaaaaccaggagcaucaguaagaguaucaugcuggacaucagaagauauauuugacacaacagaauuaauauacuggguaagacaagcaccaggacaaggacuagaauggauaggauggguaaaaauaguaagcggaacaguaaacuuugcaucauuagauuuuagaaacagaauaagucuaucaagagauagagauuuaucaacagcauacauggacauaagaggacuaacacaagaugacacagcaacauacuuuugcgcaagacaaaaauuugcaucaagauauagcggagaccaaggaucauacuuugacuuauggggaagaggaacauuaauaguaguaucaagcgcaagcacaaaaggaccaucaguauuuccacaugacuuaaga

SEQ ID NO: 49647 - RNA, 423 nt, Artificial Sequence
  derived and/or modified sequence opt6 from anti-HIV-1_HeavyChain
caaucacacuuagaacaaagcggaagugcaaugaaaaaaccaggagcaagcguaagaguaagcuguuggacaagcgaagacauauucgauacaacagaauuaauauauuggguaagacaagcaccaggacaaggacuagaauggauaggauggguaaaaauaguaucaggaacaguaaauuucgcaaguuuagauuuuagaaauagaauaagcuuaagcagagauagagacuuaagcacagcacauauggauauaagaggauuaacacaagacgauacagcaacauauuucugugcaagacaaaaauucgcaagcagauacucaggagaucaaggaaguuauuucgaucuauggggaagaggaacacuaauaauaguaagcucagcaucaacaaaaggaccaagcguauucccaacaauaugc

SEQ ID NO: 49648 - RNA, 417 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuucggaaguccaaauuuuagacauagaguaaguuuaacaagagacagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcauuacaucaaggaccaauaggauuaccaccaagaucaaca

SEQ ID NO: 49649 - RNA, 423 nt, Artificial Sequence
  derived and/or modified sequence opt6 from anti-HIV-1_HeavyChain
caaguauauauggaacaagcaggaggaggaguaaaaaagccaggagcaaguguaacauuaagcuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuagggauagcauauauggauuuaagaaaucuaagauuugaugauacagcgguauauuuuugugcaagaaaaacagcaggagauguaaguggagauaaaagaggauuuuuuuuugauuuauggggaagaggaaguagaguaauaguaaguagugcaaguacaaaaggaccaaguguauuaccaccaagaagugca

SEQ ID NO: 49650 - RNA, 423 nt, Artificial Sequence
  derived and/or modified sequence opt6 from anti-HIV-1_HeavyChain
caaguccaacuaguucaaucaggagcagaaguaaaaaaaccaggagcaucaguaaaaauaucaugcaaagcaucaggauacacauuuauaagacacggaauacacuggcuaagacaaguaccaggacaaagaccagaauggaugggauggauaagaccaaaaacaggagcaagaaaucaagcaagacaauuccaaccaagaauaucacuagcaagagacagagcacuaucaacagcauacuuagacuuaaacucacuaacaucagcagacucaggaacauacuuuugcgcaagacaaacauuuaaaccagacuuuuacuuugcagaucaaggauggucauucaaucuauggggcagaggagcacacuucauaguaucaucagcauuacaccaaggaccaauaggacuaccaccaagaucaaca

SEQ ID NO: 49651 - RNA, 426 nt, Artificial Sequence
  derived and/or modified sequence opt6 from anti-HIV-1_HeavyChain
caaagccaucuagaacaaucaggaucagcaaugaaaaaaccaggagcaucaguaagaguaucaugcuggacaucagaagauauauuugaaagaacagaacuaauauacuggguaagacaagcaccaggacaaggacuagaauggauaggauggguaaaaauaguaaguggaacaguaaacuuugcaucacuagauuucagaaacagaauaucacuaucaagagauagagauuuaucaacagcauacauggacauaagaggauuaacacaagaugacacagcaacauacuucugcgcaagacaaaaauuugcaucaagauauaguggggaccaaggaucauacuuugacuuauggggaagaggaacauuaauaguaguaucaagcgcaagcacaaaaggaccaucaguauuuccacaugacuuaaga

SEQ ID NO: 49652 - RNA, 426 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagugaagauauauuugaaagaacagaauuaauacauuggguaagacaagcaccaggacaaggauuagaauggauaggauggguaaaaacaguaacaggagcaguaaauuuuggaagcuuagauuuuagacauagaauaaguuuaacgagagauagagauuuauuuacagcacauauggauauaagaggauuaacacaaggagauacagcaacauauuuaugugcaagacaaaaauuugaaaguagauauacaggaggacaaggaugguauuuugauuuauggggaagaggaacacauauaguaguaaguagugcaaguacaaaaggaccaaguguauuuccaacaauaugugua

SEQ ID NO: 49653 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagacauauuugauacaacagaauuaauauauuggguaagacaagcaccaggacaaggauuagaauggauaggauggguaaaaauaguaaguggaacaguaaauuuugcaaguuuagauuuuagaaauagaauaagucuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagugcaaguacaaaaggaccaaguguauuuccacaaauaugugua

SEQ ID NO: 49654 - RNA, 426 nt, Artificial Sequence
  derived and/or modified sequence opt6 from anti-HIV-1_HeavyChain
caagcacacuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagugcaaguacuaaaggaccaaguguauuuccaacaauaugugua

SEQ ID NO: 49655 - RNA, 426 nt, Artificial Sequence
  derived and/or modified sequence opt6 from anti-HIV-1_HeavyChain
caagcacauuuagaacaaucaggaagcggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguucagauuuuagacaaagaguaaguuuaacaagagauagagauuuauuuacagcacauauggauauaagaggauuaacacaaggagauacagcaacauauuuuugugcaagacaaaaauuugaaaguuuauauagugaugaucaaggaaguuauuuugauuuauggggaagaggaacauuaauaauaguaaguagugcaagcacaaaaggaccaaguguauuuccaacgauaugugua

SEQ ID NO: 49656 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaucaccaaauuuuagacauagaguaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagugcaaguacaaaaggaccaagcguauuuccacaugauuuaaga

SEQ ID NO: 49657 - RNA, 426 nt, Artificial Sequence
  derived and/or modified sequence opt6 from anti-HIV-1_HeavyChain
caaagccaucuagaacaaucaggaucagcaaugaaaaaaccaggagcaucaguaagaguaucaugcuggacaucggaagauauauuugacacaacagaacuaauauacuggguaagacaagcaccaggacaaggacuagaauggauaggauggguaaaaauaguaagcggaacaguaaacuuugcaucacuagauuucagaaacagaauaucacuaucaagagauagagaucuaucaacagcacacauggacauaagaggacuaacacaagaugacacagcaacauacuuuugcgcaagacaaaaauuugcaucacgauauagcggagaccaaggaucauacuuugacuuauggggaagaggaacauuaauaauaguaucaagcgcaagcacaaaaggaccaucaguauuuccaacaauaugugua

SEQ ID NO: 49658 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggaacaguaaauuuuggaagcuuaaauuuuagacaaagaguaaguuuaacaagagauagagauuuauuuacagcacauauggauauaagaggauuaacacaagaugauacagcaacauauuuuugugcaagacaaaaauuugcaaguagauauucaggagaucaaggaaguuauuuugauuuauggggaagaggaacacuaauaguaguaaguagugcaaguacaaaaggaccaaguguauuuccaacaauaugugua

SEQ ID NO: 49659 - RNA, 426 nt, Artificial Sequence
  derived and/or modified sequence opt6 from anti-HIV-1_HeavyChain
caaagucauuuagaacaaucaggaucagcaaugaaaaaaccaggagcaucgguaagaguaucaugcuggacaucagaagauauauuugacacaacagaauuaauauacuggguaagacaagcaccaggacaaggacuagaauggauaggauggguaaaaauaguaaguggaacaguaaacuuugcaucacuagauuucagaaacagaauaucacuaucaagagauagagauuuaucaacagcacacauggacauaagaggauuaacacaagaugacacagcaacauacuuuugugcaagacaaaaauuugcaucaagauauagcggagaccaaggaucauacuuugauuuauggggaagaggaacauuaauaauaguaucaagugcaagcacaaaaggacacagaaguucaccaacaauaugugua

SEQ ID NO: 49660 - RNA, 423 nt, Artificial Sequence
  derived and/or modified sequence opt6 from anti-HIV-1_HeavyChain
caaguguauauggaacaagcaggagcaggaaugaaaaaaccaggagcaagcaugacaguaaguuguaaaacagcagaugaagauguauuugaugcagcauauaugcauuggguaagacaagcaccaggacaaacauuugaaugguuaggauggaugaaaccaguaacgggggcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaagcggagauaaaagaggauuuuuuuuugauuuauggggaagaggaaguagaguaauaguaaguagugcaagcacaaaaggaccaaguguauuuccaacaauauaugua

SEQ ID NO: 49661 - RNA, 423 nt, Artificial Sequence
  derived and/or modified sequence opt6 from anti-HIV-1_HeavyChain
caaucacaccuagaacaaagcggaagcgcaaugaaaaaaccaggagcaagcguaagaguaagcuguuggacgagugaagacauauucgauacaacagaauuauacuggguaagacaagcaccaggacaaggacuagaauggauaggauggguaaaaauaguaagcggaacaguaaacuuugcaucacuagauuucagaaacagaauaucacuaucaagagauagagauuuaucaacagcauacauggacauaagaggacuaacacaagaugacacagcuacauacuuuugcgcaagacaaaaauuugcaucaagauauaguggagaccaaggaucauacuuugaccuauggggaagaggaacauuaauaguaguaucaagugcaaguacaaaaggaccaucaguauuuccacaugacuuaaga

SEQ ID NO: 49662 - RNA, 423 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagcgaagauauauuugauacaacagaauuaauauauuggguaagacaagcaccaggacaaggguuagaauggauaggauggguaaaaauaguaaguggaacaguaaauuuugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagugcaaguacaaaaggaccaucaguauuuccacaugauccagca

SEQ ID NO: 49663 - RNA, 426 nt, Artificial Sequence
  derived and/or modified sequence opt6 from anti-HIV-1_HeavyChain
caagcacauuuagaacaaagugggaguggaguaaaaaaaccaggagcaaguguaagaguaaguuguuggacaagugaagauauauucgaaaaaagugaauuaauacauuggguaagacaagcaccaggacaaggauuagaauggauaggauggguaaaaacaguaacaggagcaguaaauuuuggaaguagugauuuuagacaaagaguaagucuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagugcaaguacaaaaggaccaaguguauuuccaacaauaugugua

SEQ ID NO: 49664 - RNA, 426 nt, Artificial Sequence
  derived and/or modified sequence opt6 from anti-HIV-1_HeavyChain
caagcacaccuagaacaaagcggaagcggaguaaaaaaaccaggagcaaguguaagaguaagcuguuggacaagcgaagauauauucgaaagaucagaauuaauacauuggguaagacaagcaccaggacaaggauuagaauggauaggauggguaaaaacaguaacaggagcaguaaauuucggaagcccaaacuuuagacaaagaguaagcuuaacaagagacagagacuuaagcacagcacauauggauauaagaggauuaacacaagacgauacagcaaccuauuucugugcaagacaaaaauucgaaagcuuauacucagacgaucaaggaagcuauuucgauuuauggggaagaggaacacuaauaauaguaaguucagcaucaacaaaaggaccaagcguauucccaacaauaugcgua

SEQ ID NO: 49665 - RNA, 426 nt, Artificial Sequence
  derived and/or modified sequence opt6 from anti-HIV-1_HeavyChain
caagcacauuuagaacaaagugcaagcggaguaaaaagaccaggagcaagugugagaguaaguuguuggacaagugaagauauauuugaaagaacagaauuaauauauuggguaagacaagcaccaggacaaggauuagaauggauaggauggguaaaaacaguaucaggagcaguaaauuuuggaagucaagauuuuagagauagauuuaguuuaacaagagauagagauuuauuuacagcacauauggauauaagaggauuaacacaaggagauacagcaacauauuuuugugcgagacaaaaauuugcaaguagguauaguggagaucaaggaaguuauuuugauuuauggggaagaggaacauuaauaguaguaaguagugcaaguacaaaaggaccaaguguauuuccaacaauaugugua

SEQ ID NO: 49666 - RNA, 426 nt, Artificial Sequence
  derived and/or modified sequence opt6 from anti-HIV-1_HeavyChain
caagcacauuuagaacaaaguggaaguggaguaaaaaaauuaggagcgaguguaagaguaaguuguuggacaagugaagauauauuugaaagaacagaauuaauacauuggguaagacaagcaccaggacaaggacuagaauggauaggauggguaaaagcaguaagcggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugaaaguagauauacaggaggacaaggaugguauuuugauuuauggggaagaggaacacauauaguaguaaguagcgcaaguacaaaaggaccaaguguauuuccaacaauaugugua

SEQ ID NO: 49667 - RNA, 423 nt, Artificial Sequence
  derived and/or modified sequence opt6 from anti-HIV-1_HeavyChain
caaguacauauggaacaagcaggaggaggaaugaaaaaaccaggagcaucaaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuucuacaagaucaaggaauaagaauagcauauauggauuuaagagauuuaaaauuugaugauacagcaguauauuuuugugcaagaaaaacaaaaggagauguaagcggagaugauagaggauuuuuuuuugauuuauggggaagaggaacaagaguaauaguaaguaguaguuuacaucaaggaccaauaggauuaccaccaagaagugca

SEQ ID NO: 49668 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaagcagugauuuuagacauagaauaagcuuaacaagagauagagaucuauuuacagcacauauggauauaagaggauuaacacaaggagauacagcaacauauuuuugugcgagacaaaaauuugaaaguagauauacaggaggacaaggaugguauuuugauuuauggggaagaggaacacauauaguaguaaguagugcaaguacaaaaggaccaaguguauuuccaacaauauaugua

SEQ ID NO: 49669 - RNA, 426 nt, Artificial Sequence
  derived and/or modified sequence opt6 from anti-HIV-1_HeavyChain
caaguauauauggaacaagcaggaggaggaguaaaaaaaccaggagcaaguguaacguuaaguuguaaaacagcagaugaagauguauuugaugcagcauauaugcauuggguaaggcaagcaccaggacaaacauuugaaugguuaggauggaugaaaccaguaacaggagcaguaaauuaugcaagaaauuuucaaggaagaguaaguuuuuauagaacaagagaauuaggaauagcauauauggauuuaagaaauuuaagauuugaugauacagcaguauauuuuugugcaagaaaaacaaaaggagauguaaguggagaugauagaggauuuuuuuuugauuuauggggaagaggaacaagaguaauaguaaguaguggauuacaucaaagagcacauagaaguaguccaacaauaugugua

SEQ ID NO: 49670 - RNA, 426 nt, Artificial Sequence
  derived and/or modified sequence opt6 from anti-HIV-1_HeavyChain
caaagucauuuagaacaaagcggaagugcaaugaaaaaaccaggagcaaguguaagaguaaguuguuggacaagugaagauauauuugauacaacagaauuaauauauuggguaaggcaagcaccaggacaaggauuagaauggauaggauggguaaaaauaguaaguggaacaguaaauuuugcaaguuuagauuuuagaaauagaauaagcuuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaagcagugcaaguacaaaaggaccaaguguauuuccaacaauaugugua

SEQ ID NO: 49671 - RNA, 423 nt, Artificial Sequence
  derived and/or modified sequence opt6 from anti-HIV-1_HeavyChain
caaguauauauggaacaagcaggaguaggaguaaaaaaaccaggagcaaguguaacauuaaguuguaaaacggcagaugaagauguauuugaugcagcauauaugcauuggguaagacaagcaccaggaccagauuuagaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaagcggagauaaaagaggauuuuuuuuugauuuauggggaagaggaaguagaguaauaguaaguagugcaaguacaaaaggaccaaguguauuuccaacaauaugugua

SEQ ID NO: 49672 - RNA, 426 nt, Artificial Sequence
  derived and/or modified sequence opt6 from anti-HIV-1_HeavyChain
caaucacaucuagaacaaucaggaucagcaaugaaaaaaccaggagcaucaguaagaguaaguugcuggacaucagaagauauauuugacacaacagaauuaauauacuggguaagacaagcuccaggacaaggacuagaauggauaggauggguaaaaauaguaagcggaacaguaaacuuugcaucacuagauuucagaaacaggauaucacuaucaagagauagagauuuaaguacagcacacauggacauaagaggauuaacacaagaugacacagcaacguacuuuugugcaagacaaaaauuugcaucaagauauagcggagaccaaggaucauacuuugacuuauggggaagaggaacauuaauaauaguaaguagugcaagcacaaaaggaccaucaguauuuccacaugacuuaaga

SEQ ID NO: 49673 - RNA, 426 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaacaggagcaguaaauuuuggaaguuuagauuuuagacauaggauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaagcagugcaaguacaaaaggaccaaguguauuuccacaugauuuaaga

SEQ ID NO: 49674 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaaagaauaggauggguaaaaacaguaacaggagcagugaauuuuggaagucuagauuuuagacauagaauaagucuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagugcaaguacaaaaggaccaagcguauuuccaacaauaugugua

SEQ ID NO: 49675 - RNA, 423 nt, Artificial Sequence
  derived and/or modified sequence opt6 from anti-HIV-1_HeavyChain
gaaguauauauggaaagaggaagaggaggaguaaaaaaaccaggagcaagugcaacauuaaguuguaaaacagcagaugaagauguauuugaugcagcauauaugcauuggguaagacaagcaccaggacaaacauuugaaugguuaggauggaugaaaccaguaacaggagcaguaagcuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaagcggagauaauagaggauauuuuuuugaucuauggggaaggggaaguagaguaauaguaaguagugcaaguacaaaaggaccaaguguauuuccacaugauuuaaga

SEQ ID NO: 49676 - RNA, 426 nt, Artificial Sequence
  derived and/or modified sequence opt6 from anti-HIV-1_HeavyChain
caagcacauuuagaacaaaguggaaguggaguaaaaaaaccaggagcaagugcaagaguaaguuguuggaguagugaagauauauuugaaagaauagaacuaauacauuggguaagacaagcaccagggcaaggauuagaauggauaggauggguaaaaacaguagcaggagcaguaaauuuuggaagccuagauuuuagacauagaauaaguuuaacaagagauagagauuuauuuacagcacauauggauauaagaggauuaacacaaggagauacagcaacauauuuuugugcaagacaaaaauuugaaagcagauauacaggaggacaaggaugguauuuugauuuauggggaagaggaacacauauaguaguaaguagugcaaguacaaaaggaccaaguguauuuccacaugauuuaaga

SEQ ID NO: 49677 - RNA, 426 nt, Artificial Sequence
  derived and/or modified sequence opt6 from anti-HIV-1_HeavyChain
caaucacacuuagaacaaagcggaagcgcaaugaaaaaaccaggagcaaguguaagaguaagcuguuggacaagugaagacauauuugauacaacagaauuaauauauuggguaagacaagcaccaggacaaggauuagaauggauaggauggguaaaaauaguaucaggaacaguaaauuucgcaagcuuagacuuuagaaauagaauaagcuuaagcagagacagagacuuaaguacagcacauauggauauaagaggauuaagacaagacgauacagcaacauauuucugugcaagacaaaaauucgaaaguagauacucaggagaucaaggaaguuauuucgaucuauggggaagaggaacacuaauaauaguaagcucagcaucaacaaaaggaccaagcguauucccaacaauauacgua

SEQ ID NO: 49678 - RNA, 426 nt, Artificial Sequence
  derived and/or modified sequence opt6 from anti-HIV-1_HeavyChain
caaagucauuuagaacaaucgggaucagcaaugaaaaaaccaggagcaucaguaagaguaucauguuggacaagugaagauauauuugacacaacagaauuaauauacuggguaagacaagcacccggacaaggacuagaauggauaggauggguaaaaauaguaaguggaacaguaaacuuugcaucacuagauuucagaaacggaauaucacuaucaagagauagagauuuaucaacagcauacauggacauaagaggacuaacacaagaugacacagcaacauacuuuugcgcaagacaaaaauuugcaucaagauauaguggagaccaaggaucauacuuugacuuauggggaagaggaacauuaauaguaguaucaagugcaagcacaaaaggaccaucaguauuuccacaugacuuaaga

SEQ ID NO: 49679 - RNA, 426 nt, Artificial Sequence
  derived and/or modified sequence opt6 from anti-HIV-1_HeavyChain
caaagccaucuagaacaaucaggaucagcaaugaaaaaaccaggagcaucaguaagaguaucaugcuggacaucagaagauauauuugacacaacagaacuaauauacuggguaagacaagcaccaggacaaggacuagaauggauaggauggguaaaaauaguaagcggaacaguaaacuuugcaucacuagauuucagaaacagaauaucacuaucgagagauagagaucuaucaacagcacacauggacauaagaggacuaacacaagaugacacagcaacauacuuuugcgcaagacaaaaauuugcaucaagauauaguggagaccaaggaucauacuuugacuuauggggaagaggaacauuaauaguaguaucaagugcaagcacaaaaggaccaucaguauuuccacaugacuuaaga

SEQ ID NO: 49680 - RNA, 426 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagcggagauauauuaagaaaaagcgaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagcgcaaguacaaaaggaccaaguguauuuccacaugauuuaaga

SEQ ID NO: 49681 - RNA, 426 nt, Artificial Sequence
  derived and/or modified sequence opt6 from anti-HIV-1_HeavyChain
caaguacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacagugacaggggcaguaaauuuuggaaguuuagauuuuagacauagaauaaguuuaacaagagauagagaucuauuuacagcgcauauggauauaagaggauuaacacaaggagauacagcaacauauuuuugugcaagacaaaaauuugaaaguagauauacaggaggacaaggaugguauuuugauuuauggggaagaggaacacauauaguaguaaguagugcauguacaaaaggaccaaguguauuuccacaugauuuaaga

SEQ ID NO: 49682 - RNA, 426 nt, Artificial Sequence
  derived and/or modified sequence opt6 from anti-HIV-1_HeavyChain
caagcacauuuagaacaaaguuggaguggaguaaaaaaaccaggagcaaguguaagaguaaguuguuggaguagugaagauauauuugaaagaacagaauuaauacauuggguaaggcaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugacuuauggggaagaggaacacauauaguaguaaguagugcaaguacaaaaggaccaucaguauuuccacaugauuuaaga

SEQ ID NO: 49683 - RNA, 426 nt, Artificial Sequence
  derived and/or modified sequence opt6 from anti-HIV-1_HeavyChain
caaagccaucuagaacaaucaggaucagcaaugaaaaaaccaggagcaaguguaagaguaaguugcuggacaucagaagauauauuugaaagaacagaacuaauauacuggguaagacaagcaccaggaagaggaccagaauggauaggauggguaaaaacaguaagcggaacaguaaacuuuggaucaagcgauuucaggaacagaauaucacuaacaagagauagagaucuaucaacagcacacauggacauaagaggacuaacacaagaugacacagcaacauacuuuugcgcaagacaaaaauuugaaucauuauauagcgaugaccaaggaucauauuuugacuuauggggaagaggaacauuaauaauaguaagcagcgcaagcacaaaaggaccaucaguauuuccacaugaccuaaga

SEQ ID NO: 49684 - RNA, 426 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggaguagugaagauauauuugaaagaacagaauuaauacauuggguaagacaagcaccaggacaaggacuagaauggauaggauggguaaaaacaguaacaggagcaguaaauuuuggaaguuuagauuuuagacauagaauaaguuuaacaagagauagagauuuauuuacagcacauauggauauaagaggacuaacacaaggagauacagcaacauauuuuugugcaagacaaaaauuugaaaguagauauacaggaggacaaggaugguauuuugauuuauggggaagaggaacacauauaguaguaaguagugcaaguacaaaaggaccaaguguauuuccaacaauauuaaga

SEQ ID NO: 49685 - RNA, 426 nt, Artificial Sequence
  derived and/or modified sequence opt6 from anti-HIV-1_HeavyChain
caaagucauuuagaacaaaguggaagugcaaugaaaaaaccaggagcaucaguaagaguaaguuguuggacaagugaagauauauuugaaagaacagaauuaauauauuggguaagacaagcaccaggaagaggauuagaauggauaggauggguaaaaacaguaaguggaacaguaaauuuuggaaguagugauuuuagaaauagaauaucauuaacaagagacagagauuuaaguacagcacauauggauauaagaggauuaacacaagaugauacagcaacauauuuuugugcaagacaaaaauuugaaaguuuauauagugaugaucaaggaaguuauuuugauuuauggggaagaggaacauuaauagcaguaaguagugcaaguacaaaaggaccaaguguauuuccacaugauuuaagg

SEQ ID NO: 49686 - RNA, 426 nt, Artificial Sequence
  derived and/or modified sequence opt6 from anti-HIV-1_HeavyChain
caaagucauuuaaaacaaaguggaagugcaaugaaaaaaccaggagcaaguguaagaguaaguuguuggacaagugaagauauauuugaaagaacagaauuaauauauuggguaagacaagcaccaggaagaggauuagaauggauaggauggguaaaaacaguaaguggaacaguaaauuuuggaaguucagauuuuagaaauagaauaaguuuaacaagagauagagauuuaaguacagcacauauggauauaagaggauuaacacaagaugauacagcaacauauuuuugugcaagacaaaaauuugaaaguuuauauucagaugaucaaggaaguuauuuugauuuauggggaagaggaacauuaauaauaguaaguagugcaagcacaaaaggaccaaguguauuuccacaugauuuaaga

SEQ ID NO: 49687 - RNA, 426 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaaggcaagcaccaggacaaggauuagaauggauagaauggguaaaagcaguaucaggagcaguaaauuauggaaguuuagauuuuaggcauagaguaaguuuaacaagagauagagauuuauuuacagcacauauggauauaagaggauuaacacaagaugauacagcaacauauuuuugugcaagacaaaaauuugaaagcagauauacaggaggacaaggaugguauuuugauuuaugggguagaggaacacauauaguaguaaguucagcaucaacaaaaggaccaaguguauuuccacaugauuuaaga

SEQ ID NO: 49688 - RNA, 426 nt, Artificial Sequence
  derived and/or modified sequence opt6 from anti-HIV-1_HeavyChain
caaagccaucuagaacaaucaggaucagcaaugaaaaaaccaggagcaucaguaaggguaucaugcuggacaucagaagauauauuugacacaacagaacuaauauacuggguaagacaagcaccaggacaaggacuagaauggauaggauggguaaaaauaguaagcggaacaguaaacuuugcaucacuagauuucagaaacagaauaucacuaucgagagauagagauuuaucaacagcacacauggacauaagaggacuaacacaagaugacacagcaacauacuuuugcgcaagacaaaaauuugaaucaagauauagcggagaccaaggaucauacuuugacuuauggggaagaggaacauuaauaauaguaucaagcgcaagcacaaaaggaccaucaguauuuccacaugacuuaaga

SEQ ID NO: 49689 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaagucuagauuuuagaaauagaauaagucuaaguagagauagagaucuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaagcagugcaaguacaaaaggaccaaguguauuuccacaugauuuaaga

SEQ ID NO: 49690 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaagugaauuaauacauuggguaagacaagcaccgggacaaggauuagaauggauaggauggguaaaaacaguaacaggagcaguaaauuuuggaaguccaaauuuuagacaaagaguaaguuuaaguagagauagagauuuaaguacagcacauauggauauaagaggauuaacacaagaugauacagcaacauauuuuugugcaagacaaaaauuugcaaguagauauaguggagaucaaggaaguuauuuugauuuauggggaagaggaacauuaauaauaguaaguagugcaaguacaaaaggaccaaguguauuuccacaugauuuaaga

SEQ ID NO: 49691 - RNA, 426 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugaaagaacggaacuaauauauuggguaagacaagcaccaggaagaggauuagaauggauaggauggguaaaaacaguaaguggaacaguaaauuuuggaaguagugauuuuagaaauagaauaaguuuaacaagagauagagauuuaaguacagcacauauggauauaagaggauuaacacaagaugauacagcaacauauuuuugugcgagacaaaaauuugaaaguuuauauagugaugaucaaggaaguuauuuugauuuauggggaagaggaacauuaauaauaguaaguagugcaaguacaaaaggaccaaguguauuuccacaugauuuaaga

SEQ ID NO: 49692 - RNA, 426 nt, Artificial Sequence
  derived and/or modified sequence opt6 from anti-HIV-1_HeavyChain
caagcacauuuagaacaaucaggaucaggaguaaaaaaaccaggagcaucaguaagaguaucaugcuggacaucagaagauauauuugaaagaacagaacuaauacacuggguaagacaagcaccaggaagaggacuagaauggauaggauggguaaaaacaguaagcggaacaguaaacuuuggaucaagcgauuucagaaacagaauaagucuaacaagagauagagauuuaucaacagcacacauggauauaagaggacuaacacaagaugauacagcaacauacuuuugugcaagacaaaaauuugaaucacuauauagcgaugaccaaggaaguuacuuugacuuauggggaagaggaacauuaauaauaguaucaagcgcaagcacaaaaggaccaucaguauuuccacaugacuuaaga

SEQ ID NO: 49693 - RNA, 426 nt, Artificial Sequence
  derived and/or modified sequence opt6 from anti-HIV-1_HeavyChain
caaguacauuuagaacaaagcggaagcggaguaaaaaaaccaggagcaaguguaagaguaaguuguuggucaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagacuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagugcaagcacaaaaggaccaagcguauucccacaugauuuaaga

SEQ ID NO: 49694 - RNA, 426 nt, Artificial Sequence
  derived and/or modified sequence opt6 from anti-HIV-1_HeavyChain
caaagucauuuagaacaaaguggaagcgcaaugaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaagcuuagauuuuagaaauagaauaagucuaaguagagauagagauuuaaguacagcacauauggauauaagaggauuaagacaagaugauacagcaacauauuuuugugcaagacaaaaauuugaaaguagauauaguggagaucaaggaaguuauuuugauuuauggggaagaggaacauuaauaauaguaagcagugcaaguacaaaaggaccaaguguauuuccacaugauuuaaga

SEQ ID NO: 49695 - RNA, 423 nt, Artificial Sequence
  derived and/or modified sequence opt6 from anti-HIV-1_HeavyChain
caaguauauauggaacaagcaggagcaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaguagcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaaguucagcaucaacaaaaggaccaaguguauuuccacaugauuuaaga

SEQ ID NO: 49696 - RNA, 426 nt, Artificial Sequence
  derived and/or modified sequence opt6 from anti-HIV-1_HeavyChain
caaucacacuuagaacaaagcggaagugcaaugaaaaaaccaggagcaagcguaagaguaagcuguuggacaagcgaagacauauucgacacaacagaauuaauauauuggguaagacaagcaccaggacaaggauuagaauggauaggauggguaaaaauaguaucaggaacaguaaauuucgcaagcuuagacuuuagaaauagaauaagcuuaucaagagacagaaaccuaagcacagcacauauggauauaagaggauuaagacaagacgauacagcaacauauuucugugcaagacaaaaauucgaaagcagauacucaggagaucaaggaaguuauuucgaucuauggggaagaggaacauuaauaauaguaagcucagcaucaacaaaaggaccaagcguauucccacacgaucuaaga

SEQ ID NO: 49697 - RNA, 423 nt, Artificial Sequence
  derived and/or modified sequence opt6 from anti-HIV-1_HeavyChain
caaguacaacuaguacaaaguggagcagaaguaaaaaaaccaggagcaaguguaacauuaaguuguaaaacagcagaugaagauguauuugaugcagcauauaugcauuggguaagacaagcaccaggacaaacauuugaauggcuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaagcggagauaauagaggauauuuuuuugauuuauggggaagaggaaguagaguaauaguaaguagugcaaguacaaaaggaccaaguguauuuccaacaauauaugua

SEQ ID NO: 49698 - RNA, 426 nt, Artificial Sequence
  derived and/or modified sequence opt6 from anti-HIV-1_HeavyChain
caagcacauuuagaacaaucaggaucaggaguaaaaaaaccaggagcaucaguaagaguaaguuguuggacaagugaagauauauuugaaagaacagaauuaguacacuggguaagacaagcaccaggacaaggauuagaauggauaggauggguaaaaacaguaacaggagcaguaaauuuuggaucaccaaauuuuagacaaagaguaucauuaacaagagauagagauuuauuuacagcacauauggauauaagaggauuaacacaagaugacacagcaacauauuuuugugcaagacaaaaauuugcaucaagauauaguggagaucaaggaucauauuuugauuuauggggaagaggaacauuaauaguaguaucaagugcaagcacaaaaggaccaucaguauuuccacaugauuuaaga

SEQ ID NO: 49699 - RNA, 426 nt, Artificial Sequence
  derived and/or modified sequence opt6 from anti-HIV-1_HeavyChain
caaagucauuuagaacaaucaggaucagcaaugaaaaaaccaggagcaaguguaagaguaucauguuggacaucagaagauauauuugacacaacagaauuaauauacuggguaagacaagcaccaggacaaggacuagaauggauaggauggguaaaaauaguaagcggaacaguaaacuuugcaagucuagauuucagaaacagaauaucacuaucaagagauagagauuuaaguacagcauacauggacauaagaggacuaacacaagaugacacagcaacauauuuuugugcaagacaaaaauuugcaucaagauauagcggagaccaaggaucauacuuugacuuauggggaagaggaacauuaauaauaguaucaagugcaagcacaaaaggaccauuaggauuaccacaugacuuaaga

SEQ ID NO: 49700 - RNA, 426 nt, Artificial Sequence
  derived and/or modified sequence opt6 from anti-HIV-1_HeavyChain
caagcacauuuagaacaaagcggaaguggaguaaaaaaacuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaacauauuuuugugcaagacaaaaauuugcaaguagauauucaggagaucaaggaagcuauuuugauuuauggggaagaggaacauuaauaguuguaaguucagcaucaacaaaaggaccaaguguauuuccacaugauuuaaga

SEQ ID NO: 49701 - RNA, 426 nt, Artificial Sequence
  derived and/or modified sequence opt6 from anti-HIV-1_HeavyChain
caagcacaucuagaacaaucaggaucaggaguaaaaaaaccaggagcaucaguaagaguaucaugcuggacaucagaagauauauuugaaagaacagaacuaauauacuggguaagacaagcaccaggacaaggacuagaauggauaggauggguaaaaauaguaagcggaacaguaaacuuugcaucacuagauuucagaaacagaauaucauuaucaagagauagagaucuaucaacagcacacauggacauaagaggauuaacacaagaugacacagcaacauacuuuugcgcaagacaaaaauuugcaucaagauauagcggagaccaaggaucauacuuugacuuauggggaagaggaacauuaauaauaguaucaagcgcaagcacaaaaggaccaucaguauuuccacaugacuuaaga

SEQ ID NO: 49702 - RNA, 426 nt, Artificial Sequence
  derived and/or modified sequence opt6 from anti-HIV-1_HeavyChain
caagcacacuuagaacaaagcggaagcggaguaaaaaaaccaggagcaagcguaagaguaagcuguuggacaagugaagacauauucgaaagaacagaauuaauacauuggguaagacaagcaccaggacaaggauuagaauggauaggauggguaaaaacaguaacaggagcaguaaauuucggaagcccaaacuuuagaaauagaauaagcuuaacaagagacagagacuuaagcacagcacauauggauauaagaggauuaacacaagaugauacagcaacauauuucugugcaagacaaaaauucgaaagcuuauacucagacgaucaaggaaguuauuucgaucuauggggaagaggaacauuaauaauaguaagcucagcaucaacaaaaggaccaaguguauucccacacgaucuaaga

SEQ ID NO: 49703 - RNA, 426 nt, Artificial Sequence
  derived and/or modified sequence opt6 from anti-HIV-1_HeavyChain
caagcacaucuugaacaaucaggaucaggaguaaaaaaaccaggagcaucaguaagaguaucauguuggacaucagaagauauauuugaaaaaagugaauuaauacauuggguaagacaagcaccaggacaaggauuagaauggauaggauggguaaaaacaguaacaggagcaguaaauuuuggaaguagugauuuuagacaaagaguaucauuaacaagagauagagauuuauuuacagcacauauggauauaagaggauuaacacaaggagauacagcaacauauuuuugcgcaagacaaaaauuugaaucauuauauagugaugaucaaggaucauauuuugaucuauggggaagaggaacauuaauaauaguaucaagugcaaguacaaaaggaccaagcguauuuccacaugauuuaaga

SEQ ID NO: 49704 - RNA, 426 nt, Artificial Sequence
  derived and/or modified sequence opt6 from anti-HIV-1_HeavyChain
caagcacaucuagaacaaucaggaucaggaguaaaaaaaccaggagcaucaguaagaguaucaugcuggacaucagaagauauauuugaaagaacagaauuaauacacuggguaagacaagcaccaggacaaggacuagaauggauaggauggguaaaaacaguaacaggagcaguaaacuuuggaucaagcgauuucagaaacagaauaucacuaacaagagauagagaucuaucaacagcacacauggacauaagaggacuaacacaagaugacacagcaacauacuuuugcgcacgacaaaaauuugaaucacuauauagcgaugaccaaggaucauacuuugacuuauggggaagaggaacacuaauaauaguaucaagugcaagcacaaaaggaccaucaguauuuccacaugaccuaaga

SEQ ID NO: 49705 - RNA, 426 nt, Artificial Sequence
  derived and/or modified sequence opt6 from anti-HIV-1_HeavyChain
caaagccaucuagaacaaucaggaucagcaaugaaaaaaccaggagcaucagcaagaguaucaugcuggacaucagaagauauauuugacacaacagaacuaauauauuggguaagacaagcaccaggacaaggacuagaauggauaggauggguaaaaauaguaagcggaacaguaaacuuugcaucauuagauuucagaaacagaauaucacuaucaagagauagagaucuaucaacagcacacauggacauaagaggacuaacacaagaugacacagcaacauacuuuugugcaagacaaaaauuugcaucaagauauagcggagaccaaggaucauacuuugacuuauggggaagaggaacacauauaguaguaucaucagcaagcacaaaaggaccaucaguauuuccacaugaccuaaga

SEQ ID NO: 49706 - RNA, 426 nt, Artificial Sequence
  derived and/or modified sequence opt6 from anti-HIV-1_HeavyChain
caagcacauuuagaacaaaguggaaguggaguaaaaaaauuaggagcaagcguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacggcaacauauuuuugugcaagacaaaaauuugaaaguagauauacaggaggacaaggaugguauuuugauuuauggggaagaggaacacauauaguaguaaguagugcaaguacaaaaggaccaaguguauuuccacaugauuuaaga

SEQ ID NO: 49707 - RNA, 426 nt, Artificial Sequence
  derived and/or modified sequence opt6 from anti-HIV-1_HeavyChain
caagcacauuuagaacaaaguggaaguggaguaaaaaaauuaggagcaagugugagagugaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacacagaguaaguuuaacaagagauagagauuuaaguacagcacauauggauauaagaggauuaacacaagaugauacagcaacauauuuuugugcaagacaaaaauuugaaaguagauauacaggaggacaaggaugguauuuugauuuauggggaagaggaacacauauaguaguaaguagugcaaguacaaaaggaccaaguguauuuccacaugauuuaaga

SEQ ID NO: 49708 - RNA, 426 nt, Artificial Sequence
  derived and/or modified sequence opt6 from anti-HIV-1_HeavyChain
caaagccaucuagaacaaucaggaagugcaaugaaaaaaccaggagcaucaguaagaguaucaugcuggacaucagaagauauauuugaaagaacagaacuaauauacuggguaagacaagcaccaggaagaggacuagaauggauaggaugggucaaaacaguaagcggaacaguaaacuuuggaucaagcgauuucagaaacagaauaucacuaacaagagauagagaucuaaguacagcacacauggacauaagaggauuaacacaagaugacacagcaacauacuuuugcgcaagacaaaaauuugcaucaagauauagcggagaccaaggaucauacuuugacuuaugggggagaggaacauuaauaauaguaucaagcgcaagcacaaaaggaccaucaguauuuccacaugacuuaaga

SEQ ID NO: 49709 - RNA, 426 nt, Artificial Sequence
  derived and/or modified sequence opt6 from anti-HIV-1_HeavyChain
caaagccaucuagaacaaucgggaucagcaaugaaaaaaccaggagcaucaguaagaguaucaugcuggacaucagaagauauauuugaaagaacagaacuaauauacuggguaaggcaagcaccaggaagaggacuagaauggauaggauggguaaaaacaguaaguggaacaguaaacuuuggaaguagcgauuucagaaacagaauaucacuaacaagagauagagauuuaucaacagcaagaauggacauaagaggacuaacacaagaugacacagcaacauacuuuugcgcaagacaaaaauuugaaucacuauauagcgaugaccaaggaucauacuuugacuuauggggaagaggaacauuaauaauaguaaguagcgcaagcacaaaaggaccaucaguauuuccaacagacuuaaga

SEQ ID NO: 49710 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaaaaagugaacuaauacauuggguaagacaagcaccaggacaaggauuagaauggauaggauggguaaaaacagugacaggagcaguaaauuuuggaaguagugauuuuagacaaagaguaagcuuaacaagagauagagauuuauuuacagcacauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagcgcaaguacaaaaggaccaagcguauuuccacaugauuuaaga

SEQ ID NO: 49711 - RNA, 426 nt, Artificial Sequence
  derived and/or modified sequence opt6 from anti-HIV-1_HeavyChain
caaagccauuuagaacaaaguggaagugcaaugaaaaaaccaggagcaaguguaagaguaaguuguuggacaagcgaagauauauuugaaagaacagaauuaauauauuggguaagacaagcaccaggaagaggauuagaauggauaggauggguaaaaacaguaaguggaacaguaaauuuuggaaguagugauuuuagaaauagaauaaguuuaacaagagauagagauuuaaguacagcacauauggauauaagaggauuaacacaagaugauacagcaacauauuuuugugcaagacaaaaauuugaaaguuuauauagugaugaucaaggaaguuauuuugauuuauggggaagaggaacauuaauaauaguaagcagugcaagcacaaauggaccaauaggauuaccacaugauuuaaga

SEQ ID NO: 49712 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagacacagcaacauauuuuugugcaagacaaaaauuugaaaguagauauacaggaggacaaggaugguauuuugauuuauggggaagaggaacacauauaguaguaaguagugcaaguacaaaaggaccaaguguauuuccacaugauuuaaga

SEQ ID NO: 49713 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaagaugauacagcaacauauuuuugugcaagacaaaaauuugcaaguagguauaguggagaucaaggaaguuauuuugaucuauggggaagaggaacauuaauaguaguaaguagugcaaguacaaaaggaccaaguguauuuccacaugauuuaaga

SEQ ID NO: 49714 - RNA, 426 nt, Artificial Sequence
  derived and/or modified sequence opt6 from anti-HIV-1_HeavyChain
caaagucaucuagaacaaucgggaucagcaaugaaaaaaccaggagcaucaguaagaguaucaugcuggacaucagaagauauauuugaaagaacaggauuaauauacuggguaagacaagcaccaggaagaggacuagaauggauaggauggguaaaaacaguaagcggaacaguaaacuuuggaucaagcgauuucagaaacagaauaucacuaacaagagauagagaucuaucgacagcacacauggacauaagaggauuaacacaagaugacacagcaacauacuuuugcgcaagacaaaaauuugaaucacuauauagcgaugaccaaggaucauacuuugacuuauggggaagaggaacauuaauaauaguaucaagcgcaagcacaaaaggaccaucaguauuuccacaugacuuaaga

SEQ ID NO: 49715 - RNA, 426 nt, Artificial Sequence
  derived and/or modified sequence opt6 from anti-HIV-1_HeavyChain
caagcacauuuagaacaaaguggaaguggaguaaaaaaaccaggagcaagcgugagaguaaguuguuggacaagugaagauauauuugaaagaacagaauuaauacauuggguaagacaagcaccaggacaaggacuagaauggauaggauggguaaaaacaguaacaggagcaguaaauuuuggaagucaaauauuuagacauagaauaaguuuaacaagagauagagauuuauuuacagcacauauggauauaagaggauuaacacaaggagauacagcaacauauuuuugugcaagacaaaaauuugaaagcagauauacaggaggacaaggaugguauuuugauuuauggggaagaggaacacauauaguaguaaguagugcaaguacaaaaggaccaaguguauuuccacaugauuuaaga

SEQ ID NO: 49716 - RNA, 426 nt, Artificial Sequence
  derived and/or modified sequence opt6 from anti-HIV-1_HeavyChain
caaagucauuuagaacaaucaggaucagcaaugaaaaaaccaggagcaaguguaagaguaucauguuggacaucagaagauauauuugauacaacagaauuaauacauuggguaagacaagcaccaggacaaggauuagaauggauaggauggguaaaaacaguaacaggagcaguaaauuuuggaucauuagauuuuagacauagaauaagucuaacaagagauagagauuuauuuacagcacauauggauauaagaggauuaacacaaggagauacagcaacauauuuuugcgcaagacaaaaauuugaaagucgauauacaggaggacaaggaugguauuuugauuuauggggaagaggaacacauauaguaguaucaagugcaaguacaaaaggaccaucaguauuuccacaugaucuaaga

SEQ ID NO: 49717 - RNA, 426 nt, Artificial Sequence
  derived and/or modified sequence opt6 from anti-HIV-1_HeavyChain
caaagccaucuagaacaaucaggaucagaaguaaaaaaaccaggagcaucaguaagaguaucaugcuggacaucagaagauauauuugaaagaacagaacuaauauacuggguaagacaagcaccaggaagaggacuagaauggauaggauggguaaaaacaguaagcggaacaguaaacuuuggaucaagcgauuucagaaacagaauaucacuaacaagagauagagaucuaucaacagcacacauggacauaagaggauuaacacaagaugacacagcaacauacuuuugcgcaagacaaaaauuugaaucacuauauagcgaugaccaaggaucauacuuugacuuauggggaagaggaacacuaauaauaguaucaagcgcaagcacaaaaggaccaucaguauuuccacaugacuuaaga

SEQ ID NO: 49718 - RNA, 423 nt, Artificial Sequence
  derived and/or modified sequence opt6 from anti-HIV-1_HeavyChain
caaguauauauggaacaagcaggaggaggaguaaaaaaaccaggagcaaguguaacacuaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagugcaaguacaaaaggaccaaguguauuuccacaugauuuaaga

SEQ ID NO: 49719 - RNA, 426 nt, Artificial Sequence
  derived and/or modified sequence opt6 from anti-HIV-1_HeavyChain
caaagccaucuagaacaaucaggaucagaaguaaaaaaaccaggagcaucaguaagaguaucaugcuggacaucagaagauauauuugauacaacagaacuaauauacuggguaagacaagcaccaggacaaggauuagaauggauaggauggguaaaaauaguaagcggaacaguaaacuuugcaucacuagauuucagaaacagaauaucacuaucaagagauagagaucuaucaacagcacacauggacauaagaggacuaacacaagaugacacagcaacauacuuuugcgcaagacaaaaauuugcaaguagauauaguggagaccaaggaucauacuuugacuuauggggaagaggaacacuaauaauaguaaguagcgcaagcacaaaaggaccaucaguauuuccacaugaccuaaga

SEQ ID NO: 49720 - RNA, 426 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagugcaaguacaaaaggaccaaguguauuuccacaugauuuaaga

SEQ ID NO: 49721 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaucauguuggaguagugaagauauauuugaaagaacagaauuaauacauuggguaagacaagcaccaggacaaggauuagaauggauaggauggguaaaaacaguaacaggagcaguaaauuuuggaagcuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugaucuauggggaagagggacacauauaguaguaaguagugcaagugcaaaaggaccaaguguguuuccacaugauuuaaga

SEQ ID NO: 49722 - RNA, 426 nt, Artificial Sequence
  derived and/or modified sequence opt6 from anti-HIV-1_HeavyChain
caaagccaucuagaacaaucaggaucagcaaugaaaaaaccaggagcaucaguaagaguaaguugcuggacaagugaagauauauuugaaagaacagaacuaauauacuggguaagacaagcaccaggaagaggacuagaauggauaggauggguaaaaacaguaaguggaacaguaaacuuuggaucaagcgauuucagaaacagaauaucacuaacaagagauagagauuuaucaacagcacauauggacauaagaggacuaacacaagaugacacagcaacauacuuuugcgcaagacaaaaauuugaaucacuauauagugaugaccaaggaucauacuuugacuuguggggaagagggacacuaauaguaguaucaagcgcaagcacaaaaggaccaucaguauuuccaccaagaagugca

SEQ ID NO: 49723 - RNA, 426 nt, Artificial Sequence
  derived and/or modified sequence opt6 from anti-HIV-1_HeavyChain
caaguacauauggaacaagcaggaggaggaguaaaaaaaccaggagcaaguguaacauuaaguuguaaaacagcagaugaagauguauuugaugcggcauauaugcacuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaaucuaagauuugaugauacagcaguauauuuuugugcaagaaaaacaaaaggagauguaagcggagaugauagaggauuuuuuuuugauuuauggggaagaggaacaagaguaauaguaaguagugcaaguacaaaaggaccauuaagaaguuuuccaagaagaagugca

SEQ ID NO: 49724 - RNA, 426 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaagcuuagauuuuagacauagaauaagucuaacaagagauagagauuuauuuacagcacauauggauauaagaggacuaacacaaggagauacagcaacauauuuuugugcaagacaaaaauuugaaaguagauauacaggaggacaaggaugguauuuugacuuauggggaagaggaacacauauaguaguaaguagugcaaguacaaaaggaccaaguguauuuccaacaauauaugua

SEQ ID NO: 49725 - RNA, 426 nt, Artificial Sequence
  derived and/or modified sequence opt6 from anti-HIV-1_HeavyChain
gaaagucaucuagaacaaucaggaucagcaaugaaaaaaccaggagcaucaguaagaguaucaugcuggacaucagaagauauauuugacacgacagaacuaauauacuggguaagacaagcaccaggacaaggacuagaauggauaggauggguaaaaauaguaagcggaacaguaaacuuugcaucacuagauuucagaaacagaauaucacuaucaagagauagagauuuaucaacagcacacauggacauaagagggcuaacacaagaugacacagcaacauacuuuugcgcaagacaaaaauuugcaucaagauauagcggagaccaaggaucauacuuugacuuguggggaagaggaacauuaauaauaguaucaagcgcaagcacaaaaggaccaucgguauuuccacaugaccuaaga

SEQ ID NO: 49726 - RNA, 429 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagacauauuugaaagaacagaauuaauacauuggguaagacaagcaccaggacaaggauuagaauggauaggauggguaaaaauaguaaguggagcaguaaauuuuggaucaccaaauuuuagacaaagaguaaguuuaacaagagauagagauuuauuuacagcacauauggauauaagaggauuaacacaagaugacacagcaacauauuuuugugcaagacaaaaauuugcaaguagauauaguggagaucaaggaaguuauuuugauuuauggggaagaggaacauuaauaguaguaaguagcgcaaguacaaaaggaccaaguggauuaccaccaagaaguugugua

SEQ ID NO: 49727 - RNA, 423 nt, Artificial Sequence
  derived and/or modified sequence opt6 from anti-HIV-1_HeavyChain
caaguacaucuaguacaaucaggagcagaaguaaaaaaaccaggagcaucaguaaaaguaucaugcaaagcaucaggauauacauuuacaacaagcggaauacauugguuaagacaaguaccaggacaaagaccagaauggaugggauggauaagaccaaaaacaggagcaagaaaucaagcaagacaauuccaaccaagaauaucucuaacaagagauagagcauuaucaacagcauacuuagacuuaaacucacuaacaucagcagacucaggaacauacuuuugcgcaagacaaacauuuaaaccagacuuuuacuuugcagaucaaggauggucauucaaucuauggggaagaggagcucacuuuauaguaagcucagcaucaacaaaaggaccaucaguauucccacacgaucuaaga

SEQ ID NO: 49728 - RNA, 429 nt, Artificial Sequence
  derived and/or modified sequence opt6 from anti-HIV-1_HeavyChain
caagcacaucuagaacaaaguggaaguggaguaaaaaaaccaggagcaaguguaagaguaucauguuggaguagugaagauauauuugaaagaacagaauuaauacauuggguaagacaagcaccaggacaaggauuagaauggauaggauggguaaaaacaguaacaggagcaguaaauuuuggaucauuagauuuuagacauagaauaucauuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaucaagugcaagcacacaaggaccaauaggauuaccaccaagauuaugugua

SEQ ID NO: 49729 - RNA, 426 nt, Artificial Sequence
  derived and/or modified sequence opt6 from anti-HIV-1_HeavyChain
caaagccaucuagaacaaucaggaucagcaaugaaaaaaccaggagcaucgguaagaguaucaugcuggacaucagaagauauauuugacacaacagaacuaauauacuggguaagacaagcaccaggacaaggauuagaauggauaggauggguaaaaauaguaagcggaacaguaaacuuugcaucacuagauuucagaaacagaauaucauuaucaagagauagagaucuaucaacagcacacauggacauaagaggauuaacacaagaugacacagcaacauacuuuugcgcaagacaaaaauuugcaucaagauauagcggagaccaaggaucauacuuugacuuauggggaagaggaacauuaauaauaguaucaagcgcaagcacaaaaggaccaauaggauuaccaccaagaucaaca

SEQ ID NO: 49730 - RNA, 426 nt, Artificial Sequence
  derived and/or modified sequence opt6 from anti-HIV-1_HeavyChain
caagcacauuuagaacaaucaggaaguggaguaaaaaaaccaggagcaaguguaagaguaaguuguuggacaagugaagacauauuugaaaaaagugaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugaucuauggggaagagggacacauauaguaguaagcagcgcaaguacaaaagggccaaguguauuuccaacaauaugugua

SEQ ID NO: 49731 - RNA, 426 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaagcuuagauuuuagacauagaguaaguuuaacaagagauagagauuuauuuacagcacauauggauauaagaggauuaacacaaggggauacagcaacauauuucugugcaagacaaaaauuugaaaguagauauacaggaggacaaggaugguauuuugauuuauggggaagaggaacacauauaguaguaaguagugcauuacaucaaggaccaauaggauuaccaccaagaaguaca

SEQ ID NO: 49732 - RNA, 429 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagcgaagauauauuugauacaacagaauuaauauauuggguaagacaagcaccaggacaaggauuagaauggauaggguggguaaaaauaguaaguggaacaguaaauuuugcaaguuuagauuuuagaaauagaguaaguuuaagcagagauagagauuuaaguacagcauauauggauauaagaggauuaacacaagaugauacagcgacauauuuuugugcaagacaaaaauuugcaaguagauauaguggagaucaaggaaguuauuuugauuuauggggaagaggaacauuaauaguaguaagcagugcauuacaucaaggaccaauaggaccaucaccaacaauauuaaga

SEQ ID NO: 49733 - RNA, 426 nt, Artificial Sequence
  derived and/or modified sequence opt6 from anti-HIV-1_HeavyChain
caaagccaucuagaacaaaguggaucagcaaugaaaaaaccaggagcaucaguaagaguaagcugcuggacaucagaagauauauuugacacaacagaacuaauauacuggguaagacaagcaccaggacaaggacuagaauggauaggauggguaaaaauaguaagcggaacaguaaauuuugcaucauuagauuucagaaacagaauaucacuaucaagagacagagaucuaucaacagcacacauggacauaagaggacuaacacaagaugacacagcaacauacuuuugcgcaagacaaaaauuugcaucaagauauagcggagaccaaggaucauacuuugacuuauggggaagaggaacauuaauaauaguaucaagugcaagcacaaaaggaccaucaguauuuccaacaauauaugua

SEQ ID NO: 49734 - RNA, 426 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagugaagauauauuugauacaacagaauuaauauauuggguaagacaagcaccaggacaaggauuagaauggauaggaugggugaaaauaguaaguggaacaguaaauuuugcaaguuuagauuuuagaaauagaauaaguuuaaguagagauagagauuuaaguacagcauauauggauauaagaggauuaacacaagaugauacagcaacauauuuuugugcaagacaaaaauuugaaagcagauauacaggaggacaaggaugguauuuugauuuauggggaagaggaacacauauaguaguaagcagugcaucaacaaaaggaccaaguguauuuccaacaauaugugua

SEQ ID NO: 49735 - RNA, 426 nt, Artificial Sequence
  derived and/or modified sequence opt6 from anti-HIV-1_HeavyChain
caaguacaauuaguacaaaguggagcagaaguaaaaaaaccaggagcaaguguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaaguagggauagagauuuaaguacagcacauauggauauaagaggauuaacacaagaugauacagcaacauauuuuugugcaagacaaaaauuugaaaguagauauacaggaggacaaggaugguauuuugauuuauggggaagaggaacacacauaguaguaaguagugcaaguacaaaaggaccaaguguauuuccaacaauaugugua

SEQ ID NO: 49736 - RNA, 426 nt, Artificial Sequence
  derived and/or modified sequence opt6 from anti-HIV-1_HeavyChain
agaagacauuuagaacaaaguggaaguggaguaaaaaaaccaggagcaaguguaagaguaagcuguuggagcagugaagauauauuugaaagaacagaauuaauacauuggguaagacaagcaccaggacaaggauuagaauggauaggauggguaaaaacaguaacaggagcaguaaauuuuggaucauuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagugcaaguacaaaaggaccaaguguauuuccacaugauuuaaga

SEQ ID NO: 49737 - RNA, 426 nt, Artificial Sequence
  derived and/or modified sequence opt6 from anti-HIV-1_HeavyChain
caaagccaucuagaacaaucaggaucagcaaugaaaaaaccaggagcaucaguaagaguaucaugcuggacaucagaagauauauuugacacaacagaacuaauauacuggguaagacaagcaccaggacaaggacuagaauggauaggauggguaaaaauaguaagcggaacaguaaacuuugcaucguuagauuucagaaacagaauaucacuaucaagagauagagaucuaucaacagcauacauggacauaagaggacuaacacaagaugacacggcaacauacuuuugcgcaagacaaaaauuugaaucaagauauagcggagaccaaggaucauacuuugacuuauggggaagaggaacauuaauaauaguaucaagcgcaagcacaaaaggaccaucaguauuuccaacaauaugugua

SEQ ID NO: 49738 - RNA, 429 nt, Artificial Sequence
  derived and/or modified sequence opt6 from anti-HIV-1_HeavyChain
caagcacauuuagaacaaucaggaucaggaguaaaaaaaccaggagcaucaguaagaguaucaugcuggacaucagaagauauauuugaaagaacagaauuaauacacuggguaagacaagcaccaggacaaggacuagaauggauaggauggguaaaaacaguaacaggagcaguaaauuuuggaucauuagauuuuagacacagaauaagucuaacaagagauagagauuuauuuacagcacacauggacauaagaggauuaacacaaggagauacagcaacauauuuuugcgcaagacaaaaauuugaaucaagauauacaggaggacaaggaugguauuuugauuuauggggaagaggaacacauauaguaguaucaagcgcaaguacaaaaggaccacauccaguauucccacaugauuuacca

SEQ ID NO: 49739 - RNA, 426 nt, Artificial Sequence
  derived and/or modified sequence opt6 from anti-HIV-1_HeavyChain
caagcacauuuagaacaaagcggaagugggguaaaaaaauuaggagcaaguguaagaguaagcuguuggacaagugaagacauauuugaaagaacagaauuaauauauuggguaagacaagcaccaggacaaggauuagaauggauaggauggguaaaaauaguaucaggaacaguaaauuuugcaaguuuagauuuuagaaauagaauaagucuaaguagagauagagauuuaaguacagcuuauauggauauaagaggauuaacacaagaugauacagcaacauauuuuugugcaagacaaaaauuugcaaguagauauaguggagaucaaggaaguuauuuugaucuauggggaaggggaacacuaauaguaguaaguucagcaucaacaaaaggaccaaguguauuuccgacaauauaugua

SEQ ID NO: 49740 - RNA, 429 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagcgaagauauauuugaaagaacagaauuaauacauugggcaagacaagcaccaggacaaggauuagaauggauaggauggguaaaaacaguaacaggagcaguaaauuuuggaagucuagauuuuagacauagaauaaguuuaacaagagauagggauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagugcaaguacaaaaggaccauuaggauuaccaccaagauuaaguaga

SEQ ID NO: 49741 - RNA, 426 nt, Artificial Sequence
  derived and/or modified sequence opt6 from anti-HIV-1_HeavyChain
caaucacaccuagaacaaucaggaucagcaaugaaaaaaccaggagcaucaguaagaguaucaugcuggacaucagaagauauauuugacacaacagaauuaauauacuggguaagacaagcaccaggacaaggacuagaauggauaggauggguaaaaauaguaucaggaacaguaaacuuugcaucacuagacuucagaaacagaauaucacuaucaagagacagagacuuaucaacagcacacauggauauaagaggacuaacacaagaugacacagcaacauacuucugcgcaagacaaaaauuugcaucaagauauucaggagaccaaggaaguuacuuugacuuauggggaagaggcacauuaauaauaguaucaucagcaucaacaaaaggaccaucaggauuaccaccaagaucagca

SEQ ID NO: 49742 - RNA, 426 nt, Artificial Sequence
  derived and/or modified sequence opt6 from anti-HIV-1_HeavyChain
caaguacaacuaguacaaucaggagcagaaguaaaaaaaccaggagcaucaguaagaguaucaugcuggacaucagaagauauauuugacacaacagaauuaauauacuggguaagacaagcaccaggacaaggauuagaauggauaggauggguaaaaauaguaagcggaacaguaaacuuugcaucacuagauuuuagaaacagaauaucauuaucaagagauagagauuuaucaacagcacacauggacauaagaggacuaagacaagaugacacagcaacauauuuuugugcaagacaaaaauuugaaaguagauauaguggagaucaaggaucauauuuugacuuauggggaagaggaacauuaauaauaguaucaagugcaaguacaaaaggaccaucaguauuuccacaugacuuaaga

SEQ ID NO: 49743 - RNA, 426 nt, Artificial Sequence
  derived and/or modified sequence opt6 from anti-HIV-1_HeavyChain
gaagcacaucuagaacaaaguggaaguggaguaaaaaaaccaggagcaaguguacgaguaaguuguuggacaagugaagauauauuugaaagaacagaauuaauacauuggguaagacaagcaccaggacaaggauuagaauggauaggauggguaaaaauaguaaguggaacaguaaauuuugcaaguuuagauuuuagaaauagaauaaguuuaaguagagauagagauuuaaguacagcauauauggauauaagaggauuaacacaagaugauacagcaacauauuuuugugcaagacaaaaauuugcaaguagauauagcggagaucaaggaaguuauuuugauuuauggggaagaggaacauuaauaguaguaaguagugcaaguacaaaaggaccaucaguauuuccacaugauuuaaga

SEQ ID NO: 49744 - RNA, 423 nt, Artificial Sequence
  derived and/or modified sequence opt6 from anti-HIV-1_HeavyChain
caaguacaacuaguacaaucaggagcagaaguaaaaaaaccaggagcaucaguaaaaguaucaugcagagcaucaggauauacauuuggaaaucacgcaauaucauggguaagacaagcaccaggacaaggauuagaauggaugggauggauaagaccaaaaacaggagcaagaaaucaagcaagacaauuccaaccaagaauaucauuaacaagagauagagcacuaucaacagcauacuuagacuuaaacucauuaacaagugcagacucaggaacauacuuuugcgcaagacaaacauuuaaaccagacuuuuacuuugcagaucaaggauggucauucaaucuauggggaagaggagcacacuuuauaguaaguucagcaucaacaaaaggaccaagcguauucccacacgaucuaaga

SEQ ID NO: 49745 - RNA, 429 nt, Artificial Sequence
  derived and/or modified sequence opt6 from anti-HIV-1_HeavyChain
caaggacauaauuuagaacaaaguggaagugaaguaaaaaaaccaggagcaagcguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaagcagauauacaggaggacaaggaugguauuuugauuuauggggaagaggaacacauauaguaguaaguagugcaaguacaaaaggaccaagcguauuuccacaugauuuaaga

SEQ ID NO: 49746 - RNA, 426 nt, Artificial Sequence
  derived and/or modified sequence opt6 from anti-HIV-1_HeavyChain
ccaacaacauggaacaaaagcggaagcgauguaaaaaaaccaggagcaagcguaagaguaagcuguuggacaagcgaagacauauucgaaagaacagaauuaauacauuggguaagacaagcaccaggacaaggauuagaauggauaggauggguaaaaacaguaacaggagcaguaaauuucggaaguccaaacuuuagacauagaguaagcuuaacaagagacagagacuuaaguacagcacauauggauauaagaggauuaacacaagacgauacagcaaccuauuucugugcaagacaaaaauucgaaagcuuauacucagacgaucaaggaagcuauuucgauuuauggggaagaggaacacuaauaauaguaagcucagcaucaacaaaaggaccaagcguauucccacacgaucuaaga

SEQ ID NO: 49747 - RNA, 432 nt, Artificial Sequence
  derived and/or modified sequence opt6 from anti-HIV-1_HeavyChain
cauguaacaccauggaaugaauauguaggaagagcaaugaaaaaaccaggaagaucaguaagaguaaguuguuggacaagugaagauauauuugauacaacagaauuaauauauuggguaagacaagcaccaggacaaggauuagaauggauaggauggguaaaaauagugaguggaacaguaaauuuugcaaguuuagauuuuagaaacagaauaagcuuaagcagagaucgagauuuaaguacagcauauauggauauaagaggauuaacacaagaugauacagcaacauauuuuugugcaagacaaaaauuugcaaguagauauagcggagaucaaggaaguuauuuugauuuauggggaagaggaacauuaauaguaguaaguucagcaaguacuaaaggaccaaguguauuuccacaugauuuaaga

SEQ ID NO: 49748 - RNA, 372 nt, Artificial Sequence
  derived and/or modified sequence opt6 from anti-HIV-1_HeavyChain
caaguacaauuaguacaaaguggagcagaaguaagaagaccaggagcaaguguaaaaguaaguuguaaagcaaguggauuuucauuuuuaggacauuauauacauuggguaagacaagcaccaggacaaggauuagaauggauaggauggguaaaagcaguaaguggagcaguaaauuauggaucauuagauuuuagacauagaguaucauuaacaagagauagagaucuaucaacagcacauauggauauaagaggauuaacacaagaugauacagcaacauauuuuugugcaagacaaaaauuugcaagaggagaucaaggaugguuuuuugauuuauggggaagaggaacacuaauaguaguaaguuca

SEQ ID NO: 49749 - RNA, 372 nt, Artificial Sequence
  derived and/or modified sequence opt6 from anti-HIV-1_HeavyChain
caaguacaauuaguacaaaguggagcagaaguaaaaaaaccaggagcgaguguaaaaguaaguuguaaagcaaguggauauacauuuacaaguuauggaauaaguuggguaagacaagcaccagggcaaggauuagaauggauaggauggguaaaaauaguaaguggagcaguaaauuuuggaaguccaaauuuuagacaaagaguaucauuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguuca

SEQ ID NO: 49750 - RNA, 372 nt, Artificial Sequence
  derived and/or modified sequence opt6 from anti-HIV-1_HeavyChain
caaguacaauuaguacaaagugaagcagaaguaaaaaaaccaggagcaaguguaaaaauaaguugugcuacaaguggauaugcauuuacauuauauuauuuacauuggguaagacaagcaccaggacaaggauuagaauggauaggauggguaaaaacaguaacaggagcaguaaauuuuggaucagcauauuuuagacauagaguaucauuaacaagagauagagauuuauuuacagcacauauggauauaagaggauuaacacaaggagauacagcaacauauuuuugugcaagacaaaaauuuuauaaaggaggacaaggaugguauuuugacuuauggggaaggggaacauuaauaguaguaaguuca

SEQ ID NO: 49751 - RNA, 372 nt, Artificial Sequence
  derived and/or modified sequence opt6 from anti-HIV-1_HeavyChain
caagcacauuuagaacaaaguggaaguggaguaaaaaaaccaggagcaaguguacgaguaaguuguuggacaagugaagauauauuuaaaacagaauuaauacauuggguaagacaagcaccaggacaaggauuagaauggauaggauggguaaaaacaguaacaggagcaguaaauuuuggaucaccaaauuuuagacauagaguaucauuaacaagagauagagauuuauuuacagcacauauggauauaagaggauuaacacaaggagauacagcaacauauuuuugcgcaagacaaaaauuugaaagaggaggacaaggaugguauuuugauuuauggggaagaggaacauuaauaguaguaaguuca

SEQ ID NO: 49752 - RNA, 375 nt, Artificial Sequence
  derived and/or modified sequence opt6 from anti-HIV-1_HeavyChain
caagcacauuuagaacaaagcggaagcggaguaaaaaaauuaggagcaaguguaagaguaaguuguuggacaagugaagauauauuugaaagaacagaauuaauacauuggguaagacaagcaccaggaagaggauuagaauggauaggauggguaaaagcaguaaguggagcaguaaauuauggaaguuuagauuuuagacauagaguaccauuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagc

SEQ ID NO: 49753 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaccagaagauauauuugaaagaacagaauuaauacauuggguaagacaagcaccaggacaaggauuagaauggauaggauggguaaaaauaguaaguggagcaguaaauuuuggaaguccaaauuuuagacaaagaguaagcuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49754 - RNA, 375 nt, Artificial Sequence
  derived and/or modified sequence opt6 from anti-HIV-1_HeavyChain
caagcacauuuagaacaaagugcaaguggaguaaaaagaccaggagcaaguguaagaguaagcuguuggacaagugaagauauauuugaaggaagugaauuaauacauuggguaagacaagcaccaggacaaggauuagaauggauaggauggguaaaaacaguaacaggagcaguaaauuuuggaagugcauauuuuaggcauagaguaaguuuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaagcagu

SEQ ID NO: 49755 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaagcuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49756 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggagcagugaagauauauuugaaagagcagaacuaauacauuggguaagacaagcaccaggacaaggauuagaauggauaggauggguaaaaacaguaacaggagcaguaaauuuuggaaguccaaauuuuagacaaagaguaagcuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49757 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49758 - RNA, 375 nt, Artificial Sequence
  derived and/or modified sequence opt6 from anti-HIV-1_HeavyChain
caaguacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuaagcacagcacauauggauauaagaggauuaacacaagaugauacagcaacauauuuuugugcaagacaaaaauuugcaagaggagaucaaggaugguuuuuugauuuauggggaagaggaacauuaauaguaguaaguagc

SEQ ID NO: 49759 - RNA, 375 nt, Artificial Sequence
  derived and/or modified sequence opt6 from anti-HIV-1_HeavyChain
caagcauauuuagaacaaaguggaagcauaaugaaaaaaccaggagcaagcguaagaguaaguuguuggacaagugaagauauauuugauagaacagaauuaauauauuggguaagacaagcaccaggacaaggauuagaauggauaggauggguaaaaauaguaaguggagcaguaaauuuuggaaguuuagauuuuagaaauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49760 - RNA, 375 nt, Artificial Sequence
  derived and/or modified sequence opt6 from anti-HIV-1_HeavyChain
caagcacauuuagaacaaagcggaaguggaguaaaaaaaccaggagcaaguguaagaguaaguuguuggacaagugaagauauauuugaaagaacagaauuaauaaauuggguaagacaagcaccaggacaaggauuagaauggauaggauggguaaaagcaguaaguggagcaguaaauuauggaaguuuagauuuuagacauagaguaaguuuaacaagagauagagauuuaaguacagcacauauggauauaagaggauuaacacaagaugauacagcaacauauuuuugcgcaagacaaaaauuugcaagaggagaucaaggaugguuuuuugauuuauggggaagaggaacauuaauaguaguaaguagu

SEQ ID NO: 49761 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggaguagugaagauauauuugaaagaacagaauuaauacauuggguaagacaagcaccaggacaaggacuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49762 - RNA, 375 nt, Artificial Sequence
  derived and/or modified sequence opt6 from anti-HIV-1_HeavyChain
caagcacauuuagaacaaaguggaaguggaguaaaaaaaccaggaacaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacguauuuuugugcaagacaaaaauuugaaagaggaggacaaggauggauauuugauuuauggggaagaggaacauuaauagcaguaaguagu

SEQ ID NO: 49763 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaaguggagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49764 - RNA, 375 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauacagauauaagaggauuaacacaaggagauacagcaacauauuuuugugcaagacaaaaauuugaaagaggaggacaaggaugguauuuugauuuauggggaagaggaacauuaauaguaguaagcagu

SEQ ID NO: 49765 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuuagcaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagacagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagc

SEQ ID NO: 49766 - RNA, 375 nt, Artificial Sequence
  derived and/or modified sequence opt6 from anti-HIV-1_HeavyChain
caagcacauuuagaacaaaguggagcaggaguaaaaagaccaggagcaaguguaagaguaucauguuggacaagugaagauauauuugaaacaacagaauuaauacauuggguaagacaagcaccaggacaaggauuagaauggauaggauggguaaaaacaguaaguggagcaguaaauuuuggaaguuuaaauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggaagaggaacauuaauaguaguaaguagu

SEQ ID NO: 49767 - RNA, 375 nt, Artificial Sequence
  derived and/or modified sequence opt6 from anti-HIV-1_HeavyChain
agacauacauggaauaaaagcggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaagcagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagu

SEQ ID NO: 49768 - RNA, 375 nt, Artificial Sequence
  derived and/or modified sequence opt6 from anti-HIV-1_HeavyChain
ggaacaccaggaagugaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaauaguaagcggagcaguaaauuuuggaaguccaaauuuuagacaaagaguaagcuuaacaagagauagagauuuauuuacagcgcauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49769 - RNA, 378 nt, Artificial Sequence
  derived and/or modified sequence opt6 from anti-HIV-1_HeavyChain
caaguacaacuaguacaaucaggaacagaaguacaaaaaccaggagcaucaguaaaaguaucaugcaaagcauucggauacucauucacagacuacuacguauacuggguaagacaagcaccaggacaaggacuagaauacguagcauggauaaacccaucaaacggauacacaaaauacgcacaaaaauuccaagacuggguaacacuaacaagagacucaucaauaaacacagcauaccuacaacuagcaagaguaacaucagacgacacagcaauauacuacugcgcaagacaaaaauucgcaucaagauacucaggagaccaaggaucauacuucgaccuauggggaagaggaacacuaauaguaguaucauca

SEQ ID NO: 49770 - RNA, 378 nt, Artificial Sequence
  derived and/or modified sequence opt6 from anti-HIV-1_HeavyChain
caaguacaacuaguacaaaguggagcagcaguaaaaaaaccaggaaguaguguaaaaguaagcuguaaagcaaguggauauauauuuacaggauauuauauacauuggauaagacaagcaccaggacaaggauuagaauggaugggauggauaaauccaaguacaggagauacaaaauuugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49771 - RNA, 381 nt, Artificial Sequence
  derived and/or modified sequence opt6 from anti-HIV-1_HeavyChain
caaguauauauggaacaagcaggagcaggaaugaaaaaaccaggagcaagcaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49772 - RNA, 381 nt, Artificial Sequence
  derived and/or modified sequence opt6 from anti-HIV-1_HeavyChain
caaguauuuauggaacaagcaggaggaggaaugaaaaaaccaggagcgaguaugacaguaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauaggacaagagaauuaggaauagcauauauggauuuaagagaucuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49773 - RNA, 381 nt, Artificial Sequence
  derived and/or modified sequence opt6 from anti-HIV-1_HeavyChain
caaguauuuauggaacaagcaggaggaggaaugaaaaaaccaggagcaaguaugacaguaaguuguaaaacagcagaugaagauguauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49774 - RNA, 381 nt, Artificial Sequence
  derived and/or modified sequence opt6 from anti-HIV-1_HeavyChain
caaguacauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccagugacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauaggggauauuuuuuugauuuauggggaagaggaaguagaguaauaguaaguagu

SEQ ID NO: 49775 - RNA, 381 nt, Artificial Sequence
  derived and/or modified sequence opt6 from anti-HIV-1_HeavyChain
caaguauauauggaacaagcaggaggaggaaugaaaaaaccaggagcaaguaugacaguaaguuguaaaacagcagaugaagauauauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauggcauauauggaucuaagaaauuuaagauuugaugauacagcaguauauuuuugugcaagaaaaacagcaggagauguaaguggagauaauagaggauauuuuuuugauuuauggggaagaggaaguagaguaauaguaaguagu

SEQ ID NO: 49776 - RNA, 381 nt, Artificial Sequence
  derived and/or modified sequence opt6 from anti-HIV-1_HeavyChain
caaguauauauggaacaagcaggaggaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaaguuuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguuggguaauaguaaguagu

SEQ ID NO: 49777 - RNA, 381 nt, Artificial Sequence
  derived and/or modified sequence opt6 from anti-HIV-1_HeavyChain
caaguacaauuaguacaaaguggagcagaaguaaaaaaaccaggagcaaguguaacacuaaguuguaaaacagcagaugaagauguauuugaugcagcauauaugcauuggguaagacaagcaccaggacaaacauuugaaugguuaggauggaugaaaccaguaacaggagcaguaaauuaugcaagaaaauuucaaggaagaguaaguuuuuauagaacaagagaauuaggaauagcauauauggauuuaagaaauuuaagauuugaugauacagcaguauauuuuugugcaagaaaaacagcaggagauguaaguggagauaaaagaggauuuuuuuucgauuuauggggaagaggaaguagaguaauaguaucaagu

SEQ ID NO: 49778 - RNA, 384 nt, Artificial Sequence
  derived and/or modified sequence opt6 from anti-HIV-1_HeavyChain
caaagucauuuagaacaaaguggaagugcaaugaaaaaaccaggagcaaguguaagaguaaguuguuggacaagcgaagauauauuugauacaacagaacuaauauauuggguaagacaagcaccaggacaaggauuagaauggauaggauggguaaaaauaguaaguggaacaguaaauuuugcaagcuuagauuuuagaaauagaauaaguuuaaguagagauagaggauuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49779 - RNA, 384 nt, Artificial Sequence
  derived and/or modified sequence opt6 from anti-HIV-1_HeavyChain
caagcacauuuagaacaaagugcaaguggaguaagaagaccaggagcaaguguaagaguaaguuguuggacaagugaagauauauuugaaagaagugaauuaauauauuggguaagacaagcaccaggaagaggacuagaauggauaggauggauaaaauuaguaaguggagcaguaaauuuuggaaguguagauuuuagagauagaguaagucuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49780 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaacuaauacauuggguaagacaagcaccaggacaaggauuagaauggauaggauggguaaaaacaguaacaggagcaguaaauuauggaaguuuaaauuuuagaaguagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49781 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagcgaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49782 - RNA, 384 nt, Artificial Sequence
  derived and/or modified sequence opt6 from anti-HIV-1_HeavyChain
caaguacauuuagaacaaaguggaaguggaguaaaaaaaccaggagcaaguguaagaguaaguuguuggaguagugaagauauauuugaaaggacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagagggcuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49783 - RNA, 384 nt, Artificial Sequence
  derived and/or modified sequence opt6 from anti-HIV-1_HeavyChain
caaagucauuuagaacaaagcggaagugcaaugaaaaaaccaggagcaagcguaagaguaaguuguuggacaagugaagauauauuugauacaacagaauuaauauauuggguaagacaagcaccaggacaaggauuagaauggauaggauggguaaaaauaguaaguggaacaguaaauuuugcaaguuuagauuuuagaaauagaauaaguuuaggaagagauagagauuuaagcacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49784 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaggacagaauuaauacauuggguaagacaagcaccaggacaaggauuagaauggauaggauggguaaaaacaguaacaggaacaguaaauuuuggaaguuuaaauuuuagacaaagaguaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49785 - RNA, 384 nt, Artificial Sequence
  derived and/or modified sequence opt6 from anti-HIV-1_HeavyChain
caaagucauuuagaacaaaguggaagcgcaaugaaaaaaccaggagcaaguguaagaguaaguuguuggacaagugaaggaauauuugauacaacagaauuaauauauuggguaagacaagcaccaggacaaggauuagaauggauaggauggguaaaaauaguaaguggaacaguaaauuuugcaaguuuagauuuuagaaauagaauaagucuaaguagagauagagauuuaaguacagcauauauggauauaagaggauuaacacaagaugauacagcaacauauuuuugugcaagacaaaaauuugcaaguagauauaguggagaucaaggaaguuauuuugauuuauggggaagaggaacauuaauaguaguaaguagu

SEQ ID NO: 49786 - RNA, 384 nt, Artificial Sequence
  derived and/or modified sequence opt6 from anti-HIV-1_HeavyChain
caaaguagauuagaacaaaguggaagugcaaugaaaaaaccaggagcaaguguaagaguaaguuguuggacaagugaagauauauuugauacaacagaauugauauauuggguaagacaagcaccaggacaaggauuagaauggauaggauggguaaaaauaguaagcggaacaguaaauuuugcaaguuuagauuuuagaaauagaauaaguuuaaguagagauagagauuuaaguacagcacauauggauauaagaggauuaacacaagaugauacagcaacauauuuuugugcaagacaaaaauuugcaaguagauauaguggagaucaaggaagcuauuuugaucuauggggaagaggaacauuaauaauaguaaguagu

SEQ ID NO: 49787 - RNA, 384 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagagugaguuuaacaagagauagagauuuauuuacagcacauauggauauaagaggauuaacacaaggagauacagcaacauauuuuugugcaaggcaaaaauuugaaaguagauauacaggaggacaaggaugguauuuugauuuauggggaagaggaacacauauaguaguaaguagu

SEQ ID NO: 49788 - RNA, 384 nt, Artificial Sequence
  derived and/or modified sequence opt6 from anti-HIV-1_HeavyChain
caaucacauuuagaacaaagcggaagcgcaaugaaaaaaccaggagcgaguguaagaguaagcuguuggacaagugaagacauauuugauacaacagaauuaauauauuggguaagacaagcaccaggacaaggauuagaauggauaggauggguaaaaauaguaucaggaacaguaaauuucgcaaguucagacuuuagaaauagaauaaguuuaagcagagacagagauuuaaguacagcauauauggauauaagaggauuaacacaagaugauacagcaacauauuucugugcaagacaaaaauuugcaagcagauauucaggagaucaaggaaguuauuuugauuuauggggaagaggaacacuaauaauaguaaguuca

SEQ ID NO: 49789 - RNA, 384 nt, Artificial Sequence
  derived and/or modified sequence opt6 from anti-HIV-1_HeavyChain
caagcacaucuagaacaaucaggaucaggaguaaaaaaaccaggagcaucaguaagaguaucaugcuggacaucagaagauauauuugaaagaacagaauuaauacacuggguaagacaagcaccaggacaaggacuagaauggauaggauggguaaaaauaguaagcggaacaguaaacuuugcaucacuagauuucagaaacagaauaucacuaucaagagauagagauuuaucaacagcauacauggacauaagaggacuaacacaagaugacacagcaacauacuuuugcgcaagacaaaaauuugcaucaagauauaguggagaccaaggaucauacuuugacuuauggggaagaggaacauuaauaguaguaucaagu

SEQ ID NO: 49790 - RNA, 384 nt, Artificial Sequence
  derived and/or modified sequence opt6 from anti-HIV-1_HeavyChain
agacauacaugggaacaaaguggaaguggaguaaaaaaaccaggagcaaguguaagaguaagcuguuggaguagugaagauauauuugaaagaacagaauuaauacauuggguaagacaagcaccaggacaaggauuagaauggauaggauggguaaaaacaguaacaggagcaguaaauuuuggaaguuuagauuucagacauagaauaaguuuaacaagagauagagauuuauuuacagcacauauggauauaagaggauuaacacaaggagauacagcaacauauuuuugugcaagacaaaaauuugaaaguagguauacaggaggacaaggaugguauuuugauuuauggggaagaggaacacauauaguaguaaguagc

SEQ ID NO: 49791 - RNA, 384 nt, Artificial Sequence
  derived and/or modified sequence opt6 from anti-HIV-1_HeavyChain
agacauacaugggaacaaaguggaaguggaguaaaaaaaccaggagcaagcguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49792 - RNA, 414 nt, Artificial Sequence
  derived and/or modified sequence opt6 from anti-HIV-1_HeavyChain
caagcacauuuagaacaaucaggaucaggaguaaaaaaaccaggagcaaguguaagaguaaguuguuggacaagugaagauauauuugaaagaagugaauuaauacauuggguaagacaagcaccaggacaaggauuagaauggauaggauggguaaaaacaguaacaggagcaguaaauuucggaucaccaaauuuuagacauagaguaagucuaacaagagauagagauuuauuuacagcacauauggauauaagaggauuaacacaaggagauacagcaacauauuuuugugcaagacaaaaauauuaugcaggaggacaaggaugguauuuugauuuauggggaagaggaacauuaauaguaguaaguucagcaaguacaaaaggaccaaguguauuucaugauuuaaga

SEQ ID NO: 49793 - RNA, 417 nt, Artificial Sequence
  derived and/or modified sequence opt6 from anti-HIV-1_HeavyChain
caagcacauuuagaacaaaguggaaguggaguaaaaaaaccaggagcaagcguaagagugaguuguuggacaagugaagauauauuugaaagaacggaauuaauacauuggguaagacaagcaccaggacaaggauuagaauggauaggauggguaaaaauaguaaguggagcgguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaucaagugcaagcacaaaaggaccaaguguauuuccaacaauaugugua

SEQ ID NO: 49794 - RNA, 417 nt, Artificial Sequence
  derived and/or modified sequence opt6 from anti-HIV-1_HeavyChain
caagcacauuuagaacaaaguggaagcggaguaaaaaaaccaggagcaagcguaagaguaaguuguuggacaagugaagauauauuugaaaaaagugaauuaauacauuggguaagacaagcaccaggacaaggauuagaauggauaggauggguaaaagcaguaaguggagcaguaaauuauggaaguuuagauuuuagacauagaguaagcuuaacaagagauagagauuuauuuacagcacauauggauauaagaggauuaacacaagaugauacagcaauauauuuuugugcaagacaaaaauuugcaaggggagaucaaggaugguuuuuugauuuauggggaagaggaacauuaauaguaguaaguagugcaagcacaaaaggaccaaguguauuuccacaugauuuaaga

SEQ ID NO: 49795 - RNA, 417 nt, Artificial Sequence
  derived and/or modified sequence opt6 from anti-HIV-1_HeavyChain
caagcacauuuagaacaaaguggaaguggaguaaaaaaaguaggagcaaguguaagaguaaguuguuggacaagugaagauauauuugaaagaacagaauuaauacauuggguaaggcaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaauauauuuuugugcaagacaaaaauuugcaagaggagaucaaggaugguuuuuugauuuauggggaagaggaacauuaauaguaguaaguagugcaaguacaaaaggaccaagcguauuuccacaugauuuaaga

SEQ ID NO: 49796 - RNA, 417 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaaggcaagcgccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguagugcaaguacaaaaggaccaaguguauuuccacaugauuuaaga

SEQ ID NO: 49797 - RNA, 423 nt, Artificial Sequence
  derived and/or modified sequence opt6 from anti-HIV-1_HeavyChain
caaguauauauggaacaagcaggagcaggaguaaaaaaaccaggagcaaguguaacauuaaguuguaaaacagcagaugaagauguauuugaugcagcauauaugcauuggguaagacaagcaccaggacaaacauuugaaugguuaggauggaugaaaccaguaacaggagcaguaaguuaugcaagaaaauuucaaggaagaguaucauuuuauaugacaagagaauuaggaauggcauauauggauuuaagaaauuuaagauuugaugauacagcaguauauuuuugugcaagaaaaacagcaggagauguaaguggagauaauagaggauauuuuuuugauuuauggggaagaggaaguagaguaauaguaagcagugcaaguacaaaaggaccaaguguauuuccacaugauuuaaga

SEQ ID NO: 49798 - RNA, 426 nt, Artificial Sequence
  derived and/or modified sequence opt6 from anti-HIV-1_HeavyChain
caaagucauuuagaacaaucaggaucagcaaugaaaaaaccaggagcaucaguaagaguaucaugcuggacaucagaagauauauuugacacaacagaauuaauauacuggguaagacaagcaccaggacaaggacuagaauggauaggauggguaaaaauaguaaguggaacaguaaacuuugcaucacuagauuucagaaacagaauaucacuaucaagagauagagauuuaucaacagcauacauggacauaagaggacuaacgcaagaugacacagcaacauacuuuugcgcaagacaaaaauuugcaucaagauauagcggagaccaaggaucauacuuugauuuauggggaagaggaacauuaauaguaguaucaagugcaaguacaaaaggaccaucaguauuuccaacaauauaugua

SEQ ID NO: 49799 - RNA, 372 nt, Artificial Sequence
  derived and/or modified sequence opt6 from anti-HIV-1_HeavyChain
caaguacaauuaguacaaaguggagcagaaguaaaaaaaccaggagcaaguguaaaaguaaguuguaaagcaaguggaggaacauuaaguaguuaugcaauaaguuggguaagacaagcaccaggacaaggauuagaauggauaggauggguaaaaacaguaacaggagcaguaaauuuuggaagugcauguuuuagacauagaguaaguuuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacacuaauaguaguaaguagu

SEQ ID NO: 49800 - RNA, 372 nt, Artificial Sequence
  derived and/or modified sequence opt6 from anti-HIV-1_HeavyChain
cauguaagauuaguacaaaguggagcagaaguagaaaaaccaggagcaaguguaaaaguaaguugugaaacaaguaauuauccauuuaauauguauggaaugacauggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggauggauauuugauuuauggggaagaggaacauuaauagcaguaaguagu

SEQ ID NO: 49801 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauguauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuuuaugcaggaggacaaggaugguauuuugauuuauggggaagaggaacauuaauaguaguaaguagu

SEQ ID NO: 49802 - RNA, 375 nt, Artificial Sequence
  derived and/or modified sequence opt6 from anti-HIV-1_HeavyChain
agacauacaugggaacaaaguggaaguggaguaaaaaaaccaggagcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaagcuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49803 - RNA, 375 nt, Artificial Sequence
  derived and/or modified sequence opt6 from anti-HIV-1_HeavyChain
agacauacaugggaacaaaguggaagcggaguaaaaagaccaggagcaaguguaagaguaaguuguuggacaagugaagauauauuugaaacaacagaauuaauacauuggguaagacaagcaccaggacaaggauuagaauggauaggauggguaaaaacaguaaguggagcaguaaauuuuggaaguuuaaauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagu

SEQ ID NO: 49804 - RNA, 381 nt, Artificial Sequence
  derived and/or modified sequence opt6 from anti-HIV-1_HeavyChain
caaguauuuauggaacaagcaggagcaggaaugaaaaaaccaggagcaaguaugacaguaaguuguaaaacagcagaugaagauguauuugaugcagcauauaugcauuggguaagacaagcaccaggacaaacauuugaaugguuaggauggaugaaaccaguaacaggagcaguaaauuaugcaagacaauuucaaggaagaguaaguuuuuauagaacaagagaauuaggaauagcauauauggauuuaagagauuuaaaauuugaugauacagcaguauauuuuugugcaagaaaaacaaaaggagauguaaguggagaugauagaggauuuuuuuuugauuuauggggaagaggaacaagaguaauaguaaguagu

SEQ ID NO: 49805 - RNA, 384 nt, Artificial Sequence
  derived and/or modified sequence opt6 from anti-HIV-1_HeavyChain
caaguacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaagcuuaacaagagauagagaucuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49806 - RNA, 417 nt, Artificial Sequence
  derived and/or modified sequence opt6 from anti-HIV-1_HeavyChain
caagcacauuuagaacaaaguggaaguggaguaaaaaaacuaggagcaaguguaagaguaaguuguuggacaagugaagauauauuugaaagaacagaauuaauacauuggguaagacaagcaccaggacaaggacuagaauggauaggauggguaaaagcaguaaguggagcaguaaauuauggaagucuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagugcaaguacaaaaggaccaagcguauuuccaacaauaugugua

SEQ ID NO: 49807 - RNA, 417 nt, Artificial Sequence
  derived and/or modified sequence opt6 from anti-HIV-1_HeavyChain
caagcacauuuagaacaaucaggaucaggaguaaaaaaaccaggagcaucaguaagaguaucauguuggacaagugaagauauauuugaaaaaagugaauuaauacauuggguaagacaagcaccaggacaaggauuagaauggauaggauggguaaaaacaguaacaggagcaguaaauuuuggaucaagugauuuuagacaaagaguaucauuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauaguaguaaguucagcaucaacaaaaggaccaaguguauuuccaacaauaugugua

SEQ ID NO: 49808 - RNA, 417 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauguauuugaaagaacagaauuaauacauuggguaagacaagcaccaggacaaggauuagaauggauaggauggguaaaagcaguaaguggagcaguaaauuauggaagucuagauuuuagacauagaguaaguuuaacaagagauagggauuuauuuacagcacauauggauauaagaggauuaacacaagaugauacagcaacauauuucugugcaagacaaaaauuuuaugcaggaggacaaggaugguauuuugauuuauggggaagaggaacauuaauaguaguaaguagugcaaguacaaaaggaccaagcguauuuccacaugauuuaaga

SEQ ID NO: 49809 - RNA, 375 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagugaagauauauuugaaagaacagaauuaauacauuggguaagacaagcaccaggacaaggauuagaauggauaggauggguaaaaauaguaaguggagcaguaaauuuuggaaguccaaauuuuagacaaagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49810 - RNA, 384 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaaggcaagcaccaggacaaggauuagaauggauaggauggguaaaaacaguaacaggagcaguaaauuuuggaaguuuagauuuuagacauagaauaaguuuaacaagagauagagauuuauuuacagcacauauggauauaagaggauuaacacaaggagauacagcaacauauuuuugugcaagacaaaaauuugaaaguagauauacaggaggacaaggaugguauuuugauuuauggggaagaggaacacauauaguaguaaguagu

SEQ ID NO: 49811 - RNA, 426 nt, Artificial Sequence
  derived and/or modified sequence opt6 from anti-HIV-1_HeavyChain
caagcacauuuagaacaaaguggaagcggaguaaaaaaaccaggggcaaguguaagaguaaguuguuggaguagugaagauauauuugaaagaacagaauuaauacauuggguaagacaagcaccaggacaaggauuagaauggauaggauggguaaaaacaguaacaggagcaguaaauuuuggaaguuuagauuuuagacauagaauaagucuaacaagagauagagauuuauuuacagcacauauggauauaagaggauuaacacaaggggauacagcaacauauuuuugugcaagacaaaaauuugaaaguagauauacaggaggacaaggaugguauuuugauuuauggggaagaggaacacauauaguaguaaguagugcaaguacaaaaggaccaaguguauuuccaacgauaugugua

SEQ ID NO: 49812 - RNA, 375 nt, Artificial Sequence
  derived and/or modified sequence opt6 from anti-HIV-1_HeavyChain
caagcacauuuagaacaaaguggaaguggaguaaaaaaaccaggaacaaguguaagaguaaguuguuggacaagugaagauauauuugaaagaacagaauuaauacauuggguaagacaagcaccaggacaaggacuagaauggauaggauggguaaaaacaguaacaggagcaguaaauuuuggaagcccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49813 - RNA, 381 nt, Artificial Sequence
  derived and/or modified sequence opt6 from anti-HIV-1_HeavyChain
caaguacaacuaguacaaucaggagcagaaguaaaaaaaccaggagcaucaguaaaaguaucaugcaaagcaucaggauauacauauacaacauacggaguaucaugguuaagacaaguaccaggacaaagaccagaauggaugggauggauaagaccaaaaacaggagcaagaaaucaagcaagacaauuccaaccaagaauaucacuaacgagagauagagcacuaucaacagcauacuuagacuuaaacucacuaacaagcgcagacucaggaacauacuuuugcgcaagacaaacauuuaaaccagacuuuuacuuugcagaucaaggauggucauucaaucuauggggaagaggagcacacuuuauaguaagcuca

SEQ ID NO: 49814 - RNA, 384 nt, Artificial Sequence
  derived and/or modified sequence opt6 from anti-HIV-1_HeavyChain
agagcacauuuagaacaaaguggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuuuugugcaagacaaaaauuugaaaguagauauacaggaggacaaggaugguauuuugauuuauggggaagaggaacacauauaacaguaaguagu

SEQ ID NO: 49815 - RNA, 375 nt, Artificial Sequence
  derived and/or modified sequence opt6 from anti-HIV-1_HeavyChain
caagcacauuuagaacaaaguggaagcggaguaaaaaaaccaggagcaagcguaagaguaaguuguuggacaagugaagauauauuugaaagaacagaauuaauacauuggguaagacaagcaccaggacaaggauuagaauggauaggauggguaaaaauaguaaguggagcaguaaauuuuggaagcccaaauuuuagacaaagaguaaguuuaacaagagauagagauuuauuuacagcacauauggauauaagaggauuaacacaaggagauacagcaacauauuauugugcaagacaaaaauuugaaagaggaggacaaggauggauauuugauuuauggggaagaggaacauuaauagcaguaaguagu

SEQ ID NO: 49816 - RNA, 375 nt, Artificial Sequence
  derived and/or modified sequence opt6 from anti-HIV-1_HeavyChain
caagcacauuuagaacaaaguggaaguggaguaaaaaaacuaggagcaagcguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggguuaacacaagaugauacagcaacauauuuuugugcaagacaaaaauuugcaagaggagaucaaggaugguuuuucgauuuauggggacauggaacauuaauaguaguaaguagu

SEQ ID NO: 49817 - RNA, 375 nt, Artificial Sequence
  derived and/or modified sequence opt6 from anti-HIV-1_HeavyChain
caagcacauuuagaacaaaguggaaguggaguaaaaaaaccaggagcaagcguaagaguaaguuguuggacaagugaagauauauuugaaagaacagaauuaauacauuggguaagacaagcaccaggacaaggauuagaauggauaggauggguaaaaacaguaacaggagcaguaaauuuuggaagcccaaauuuuagacauagaguaaguuuaacaagagauagagaucuauuuacagcacauauggauauaagaggauuaacacaaggagauacagcaacauauuuuugugcaagacaaaaauuugaaagaggaggacaaggaugguauuuugauuuauggggacauggaacauuaauaguaguaaguagu

SEQ ID NO: 49818 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccagggcaaggauuagaauggauaggauggguaaaaacaguaacaggagcaguaaauuuuggaaguagcgauuuuagacaaagaguaaguuuaacaagagauggagaucuauuuacagcacauauggauauaagaggauuaacacaaggagauacagcaacauauuuuugugcaagacaaaaauuuuaugcaggaggacaaggaugguauuuugauuuauggggaagaggaacauuaauaauaguaaguagu

SEQ ID NO: 49819 - RNA, 372 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagacauauuugaaaaaucagaauuaauacauuggguaagacaagcaccaggacaaggauuagaauggauaggauggguaaaaacaguaacaggagcaguaaauuuuggacaucaaauaucagauagaguaucauuaacaagagauagagauuuauuuacagcacauauggauauaagaggacuaacacaaggagauacagcaacauauuuuugugcaagacaaaaauuuuaugcaggaggacaaggaugguauuuugauuuauggggacauggaacauuaauaguaguaaguuca

SEQ ID NO: 49820 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggacauggaacauuaauaguaguaucaagc

SEQ ID NO: 49821 - RNA, 375 nt, Artificial Sequence
  derived and/or modified sequence opt6 from anti-HIV-1_HeavyChain
caagcacauuuagaacaaaguggagcaggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaaguggggcaguaaauuuuggaaguccaaauuuuagacauagaguaaguuuaacaagagauagagauuuauuuacagcacauauggauauaagaggauuaacacaaggagauacagcaacauauuauugugcaagacaaaaauuugaaagaggaggacaaggaugguauuuugauuuauggggaagaggaacauuaauaguaguaaguagu

SEQ ID NO: 49822 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggaagaggauuagaauggauaggauggguaaaagcaguaaguggagcaguaaauuauggaaguuuagauuuuagacauagaguaaguuuaacaagagauagagauuuauuuacagcacauauggauauaagaggacuaacacaagaugauacagcaacauauuauugugcaagacaaaaauucgaaagaggaggacaaggauggauauuugauuuauggggaagaggaacauuaauagcaguaaguagu

SEQ ID NO: 49823 - RNA, 375 nt, Artificial Sequence
  derived and/or modified sequence opt6 from anti-HIV-1_HeavyChain
caagcacauuuagaacaaagcggaaguggaguaaaaaaaccaggagcaaguguaagaguaagcuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaagcuuaacaagagauagagaucuauuuacagcacauauggauauaagaggauuaacacaaggagauacagcaacauauuauugugcaagacaaaaauuuuaugcaggaggacaaggaugguauuuugauuuauggggaagaggaacauuaauaguaguaaguagu

SEQ ID NO: 49824 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaaguagu

SEQ ID NO: 49825 - RNA, 372 nt, Artificial Sequence
  derived and/or modified sequence opt6 from anti-HIV-1_HeavyChain
uacguagaauuaggaacaaacacaggaccagaaguaagaaaaccaggagcaucaguaaaaauaucaugcaaaacaucaggauauauauuuacagauaacuauuuccauugguuaagacaagcaccagcaguaggauuagaauggaugggauggauaaacucacacaauggauauacaaaaagcgcaaaaaaauuccaaggaagaauaacaaugacaagagauacagcaguagauacagcauacauggaauuaauagaucuaacaagcgaugacacagcaacauacuauugcgcaagacaaaaauuuuacgcaggaggacaaggaugguauuucgaucuauggggauguggaacacuaauaguaguaagcuca

SEQ ID NO: 49826 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuuuugugcaagacaaaaauuuuaugcaggaggacaaggaugguauuuugauuuauggggaagaggaacauuaauauguguaaguagu

SEQ ID NO: 49827 - RNA, 375 nt, Artificial Sequence
  derived and/or modified sequence opt6 from anti-HIV-1_HeavyChain
caagcacauuuagaacaaaguggaaguggaguaaaaaaaccaggagcaagcguaagaguaagcuguuggacaagcgaagauauauuugaaagaacagaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggguuaacacaaggagauacagcaacauauuauugugcaagacaaaaauuuuaugcaggaggacaaggaugguauuuugauuuauggggaaggggaacauuaauaguaguaaguagu

SEQ ID NO: 49828 - RNA, 375 nt, Artificial Sequence
  derived and/or modified sequence opt6 from anti-HIV-1_HeavyChain
caagcacauuuagaacaaagcggaaguggaguaaaaaaaccaggagcaaguguaagaguaagcuguuggacaagugaagauauauuugaaagaacagaauuaauacauuggguaagacaagcaccaggacaaggauuagaauggauaggauggguaaaaccaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugauuuauggggaagaggaacauuaauaguaguaaguagu

SEQ ID NO: 49829 - RNA, 375 nt, Artificial Sequence
  derived and/or modified sequence opt6 from anti-HIV-1_HeavyChain
caaguacaauuaguacaaaguggagcagaaguaaaaaaaccaggagcaaguguaagaguaaguuguuggacaagugaagauauauuugaaaaaagugaauuaauacauuggguaagacaagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuauugugcaagacaaaaauuugaaagaggaggacaaggaugguauuuugauuuauggggaagaggaacauuaauaguaguaaguagu

SEQ ID NO: 49830 - RNA, 375 nt, Artificial Sequence
  derived and/or modified sequence opt6 from anti-HIV-1_HeavyChain
caagcacauuuagaacaaagcggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuaugggaguuuagauuuuagacauagaguaaguuuaacaagagauagagauuuaaguacagcacauauggauauaagaggauuaacacaagaugauacagcaacauauaguugugcaagacaaaaauuugcaagaggagaucaaggaugguuuuuugauuuauggggaagaggaacauuaauaguaguaaguagu

SEQ ID NO: 49831 - RNA, 375 nt, Artificial Sequence
  derived and/or modified sequence opt6 from anti-HIV-1_HeavyChain
caagcacauuuagaacaaaguggaaguggaguaaaaaaaccaggaacaaguguaagaguaaguuguuggacaagugaagauauauuugaaagaacagaacuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuauugugcaagacaaaaauuugaaagaggaggacaaggaugguauuuugauuuauggggaagaggaacauuaauaguaguaaguagu

SEQ ID NO: 49832 - RNA, 375 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggaacaguaaauuuuggaaguuuaaauuuuagacaaagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggacauggaacauuaauaguaguaaguagu

SEQ ID NO: 49833 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauccauuuacagcacauauggauauaagaggauuaacacaaggagauacggcaacauauuuuugugcaagacaaaaauucgaaagaggaggacaaggaugguauuuugauuuauggggacauggaacauuaauaguaguaucaagu

SEQ ID NO: 49834 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagcgaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauauguggauuaacacaaggagauacagcaacauauuuuugugcaagacaaaaauuugaaagaggaggacaaggaugguauuuugauuuauggggacauggaacacuaauaguaguaaguagu

SEQ ID NO: 49835 - RNA, 375 nt, Artificial Sequence
  derived and/or modified sequence opt6 from anti-HIV-1_HeavyChain
caagcacauuuagaacaaaguggaaguggaguaaaaaaauuaggagcaaguguaagaguaaguuguuggacaagugaagauauauuugaaagaacagaauuaauacauuggguaagacaagcaccaggacaaggacuagaauggauaggauggguaaaagcaguaaguggagcaguaaauuauggaagcuuagauuuuagacaaagaguaaguuuaacaagagauagagaucuauuuacagcacauauggauauaagaggauuaacacaaggagauacagcaacauauuauugugcaagacaaaaauucuaugcaggaggacaaggaugguauuuugauuuauggggaagaggaacauuaauaguagugagcagu

SEQ ID NO: 49836 - RNA, 372 nt, Artificial Sequence
  derived and/or modified sequence opt6 from anti-HIV-1_HeavyChain
caagcgcauuuagaacaaaguggaaguggaguaaaaaaaccaggagcaaguguaagaguaaguuguuggacaagugaagauauauuuaaaagugaauuaauacauuggguaagacaagcaccaggacaaggacuagaauggauaggauggguaaaaacaguaacaggagcaguaaauuuuggaucaagcgauuuuagacaaagaguaucacuaacgagagauagagaucuauuuacagcacauauggauauaagaggauuaacacaaggagauacagcaacauauuuuugugcaagacaaaaauuuuaugcaggaggacaaggaugguauuuugauuuauggggccauggaacauuaauaguaguaaguuca

SEQ ID NO: 49837 - RNA, 375 nt, Artificial Sequence
  derived and/or modified sequence opt6 from anti-HIV-1_HeavyChain
caagcacauuuagaacaaaguggaaguggaguaaaaaaaccaggaacaaguguaagaguaaguuguuggacaagugaagauauauuugaaagaacagaauuaauacauuggguaagacaagcaccaggacaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugcaagaggagaucaaggaugguuuuuugauuuauggggacauggaacauuaauaguaguaaguagu

SEQ ID NO: 49838 - RNA, 375 nt, Artificial Sequence
  derived and/or modified sequence opt6 from anti-HIV-1_HeavyChain
caagcacaucuagaacaaagcggaaguggaguaaaaaaauuaggagcaagcguaagaguaaguuguuggacaagugaagauauauuugaaagaacagaauuaauacauuggguaagacaagcaccaggacaaggauuagaauggauaggauggguaaaagcaguaagcggagcaguaaauuauggaaguuuagauuuuagacauagaguaagcuuaacaagagauagagauuuauuuacagcacauauggauauaagaggauuaacacaagaugauacagcaacauauuauugugcaagacaaaaauuugcaagaggagaucaaggaugguuuuuugaucuauggggaagaggaacauuaauaguaguaaguagu

SEQ ID NO: 49839 - RNA, 381 nt, Artificial Sequence
  derived and/or modified sequence opt6 from anti-HIV-1_HeavyChain
caaguacaauuaguacaaagcggagcagaaguaaaaaaaccaggagcaucaguaaaaguaagcuguaaagcaagcggauacacauucacagauuauuaccuacacuggguaagacaagcaccaggacaaggacuagauuggguaggauggauaaauccaaauagcggaggaacaaauuaugcacaaaaauuucaaggaagaguagcaaugacaagagacacaaguuuaagcucaguauauuuagaucuaaauagcuuaacaucagcagauagcggaacauauuucugugcaagacaaacauucaaaccagauuucuauuucgcagaccaaggauggaguuuuaacuuauggggacaaggaagccauuucauaguaucaagc

SEQ ID NO: 49840 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaagcuguuggacaagugaagauauauuugaaaaaagugaauuaauacauuggguaagaagagcaccaggacaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuauugugcaagacaaaaauuuuaugcaggaggacaaggaugguauuuugauuuauggggaagaggaacauuaauaguaguaaguuca

SEQ ID NO: 49841 - RNA, 372 nt, Artificial Sequence
  derived and/or modified sequence opt6 from anti-HIV-1_HeavyChain
caagcacauuuagaacaaaguggaaguggaguaaaaaaaccaggagcaaguguaacaguaaguuguuggacaagugaagacauauuugaaaaaucagaauuaauacauuggguaagacaagcaccaggacaaggauuagaauggauaggauggguaaaaacaguaacaggagcaguaaauuuaguauaucaaauaucagauagaguaucauuaacaagagauagaggauuauuuacagcacauauggauauaagaggauuaacacaaggagauacagcaacauauuauugugcaagacaaaaauuuuaugcaggaggacaaggaugguauuuugauuuauggggaagagguacauuaauaguaguaaguuca

SEQ ID NO: 49842 - RNA, 375 nt, Artificial Sequence
  derived and/or modified sequence opt6 from anti-HIV-1_HeavyChain
caagcacaucuagaacaaagcggaaguggaguaaaaaaaccaggagcaaguguaagaguaaguuguuggacaagugaagauauauuugaaggaagugaauuaauacauuggguaagacaagcaccaggacaaggauuagaauggauaggauggguaaaaacaguaacaggagcaguaaauuuuggaagcgcauauuuuagacauagaguaaguuuaacaagagauagagauuuauuuacagcacauauggauauaagaggauuaacacaaggagauacagcaacauauuuuugugcaagacaaaaauuuuauaaaggaggacaaggaugguauuuugaucuauggggacauggaacauuaauaguaguaaguagu

SEQ ID NO: 49843 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaacaggagcaguaaauuauggaaguuuaaauuuuagaaguagaauaaguuuaacaagagauagagauuuauuuacagcacauauggauauaagaggauuaacagaaggagauacagcaacauauuuuugugcaagacaaaaauuuuaugcaggaggacaaggaugguauuuugaucuauggggacauggaacauuaauaguaguaagcagu

SEQ ID NO: 49844 - RNA, 375 nt, Artificial Sequence
  derived and/or modified sequence opt6 from anti-HIV-1_HeavyChain
caagcacauuuagaacaaaguggaagcggaguaaaaaaaccaggagcaaguguaagaguaaguuguuggacaagugaagauauauuugaaagaacagaauuaauacauuggguaagacaagcaccaggacaaggauuagaauggauaggauggguaaaaacaguaagcggagcaguaaauuuuggaaguccaaauuuuagacauagaguaaguuuaacaagagauagagauuuauuuacagcacauauggauauaagaggauuaacacaaggagauauggcaacauauuuuugugcaagacaaaaauuugaaagaggaggacaaggaugguauuuugauuuauggggacauggaacauuaauaguaguaaguagu

SEQ ID NO: 49845 - RNA, 375 nt, Artificial Sequence
  derived and/or modified sequence opt6 from anti-HIV-1_HeavyChain
caagcacauuuagaacaaaguggaaguggaguaaaagaaccaggaacaaguguaagaguaaguuguuggacaagugaagauauauuugaaagaacagaauuaauacauuggguaagacaagcaccaggacaaggauuagaauggauaggaugggugaaaacaguaacaggagcaguaaauuuuggaagcccaaauuuuagacauagaguaaguuuaacaagagauagagauuuauuuacagcacauauggauauaagaggauuaacacaaggagauacagcaacauauuuuugugcaagacaaaaauuugaaagaggaggacaaggauggauauuugaucuauggggaagaggaacauuaauagcaguaaguagu

SEQ ID NO: 49846 - RNA, 375 nt, Artificial Sequence
  derived and/or modified sequence opt6 from anti-HIV-1_HeavyChain
caaguacaauuagaacaaaguggaaguggaguaaaaaaauuaggagcaaguguaagaguaagcuguuggacaagugaagauauauuuggaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaagaugauacagcaacauauuauugugcaagacaaaaauuugcaagaggagaucaaggaugguuuuuugauuuauggggaagaggaacauuaauaguaguaaguagu

SEQ ID NO: 49847 - RNA, 372 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaugauauauuuaaaacagaauuaauacauuggguaagacaagcaccaggacaaggauuagaauggauaggauggguaaaaacaguaacaggagcaguaaauuuuggaucaccaaauuuuagacaaagaguaucauuaacaagagauagagauuuauuuacagcacauauggauauaagaggauuaacacaagaugauacagcaacauauuuuugugcaagacaaaaauuugcaagaggagaucaaggaugguuuuuugauuuauggggaagaggaacacuaauaguaguaaguuca

SEQ ID NO: 49848 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaagaacagaauuaauacauuggguaagacaagcaccagggcaaggauuagaauggauaggauggguaaaaacaguaacaggagcaguaaauuuuggaaguccaaauuuuagacauagaguaaguuuaacaagagauagagauuuauuuacagcacauauggauauaagaggauuaacacaaggagauacagcaacauauuauuguguaagacaaaaauuugaaagaggaggacaaggaugguauuuugauuuauggggaagaggaacauuaauaguaguaaguagu

SEQ ID NO: 49849 - RNA, 375 nt, Artificial Sequence
  derived and/or modified sequence opt6 from anti-HIV-1_HeavyChain
caaguacaauuaguacaaaguggagcagaaguaaaaaaaccaggagcaaguguaaaaguaaguuguuggacaagugaagauauauuugaaaaaagugaauuaauacauuggguaagacaagcaccagggcaaggauuagaauggauaggauggguaaaaacaguaacaggagcaguaaauuuuggaaguagugauuuuagacaaagaguaaguuuaacaagagauagagauuuauuuacagcacauauggauauaagaggauuaacacaaggagauacagcaacauauuauugugcaagacaaaaauuuuaugcaggaggacaaggaugguauuuugauuuauggggaagaggaacauuaauaguaguaagcagu

SEQ ID NO: 49850 - RNA, 375 nt, Artificial Sequence
  derived and/or modified sequence opt6 from anti-HIV-1_HeavyChain
caagcacauuuagaacaaagcggaaguggaguaaaaaaauuaggagcaaguguaagaguaaguuguuggacaagugaagauauauuugaaagaacagaauuaauacauuggguaagacaagcaccaggacaaggauuagaauggauaggauggguaaaagcaguaaguggagcaguaaauuauggaaguuuagauuuuagacauagaguaaguuuaacaagagauagagauuuauuuacagcacauauggauauaagaggauuaacacaaggagauacagcaacauauuuuugugcaagacaaaaauuuuauaaaggaggacaaggaugguauuuugauuuauggggaagaggaacauuaauaguaguaaguagu

SEQ ID NO: 49851 - RNA, 372 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuugaaaaaucagaauuaauacauuggguaagacaagcaccaggacaaggauuagaauggauaggauggguaaaaacaguaacaggagcaguaaauuuugcacaucaaauaucagauagaguaucauuaacaagagauagagauuuauuuacagcacauauggauauaagaggauuaacacaaggagauacagcaacauauuauugugcaagacaaaaauuuuaugcaggaggacaaggaugguauuuugauuuauggggaagaggaacauuaauaguaguaaguuca

SEQ ID NO: 49852 - RNA, 375 nt, Artificial Sequence
  derived and/or modified sequence opt6 from anti-HIV-1_HeavyChain
caagcacauuuagaacaaaguggaaguggaguaaaaaaaccaggagcaaguguaagaguaaguuguuggacaagugaagauauauuuggaagaacagaauuaauacauuggguaagacaagcaccaggacaaggauuagaauggauaggauggguaaaaacaguaaguggagcaguaaauuuuggaaguccaaauuuuagacauagaguaaguuuaacaagagauagagauuuauuuacagcacauauggauauaagaggauuaacacaaggagauacagcaacauauuuuugugcaagacaaaaauuugaaagaggaggacaaggaugguauuuugaucuauggggaagaggaacauuaauauguguaagcagu

SEQ ID NO: 49853 - RNA, 636 nt, Artificial Sequence
  derived and/or modified sequence opt6 from anti-HIV_5CIN_LightChain
gaaauaguacuaacacaaucaccaggaacacaaucacuaucaccaggagaacgagcaacacuaucaugcagagcaucacaaucaguaggaaacaacaaacuagcaugguaccaacaaagacccggacaagcaccaagacuacuaauauauggagcaucaucacgaccaucaggaguagcagacagauucucaggaucaggaucaggaacagacuucacacuaacaauaucacgauuagaacccgaagacuucgcuguauacuauugccaacaauacggacaaucacuaucaacauucggacaaggcacaaaaguagaaguaaaaagaacaguagcagcacccucaguauucauauucccaccaucagacgaacaacuaaaaagcggaacagcaucaguaguaugccuacuuaacaacuucuacccaagagaagcaaaaguacaauggaaaguagacaacgcacuacaauccggaaacucacaagaaucaguaacagaacaagacucaaaagacuccacauacagccuaucaucaacauuaacauuaucaaaagcagacuacgaaaaacacaaaguauacgcaugugaaguaacacaccaaggacuauccucaccuguaacaaaaucauucaacaga

SEQ ID NO: 49854 - RNA, 672 nt, Artificial Sequence
  derived and/or modified sequence opt6 from anti-HIV_5CIN_HeavyChain
guacaacuuguacaaucaggagcagaaguaaaaagaccaggaucaucaguaacaguaucauguaaagcaucaggaggaaguuucucuacauaugcauuauccuggguaagacaagcaccaggcagaggacuagaauggaugggaggaguaauaccacuacuaacaauaacaaacuaugcuccaagauuccaaggaagaauaaccauaacagcagaccgcaguacaucaacagcauaucuagaauuaaauucauuaagaccagaagauacagcaguauauuauugugccagagaaggaaccacaggaucaggaggaaaaccaauaggagcauuugcacauuggggacaaggaacauuaguaacaguaucuucagcaucaacuaaaggaccaucaguauuuccacuagcaccaucaucaaaaucaacauccggaggaacagcagcacuaggaugcuuaguaaaagauuacuuuccagaaccaguaacaguaucauggaacucaggagcacuaacuucaggaguacauacauuuccagccguacuacaaucauccggauuauacucauuaucaucaguaguuacaguaccaucaucaucacuaggaacacaaacauauauauguaacguaaaccauaaaccaucaaauacaaaaguagauaaaaaaguagaacca

SEQ ID NO: 49855 - RNA, 678 nt, Artificial Sequence
  derived and/or modified sequence opt6 from anti-HIV_5CIL_HeavyChain
guacaauuaguacaaucaggagcagaaguaaaaagaccaggaucaucaguaacaguaucaugcaaagcaucaggaggaucauucucaacauaugcauuaucauggguaagacaagcaccaggaagaggucuagaauggaugggcggaguaauaccacuacuaacaauaacuaauuaugcaccaagauuucaagguagaauaacuauaacagcagacagaucaacuucaacagccuaucuagaacuaaauucauuaagaccagaagauacagcaguauauuauugugcaagagaagguacaacuggagauggagaucuaggaaaaccaauaggagcauuugcacauuggggacaaggaacauuaguaacuguaucaucagcaucaacaaaaggaccaucaguauuuccauuagcaccaucaucaaaaucuacaucaggaggaacagcagcauuaggaugccuaguaaaagauuauuucccagaaccaguuacaguaucauggaacucuggagcucuaacaucaggaguacauacauuuccagcaguauuacaaaguucaggacuauauucauuaucaucaguaguaacaguaccauccucaucacuaggaacacaaacauauauauguaacguaaaccauaaaccaagcaauaccaaaguagauaaaaaaguagaacca

SEQ ID NO: 49856 - RNA, 678 nt, Artificial Sequence
  derived and/or modified sequence opt6 from anti-HIV_5CIP_A-Chain
guacaauuaguacaaucaggagcagaaguaaaaagaccaggaucaucaguaacaguaucaugcaaagcaucaggaggaucauuuucaacauaugcauuaucauggguaagacaagcaccaggaagaggacuagaauggaugggaggaguaauaccauuacuaacaauaacuaauuaugcaccacgcuuucaaggaagaauuaccauuacagcagauagaucaacaucaaccgcauaucuagaacuaaacucacuaagaccagaagauacagcaguauauuacugugcacgagaaggaaccacaggauggggaugguuaggaaaaccaauaggagcauuugcacauuggggacaaggaacacuaguaaccguaucaucagcaagcacaaaaggaccaucaguauuuccauuagcaccaaguucaaaaucaacaucaggaggaacagcagcauuaggcugucuaguaaaagauuacuuuccagaaccaguaacaguuucauggaacucaggagcacuaacaucaggaguacacacauuuccagcaguauuacaaucaucaggacuauacaguuuaucaucaguaguuacaguaccaucaucaucauuaggaacacaaacauauauauguaauguaaaccauaaaccaucaaauacaaaaguagauaaaaaaguagaacca

SEQ ID NO: 49857 - RNA, 681 nt, Artificial Sequence
  derived and/or modified sequence opt6 from anti-HIV_5CIP_HeavyChain
guacaauuaguacaaucaggagcagaaguaaaaagaccaggaucaucaguaacaguaucauguaaagcaucaggaggaucauucucaacauaugcauuaucauggguaagacaagcaccaggaagaggacuagaauggaugggaggaguaauaccacuauuaacaauaacaaacuaugcaccaagauuucaaggaagaauaacaauuacagcagacagaucaacaagcacagcauauuuagaauuaaauagcuuaagaccagaagauacagcaguauauuauugugcacgagaaggaacaacaggauggggauggcuagguaaaccaauaggagcauuugcacauuggggacaaggaacauuaguaacaguaucaucagcaucaacaaaaggaccaaguguauuuccauuagcaccaucaaguaaaucaacaaguggaggaacagcagcauuaggaugucuaguaaaagauuacuuuccagaaccaguaacaguaucauggaacucaggagcacuaacuagcggaguccauacauuuccagcaguauuacaaucaucaggauuauauagucuaucaagcguaguaacaguaccaaguucaucauuaggaacacaaacauauauauguaacguaaaccauaaaccaucuaauacaaaaguagauaaaaaaguagaaccaaaa

SEQ ID NO: 49858 - RNA, 630 nt, Artificial Sequence
  derived and/or modified sequence opt6 from anti-HIV_4JKP_LightChain
gaaauaguacucacacaaagcccagcaacauuaagccuaagcccaggcgaaacagcaauaauaucauguagaacaagccaauacgguagcuuagcaugguaccaacaaagaccaggacaagcaccaagauuagucauauauagcggaucaacaagagcagccggaauaccagacagauucucaggaucaagauggggagcagacuauaaccuaagcauaucaaaucuagaaagcggagacuuuggaguauacuauugccaacaauaugaauuuuucggacaaggaacaaaaguacaaguagacauaaaaagaacaguagcagcaccaagcguauucauauuuccacccucagacgaacaauuaaaaucaggaacagcaucaguaguaugcuuacuaaauaacuuuuacccaagagaagcaaaaguccaauggaaagucgauaacgcacuacaaagcggaaauucacaagaaagcguaacagaacaagauaguaaagacucaacauauagcuuaagcucaacauuaacauuaagcaaagccgauuacgaaaaacauaaaguauacgcaugcgaagucacacaccaaggauuaagcucaccaguaacaaaaucauuuaacagaggagaaugc

SEQ ID NO: 49859 - RNA, 678 nt, Artificial Sequence
  derived and/or modified sequence opt6 from anti-HIV_3TNN_E-Chain
gaaguacaauuaguagaaucaggaggaggauuaguacaaccaggaggaucacuaagacuauccugugcagcaucaggauucacauucucaacauaugcaaugucauggguaagacaagcaccaggaaaaggacuagaauggguaucaucaauaaauaacucaggaagaaacacauucucagcagacucaguaaaaggaagauuuacaauaucaagagacaauaguaaaaacacacuauuucuaguaaugaacucacuaagagcagaagauacagcaguauauuacugugcaaaagaccuaagacuaggaggaggaucagacuauuggggacaaggaacuuuaguaacgguaucaucagcaucaacaaaaggaccaaguguauucccacuagcaccaucuucaaaaucaaccucaggaggaacagcagcacucggaugucuaguuaaagauuacuuuccagaaccaguaacaguaucauggaauaguggagcacuaacuucaggaguacauacauuuccagcaguauuacaaucuucaggacuauauucauuaucaucaguaguaacaguaccaucaucaucacuaggaacacaaacauauauauguaauguaaaccauaaaccaucaaacacaaaaguagauaaaagaguagaaccaaaaucaugugacaaaacacau

SEQ ID NO: 49860 - RNA, 705 nt, Artificial Sequence
  derived and/or modified sequence opt6 from anti-HIV_3BQU_B-Chain
agaauaacccuaaaagaaucaggaccaccccuaguaaaaccaacacaaacacuaacauuaacaugcagcuucucaggauucucauuaucagacuucggaguaggaguaggauggauacgacaaccaccaggaaaagcacuagaaugguuagcaauaauauauucagaugacgacaaaagauacucaccaucauuaaauacuagacuaacaauaacaaaagauacauccaaaaaccaaguaguccuaguaaugaccagaguaucaccaguagacacagcaacauacuucugcgcacacagaagaggaccaacaacauuauucggaguaccaauagcaagaggaccaguaaacgcaauggacguauggggucaaggaauaacaguaacaauaucaucaacaucaacaaaaggaccaucaguauucccacuagcaccaucaucaaaaucaacagcaggaggagcagcagcauuaggaugcuuaguaaaagacuacuucccagaaccaguaacaguauccuggaacucaggcgcacuaacauccggaguacacacauucccagccguauuacaaucaucaggacuauauucacuaucaagcguaguaacaguaccaucaucaucauuaggaacacaaacauacacaugcaacgucaaccacaaaccaucaaacacaaaaguagauaaacgcguagaaccaaaaucaugc

SEQ ID NO: 49861 - RNA, 642 nt, Artificial Sequence
  derived and/or modified sequence opt6 from anti-HIV_3BQU_A-Chain
gcacuacaacuaacacaaucaccaucaucacuaucagcaucaguaggagacagaauaacaauaacaugccgagcaucacaaggaguaacaucagcccuagcaugguacagacaaaaacccggauccccaccacaauuauuaauauacgacgcaucaucacuagaaucaggaguaccaagcagauucucagguucuggaucaggaacagaauuuacauuaacaaucucaacacuaagaccagaagacuucgcaacauacuacugucaacaauuacacuucuacccacacacauucggaggaggaacaagagucgacguaagaagaacaguagcagcaccaucaguauucauauucccaccaucagacgaacaauuaaaaucaggaacagcaucaguaguaugcuuacucaacaacuucuacccaagagaagcaaaaguacaauggaaaguagacaacgccuuacaaucaggaaacucacaagaauccguaacagaacaagacucaaaagacucaacuuacucacucucaucaacauuaacacuaucaaaagcagacuacgaaaaacacaaaguauacgaaugcgaaguaacacaccaaggauuaucaucaccaguaacaaaaucauucaacagaggcgaaugc

SEQ ID NO: 49862 - RNA, 387 nt, Artificial Sequence
  derived and/or modified sequence opt6 from anti-HIV_IgG_VR-Chain
auggaaacaccagcacaauuacuauuuuuauugcuauuaugguuaccagauacaacaggagaaauaguacuaacacaaucaccaggaacauuaucauuaagcgcaggagaaagagcaacauuaagcuguagagcaagccaaagcguaagcagcagauauuuagcaugguaucaacaaaaaccaggacaagcaccaagauuacuaauauacggagcaucaagcagagcaacaggaauaccagauagauuuagcggaagcggaaguggaacagauuucacacuaacaauaucaagaguagaaccagaagauuucgcaggauauuacugucaacaauacgauaacucaguauguacauuuggacaaggaacaaaauuagaaauaaaaaga

SEQ ID NO: 49863 - RNA, 348 nt, Artificial Sequence
  derived and/or modified sequence opt6 from anti-HIV_IgG_HeavyChain
augaaacaccuaugguucuuccuacuacuaguagcagcaccaagauggguacuaucacaaguacaacuacaagaaucaggaccaggacuaguaaaaccaucagaaacacuaucacuaacaugcacaguaucaggaggaucaauaucaucacacuacuggucauggauaagacaaucaccaggaaaaggauuacaauggauaggauacauauacuacucaggaucaacaaacuacucaccaucacuaaaaucaagaguaacaauaucaguagaaacaucaaaaaaccaauucucacuaaaauuaacaucaaugacagcagcagacacagcaguauacuacugcgcaaga

SEQ ID NO: 49864 - RNA, 714 nt, Artificial Sequence
  derived and/or modified sequence opt6 from anti-HIV_4P9M_HeavyChain
caaauacaucuaguacaaucaggaacugaaguaaaaaaaccaggcucaucaguaacuguaucaugcaaagcauauggaguuaacacauucgguuuauaugcaguaaauuggguaagacaagcaccaggucaaucacuagaauacauaggccaaauauggagauggaaaucuucagcuucacaucacuuuagaggaagaguauuaauaucagcaguagaucucacaggaucaucaccaccaauaagcucacucgaaauaaaaaacuuaacaucugaugauacagcaguauauuucuguacaacaacaucuacauacgacaaauggucuggauuacaccaugacggaguaauggcauuuagcucauggggacaaggaacauuaauaucaguaucagcagcaucaacaaaagguccaucuguauuuccauuagcaccaucaucuaaaucuacaucaggaggaacagcagcauuaggaugucuaguaaaagauuacuuuccagaaccaguaacaguaucauggaacucaggagcacuaacaucaggaguacauacauuuccagcugucuuacaaucaucaggacuauauucauuaagcucuguaguaacaguaccaucaucaucacuaggcacacaaacauauauauguaacguaaaccauaaacccucaaauacaaaaguagauaaacgaguagaaccaaaaucaugugacaaaaca

SEQ ID NO: 49865 - RNA, 645 nt, Artificial Sequence
  derived and/or modified sequence opt6 from anti-HIV_4P9M_LightChain
gacauccaaaugacacaaucaccaagcacacuaucagcaucaauuggagacacaguaagaauaucaugcagagcaucacaaucaaucacaggaaacuggguagcaugguaccaacaaagaccaggaaaagcaccuagacuauuaauauacagaggcgcagcauuauuaggaggaguaccaaguagauucucaggaucagcagcaggaaccgacuucacacuaacaauaggaaaccuacaagcagaagacuucggaacauuuuacugccaacaauacgacacauacccaggaacauucggacaaggaacaaaaguagaaguaaaaagaacuguagcagccccaucaguauuuauauucccaccaucagacgaacaacuaaaaucaggaacagcaucaguaguaugccuacuaaacaacuucuacccaagagaagcaaaaguacaauggaaagucgacaacgcacuacaaagcggaaauucacaagaaucaguaacagaacaagacucaaaagacucaaccuacucacuaucaucaacacuaacacuaucaaaagcagacuacgaaaaacacaaaguauacgcaugcgaaguaacacaccaaggacuaucauccccaguaacaaaaucauucaacagaggagaaugu

SEQ ID NO: 49866 - RNA, 558 nt, Artificial Sequence
  derived and/or modified sequence opt6 from anti-HIV_4P9H_C-Chain
aaaaaaguaguacuaggaaaaaaaggagacacaguagaauuaacaugcaccgcaucacaaaaaaaaucaauacaauuccacuggaaaaacucaaaccaaauaaaaauauuaggaaaccaaggaucauuccuaaccaaaggaccaucaaaacuaaacgacagagcagacucaagacgaucauuaugggaccaaggaaacuucccauuaauaauaaaaaaccuaacaauagaagacucagacacauacauaugcgaaguagaagaucaaaaagaagaaguacaauuacuaguauucggauuaacagcaaauucagacacacaccuacuacaaggccaaucacuaacacuaacacuagaaucaccuccaggcucaucaccaucuguacaaugcagaucaccaagaggaaaaaacauacaaggaggcaaaacacuaucaguaucacaacuagaacuacaagacucaggaacauggacaugcacaguacuacaaaaccaaaaaaaaguagaauucaaaauagacauaguaguccuagcauuccaaaaagcaauagauggaaga

SEQ ID NO: 49867 - RNA, 462 nt, Artificial Sequence
  derived and/or modified sequence opt6 from anti-HIV_4YBL_A-Chain
guaccaguauggaaagacgcagacacaacacuauucugcgcaucagacgcaaaagcacacgaaacagaaugccacaacguaugggcaacacacgcaugcguaccaacagacccaaacccacaagaaauacaccuagaaaacgucacagaaaacuucaacauguggaaaaacaacaugguagaacaaaugcaagaagacguaauaagccuaugggaccaaugccuacaaccaggaggagcaccaaaaauaaguuucgacccaauaccaauacacuacugcacaccagcaggauacguaauacuaaaaugcaacgacaaaaacuucaacggaacaggaccaugcaaaaacguaucaucaguacaaugcacacacggaauaaaaccaguaguaagcucaggaggaggaaauauaaaagacaacuggagaucagaacuauacaaauacaaaguaguacaaauagaa

SEQ ID NO: 49868 - RNA, 1056 nt, Artificial Sequence
  derived and/or modified sequence opt6 from anti-HIV_4R4N_V-Chain
auauggaaagacgccaauacaacauuauucugcgcaucagacgcaaaagcauaugacacagaaguacacaacguaugggcaacacacgccuguguaccaacagacccaagcccacaagaacuaaaaauggaaaacguaacagaagaauuuaauauguggaaaaacaacaugguagaacaaaugcauacagacauaauaaguuuaugggaccaaagccuaaaaccaugcguacaacucacaggaggaagugcacuaacacaagcaugcccaaaaguaacauucgaaccaauaccaauacacuacugcgcaccagcaggauacgcaauccuaaaauguaaugacaaagaauuuaacggaacaggccuauguaagaacguaucaacaguacaaugcacacacggcaucagaccugucgucucaacacaauuacuacuaaauggaucacuagcagaaggaaaaguaaugauaagaucagaaaacauaacaaacaacgucaaaaacauaauaguacaacuaaacgaaucaguaacaauaaacugcacaagaccaaauaacggaggaucaggaucaggaggagacauaagacaagcacacugcaacguaagugggagucaauggaacaaaacacuacaccaaguaguagaacaacucagaaaauacuggaacaauaacacaaucauuuucaauucaaguuccggaggagaccuagaaaucacaacacauucuuucaacugcggaggagaauuuuucuacugcaauacauccggauuauucaauucaacauggguaaauggaacagcaucaauagaaaacggaacaauaaccuuaccauguagaauaaaacaaauaauaaauauguggcaaagaguaggacaagcaauauacgcaccaccaauacaaggaguaauaagaugcgucucaaacauaacaggauuaauacuaacaagagacggaggaggaaacagcaacgaaaacgaaacauuccgaccaggaggaggagacaugagagacaacuggagaagcgaacuauacaaauacaaaguaguaaaaauugaa

SEQ ID NO: 49869 - RNA, 1065 nt, Artificial Sequence
  derived and/or modified sequence opt6 from anti-HIV_4JKP_G-Chain
guauggaaagacgcagauaccacuuuauuuugugccagcgacgcuaaagcacacgaaacagaaugccacaacguaugggcaacucacgcaugcguaccaacagacccaaacccacaagaaauacacuuagaaaacguaaccgaaaacuucaacauguggaaaaacaacaugguagaacaaaugcaagaagauguaaucucacuaugggaucaauguuuacaaccaugcguaaaauuaacaggaggaucaguaauaaaacaagcaugcccaaaaauaucauucgacccaauaccaauacacuacugcaccccagcaggauacguaauacuaaaauguaacgauaaaaacuucaacggaacagggcccugcaaaaacguaucaagcguacaaugcacacacggaaucaaaccaguaguaucaacacaacuacuauuaaacggaucauuagcagaagaagaaauaauaauaagaucggaaaaccuaaccaauaacgcaaaaacaauaauaguacauuuaaacaaaucaguagaaauaaacugcacuagaccaaguaacggaggaagcggaucaggcggagacauaagaaaagcauacugcgaaauaaacggaacaaaauggaacaaaguccuaaaacaaguaacagaaaaacuaaaagaacacuucaacaacaaaacaauaauauuccaaccaccuucaggaggagaccuagaaauaacaaugcaccacuucaacuguagaggagaauuuuucuacugcaacaccacacaacuauucaacaacacaugcauaggaaacgaaaccaugaaaggaugcaacggaacaauaacacucccauguaaaauaaaacaaauaauaaacauguggcaaggcacaggacaagcaauguaugcaccacccaucgacggcaaaauaaacugcguaaguaacauaacaggaauacuacuaaccagagauggaggcgcaaacaacacaaguaacgaaacauuccgaccaggcggaggaaauaucaaagacaacuggagaucagaacuauauaaauauaaaguaguacaaauagaagguagu

SEQ ID NO: 49870 - RNA, 723 nt, Artificial Sequence
  derived and/or modified sequence opt6 from anti-HIV_3BQU_D-Chain
augggcuggucauggauauuucuauuccuacuaucagguacagcaggcguacacucaggaguacaauuacaacaaucaggaccagaacuaguaaaaccaggugcaucaguaaaaaugucauguaaagcaucuggauacucuuucacugacuauuucaugcacuggguaaaacaaucacacggaaaaucauuagauuggauaggauacauaaauugcuauaccggagcaacaaacuacucacaaaaauuuaaaggaaaagcaacauuuaccguagauaccucaucaaauacagcauacaugcaauucaauucccuaacaucagaagacucagcaguauauuacugcgcaagaacaucaauaggauacgguuccucaccaccauucccauacuggggacaaggaacacuaguaacaguauccgcagcaaaaacaacaccaccauccguauacccacuagcaccaggaucagcagcccaaacaaauucaaugguaacacuaggaugcuuaguaaaaggauacuucccagaaccaguaacagucacauggaacucaggcuccuuauccucaggaguacacacauucccugcaguauuacaauccgaucuauauacacuaucaucaucaguaacaguacccucaucuccacgaccauccgaaaccguaacaugcaacguagcacacccagcaucaucuaccaaaguagauaaaaaaauaguaccaaga

SEQ ID NO: 49871 - RNA, 699 nt, Artificial Sequence
  derived and/or modified sequence opt6 from anti-HIV_3BQU_C-Chain
augacaauguucucauuagcacuacuacuaucacuacuacuacuauguguaucagacucaggagcagaaaccacaguaacacaaucacccgcaucauuaaguaugucaaucggagaaaaaguaaccauacgaugcauaacaucaacagacauagacgacgacaugaacugguaccaacaaaaaccaggagaaccaccaagauuacucauaucagauggaaacacacuaagaccaggaguaccaucaagauucucaucaucaggauacggaacagacuucguauucacaauagaaaacaugcuauccgaagacguagccgacuacuauugcuuacaaucagacaaccuaccauacacauucggcgguggaaccaaucuagaaauaaaaagagcagaugcagcaccaacaguaucaauauuuccaccaucaucagaacaacuaacaucaggaggagccucuguagucugcuucuuaaacaacuucuauccuaaagacauaaacguaaaauggaaaauagacggcucagaaagacaaaacggaguacuaaacucauggacagaccaagacucaaaagacucaacauacucaauguccucaacacuaacacuaacaaaagacgaauacgaaagacauaacucauacacaugcgaagcaacacacaaaacaucaacaucaccaauaguaaaaucauucaacaga

SEQ ID NO: 49872 - RNA, 333 nt, Artificial Sequence
  derived and/or modified sequence opt6 from anti-HIV_Ig_LightChain
gacguaguacuaacacaaucaccagcaucacuagcaguaucacuaggacaaagagcaacaauaucaugcaaagcaucacaaucaguagacuacgacggagacucauacaugaacugguaccaacaaaaaccaggacaaccaccaaaacuacuaauacacgcagcaagcaaccuaguaucaggaaugccagcaagauucucaggaucaggaucaggaacagacuucacacuaaacauacacccaguagaagaagaagacgcagcaacauacuacugccaacaaucaauagaagacccaccaacauucggaggaggaacaaaacuagaaauaaaa

SEQ ID NO: 49873 - RNA, 342 nt, Artificial Sequence
  derived and/or modified sequence opt6 from anti-HIV_Ig_HeavyChain
gacguacaacuacaacaaucaggaccaggacuaguaaaaccaucacaaucacuaucacacacaugcacaguaacaggauacucaauaacaucagacuacgcauggaacuggauaagacaauucccaggaaacaaacuagaauggaugggauacauaucauucuccggaucaacaucauacaacccaucacuaaaaucaagaauaucaauaacaagagacacaucaaaaaaccuauucuuccuacaacuaaacucaguaacaacagaagacacagcaacauacuacugcgcaagaggacuaccagacuacuggggacaaggaacaacacuaacaguaucauca

SEQ ID NO: 49874 - RNA, 1083 nt, Artificial Sequence
  derived and/or modified sequence opt6 from anti-HIV_4P9H_G-Chain
guauggaaagaugcagacacaacauuauuuugugcaucagacgcaaaagcacacgaaacagaaugccauaacguaugggcaacacacgccugcguaccaacagacccaaacccacaagaaauacaucuagaacaagucacagaaaacuucaacauguggaaaaauaacaugguagaacaaaugcaagaagacguaauaucucuaugggaccaaugccuacaacccugcguaaaauuaacaggaggaaguguaauaaaacaagccugcccaaaaaucagcuucgaucccauccccauccacuacuguacaccagcaggauacguaauacuaaaaugcaacgacaaaaauuucaacggaacuggaccaugcaaaaauguaagcagcguacaaugcacacacggaauaaaaccaguaguaucaacacaacuacuacucaacggaagccuugcagaagaagaaauaauaauaagaucagaaaaucuaacaaacaaugcaaaaacaauaauaguacaccuacaaaaauccgucgaaaucaacuguacaagaccaagcaacggaggaucagguucaggaggagacaucagaaaagcauacugugaaauacaaggaacuaaauggaauaaaguauuaaaacaaguaacagaaaaauuaaaagaacacuucaauaacaaaacuaucauauuucaaccaccaucaggaggagacuuagaaauaacaaugcaccacuuuaacuguagaggagaauuuuucuacugcaacacaacacaacuauuccaaaauaccugcauaggaaacgaaacaaugaaaggaugcaauggaacaauaacauuacccuguaaaauaaaacaaauaauaaacauguggcaaggaaccggacaagcaauguaugcaccaccaauagacggaaaaauaaacuguguaucacaaauaacaggaauacuacuaaccagagacggcggagcuaauaacacaucaaacgaaacauucagaccaggaggcggaaacauaaaagacaacuggagaucagaacuauacaaauacaagguuguacaaauagaaggaucacaccaccaccaccaccac

SEQ ID NO: 49875 - RNA, 147 nt, Artificial Sequence
  derived and/or modified sequence opt6 from anti-HIV_Chain
caaguacaauuaguacaaagcggaggacaaaugaaaaaaccaggagaaagcaugagaauaagcuguagagcaagcggauacgaauucauagacuguacauuaaacuggauaagacuagcaccaggaaaaagaccagaauggauggga

SEQ ID NO: 49876 - RNA, 180 nt, Artificial Sequence
  derived and/or modified sequence opt6 from anti-HIV_Chain
ccaugcugcuuugcauauauagcaagaccacuaccaagagcacacauaaaagaauacuuuuacacaagcggaaaaugcagcaauccagcaguaguauucguaacaagaaaaaacagacaaguaugugcaaauccagaaaaaaaauggguaagagaauacauaaacucacuagaaauguca

SEQ ID NO: 49877 - RNA, 249 nt, Artificial Sequence
  derived and/or modified sequence opt6 from anti-HIV_Chain
cuagaauggaugggaagaauaauaccagcaauagaugacguaacauaugcacaaacauuuagaggaagaguaacauuuagcgcagacaaauucacaacaacagcauauauggaucuaacaggauuaagaucagaagauacagcaacauauuucugugcaagagacccacaaguaaacagaagaggaaacuguuucgaucacuggggacaaggaacauuaguaacaguaagcucagcaucaacaaaagga

SEQ ID NO: 49878 - RNA, 270 nt, Artificial Sequence
  derived and/or modified sequence opt6 from anti-HIV_Chain
gauguaguaaugacacaaucaccauuaucauuaccaguaacauuaggacaaccagcaagcauaagcuguagaagcagccaaucauuaguauauagccauggagauacauaucuaaaaugcuuucaacaaagaccaggacaaagcccaagaagaccaauauacaaaguaagcaacagagacucaggaguaccagauagauuuagcggaagcggaagcggaacagauuucacacuaaaaauaucaagaguagaagcagaagauguaggagua

SEQ ID NO: 49879 - RNA, 294 nt, Artificial Sequence
  derived and/or modified sequence opt6 from anti-HIV_Chain
aguucauuugcaauaucauggguaagacaagcaccaggacaaggacuagaauggaugggaggaauaauaccaauauucgaagcaacaucauaugcacaaaaauuucaagauagacuaacaauaacaacagacgaaagcacaacaacagcauauauggaucuaaguucauuaagaagugaagauacagcaguauauuacugugcaagagcacaaggagauauauuaacagaaggauauuucgauuacuggggacaaggaacauuaguaacaguaucaagugcaagcacaaaagga

SEQ ID NO: 49880 - RNA, 297 nt, Artificial Sequence
  derived and/or modified sequence opt6 from anti-HIV_Chain
aauacauucacaagucacuacguacacuggguaagacaagcaccaggacaaggacuagaauggaugggaaugauaaacccaggaggaacaacaagauacgcaccaaaauuucaagacagaguaacacuaacaagagacacaucaacaagaacaguauacauggaacuaagaucacuaagaagugaagacacagcaguauacuacugcgcaagaccacaauacaaccuaggaagagaaccacuaaacguauggggacaaggaacaaugguaacaguaaguucagcaucaacaaaagga

SEQ ID NO: 49881 - RNA, 297 nt, Artificial Sequence
  derived and/or modified sequence opt6 from anti-HIV_Chain
auaagaucauucuauuggcauuggauaagacaaagcccaggaaaaggauuagaauggcuaggaagcguauucgauaacggacuaacaacacauaacccaagccuaaaaucaagauuaacaauaagugaagacccaagcagaaaccaaauaucacuaaaacuaagaagcaugacagcagcagauacagcaguauauuacugugcaagaggagauuacgauauacuaacaucaagcuaucaauuugacuauuggggacaaggaacauuaguagcaguaucaagcgcaagcacaaaagga

SEQ ID NO: 49882 - RNA, 300 nt, Artificial Sequence
  derived and/or modified sequence opt6 from anti-HIV_Chain
caaucagcacuaacacaaccagcauucguaucaggaucaccaggacaaucaauaacacuaucaugcacacuaggaacagaagacguaucaugguaccaacaaagaccaaacucagcaccaagacucauaauauucgacguaaaaaaaagaccaucagacguaucagacagauucucaggacacaacucagacacagcagcauuccuaacaauaucagaacuaagaccagaagacgaagcagacuacuucugcacaucauggccauacagauucgacagaggaacaaaaguagacguagca

SEQ ID NO: 49883 - RNA, 300 nt, Artificial Sequence
  derived and/or modified sequence opt6 from anti-HIV_Chain
caaucagcacuaacacaaccagcauucguaucaggaucaccaggacaaucaauaacacuaucaugcacacuaggaacagaagacguaucaugguaccaacaaagaccaaacucagcaccaagacuaauaauauucgacguaaaaaaaagaccaucagacguaucagacagauucucaggacacaacucagacacagcagcauuccuaacaauaucagaauuaagaccagaagacgaagcagaauacuucugcacaucauggccauacagauucggaagaggaacaaaaguagacguagca

SEQ ID NO: 49884 - RNA, 300 nt, Artificial Sequence
  derived and/or modified sequence opt6 from anti-HIV_Chain
caaucagcacuaacacacccagcauucguaucaggaucaccaggacaaucaauaacacuaucaugcacacuaggaacagaagacguaucaugguaccaacaaagaccaaacucagcaccaagacuaauaauauucgacguaagaaaaagaccaucagaaguaucagacagauucucaggacacaaaucagacacagcagcauuccuaacaauaucagaccuaagaccagaagacgaagcagaauacuucugcacaucauggccauacagauucgacagaggaacaagacuagacguagca

SEQ ID NO: 49885 - RNA, 300 nt, Artificial Sequence
  derived and/or modified sequence opt6 from anti-HIV_Chain
caaucaguauuaacacaaccagcauucguaucaggaucaccaggacaaucaauaacaauaucauguacaguaggaacaacagauguaucaugguaucaacaaagaccaaacucagcaccaagacuaauaauauucgauguaaaaaaaagaccaaguggaguaucagacagauuuucaggaucaucaucagauaacgcagcauuucuaacaauagcaggauuaagaccagaagaugaagcagaauauuacuguacaucauggccauacagauucggaagaggaacaaaaguagauguagga

SEQ ID NO: 49886 - RNA, 300 nt, Artificial Sequence
  derived and/or modified sequence opt6 from anti-HIV_Chain
caaucaguacuaacacaaccagcauucguaucagcaucaccaggacaaucaauaacacuaucaugcaaccuaggaacagacuacguaucaugguaccaacaaagaccaucaucagcaccaagacuaauaauauucgacguaaaaaacagaccaucaggaguaucagacagauucucaggauacaacucagacacagcagcauuccuaacaauaucaggauuacaaccagaagacgaagcagaauacuacugcacaucauggccauacaacuucggaccaggaacaaaaguagacguaaca

SEQ ID NO: 49887 - RNA, 300 nt, Artificial Sequence
  derived and/or modified sequence opt6 from anti-HIV_Chain
caaucaguacuaacacaaccagcaucaguaucaggaucaccaggacaaucaauaaacauaucaugcgcaggaagaucagacagaguaucaugguaccaacaaagaccaaacggaguaccaaaacuacuacuauucgacguauacagaagaccaucaggaguaucagacagauucucaggaucacacucagacgacacagcauuccuaacaauaucaggacuacaaacagacgacgaagcagacuacuacugcacaucacacccauacgcauucggaccaggaacaaaaguaaacguacua

SEQ ID NO: 49888 - RNA, 300 nt, Artificial Sequence
  derived and/or modified sequence opt6 from anti-HIV_Chain
caaucaguacuaacacaaccagcauucguaucaggaucaccaggacaaucaauaacacuaucaugcacacuaggaacagaagacguaucaugguaccaacaaagaccaaacucagcaccaagacuaauaauauucgacguaaaaaaaagaccaucagacguaucagacagauucucaggacacaacucagacacagcagcauuccuaacaauaucagaacuaagaccagaagacgaagcagaauacuucugcacaucauggccauacagauucggaagaggaacaaaaguagacguagca

SEQ ID NO: 49889 - RNA, 306 nt, Artificial Sequence
  derived and/or modified sequence opt6 from anti-HIV_Chain
caaagcgcacuaacacaaccagcaagcguaucaggaucaccaggacaaucaauaacaauaucaugcacagcagauagcgauuacguaagcugguaccaacaaagaccaaauagcgcaccaaaauuaauacuauuugacguaaacucaagaccaagcggaguaucagacagauacucaggaucaagaucaggaaauacagcaucauuaacaauaagcggacuacaaagagaagacgaagcagauuacuuuugcacaccauggccauaugacuuuagaccaggaacaagaguauucguacuaggacaa

SEQ ID NO: 49890 - RNA, 306 nt, Artificial Sequence
  derived and/or modified sequence opt6 from anti-HIV_Chain
caaucagcacuaacacaaccagcauucguaucaggaucaccaggacaaucaauaacacuaucaugcucacuaggaacagcagacguaucaugguaccaacaaagaccaaacucagcaccaagacuaauaauauucgacguaaaaaaaagaccaucagacguaucagacagauucucaggacacaacucagacacagcagcauucguaacaauaucagaacuaagaccagaagacgaagcagaauacuucugcacaucauggccauacagauucggaccaggaacaaaaguagacguagcaagacaa

SEQ ID NO: 49891 - RNA, 306 nt, Artificial Sequence
  derived and/or modified sequence opt6 from anti-HIV_Chain
caaucaguacuaacacaaccagcaucaguaucaggaucaccaggacaaacaauaucaauaucaugcucaggaacauucggaucagacucaguaucaugguaccaacaauucccaaacucagcaccaacacuaauaauauucgacguacacagaagaccaucaggaauaucaacaagauucucaggauccacaucaggagacacagcaucacuaacaauaucaacacuacacagagaagacgaagcauucuacuacugcacaucacacccauacgacuucggaggaggaacauacguaauaguacua

SEQ ID NO: 49892 - RNA, 306 nt, Artificial Sequence
  derived and/or modified sequence opt6 from anti-HIV_Chain
caaucaguacuaacacaaccagcaucaguaucaggaucaccaggacaaacaauaucaauaucaugcucaggaacauucggaucagacucaguaucaugguaccaacaauacccaaacucagcaccaacacuaauaauauucgacguacacagaagaccaucaggaauaucaacaagauucucaggaucaacaucaggagacacagcaucacuaacaauaucaacacuacacagagaagacgaagcauacuacuacugcacaucacacccauacgacuucggaggaggaacauacguaauaguacua

SEQ ID NO: 49893 - RNA, 306 nt, Artificial Sequence
  derived and/or modified sequence opt6 from anti-HIV_Chain
caaucagcacuaacacaaccagcaucaguaucaggaucaccaggacaaucaauaaacauaucaugcgcaggaagaucagacagaguaucaugguaccaacaaagaccaaacggaguaccaaaacuacuaauguucgacguauacagaagaccaucaggaguaucagacagauucucaggaucacacucaggagacacagcauuccuaacaauaucaggacuacaaacagaagacgaagcagacuacuacugcacaagccacccauacgcauucggagcaggaacaaaaguaaacguacuaagacaa

SEQ ID NO: 49894 - RNA, 306 nt, Artificial Sequence
  derived and/or modified sequence opt6 from anti-HIV_Chain
gacauacaaaugacacaaucaccaucaucauuaucagcaucaguaggagacagaguaucaauacacugucaagcaggacaaggaauaggaucaucauuaaacugguaccaacaaaaaccaggaagagcaccaagacuauuaguacacggagcaucaaaucuacaaagaggaguaccaucaagauucucaggaucaggauuucacacaacauuuacacuaacaauaucaucacuacaaccagacgacguagcaacauacuggugcgcagcauuagaauuuuucggaccaggaacaaaaguagaaaua

SEQ ID NO: 49895 - RNA, 309 nt, Artificial Sequence
  derived and/or modified sequence opt6 from anti-HIV_Chain
gacauacaaaugacacaaucaccaucaucacuaucagcaucaguaggagacacaguaacaauaacaugccaagcaaacggauaccuaaacugguaccaacaaagaagaggaaaagcaccaaaacuacuaauauacgacggaucaaaacuagaaagaggaguaccaucaagauucucaggaagaagauggggacaagaauacaaccuaacaauaaacaaccuacaaccagaagacauagcaacauacuucugccaaguauacgaauucguaguaccaggaacaagacuagaccuaaaaagaacaguagca

SEQ ID NO: 49896 - RNA, 309 nt, Artificial Sequence
  derived and/or modified sequence opt6 from anti-HIV_Chain
gacauacaaaugacacaaucaccaucaucacuaucagcaagaguaggagacacaguaacaauaacaugccaagcaaacggauaccuaaacugguaccaacaaagaagaggaaaagcaccaaaacuacuaauauacgacggaucaaaacuagaaagaggaguaccagcaagauucucaggaagaagauggggacaagaauacaacuuaacaauaaacaaccuacaaccagaagacguagcaacauacuucugccaaguauacgaauucauaguaccaggaacaagacuagaccuaaaaagaacaguagca

SEQ ID NO: 49897 - RNA, 309 nt, Artificial Sequence
  derived and/or modified sequence opt6 from anti-HIV_Chain
gacauacaaaugacacaaucaccaucaucacuaucagcaagaguaggagacacaguaacaauaacaugccaagcaaacggauaccuaaacugguaccaacaaagaagaggaaaagcaccaaaacuauuaauauacgacggaagcaaacuagaaagaggaguaccaagcagauucucaggaagaagauggggacaagaauacaaccuaacaauaaacaaccuacaaccagaagacauagcaacauacuucugccaaguauacgaauucgcaguaccaggaacaagacuagaccuaaaaagaacaguagca

SEQ ID NO: 49898 - RNA, 309 nt, Artificial Sequence
  derived and/or modified sequence opt6 from anti-HIV_Chain
gacauacaaaugacacaaucaccaucaucacuaucagcaucaguaggagacacaguaacaauaacaugccaagcaaacggauaccuaaacugguaccaacaaagaagaggaaaagcaccaaaacuacuaauauacgauggaucaaaacuagaaagaggaguaccaucaagauucucaggaagaagauggggacaagaauacaaccuaacaauaaacaaccuacaagcagaagacauagcaacauacuucugccaaguauacgaauucgcaguaccaggaacaagacuagaccuaaaaagaacaguagca

SEQ ID NO: 49899 - RNA, 309 nt, Artificial Sequence
  derived and/or modified sequence opt6 from anti-HIV_Chain
gacauacaaaugacacaaucaccaucaucacuaucagcaucaguaggagacacaguaacaauaacaugccaagcaaacggauaccuaaacugguaccaacaaagaagaggaaaagcaccaaaacuacuaauauacgacggaucaaaacuagaaagaggaguaccaucaagauucucaggaagaagauggggacaagaauacaaccuaacaauaaacaaccuacaaccagaagacauagcaacauacuucugccaaguauacgaauucauaguaccaggaacaagacuagaccuaaaaagaacaguagca

SEQ ID NO: 49900 - RNA, 309 nt, Artificial Sequence
  derived and/or modified sequence opt6 from anti-HIV_Chain
gacauacaaaugacacaaucaccaucaucacuaucagcaagaguaggagacacaguaacaauaacaugccaagcaaacggauaccuaaacugguaccaacaaagaagaggaaaagcaccaaaacuacuaauauacgacggaucaaaacuagaaacaggaguaccaucaagauucacaggaagaagauggggacaagaauacaaccuaacaauaaacaaccuacaaccagaagacauagcaacauacuucugccaaguauacgaauucaucguaccaggaacaagacuagaccuaaaaagaacaguagca

SEQ ID NO: 49901 - RNA, 312 nt, Artificial Sequence
  derived and/or modified sequence opt6 from anti-HIV_Chain
gauauacaaaugacacaaucaccaucaagcuuaagcgcaagcguaggagauaaaguaacaauaacaugucaaacaagcgcaggauaucuaaauugguaucaacaaagaagaggaagagcaccaaaauuacuaauguacgauggaucaagauuaguaacaggaguaccaucaagauuuagcggaagaagauggggaacacaauacaaucuaacaauaggaagcuuacaaccagaagauguagcaacauauuacugucaaguauacgaauucuuuggaccaggaacaagauuagacuuaaaaagaacaguagca

SEQ ID NO: 49902 - RNA, 312 nt, Artificial Sequence
  derived and/or modified sequence opt6 from anti-HIV_Chain
gauauacaaaugacacaaucaccaucaagcuuaagcgcaagcguaggagauaaaguaacaauaacaugucaaacaagcgcaggauaucuaaauugguaucaacaaagaagaggaagagcaccaaaauuacuaauguacgauggaucaagauuaguaacaggaguaccaucaagauuuagcggaagaagauggggaacacaauacaauuuaacaauaggaagcuuacaaccagaagauauagcaacauauuacugucaaguauacgaauucuuuggaccaggaacaagauuagacuuaaaaucaacaguagca

SEQ ID NO: 49903 - RNA, 312 nt, Artificial Sequence
  derived and/or modified sequence opt6 from anti-HIV_Chain
gacauacaaaugacacaaucaccaucaagccuaagcgcaagaguaggagacacaguaacaauaacaugccaagcaaacggauaccuaaacugguaccaacaaagaagaggaaaagcaccaaaacuacuaauauaugacggaagcaaacuagaaagaggaguaccagcaagauucucaggaagaagauggggacaagaauacaaccuaacaauaaacaaccuacaaccagaagacguagcaacauacuucugccaaguauacgaauuuauaguaccaggaacaagacuagacuuaaaaagaacaguagcagca

SEQ ID NO: 49904 - RNA, 312 nt, Artificial Sequence
  derived and/or modified sequence opt6 from anti-HIV_Chain
ugcacaguaucaggaggaagcauaauaucauacuauuggaauuggauaagacaaagcccaggaaaaggauuagaauggcuaggauacauauucgauggaggaagagcaaacuauaacccaagcuuaagaucaagauuaacaaugagcguagacacaagcaaaaaccaaauaucacuaaaaguaaaaagcguaacagcagcagauagcgcaauauauuacugugcaagacuagauggagaagcauuuagauauuacuuugacucauggggacaaggaacauuaguaacaguaucaagcgcaagcacaaaagga

SEQ ID NO: 49905 - RNA, 312 nt, Artificial Sequence
  derived and/or modified sequence opt6 from anti-HIV_Chain
guaagcggaggaagauucucaaacuauggauuaagcuggguaagacaagcaccaggacaaggacuagaauggaugggaagaauaguaccagcaauaaauagagcaaaauaugcacaaaaauuucaaggaagaguaauauuaacagcagacaaaauaacagacacagcauauauggaacuaagaucauuaagaagcgaagauacagcaauauuuuacugugcaagagacccacaaauagaaauaagaggaaacgcauucgauauauggggacaaggaacaguaguaacaguaaguucagcaucaacaaaagga

SEQ ID NO: 49906 - RNA, 315 nt, Artificial Sequence
  derived and/or modified sequence opt6 from anti-HIV_Chain
ucagauauaucaguagcaccaggagaaacagcaagaauaucaugcggagaaaaaucauuaggaucaagagcaguacaaugguaucaacauagagcaggacaagcaccaucauuaauaauauacaauaaccaagacagaccaucaggaauaccagaaagauuuucaggaucaccagacucaccauuuggaacaacagcaacauuaacaauaacaucaguagaagcaggagacgaagcagauuacuauugccauauaugggacucaagaguaccaacaaaauggguauucggaggaggaacaacacuaacaguacua

SEQ ID NO: 49907 - RNA, 315 nt, Artificial Sequence
  derived and/or modified sequence opt6 from anti-HIV_Chain
ucaucaaugucaguaucaccaggagaaacagcaaaaauaucaugcggaaaagaaucaauaggaucaagagcaguacaaugguaucaacaaaaaucaggacaaccaccaucauuaauaauauacaauaaccaagacagaccaucaggaguaccagaaagauuuucagcaacaccagacuucggagcaggaacaacagcaacauuaacaauuacaaauguagaagcagaugacgaagcagauuacuacugccauauauaugacgcaagaggaggaacaaacuggguauuugacagaggagcaacauuaacaguacua

SEQ ID NO: 49908 - RNA, 315 nt, Artificial Sequence
  derived and/or modified sequence opt6 from anti-HIV_Chain
ucauuuguaagcguagcaccaggacaaacagcaagaauaacaugcggagaagaaucauuaggaucaagaucaguaauaugguaccaacaaagaccaggacaagcaccaucacuaauaauauacaacaacaaugacagaccaucaggaauaccagaaagauucucaggaucaccaggaucaacauucggaacaacagcaacacuaacaauaacaucaguagaagcaggagacgaagcagacuacuacugccacauaugggacucaagaagaccaacaaacuggguauucggagaaggaacaacacuaacaguacua

SEQ ID NO: 49909 - RNA, 315 nt, Artificial Sequence
  derived and/or modified sequence opt6 from anti-HIV_Chain
ucauuuguaaguguagcaccaggacaaacagcaagaauaacauguggagaagaaucauuaggaaguagaaguguaauaugguaucaacaaagaccaggacaagcaccaucauuaauaauguauaauaaucaugacagaccaagcggaauaccagaaagauuuucaggaucaccaggaaguacauucggaacaacagcaacauuaacaauaacaaguguagaagcaggagaugaagcagacuauuacugucauauaugggauaguagaagaccaacaaauuggguauucggagaaggaacaacauuaacaguauua

SEQ ID NO: 49910 - RNA, 315 nt, Artificial Sequence
  derived and/or modified sequence opt6 from anti-HIV_Chain
gauauacaaaugacacaaucaccaucaagcuuaagcgcaagcguaggagauaaaguaacaauaacaugucaaacaagcgcaggauaucuaaauugguaucaacaaagaagaggaagagcaccaaaauuacuaauguacgauggaucaagauuaguaacaggaguaccaucaagauuuagcggaagaagauggggaacacaauacaaucuaacaauaggaagcuuacaaccagaagauauagcaacauauuacugucaaguauacgaauucuuuggaccaggaacaagacuagacuuaaaaucaacaguagcagca

SEQ ID NO: 49911 - RNA, 315 nt, Artificial Sequence
  derived and/or modified sequence opt6 from anti-HIV_Chain
gauauacaaaugacacaaucaccaucaagcuuaagcgcaagcguaggagauagaguaagcauaaacugucaagcaggacaaggauuaggaucaagcuuaaacugguaccaacaaaaaccaggaagagcaccaaaacuauuaguacauggagcaagcaaucuacaaagaggaguaccaagcagauucucaggaucaggauuucacacaacauuuacauuaacaauaagcucacuacaaccagaugacguagcaacauacuuuugcgcagcauuucaaugguucggaccaggaacaaaaguagaaauaaaaagaaca

SEQ ID NO: 49912 - RNA, 318 nt, Artificial Sequence
  derived and/or modified sequence opt6 from anti-HIV_Chain
ugcacaguaagcggaggaucaauaucaucagcaggauacuacuggacauggauaagacaacacccaggaaaaggacuagaauucauaggauacauauacuacauaggaacaacauacuacaacccaucacuaaaaucaagacuaacaauaucaauagacacaucaaaaaaccaauucucacuaaaacuaucaucaguaacagcagcagacacagcaauauacuacugcgcaagagacuacacagcaagaggaagacacuucuucgacuacuggggacaaggagcacuaguaacaguaucaucagcaucaacaaaagga

SEQ ID NO: 49913 - RNA, 321 nt, Artificial Sequence
  derived and/or modified sequence opt6 from anti-HIV_Chain
ucaucacuaccacuaucacuagcaccaggagcaacagcaaaaauaccaugcggagaaaaaucaagaggaucaagagcaguacaaugguaccaacaaaaaccaggacaagcaccaacacuaauaauauacaacaaccaagacagaccagcaggaguaucagaaagauacucaggaaacccagacguagcaauaggaguaacagcaacacuaacaauaucaagaguagaagcaggagacgaagcagaauacuacugccacuacugggacucaagaucaccaauaucauggguauucggaggauggacacaacuaacaguacua

SEQ ID NO: 49914 - RNA, 321 nt, Artificial Sequence
  derived and/or modified sequence opt6 from anti-HIV_Chain
agcucauuaccauuaaguguagcaccaggagcaacagcaaaaauagcauguggagaaaaaucauuugcaagcagagcaguacaaugguaucaacaaaaaccaggacaagcaccaguauuaauaauauauaauaaucaagauagaccagcaggaguaucagaaagauuuucaggaacaccagauguaggauuuggaaguacagcaacacuaacaauaucaagaguagaagcaggagaugaagcagauuauuacugucauaaaugggauaguagaaguccauuaucauggguauuuggaggaggaacacaauuaacaguauua

SEQ ID NO: 49915 - RNA, 321 nt, Artificial Sequence
  derived and/or modified sequence opt6 from anti-HIV_Chain
gacauacaaaugacacaaucaccaucaucauuaucagcaucaauaggagacagaguaacaauaacaugcagagcaucacaagacauagcaaacuaccuaaacugguaccaaaaaaaaucaggaacaccaccaaaacuacuaauauucgcagcaacaaaccuacaccgaggaguaucaccaagauucacaggaucaggacacggaacacacuucucacuaacaauaacaaacguacaacacgaagacuucggaaacuacuucugccaacaaucauucgcaacaguaggaucauucggacaaggaacauggguagacauacga

SEQ ID NO: 49916 - RNA, 321 nt, Artificial Sequence
  derived and/or modified sequence opt6 from anti-HIV_Chain
gacauacaaaugacacaaucaccaucaucacuaucagcaucaauaggagacagaguaacaauaacaugcagagccucacaagacauagcaaacuaccuaaacugguaccaaaaaaaaucaggaacaccaccaaaacuacuaauauucgcagcaacaaaccuacacagaggaguaucaccaagauucacaggaucaggacacggaacacacuucucacuaacaauaacaaacguacaacacgaagacuucggacacuacuucugccaacaaucauucgcaacaguaggaucauucggacaaggaacauggguagacauaaga

SEQ ID NO: 49917 - RNA, 321 nt, Artificial Sequence
  derived and/or modified sequence opt6 from anti-HIV_Chain
gacauacaaaugacacaaucaccaucaucacuaucagcaucaguaggagacagaguaacaauaacaugcagagcaucacaagacauagcaaacuaccuaaacugguaccaaaaaaaaucaggaacaccaccaaaacuacuaauauucgcagcaacaaaccuacacagaggaguaucaccaagauucucaggaucaggaucaggaacacacuucucacuaacaauaacaaacguacaauacgaagacuucgcaaacuacuucugccaacacucauucggaacaauaggaacauucggacaaggaacauggguagacauaaga

SEQ ID NO: 49918 - RNA, 321 nt, Artificial Sequence
  derived and/or modified sequence opt6 from anti-HIV_Chain
gacauacaaaugacacaaucaccaucaucacuaucagcaucaauaggagacagaguaacaauaacaugcagagcaucacaagacauagcaaacuaccuaaacugguaccaaaaaaaaucaggaacaccaccaaaacuacuaauauucggagcaacaaaccuacaccacggaguaucaccaagauucucaggaucaggacacggaacacacuucucauuaacaauaacaaacguacaacacgaagacuucgcaaacuacuucugccaacaaucauuccaaacaguaggaucauucggacaaggaacauggguagacauaaga

SEQ ID NO: 49919 - RNA, 321 nt, Artificial Sequence
  derived and/or modified sequence opt6 from anti-HIV_Chain
gaaauaguacuaacacaaucaccagcaacauuaaguuuaagcccaggagaaacagcaauaauaagcuguagaacaagccaaagcggaagccuagcaugguaccaacaaagaccaggacaagcaccaagauuaguaauauauagcggaagcacaagagcagcaggaauaccagacagauucucaggaucaagauggggagcagacuauaacuuaagcauaaguaaucuagaaagcggagacuuuggaguauacuauugccaacaauaugaauuuuucggacaaggaacaaaaguacaaguagauauaaaaagaacaguagca

SEQ ID NO: 49920 - RNA, 321 nt, Artificial Sequence
  derived and/or modified sequence opt6 from anti-HIV_Chain
gacauacaaaugacacaaucaccaucaucacuaucagcaucaauaggagacagaguaaacauaacaugccaagcaucaagagacacaggaucagcacuaaacugguaccaacaaaaaguaggaagaccaccaagacuacuaauaucagcaguaucaaacuuaggagcaggaguaccaucaagauucucaggaagaagaucaggaacacaaagcacacuaacaauaaacacacuacaaccagaagacauagcaacauacuucugccaacacuacgaauucuucggaccaggaacaaaaguagacauaaaaagaacaguagca

SEQ ID NO: 49921 - RNA, 321 nt, Artificial Sequence
  derived and/or modified sequence opt6 from anti-HIV_Chain
gauauacaaaugacacaaucaccaucaucauuaagcgcaagcguaggagauagaguaacaauaacaugucaagcaggacaaggaauaggaagcagcuuacaaugguaccaacaaaaaccaggaaaagcaccaaaacuauuaguacauggagcaagcaaucuacauagaggaguaccaagcagauucucaggaucaggauuucacacaacauuuagcuuaacaauaagcggacuacaaagagaugacuuugcaacauacuuuugcgcaguauuagaauuuuucggaccaggaacaaaaguagaaauaaaaagaacaguagca

SEQ ID NO: 49922 - RNA, 324 nt, Artificial Sequence
  derived and/or modified sequence opt6 from anti-HIV_Chain
agcuauguaagaccauuaaguguagcauuaggagaaacagcaaguauaaguuguggaagacaagcauuaggaaguagagcaguacaaugguaucaacauagaccaggacaagcaccaauauuauuaauauauaauaaucaagauagaccaaguggaauaccagaaagguuuucaggaacaccagauauaaauuuuggaacaagagcaacacuaacaauaucaggaguagaagcaggagaugaagcagauuauuauugucauaugugggauaguagaaguggauuuucauggaguuuuggaggagcaacaagauuaacaguacua

SEQ ID NO: 49923 - RNA, 324 nt, Artificial Sequence
  derived and/or modified sequence opt6 from anti-HIV_LightChain
gacauacuaaugacacaaucaccaucacuacuauccgcaucaguaggagacagaguaacaauaacaugcaaagcaucacaagacguaucaacagcaguagcaugguaccaacaaaaaccaggaaaagcaccaaaacuacuaauauacugggcaucaacaagacauacaggaguaccaucaagauucacaggaucaggaucaggaacagacuucacacuaacaauaucaagacuacaagcagaagacuucgcacuauacuacugccaacaacacuacacaacaccauggacauucggaggaggaacaaaaguagaaauaaaaaga

SEQ ID NO: 49924 - RNA, 324 nt, Artificial Sequence
  derived and/or modified sequence opt6 from anti-HIV_LightChain
gacauaguaaugacacaaucaccaucacuacuaucagcaucaguaggagacagaguaacaauaacaugcaaagcaucacaagacguaucaacagcaguagcaugguaccaacaaaaaccaggaaaagcaccaaaacuacuaauauacugggcaucaacaagacacacaggaguaccaucaagauucucaggaucaggaucaggaacagacuucacacuaacaauaucaucacuacaaccagaagacuucgcacuauacuacugccaacaacacuacacaacaccauggacauucggaggaggaacaaaaguagaaauaaaaaga

SEQ ID NO: 49925 - RNA, 324 nt, Artificial Sequence
  derived and/or modified sequence opt6 from anti-HIV_Chain
gacauacaaaugacacaaucaccaucaucacuaucagcaucaguaggagacacaguaacaauaaacugccaaacaaacaaaggauaccuaaacugguaccaacaaagaagaggaagagcaccaaaacuauuaauguacgacggaucaaaacuaguaacaggaguaccaucaagauucucaggaagaagauggggaacacaauacaaccuaacaauaggaucacuacaaccagaagacauagcaacauacuacugccaaguauacgaauucuucggaccaggaacaagacuagaccuaaaaagaacaguagcagcaccaucagac

SEQ ID NO: 49926 - RNA, 333 nt, Artificial Sequence
  derived and/or modified sequence opt6 from anti-HIV_Chain
cuaucagcauacguaggagacagaguaacaauaacaugcagagcaucacaaaacauaaacacauaucuaaacugguaccaacaaagaccaggaaaagcaccaaaacuacuaauauacgcagcaucaacacuacaaucaggaguaccaucaagauucucaggaucaggaucaggaacagacuucacauuaacaauaucaaaccuagaaacagaagacuucgcaguauacuacugccaacaaacauacucaucaguaacauucggccaaggaacaaaacuagaaacaagaagaacaguagcagcaccaucaguauucauauucccaccaucagac

SEQ ID NO: 49927 - RNA, 333 nt, Artificial Sequence
  derived and/or modified sequence opt6 from anti-HIV_Chain
gaaauaguacuaacacaaucaccagcaacauuaucauuaagcccaggagaaagagcaacacuaagcuguagagcaagccaaggaguaaacuuuguaguaugguaucaacaaaaacgaggacaagcaccaagauuacuaauauacggaaacucagacagaguaccaggaguaccagauagauuuagcgcaagaggaagcggaacagaauuuagccuaguaauaucaagcguagaaccagacgauuucgcacuauauuacugucaagaauacucaagcacaccauauaacuucggaccaggaacaagaguagacagaaaaagaacaguagcagca

SEQ ID NO: 49928 - RNA, 336 nt, Artificial Sequence
  derived and/or modified sequence opt6 from anti-HIV_HeavyChain
gaaguaaaacuagaagaaucaggaggaggacuaguacaaccaggaggaucaagaaaacuaucaugcgcagcaucaggauucacauucucaucauucggaaugcacuggguaagacaagcaccagaaaaaggacuagaauggguagcauacauaucaucaggaucaucaacacuacacuacgcagacacaguaaaaggaagauucacaauaucaagagacaacccaaaaaacacacuauuccuacaaaugaaacuaccaucacuaugcuacggacuacuaggaucaagaaaccuaucacacagacuacuaucacaaaacgacacaccaauaugccua

SEQ ID NO: 49929 - RNA, 336 nt, Artificial Sequence
  derived and/or modified sequence opt6 from anti-HIV_Chain
gaaauaguacuaacacaaucaccagcaacauuaagcuuaagcccaggagaaagagcaacauuaagcuguagagcaagccaaggaguaaacuuuguaguaugguaucaacaaaaaagaggacaagcaccaagauuauuaauauacggaccaucagacagagcaccaggaguaccagauagauuuagcgcaagaggaagcggaacagaauucucauuaguaauaucaagcguagaaccagacgauuucgcacuauauuacugucaagaauacucaagcacaccauauaacuuuggaacaggaacaagaguagacagaaaaagaacaguagcagcacca

SEQ ID NO: 49930 - RNA, 336 nt, Artificial Sequence
  derived and/or modified sequence opt6 from anti-HIV_Chain
caaacacuaucacuaacaugcucaguaucaggaggaaguauaaguucagcaggauacuauuggggauggauaagacaacacccaggaaaaggauuagaauggauaggacacauauauuauagcggaaauacaaacuauaacccaucauuaaaaagcagauuaaguaugagcguagaaacaagcaaaaaccaauucucacuaaaucuagcaaguguaacagcagcagauacagcaguauauuucugugcaagagacuauagcgcagcaggaagacaucuauuugacucauggggacaaggaauauuaguaacaguaucaagcgcaagcacaaaagga

SEQ ID NO: 49931 - RNA, 336 nt, Artificial Sequence
  derived and/or modified sequence opt6 from anti-HIV_LightChain
gacauaguaaugacacaacaaacaccacuaacacuaucaauaacaauaggacaaccagcaucaauaucaugcaaaucaucacaaucacuacuagacucagacggaaaaacauaccuaaacuggcuacuacaaagaccaggacaaucaccaaaaagacuaauauacuggaugucaaaacuagacucaggaguaccagacagauucacaggaucaggaucaggaacagacuucacacuaaaaauaucaagaguagaagcagaagaccuaggaguauacuacugcuggcaaggaacacacuucccauggacauucggaggaggaacaaaacuagaacua

SEQ ID NO: 49932 - RNA, 339 nt, Artificial Sequence
  derived and/or modified sequence opt6 from anti-HIV_LightChain
gacauaguaauaacacaaucaacaaaauucaugucaacaucaguaggagacagaguaucaauaacaugcaaagcaucacaagacguaucaacagcaguagcaugguaccaacaaaaaccaggacaaucaccaaaacuacuaauauacugggcaucaacaagacacacaggaguaccagacagauucacaggaucaggaucaggaacagacuacacacuaacaauaucaagaguacaagcagaagaccuagcacuauacuacugccaacaacacuacacaacaccauggacauucggaggaggaacaaaauuagaaauaaaaagaacaguagcagcacca

SEQ ID NO: 49933 - RNA, 339 nt, Artificial Sequence
  derived and/or modified sequence opt6 from anti-HIV_Chain
gacauacaaaugacacaaagcccaucaucacuaucagcaagaguaggagacacaguaacauucacaugccaagcaaacggauaccuaaacugguaccaacaaagaagaggaaaagcaccaaaacuacuaauauacgacggaucaaaacuagaaagaggaguaccaucaagauucucaggaagaagauggggacaagaauacaaccuaacaauaaacaaccuacaaccagaagacauagcaacauacuucugccaaguauacgaauucgcaguaccaggaacaagacuagaccuaaaaagaacaguagcagcaccaucaguauucauauucccaucagac

SEQ ID NO: 49934 - RNA, 339 nt, Artificial Sequence
  derived and/or modified sequence opt6 from anti-HIV_Chain
caaucaguacuaacacaaccagcaucaguaucaggaucaccaggacaaucaauaacaauaucaugcacaggaacaaacucagacguaggauacucauacguauccugguuccaacaacacccaggaaaaguaccaaaacuacuaauauacgacguaucaagaagaucaucaggaguaucaaacagauucucaggaucaagaucaggaaacacagcaucacuaacaauaucaggacuaagagcagaagacgaagcagacuacuacugcggaucauucacaacaucacuaacauuaguauucggaggaggaacaaaacuagcaguauuaguaucaccauca

SEQ ID NO: 49935 - RNA, 339 nt, Artificial Sequence
  derived and/or modified sequence opt6 from anti-HIV_Chain
ucacuaucagcaucaguaggagacagaguaacaauaacaugcagagcaucagaaucaauauccuucuaccuaaacugguaccaacaaaaaccaggaaaagcaccagaacuacuaauauucgcaacaucaacacuacacucaggaguaccaucaagauucucaggaucaggaucaggaacagacuucacacuaacaauaucaucacuacaacuagaagacuucgcaacauacuacugccaacaaucaucaucaacaccauucacauucggaggaggaacaaaaguagaaauaaaaagaacaguagcagcaccaucaguauucauauucccaccaucagac

SEQ ID NO: 49936 - RNA, 342 nt, Artificial Sequence
  derived and/or modified sequence opt6 from anti-HIV_Chain
gacauacaaaugacacaaucaccaucaucauuaucagcaucaguaggagacacaguaacaauaacaugccaagcaaacggauaccuaaacugguaccaacaaagaagaggaaaagcaccaaaacuacuaauauacgacggaucaaaacuagaaagaggaguaccaucaagauucucaggaagaagauggggacaagaauacaaccuaacaauaaacaaccuacaaccagaagacauagcaacauacuucugccaaguauacgaauucauaguaccaggaacaagacuagaccuaaaaagaacaguagcagcaccaucaguauucauauucccaccaucagac

SEQ ID NO: 49937 - RNA, 342 nt, Artificial Sequence
  derived and/or modified sequence opt6 from anti-HIV_Chain
gacauacaaaugacacaaucaccaucaucacuaucagcaagaguaggagacacaguaacaauaacaugccaagcaaacggauaccuaaacugguaccaacaaagaagaggaaaagcaccaaaacuacuaauauacgacggaucaaaacuagaaagaggaguaccaucaagauucucaggaagaagauggggacaagaauacaaccuaacaauaaacaaccuacaaccagaagacauagcaacauacuucugccaaguauacgaauucgcaguaccaggaacaagacuagaccuaaaaagaacaguagcagcaccaucaguauucauauucccaccaucagac

SEQ ID NO: 49938 - RNA, 342 nt, Artificial Sequence
  derived and/or modified sequence opt6 from anti-HIV_Chain
gacauacaaaugacacaaucaccaucaucacuaucagcaagaguaggagacacaguaacaauaacaugccaagcaaacggauaccuaaacugguaccaacaaagaagaggaaaagcaccaaaacuacuaauauacgacggaucaaaacuagaaagaggaguaccaucaagauucucaggaagaagauggggacaagaauacaaccuaacaauaaacaaccuacaaccagaagacauagcaacauacuucugccaaguauacgaauucguaguaccaggaacaagacuagaccuaaaaagaacaguagcagcaccaucaguauucauauucccaccaucagac

SEQ ID NO: 49939 - RNA, 342 nt, Artificial Sequence
  derived and/or modified sequence opt6 from anti-HIV_Chain
gacauacaaaugacacaaucaccaucaucacuaucagcaagaguaggagacacaguaacauucacaugccaagcaaacggauaccuaaacugguaccaacaaagaagaggaaaagcaccaaaacuacuaauauacgacggaucaaaacuagaaagaggaguaccaucaagauucucaggaagaagauggggacaagaauacaaccuaacaauaaacaaccuacaaccagaagacauagcaacauacuucugccaaguauacgaauucgcaguaccaggaacaagacuagaccuaaaaagaacaguagcagcaccaucaguauucauauucccaccaucagac

SEQ ID NO: 49940 - RNA, 342 nt, Artificial Sequence
  derived and/or modified sequence opt6 from anti-HIV_Chain
gacauacaaaugacacaaucaccaucaucacuaucagcaucaguaggagacacaguaacaauaacaugccaagcaaacggauacuuaaacugguaccaacaaagaagaggaaaagcaccaaaacuacuaauguacgacggaucaacacuagaaagaggaguaccagcaagauucucaggaagaagauggggacaagaauacaaccuaacaauaaacaaccuacaaccagaagacguagcaacauacuucugccaaguauacgaauucauaguaccaggaacaagacuagacuuaaaaagaacaguagcagcaccaucaguauucauauucccaccaucagac

SEQ ID NO: 49941 - RNA, 342 nt, Artificial Sequence
  derived and/or modified sequence opt6 from anti-HIV_Chain
gacauacaaaugacacaaucaccaucaucacuaucagcaucagucggagacacaguaacaauaacaugccaagcaaacggauaccuaaacugguaccaacaaagaagaggaaaagcaccaaaacuacuaauauacgacggaucaaaacuagaaagaggaguaccaucaagauucucaggaagaagauggggacaagaauacaaccuaacaauaaacaaccuacaagcagaagacauagcaacauacuucugccaaguauacgaauucgcaguaccaggaacaagacuagacuuaaaaagaacaguagcagcaccaucaguauucauauucccaccaucagac

SEQ ID NO: 49942 - RNA, 342 nt, Artificial Sequence
  derived and/or modified sequence opt6 from anti-HIV_Chain
gacauacaaaugacacaaucaccaucaucacuaucagcaucaguaggagacacaguaacauucacaugccaagcaaacggauaccuaaacugguaccaacaaagaagaggaaaagcaccaaaauuacuaauauacgacggaucaagacuagaaagaggaguaccaucaagauucucaggaagaagauggggacaagaauacaacuuaacaauaaacaaccuacaaccagaagacauagcaacauacuucugccaaguauacgaauucgcaguaccaggaacaagacuagaccuaaaaagaacaguagcagcaccaucaguauucauauucccaccaucagac

SEQ ID NO: 49943 - RNA, 342 nt, Artificial Sequence
  derived and/or modified sequence opt6 from anti-HIV_Chain
gacauacaaaugacacacucaccaucaucacuaucagcaucaguaggagacacaguaacaauaacaugccaagcaaacggauaccuaaacugguaccaacaaagaagaggaaaagcaccaaaacuacuaauauacgacggaucaaaacuagaaacaggaguaccaucaagauucacaggaagaagauggggacaagaauacaaccuaacaauaaacaaccuacaaccagaagacauagcaacauacuucugccaaguauacgaauucauaguaccaggaacaagacuagaccuaaaaagaacaguagcagcaccaucaguauucauauucccaccaucagac

SEQ ID NO: 49944 - RNA, 342 nt, Artificial Sequence
  derived and/or modified sequence opt6 from anti-HIV_Chain
gacauacaaaugacacaaucaccaucaucacuaucagcaagaguaggagacacaguaacaauaacaugccaagcaaacggauaccuaaacugguaccaacaaagaagaggaaaagcaccaaaacuacuaauauacgacggaucaaaacuagaaacaggaguaccaucaagauucacaggaagaagauggggacaagaauacaaccuaacaauaaacaaccuacaaccagaagacauagcaacauacuucugccaaguauacgaauucauaguaccaggaacaagacuagaccuaaaaagaacaguagcagcaccaucaguauucauauucccaccaucagac

SEQ ID NO: 49945 - RNA, 342 nt, Artificial Sequence
  derived and/or modified sequence opt6 from anti-HIV_Chain
gacauacaaaugacacaaucaccaucaucacuaucagcaagaguaggagacacaguaacauucacaugccaagcaaacggauaccuaaacugguaccaacaaagaagaggaaaagcaccaaaacuauuaauauacgacggaucaaaacuagaaagaggaguaccaucaagauucucaggaagaggauggggacaagaauacaaccuaacaauaaacaaccuacaaccagaagacauagcaacauacuucugccaaguauacgaauucgcaguaccaggaacaagacuagacuuaaaaagaacaguagcagcaccaucaguauucauauucccaccaucagac

SEQ ID NO: 49946 - RNA, 342 nt, Artificial Sequence
  derived and/or modified sequence opt6 from anti-HIV_Chain
gacauacaaaugacacaaucaccaucaucacuaucagcaucaguaggagacacaguaacaauaacaugccaagcaaacggauaucuaaacugguaccaacaaagaagaggaaaagcaccaaaacuacuaauauacgacggaucaaaacuagaaagaggaguaccaucaagauucucaggaagaagauggggacaagaauacaaccuaacaauaaacaaccuacaaccagaagacauagcaacauacuucugccaaguauacgaauucguaguaccaggaacaagacuagaccuaaaaagaacaguagcagcaccaucaguauucauauucccaccaucagac

SEQ ID NO: 49947 - RNA, 342 nt, Artificial Sequence
  derived and/or modified sequence opt6 from anti-HIV_Chain
ucacaaucaguaguaacacaagaaccaucacuaacaguaucaccaggaggaacaguaacacuaacaugcggaccaucaacaggagcaguaacaucaggauucuacccacacugguuccaacaaaaaccaggacaagcaccaagagcacuaauauacucaacaucaaacaaauacucauggacaccagcaagauucucaggaucacuacuaggaggaaaagcaguauuaacacuaucagacguacaaccagacgacgaagcagaauacuacugccuauuacuacuauacuacggaggaccauggauauucggaggaggaacaaaacuaacaguauuaguauca

SEQ ID NO: 49948 - RNA, 345 nt, Artificial Sequence
  derived and/or modified sequence opt6 from anti-HIV_Chain
gauauacaaaugacacaaucaccaucaagcuuaagcgcaagcguaggagauaaaguaacaauaacaugucaaacaagugcaggauaucuaaauugguaucaacaaagaagaggaagagcaccaaaacuacuaauguacgauggaucaagauuaguaacaggaguaccaucaagauuuagcggaagaagauggggaacacaauacaauuuaacaauaggaagcuuacaaccagaagauguagcaacauauuacugucaaguauacgaauucuuuggaccaggaacaagauuagacuuaaaaagaacaguagcagcaccaucaguauuuauauuuccaccaagugau

SEQ ID NO: 49949 - RNA, 345 nt, Artificial Sequence
  derived and/or modified sequence opt6 from anti-HIV_Chain
gacauacaaaugacacaaucaccaucaucacuaucagcaucaguaggagacacaguaacaauaacaugccaaacaacaaaaggauacuuaaacugguaccaacaaagaagaggaagagcaccaaaacuacuaauguucgacggaucaaaacuaguaacaggaguaccaucaagauucucaggaagaagauggggaacacaauacaaccuaacaauaggaucacuacaaccagaagaccuagcaacauacuacugccaaguauacgaauucuucggaccaggaacaagacuagaccuaaaaagaacaguagcagcaccaucaguauucauauucccaccaucagac

SEQ ID NO: 49950 - RNA, 345 nt, Artificial Sequence
  derived and/or modified sequence opt6 from anti-HIV_Chain
gauauacaaaugacacaaucaccaucaagcuuaagugcaagcguaggagauacaguaacaauaacaugucaaacaaacaaaggauaucuaaauugguaucaacaaagaagaggaagagcaccaaaauuacuaaugugcgauggaucaaaauuaguaacaggaguaccaucaagauuuagcggaagaagauggggaacacaauacaaucuaacaauaggaagcuuacaaccagaagauauagcaacauauuacugucaaguauacgaauucuuuggaccaggaacaagauuagacuuaaaaagaacaguagcagcaccaucaguauuuauauuuccaccaagcgau

SEQ ID NO: 49951 - RNA, 345 nt, Artificial Sequence
  derived and/or modified sequence opt6 from anti-HIV_Chain
gauauacaaaugacacaaucaccaucaagcuuaagcgcaagagugggagauaaaguaacaauaacaugucaaacaagcgcaggauaucuaaauugguaucaacaaagaagaggaagagcaccaaaacuacuaauguacgauggaucaagauuaguaacaggaguaccaucaagauuuagcggaagaagauggggaacacaauacaaucuaacaauaggaagcuuacaaccagaagauauagcaacauauuacugucaaguauacgaauucuuuggaccaggaacaagauuagacuuaaaaagaacaguagcagcaccaucaguauuuauauuuccaccaagcgau

SEQ ID NO: 49952 - RNA, 345 nt, Artificial Sequence
  derived and/or modified sequence opt6 from anti-HIV_Chain
gacauacaaaugacacaaucaccaucaucacuaucagcaucaguaggagacacaguaacaauaacaugccaaacaaacaaaggauaccuaaacugguaccaacaaaaaagaggaagagcaccaaaacuacuaauguacgacggaucaaaacuaguaacaggaguaccaucaagacuaucaggaagaagauggggaacacaauacaaccuaacaauaggaucccuacaaccagaagacauagcaacauacuacugccaaguauacgaauucuucggaccaggaacaagacuagaccuaaaaagaacaguagcagcaccaucaguauucauauucccaccaucagac

SEQ ID NO: 49953 - RNA, 345 nt, Artificial Sequence
  derived and/or modified sequence opt6 from anti-HIV_Chain
gacauacaaaugacacaaagcccaucaucacuaucagcaucaguaggagacacaguaacaauaacaugccaaacaaacaaaggauaccuaaacugguaccaacaaagaagaggaagagcaccaaaacuacuaauguacgacggaucaaaauuaguaacaggaguaccaucaagacuaucaggaagaagauggggaacacaauacaaccuaacaauaggaucacuacaaccagaagacauagcaacauacuacugccaaguauacgaauucuucggaccaggaacaagacuagaccuaaaaagaacaguagcagcaccaucaguauucauauucccaccaucagac

SEQ ID NO: 49954 - RNA, 345 nt, Artificial Sequence
  derived and/or modified sequence opt6 from anti-HIV_Chain
gacauacaaaugacacaaucaccaucaucacuaucagcaucaguaggagacacaguaacaauaacaugccacacaaacaaaggauaccuaaacugguaccaacaaagaagaggaagagcaccaaaacuacuaauguucgacggaucaaaacuaguaacaggaguaccaucaagauucucaggaagaagauggggaacacaauacaaccuaacaauaggaucacuacaaccagaagacauagcaacauacuacugccaaguauacgaaguauucggaccaggaacaagacuagaccuaaaaagaacaguagcagcaccaucaguauucauauucccaccaucagac

SEQ ID NO: 49955 - RNA, 345 nt, Artificial Sequence
  derived and/or modified sequence opt6 from anti-HIV_Chain
gacauacaaaugacacaaucaccaucaucacuaucagcaucaguaggagacacaguaacaauaaacugccaaacaaacaaaggauaccuaaacugguaccaacaaagaagaggaagagcaccaaaacuacuaauguacgacggaucaaaacuaguaacaggaguaccaucaagauucucaggaagaagauggggaacacaauacaaccuaacaauaggaucauuacaaccagaagacauagcaacauacuacugccaaguauacgaauucuucggaccaggaacaagacuagaccuaaaaagaacaguagcagcaccaucaguauucauauucccaccaucagac

SEQ ID NO: 49956 - RNA, 345 nt, Artificial Sequence
  derived and/or modified sequence opt6 from anti-HIV_Chain
gauauacaaaugacacaaucaccaucaagcuuaagcgcaagaguaggagauaaaguaacaauaacauaucaaacaagcgcaggauaucucaauugguaucaacaaagaagaggaagagcaccaaaauuacuaauguacgauggaucaagauuaguaacaggagcaccaucaagauuuagcggaagaagauggggaacacaauacaaucuaacaauaggaagcuuacaaccagaagauauagcaacauauuacugucaaguauacgaauucuuuggaccaggaacaagauuagacuuaaaaagaacaguagcagcaccaucaguauuuauauuuccaccaagcgau

SEQ ID NO: 49957 - RNA, 345 nt, Artificial Sequence
  derived and/or modified sequence opt6 from anti-HIV_Chain
gacauacaaaugacacaaucaccaucaucacuaucagcaucaguaggagacacaguaacaauaacaugccaaacaaacaaaggauaccuaaacugguaccaacaaagaagaggaagagcaccaaaacuauuaauguacgacggaucaaaacuaguaacaggaguaccaucaagauucucaggaagaagauggggaacacaauacaaccuaacaauaggaucacuacaaccagaagacauagcaacauacuacugccaaguauacgaauucuucggaccaggaacaagauuagacuuaaaaagaacaguagcagcaccaucaguauucauauucccaccaucagac

SEQ ID NO: 49958 - RNA, 345 nt, Artificial Sequence
  derived and/or modified sequence opt6 from anti-HIV_Chain
guaacauuaucauuaucaccaggagaaagagcaacacuaucaugcagagcaucacaaacaauaucaaauaacuaucuagcaugguaucaacaaaaaccaggacaagcaccaagacuacuaauauacggagcaucaucaggagcaacaggacuaccagacagauuuucaggaucaggaucaggaacagauuucacacuaacaauaucaagacuagaaccagaagacuucgcaguauauuacugucaccaauacgcacuaucaccauggacauucggaagaggaacaaaaguagaaauaaaaagaacaguagcagcaccaucaguauuuauauuuccaccaucagau

SEQ ID NO: 49959 - RNA, 345 nt, Artificial Sequence
  derived and/or modified sequence opt6 from anti-HIV_Chain
acacuaucagcaucaguaggagacagaguaacaauaacaugcagagcaucacaaucaauaaacaacuaccuaaacugguaccaacaaaaaccaggaaaagcaccaaaacuacuaauauacgcagcaucaucacuacaaucaggaguaccaucaagauucucaggaucaggaucaggaacagacuucacacuaacaauaucaucacuacaaccagaagacuucguaacauacuacugccaacaaacauacucaaacccaagaauguucggacaaggaacaaaaguagaaauaaaaagaacaguagcagcaccaucaguauucauauucccaccaucagacgaacaa

SEQ ID NO: 49960 - RNA, 345 nt, Artificial Sequence
  derived and/or modified sequence opt6 from anti-HIV_Chain
caaucagcacuaacacaagcaccaucagcaucaggaacaccaggacaacgaguaacaauaucaugcucaggaggaggaucaaacauaggaggaaaccuaguaucaugguaccaacacuucccaggagcagcaccaaaacuacuaauauacagaaacgaccaaagaccaucaggaguaccagacagauucucagcaucaaaaucaggaacaucagcaucauuagcaauaucaggacuaagaucagacgacgaagcaacauacuucugcgcagcauacgacucaacacuaucacuaagacuauucggaggaggaacaacauuagcaguauuaucacaaccaaaagca

SEQ ID NO: 49961 - RNA, 345 nt, Artificial Sequence
  derived and/or modified sequence opt6 from anti-HIV_Chain
aaaccaucacaaacacuaucacuaacaugcacaguaucaggaggaucaauaucaucagcaggauacuacuggacauggauaagacaccacccaggaaaaggacuagaauucauaggcuacauauaccacauaggaacaccauacuacaacccaucacuaaaaucaagacuaacaauaucaauagacacaucaaaaaaccaauucucacuaaaacuaucaucaguaacagcagcagacacagcaauauacuacugcgcaagagacuacacagcaagaggaagacacuucuucgacuacuggggacaaggagcacuaguaacaguaucaucagcaucaacaaaagga

SEQ ID NO: 49962 - RNA, 345 nt, Artificial Sequence
  derived and/or modified sequence opt6 from anti-HIV_Chain
ccaucagaaacacuaucacuaacaugcagaguaucaggagcaagcauaagcaauuucuauuggacauggauaagacaaccagcaggaaaaggauuagaauggauaggaagauuauacucaagcgauaaaacaaacuauaacccaagccuaaacggaagaguaacaaugagcuuagacacaagcaaaaaccaauucucacuaagacuaacaagcaugacagaugcagauacagcaauauauuacugugcaagagaaaaaggacaauggguaacauuaccaccauacuauuucgauagcuggggacaaggaauauuaguaacaguaagcucagcaucaacaaaagga

SEQ ID NO: 49963 - RNA, 348 nt, Artificial Sequence
  derived and/or modified sequence opt6 from anti-HIV_Chain
ggaccagcaacacuaucaguaagcccaggagaaagagcaacacuaucaugcagagcaucacaaucacuaagaaacaaccuagcaugguaccaacaaaaaacaggacaaucaccaagacuacuaauauacgcaguaucaacaagagcaacaggaauaccaccaagauucucaggaggaggaucaggaacagaauucacacuaacaauagacucacuacaaucagaagacuucgcaguauacuucugccaacaauacgacucaccacaauggacauucggacaaggaacaaaaguagaaaucaaaagaacaguagcagcaccaucaguauucauauucccaccaucagac

SEQ ID NO: 49964 - RNA, 348 nt, Artificial Sequence
  derived and/or modified sequence opt6 from anti-HIV_Chain
gcaccaguaacacuaucagcaucaguaggagacacaguaacaauaacaugcagagcaucacaaccaauagcaacauuccuaaacugguaccaacacaaaccaggacaagcaccaaaacuacuaauauacgcagcaucaacauuccaaagaggagcaccaucaagauacucaggaucaggaucaggaacagacuucacacuaacaauaaacucauuacaaccagaagaccuagcaacauacuauugccaacaaacauucacagacccaguaacauucggacaaggaacaagacuagaaauaaaaagaacaguagcagcaccaucaguauucauauucccaccaucagac

SEQ ID NO: 49965 - RNA, 351 nt, Artificial Sequence
  derived and/or modified sequence opt6 from anti-HIV_LightChain
gauauacaaaugacacaaucaccaucaacauuaagcgcaagcauaggcgauacaguaagaauaagcuguagagcaagccaaagcauaacaggaggauggcuagcaugguaucaccaaagaccaggaaaagcaccaagauuacuaauauacagaggaucaagauuacuaggaggaguaccaucaagauuuagcggaagcgcagcaggaacagauuucacauuaacaauagcaaacuuacaagcagaagauuucggaacauuuuacugucaacaauacgauacauauccaggaacauuuggacaaggaacaaaaguagaaguaaaaagaacaguagcagcaccaucaguauuu

SEQ ID NO: 49966 - RNA, 351 nt, Artificial Sequence
  derived and/or modified sequence opt6 from anti-HIV_LightChain
gauauacaaaugacacaaucaccaucaacauuaagcgcaagcauaggagauacaguaagaauaagcuguagagcaagccaaagcauaacaggaaacuggguagcaugguaucaacaaagaccaggaaaagcaccaagauuacuaauauacagaggagcagcauuacuaggaggagugccaucaagauuuagcggaagcgcagcaggaacagauuucacacuaacaauaggaaacuuacaaacagaagauuucggaacauuuuacugucaacaauacgauacauauccaggaacauuuggacaaggaacaaaaguagaaguaaaaagaacaguagcagcaccaucaguauuu

SEQ ID NO: 49967 - RNA, 351 nt, Artificial Sequence
  derived and/or modified sequence opt6 from anti-HIV_LightChain
gauauacaaaugacacaaucaccaucaacauuaagcgcaagcauaggagauacaguaagaauauccuguagagcaagccaaagcauaacaggaaacuggguagcaugguaucaacaaagaccaggaaaagcaccaagacuacuaauauacagaggagcagcauuacuaggaggaguaccaucaagauuuagaggaagcgcagcaggaacagauuucacacuaacaauaggaaacuuacaagcagaagauuucggaacauuuuacugucaacaauacgauacauauccaggaacauuuggacaaggaacaaaaguagaaguaaaaagaacaguagcagcaccaucaguauuu

SEQ ID NO: 49968 - RNA, 351 nt, Artificial Sequence
  derived and/or modified sequence opt6 from anti-HIV_LightChain
gauauacaaaugacacaaucaccaucaacacuaagcgcaagcguaggagauacaguaagaauaagcuguagagcaagucaaaguauaacaggaggcuggcuagcaugguaucaccaaagaccaggaaaagcaccaagauuauuaauauacagaggaucaagauuacuaggaggaguaccaucaagauuuaguggaagcgcagcaggaacagauuucacacuaacaauagcaaacuuacaagcagaagauuucggaacauuuuacugucaacaauacgauacauauccaggaacauuuggacaaggaacaaaaguagaaguaaaaagaacaguagcagcaccaucaguauuu

SEQ ID NO: 49969 - RNA, 351 nt, Artificial Sequence
  derived and/or modified sequence opt6 from anti-HIV_LightChain
gauauacaaaugacacaaucaccaucaacauuaagcgcaagcauaggagauacaguaagaauaagcuguagagcaagccaaagcauaacaggaaacuggguagcaugguaucaacaaagaccaggaaaagcaccaagauuauuaauauacagaggagcagcauuacuaggaggaguaccaucaagauuuagcggaagcgcagcaggaacagauuucacacuaacaauaggaaacuuacaagcagaagauuucggaacauuuuacugucaacaauacgauacauauccaggaacauuuggacaaggaacaaaaguagaaguaaaaagaacaguagcagcaccaucaguauuu

SEQ ID NO: 49970 - RNA, 351 nt, Artificial Sequence
  derived and/or modified sequence opt6 from anti-HIV_LightChain
gauauacaaaugacacaaucaccaucaacauuaagcgcaagcauaggagauacaguaagaauaaguuguagagcaagccaaagcauaacaggaggauggguagcaugguaucaccaaagaccaggaaaagcaccaagauuacuaauauacagaggaucaagauuacuaggaggaguaccaaguagauuuagcggaagcgcagcaggaacagauuucacacuaacaauaggaaacuuacaagcagaagauuucggaacauuuuacugucaacaauacgauacauauccaggaacauuuggacaaggaacaaaaguagaaguaaaaagaacaguagcagcaccaucaguauuu

SEQ ID NO: 49971 - RNA, 351 nt, Artificial Sequence
  derived and/or modified sequence opt6 from anti-HIV_LightChain
gauauacaaaugacacaaucaccaucaacauuaagcgcaagcguaggagauacaguaagaauaucauguagagcaagccaaagcauaacaggaggauggcuagcaugguaucaccaaagaccaggaaaagcaccaagauuacuaauauacagaggaucaagauuacuaggaggaguaccaucaagauuuagcggaagcgcagcaggaacaggauucacacuaacaauagcaaacuuacaagcagaagauuucggaacauuuuacugucaacaauacgauacauauccaggaacauuuggacaaggaacaaaaguagaaguaaaaagaacaguagcagcaccaucaguauuu

SEQ ID NO: 49972 - RNA, 351 nt, Artificial Sequence
  derived and/or modified sequence opt6 from anti-HIV_LightChain
gauauacaaaugacacaaucaccaucaacauuaagcgcaagcguaggaggaacaguaagaauaagcuguagagcaucacaaagcauaacaggaggauggcuagcaugguaucaccaaagaccaggaaaagcaccaagauuacuaauauacagaggaucaagauuacuaggaggaguaccaucaagauuuagcggaagcgcagcaggaacagauuucacacuaacaauagcaaacuuacaagcagaagauuucggaacauuuuacugucaacaauacgauacauauccaggaaccuuuggacaaggaacaaaaguagaaguaaaaagaacaguagcagcaccaucaguauuu

SEQ ID NO: 49973 - RNA, 351 nt, Artificial Sequence
  derived and/or modified sequence opt6 from anti-HIV_LightChain
gauauacaaaugacacaaucaccaucaacauuaagcgcaagcauaggagauacaguaagaauaagcuguagagcaagccaaagcauaacaggaaacuggguagcaugguaucaccaaagaccaggaaaagcaccaagauuacuaauauacagaggagcagcauuacuaggaggaguaccaucaagauuuagcggaagcgcagcaggaacagauuucacacuaacaauaggaaacuuacaagcagaagauuucggaacauuuuacugucaacaauacgauacauauccaggaacauuuggacaaggaacaaaaguagaaguaaaaagaacaguagcagcaccaucaguauuu

SEQ ID NO: 49974 - RNA, 351 nt, Artificial Sequence
  derived and/or modified sequence opt6 from anti-HIV_LightChain
gauauacaaaugacacaaaguccaucaacauuaagcgcaagcauaggagauacaguaaugauaagcuguagagcaagccaaagcauaacagguggauggcuagcaugguaucaccaaagaccaggaaaagcaccaagauuacuaauauacagaggaucaaaauuacuaggaggaguaccaucaagauuuagcggaagcgcagcaggaacaggauucacacuaacaauaggaaacuuacaagcagaagauuucggaacauuuuacugucaacaauacgauacauauccaggaacauuuggacaaggaacaaaaguagaaguaaaaagaacaguagcagcaccaucaguauuu

SEQ ID NO: 49975 - RNA, 351 nt, Artificial Sequence
  derived and/or modified sequence opt6 from anti-HIV_LightChain
gauauacaaaugacacaaucaccaucaacauuaagugcaagcguaggagauacaguaagaauaagcuguagagcaagccaaagcauaacaggaggauggcuagcaugguaucaccaaagaccaggaaaagcaccaagauuacuaauauacagaggaucaagauuacuaggaggaguaccaucaagauuuagcggaagcgcagcaggagcagauuucacacuaacaauagcaaacuuacaagcagaagauuucggaacauuuuacugucaacaauacgauacauauccaggaacauuuggacaaggaacaaaaguagaaguaaaaagaacaguagcagcaccaucaguauuu

SEQ ID NO: 49976 - RNA, 351 nt, Artificial Sequence
  derived and/or modified sequence opt6 from anti-HIV_LightChain
gauauacaaaugacacaaucaccaucaacauuaagcgcaagcauaggagauacaguaagaauaagcuguagagcaagccaaagcauaacaggaggauggcuagcaugguaucaccaaagaccaggaaaagcaccaagauuacuaauauacagaggaucaagauuaguaggaggaguaccaucaagauuuagcggaagcgcagcaggaacagauuucacacuaacaauaggaaacuuacaagcagaagauuucggaacauuuuacugucaacaauacgauacauauccaggaacauuuggacaaggaacaaaaguagaaguaaaaagaacaguagcagcaccaucaguauuu

SEQ ID NO: 49977 - RNA, 351 nt, Artificial Sequence
  derived and/or modified sequence opt6 from anti-HIV_LightChain
gauauacaaaugacacaaucaccaucaacauuaagcgcaagcauaggagauacaguaagaauaaguuguagagcaagucaaagcauaacaggaggauggcuagcaugguaucaccaaagaccaggaaaagcaccaagauuacuaauauacagaggaucaagauuacuaggaggaguaccaucaaaauuuaguggaagcgcagcaggaacagauuucacacuaacaauagcaaacuuacaagcagaagauuucggaacauuuuacugucaacaauacgauacauauccaggaacauuuggacaaggaacaaaaguagaaguaaaaagaacaguagcagcaccaucaguauuu

SEQ ID NO: 49978 - RNA, 351 nt, Artificial Sequence
  derived and/or modified sequence opt6 from anti-HIV_LightChain
gauauacaaaugacacaaucaccaucaacauuaagugcaagcacaggagauacaguaagaauaagcuguagagcaagccaaagcauaacaggaaacuggguagcaugguaucaacaaagaccaggaaaagcaccaagauuacuaauauacagaggagcagccuuacuaggaggaguaccaucaagauuuagaggaagcgcagcaggaacagauuucacauuaacaauaggaaacuuacaagcagaagauuucggaacauuuuacugucaacaauacgauacauauccaggaacauuuggacaaggaacaaaaguagaaguaaaaagaacaguagcagcaccaucaguauuu

SEQ ID NO: 49979 - RNA, 351 nt, Artificial Sequence
  derived and/or modified sequence opt6 from anti-HIV_LightChain
gauauacaaaugacacaaucaccaucaacauuaagugcaagcauaggagauacaguaagaauaaguuguagagcaagucaaagcauaacaggaaacuggcuagcaugguaucaccaaagaccaggaaaagcaccacgauuacuaauauacagaggaucaagauuacuaggaggaguaccaucaagauuuagcggaagcgcagcaggaacagauuucacacuaacaauagcaaacuuacaagcagaagauuucggaacauuuuacugucaacaauacgauacauauccaggaacauuuggacaaggaacaaaaguagaaguaaaaagaacaguagcagcaccaucaguauuu

SEQ ID NO: 49980 - RNA, 351 nt, Artificial Sequence
  derived and/or modified sequence opt6 from anti-HIV_Chain
auaauauuauucuuaguagcaacagcaacaggaucaugggcacaaucagcacuaacacaaccaagaucaguaucaggaucacuaggacaaucaguaacaauaucaugcacaggaucaucaucagacguaggaagauacaacuacguaucaugguaccaacaccacccaggaaaagcaccaaaauuaaugauaucagacguaaacaaaagaccaucaggaguaccagacagauucucaggaucaaaaucaggaaacacagcaucacuaacaauaaguggacuacaagcagaagacgaaacagacuacuacugcugcucauacgcaggaucauacauauggguauucggagga

SEQ ID NO: 49981 - RNA, 351 nt, Artificial Sequence
  derived and/or modified sequence opt6 from anti-HIV_Chain
ccaguaacacuaucagcaucaguaggagacagaguaacaauaacaugcagagcaucagaagacauaucaaaauaccuaaacugguaccaacacaaaccaggaaaagcaccaaaacuacuaauauacacagcaucaucacuagaaacaggaguaccaucaagauucucaggaucaggaucaggaacagacuucucacuaacaauaucaucacuacaaccagacgacuucgcaacauacuacugccaacaaucauacacaucaucaguaacauucggacaaggaacaagaguagaaguaaaaagaacaguagcagcaccaucaguauucauauucccaccaucagacgaacaa

SEQ ID NO: 49982 - RNA, 351 nt, Artificial Sequence
  derived and/or modified sequence opt6 from anti-HIV_Chain
guagaagaaccaggaaguucaguaaaaguaucauguaaagcaucaggaggaaguucaacagcauauggauauucauggguaagacaagcaccaggacaaggauuugaauggaugggaagaauaauaccauuuuauggaauaauaacauaugcaccaaaauuucaaggaagaguaacaauaacagcagauagaucaacaucaacaguauauauggaauuaacaagauuaacauuugcagauacagcauuauuuuuuugugcaagagauuauggagauccaagaaauggauauuauuuugauucaugggaucaaggauuaugguuaacaguaucaagugcaaguacaaaagga

SEQ ID NO: 49983 - RNA, 351 nt, Artificial Sequence
  derived and/or modified sequence opt6 from anti-HIV_Chain
caaguaagauuagaacaaagcggagcagcaguaagaacaccaggagcaagcguaacauuaagcugucaagcaagcggauacaaauucguaaacuauauaauacacuggguaagacaaagaccaggacuagcauucgaauggguaggaaugauagauccauauagaggaagaccauggucagcacauagcuuugaaggaagauuaagccuaagcagagacguaagcauggaaauacuauauaugacacuaacaucauuaagaagcgacgauacagcaacauauuucugugcaagagcagaagcagaaagccaaagccauaguagaccaauaauaucaacaucaggagcaaga

SEQ ID NO: 49984 - RNA, 351 nt, Artificial Sequence
  derived and/or modified sequence opt6 from anti-HIV_Chain
guacaccuagaaguacaacuacaacaaucaggaccagaacuaaaaaaaccaggagaaacaguaaaaauaucaugcaaagcaucaguauacacauucacagaauacccaauacacuggguaaaacaagcaccaggaaaaggauucaaauggaugggauggauaaacacauacucaggagaaccaacauacgcagacgacuucaaaggaagauucgcauucucacuagaaacaucagcaucaacagcauaccuacaaauaaacucacuaaaaaaugaagacacagcaacauacuucugcgcaucacuaggaagagacuacuggggacaaggacaaggaacaacacuaacagua

SEQ ID NO: 49985 - RNA, 354 nt, Artificial Sequence
  derived and/or modified sequence opt6 from anti-HIV_Chain
cuaucaguaucauuaggagaaagagcaacaauaaacugcaaaucaucacaaucaauacuauacucaucagacaaaaaaaacuaccuagcaugguaccaacaaaaaauaggacaaccaccaaaacuacuacuauacugggcaucaacaagagaaucaggaauaccagacagauucucaggaucaggaucaggaucagacuucacacuaacaauaucaucacuacaaccagaagacguagcaguauacuacugccaacaauacuacauaucaccauucacauucggaccaggaacaaaaguagaccuaaaaagaacaguagcagcaccaucaguauucauauucccaccaucagac

SEQ ID NO: 49986 - RNA, 354 nt, Artificial Sequence
  derived and/or modified sequence opt6 from anti-HIV_Chain
caaucaguauuaacacaaccaccaucagcaucaggagcaccaggacaaagaguaacaauaucaugcucaggaggaccaucaaacguaggaggaaacuauguauauugguauagacaauucccaggaacagcaccaaaauuauuaauacuaagagacgaccaaagaccaucaggaguaccagacagauuuucagcaucaaaaucaggaaacucugcaucacuagcaauaucaggauuaagaccagacgacgaagcauucuauuucugugcaacauacgacucagacggaucuauaagacuauuuggaggaggaacugcauuaacaguacuaucacaaccaaaagcagcaccauca

SEQ ID NO: 49987 - RNA, 354 nt, Artificial Sequence
  derived and/or modified sequence opt6 from anti-HIV_Chain
aaagcaccagcaacacuaucauuaucaccaggagaaagagcaacacuaucauguagagcaucacaaucaguaggaucagaccuagcaugguaccaacaaaaaccaggacaagcaccaagacuacuaauauacgacgcaucaaacagagcaacagcaauaccagcaagauucucaggaucaggaucaggaacagacuucacauuaucaauaucaucacuagaaccagaagacuucgcaguauacuucugccaacaaagauacgacaaaauaacauucggacaaggaacaagacuagaaauacaaagaacaguagcagcaccaucaguauucauauucccaccaucagacgaacaa

SEQ ID NO: 49988 - RNA, 354 nt, Artificial Sequence
  derived and/or modified sequence opt6 from anti-HIV_Chain
caaguacaauuaguacaaagcggagcagaagcaaaaagaccaggagacaguguaaaaguaaguuguaaagcaagcggauauacauuuacagaauauuauauacacuggguaagacaaacaccaggacaaggauuugaauggaugggaauaauaacaccaggagcaggaaauacaacauaugcacaaaaauuucaaggaagaauaacaguaacaagagauacaagugcagcaacaguauauauggaauuaucaaauuuaacaucagaagauacagcaguauauuuuuguagcagaggaguaaguuuuuggggacaaggaacauuaguaacaguaucaagugcaagcacaaaagga

SEQ ID NO: 49989 - RNA, 354 nt, Artificial Sequence
  derived and/or modified sequence opt6 from anti-HIV_HeavyChain
gaaguaaaauuacaacaaagcggagcagaauuaguaagaccaggagcaagcguaaaaaugagcuguaaagcaagcggauacagauucacaagcuauaacaugcacuggguaaaacaaacaccaagacaaggacuagaauggauaggagcaauauauccaggaaacggagacacaagcuauaaccaaaaauuuaaaggaaaagcaacacuaacaguagacaaaagcucaagcacagcauauaugcaacuaucaagccuaacaucagaagauagcgcaguauauuucugugcaagaggaagacuaucacuaggauucgauuacuggggacaaggaucaacauuaacaguaagcuca

SEQ ID NO: 49990 - RNA, 357 nt, Artificial Sequence
  derived and/or modified sequence opt6 from anti-HIV_Chain
caaguacaauuaguacaaagcggaacagcaguaaaaagaccaggagcaagcguaagaguaagcugucaagcaagcggauacacauucauagaccauuucauauacugguggagacaagcgccaggacaaggacuagaaugguuaggauggauaaauccauuaacaucacaaccaagcuauccaucaagauuucaaggaagauuaacauuaacaagagacacauucgaugaaaugcuauauauggauuuaagaggauuaagaucagacgauacaggaauauauuucugugcaagaagacauagugauuacugugacuuugacauauggggaagcggaacacaaauaauaguaucaagu

SEQ ID NO: 49991 - RNA, 357 nt, Artificial Sequence
  derived and/or modified sequence opt6 from anti-HIV_Chain
caaguacaauuaguacaaagcggaacagcaguaaaaagaccaggagcaagcguaagaguaagcugucaagcaagcggauauacauucacagacuauuucauauacugguggagacaagcaccaggacaaggacuagaaugguuaggauggauaaauccauuaacaucacaaccaagcuauccaucaagauuucaagggagauuaacauuaacaagagacacauuugaugaaaugcuauauauggauuuaagaggauuaagaucagacgauacaggaauauauuucugugcaagaagacauagcgauuacugugacuuugacauauggggaagcggaacacaaauaauaguaucaagu

SEQ ID NO: 49992 - RNA, 357 nt, Artificial Sequence
  derived and/or modified sequence opt6 from anti-HIV_Chain
caaucaguacuaacacaaccaagaucaguaucaggaucaccaggacaaucaguaacaauaucaugcacaggaacaucaucagacguaggaggauacaacuacguaucaugguaccaacaacacccaggaaaagcaccaaaaacaaugauauucgacguaacaaaaagaccaucaggaguaccagacagauucucaggauccaaaucaggaaacacagcaucacuaacaauaucaggacuacaagcagaagacgaagcagacuacuacugcucaucauacgcaggaagaaacacauucuacguauucggaacaggaacaacaguaacaguacaaguaucaccaucacaaccaccacca

SEQ ID NO: 49993 - RNA, 357 nt, Artificial Sequence
  derived and/or modified sequence opt6 from anti-HIV_Chain
gaaauaguacuaacacaaucaccaggaacauuaucacuaucaccaggagaaagagcaacacuaucaugcagagcaagccaaucaguaucaucaaacuaccuagcaugguaucaacaaaaaccaggacaagcaccacgacuacuaauauacggagcaucauccagagcaacaggaauaccagacagauucucaggaucaggaucaggaacagacuucacacuaucaauaucaagacuagaaccagaagacuucgcaguauacuacugccaacaauacggaacaucaucaugcacauucggacaaggaacaaaauuagaaauaaaaagaacaguagcagcaccaucaguauucauauuc

SEQ ID NO: 49994 - RNA, 357 nt, Artificial Sequence
  derived and/or modified sequence opt6 from anti-HIV_Chain
uuaucagcaucaguaggagaccgaguaacaauaacaugcagagcaucacaaucaauagacagauaccuaaacugguaccaacaaaaaccaggaaaagcaccaaaacuacuaauauacgcagcaucaucacuacacacagacguaccaucaagauucucaggaucaggagcaggaacauacuucacacuaacaauaacaucacuacaaccagaagacuucgcaacauacuacugccaacaaucacacucaccaucauucggacaagaaucauacucaauaacauucggacaaggaacaagacuagaaauaaaaagaacaguagcagcaccaucaguauucauauucccaccaucagac

SEQ ID NO: 49995 - RNA, 357 nt, Artificial Sequence
  derived and/or modified sequence opt6 from anti-HIV_Chain
aauuucauguuaacacaagcaccaucagcaucaggagcaccaggacaaagaguaacaauaucaugcucaggaggaccaucaaacguaggaggaaacuacguauacugguacagacaauacccaggaacagcaccaaaacuacuaauacuaagagacgaucaaagaccaucaggaguaccagacagauucucagcaucaaaaucaggaaacucagcaucacuagcaauaucagaacuaagaccagacgacgaagcauucuacuucugugcaacauacgacucagacggaucaauaagacuauucggaggaggaacagcacuaacaguacuaucacaaccaaaagcagcaccaucagua

SEQ ID NO: 49996 - RNA, 360 nt, Artificial Sequence
  derived and/or modified sequence opt6 from anti-HIV_Chain
gacauacaaaugacacaaucaccaucaucacuaucagcaucaauaggagacagaguaaacauaacaugccaagcaucaagagacacaggaucagcacuaaacugguaccaacaaaaaguaggaagaccaccaagacuacuaauaucagcaguaucaaaccuaggagcaggaguaccaucaagauucucaggaagaagaucaggaacacaaucaacacuaacaauaaacacccuacaaccagaagacauagcaacauacuucugccaacacuacgaauucuucggaccaggaacaaaaguagacauaaaaagaacaguagcagcaccaucaguauucauauucccaccaucagacgaacaa

SEQ ID NO: 49997 - RNA, 360 nt, Artificial Sequence
  derived and/or modified sequence opt6 from anti-HIV_Chain
caaucaguacuaacacaaccagcaucaguaucaggaucaccaggacaaucaauaacaauaucaugcacaggaacaucaaacgacguaggaggacaaaacuucguaucaugguaccaacaacacccaggaacagcaccacaacuacuaauauacgacguaacaaacagaccagcaggaguaucaucaagauucucaggaucaaaaucaggaaacacagcaucacuaacaauaucaggacuaagaacagaagacgaagcagacuacuacugcgcaucauucacaauauuaaacggaguagacuacguauucggaacaggaacaaaaguaacaguacuacuaucaccaucacaaccauaccua

SEQ ID NO: 49998 - RNA, 360 nt, Artificial Sequence
  derived and/or modified sequence opt6 from anti-HIV_Chain
aacuucaugcuaacacaaccagcaucaguaucaggaucaccaggacaaucaauaacacuaucaugcacaggaacaacaucagacguacgagacucaaacuucguaucaugguaccaacaaguaccaggaaaagcaccaaaacuaauaauauacgacguaucagcaagaccaucaggaguaucauucagauucucaggaucaaaaucaggaaacacagcaucacuaacaauaucaggacuacaagcagaagacgaagcacuauacuacugcucaucauucacaccaacaaacacacuaguauucggaggaggaacaaaacuaacaguacuaggacaaccaaaagcagcaccaucaguaaca

SEQ ID NO: 49999 - RNA, 360 nt, Artificial Sequence
  derived and/or modified sequence opt6 from anti-HIV_Chain
caaucagcacuaacacaaccaccagcagcaucaggagcaccaggacaaagaguaacaauaucaugcucaggaggaggaucaaacguaggaggaaaccuaguaucaugguaucaacaauucccaggagcagcaccaaaacuaauauuacacagagacggccaaagaccaucaggaguaccagacagauuuucagcaucaaaaucaggaacaucagcaucauuaacaauaucaggacuaagaucagacgacgaagcaacauauuucugcgcagcauacgacucagcaguaucacuaccaguauucggaggaggaacaaaacuaacaguacuaucacaaccaaaagcagcaccauuaguaaca

SEQ ID NO: 50000 - RNA, 360 nt, Artificial Sequence
  derived and/or modified sequence opt6 from anti-HIV_Chain
caauuaguacuaacacaaccaccaucaguaucaggaacaccaggacaaaacguaacaauaucaugcuccggaggaggaucucacguaggaggaaaccuaguaucaugguaccaacauuucccaggagcagcaccaaaacuacuaauacacagagacaaucaacgaccaucaggaguaccagacagauucucagcacuaaaaucaggaaacucagcaucacuagcaauaucaggacuaagaucagacgacgaagcauucuacuucugcgcaguauacgacucaucacuaucacuaggacuauucggaggaggaacaaaacuaacaguauuaucacaaccaaaagcagcaccaucaguaaca

SEQ ID NO: 50001 - RNA, 360 nt, Artificial Sequence
  derived and/or modified sequence opt6 from anti-HIV_Chain
gauauacaaaugacacaaucaccaucaaguuuaagcgcaagcguaggagauagaguaagcauacacugucaagcaggacaaggaauaggaucaaguuuaaaaugguaccaacaaaaaagcggaagagcaccaagacuauuaguacauggagcaaguaaucuacaaagaggaguaccaagcagauucucaggaucaggauuucacacaacauuuacauuaacaauaagcucacuacaaccagaugacguagcaacauacuggugcgcaguauuagaauuuuucggaccaggaacaaaaguagaaauaaaaagaacaguagcagcaccaaguguauucauauucccaccaucagacgaacaa

SEQ ID NO: 50002 - RNA, 360 nt, Artificial Sequence
  derived and/or modified sequence opt6 from anti-HIV_Chain
gacauacaaaugacacaaucaccaucaucacuaucagcaucaguaggagacagaguaacaauaacaugccaagcaucacaaggaauaggaucaucacuacaaugguaccaacaaaaaccaggaagagcaccaaaacuacuaguacacggagcaucaaaccuacacagaggaguaccaucaagauucucaggaucaggauuccacacaucauucacacuaacaauauccucacuacaaccagacgacguagcaacauacuucugcgcaguacuagaauucuucggaccaggaacaaaaguagaaauaaaaagaacaguagcagcaccaucaguauucauauucccaccaucagaugaacaa

SEQ ID NO: 50003 - RNA, 360 nt, Artificial Sequence
  derived and/or modified sequence opt6 from anti-HIV_Chain
gauauacaaaugacacaaucaccaagcagcuuaagcgcaagcguaggcgauagaguaagcauaaacugucaagcaggacaaggaauaggaagcucauuaaacugguaccaacaaaaacgaggaaaagcaccaaaacuauuaguacauggagcaagcacacuacaaagaggaguaccaagcagauucucaggaucaggauuucacacaacauuuacauuaacaauaagcucacuacaaccagaugacguagcaacauacuuuugcgaaucauuucaaugguucggaccaggaacaaaaguagaaauaaaaagaacaguagcagcaccaucaguauucauauucccaccaucagacgaacaa

SEQ ID NO: 50004 - RNA, 360 nt, Artificial Sequence
  derived and/or modified sequence opt6 from anti-HIV_Chain
uacauacaaaugacacaaucaccaucaucacuaucagcaucaauaggagacagaguaacaauaacaugccaagcaggacaaggaauaggaucaucacuaaacugguaccaacaaaaaccaggaaaagcaccaaaacuacuaguacacggagcaucaaaccuacaaagaggaguaucaucaagauucucaggaucaggauuccacacaacauucacacuaacaauaucaucacuaagaccagaagacguaggaacauacuucugcgaaguauacgaauucauaggaccaggaacaaaaguagacauaaaaagaacaguagccgcaccaucaguauucauauucccaccaucagacgaacaa

SEQ ID NO: 50005 - RNA, 360 nt, Artificial Sequence
  derived and/or modified sequence opt6 from anti-HIV_Chain
gacauacaaaugacacaaucaccaucaucacuaccagcaucaguaggagacacaguaacaauaacaugccaagcaggacaaggaauaggaucaucacuacaaugguaccaacaaagaccaggaagagcaccaaaccuacuaguauacgacgcaucaaaccuacaaagaggaguaccaucaagauucacaggaacaggauuccacacaacauucacacuaacaauaagaggacuaagaccagaagacuucggaacauacuucugcgcaucacuagaauucuucggaccaggaacaaaaguagacauaaaaagaacaguagcagcaccaucaguauucauauucccaccaucagacgaacaa

SEQ ID NO: 50006 - RNA, 360 nt, Artificial Sequence
  derived and/or modified sequence opt6 from anti-HIV_Chain
gacauacaaaugacacaaucaccaucaucacuaucagcaucaguaggagacagaguaacaauaacaugccaagcaucacaaggaauaggaucaucacuacaaugguaccaacaaaaaccaggaagagcaccaaaccuacuaguacacggagcaucuaaccuacacagaggaguaccaucaagauucucaggaucaggauuccacacaacauucucacuaacaauaucaggacuacaaagagacgacuucgcaacauacuucugcgcaguacuagaauucuucggaccaggaacaaaagucgacauaaaaagaacaguagcagcaccaucaguauucauauucccaccaucagacgaacaa

SEQ ID NO: 50007 - RNA, 360 nt, Artificial Sequence
  derived and/or modified sequence opt6 from anti-HIV_Chain
gacauacaaaugacacaaucaccaucaucacuaucaguaucaguaggagacagaguaucaauaacaugcagagcaacacaaggaauaggaaacucacuaaacugguaccaacaaaaaccaggaaaagcaccaaaaguacuaauauacggaacaacaaaacuacacggaggaguaccaucaagauucucaggaggaggaucaggaucaacaggaacacuaacaauagacucacuacaaccagaagacauagcaacauacuucugccaacuauucgaauucuucggaccaggaacaaaaguagaaauaaaaagaacaguagcagcaccaagcguauucauauucccaccaucagacgaacaa

SEQ ID NO: 50008 - RNA, 360 nt, Artificial Sequence
  derived and/or modified sequence opt6 from anti-HIV_Chain
gacauacaaaugacacaaucaccaucaucacuaucagcaucaguaggagacagaguaacaauaacaugccaagcaggacaaggaauaggaucaucacuaaacugguaccaacaaaaaccaggaagagcaccaaaacuacuaguauacggagcaucaaacuuacaaagaggaguaccaucaagauucucaggaucaggauuccacacaacauucacacuaacaauaucaucacuacaaccagaagacuucgcaacauacuuuugcuccguauacgaauuccuaggaccaggaacaaaaguagaaauaaaaagaacaguagcagcaccaucaguauucauauucccaccaucagacgaacaa

SEQ ID NO: 50009 - RNA, 360 nt, Artificial Sequence
  derived and/or modified sequence opt6 from anti-HIV_Chain
ccaauguuucaaccaggacaaaguggaggaguaguaguacaaaguggagaaaguuuacauuuaaguugugaagcaaguggauuuaaauuugcaagucaaaugaugcauuggguaagacauguaccaggaagaggacuagaauggguagcauuaauaaguugggauggaagcggaaaauuauuugcagauaguguaagaggaagauuuacaauacauagauggaaugauagaaauaguuuauauuuagauguaaaaaauguaagaccagaagaugcagcaauauauuauuguacaagaaauggauuugauguauggggacaaggaauacuaguaacaguaagcagugcaaguacaaaagga

SEQ ID NO: 50010 - RNA, 363 nt, Artificial Sequence
  derived and/or modified sequence opt6 from anti-HIV_HeavyChain
gaaguaaaauuaguagaaagcggaggaggauuaguacaaccaggaggaaguuuaagauuaaguugugcagcaagcggauucacauucagcucauuuggaaugcacuggguaagacaagcaccagaaaaaggacuagaauggguagcauauauaucaagcggaagcucaacauuacacuaugcagauacaguaaaaggaagauuuacaauaagcagagacaauagcaaaaacucacuauaucuacaaaugaaucuauuaagagcagaagauacagcaguauauuacugugcaagaggaucacgaaauuuaucacacagauuauuaagcuauuggggacaaggaacauuaguaacaguaucaagc

SEQ ID NO: 50011 - RNA, 363 nt, Artificial Sequence
  derived and/or modified sequence opt6 from anti-HIV_HeavyChain
gaaguacaauuaguagaaaguggaggaggauuaguacaaccaggaggaaguuuaagauuaaguugugcagcaaguggauuuacauuuaguaguuuuggaaugcauuggguaagacaagcaccaggaaaaggauuagaauggguaaguuauauaaguaguggaaguucaacauuacauuaugcagauacaguaaaaggaagauuuacaauaaguagagauaauaguaaaaauucacuauauuuacaaaugaauaguuuaagagcagaagauacagcaguauauuauugugcaagaggaaguagaaauuuaagccauagauuauuaaguuauuggggacaaggaacauuaguaacaguaaguagu

SEQ ID NO: 50012 - RNA, 363 nt, Artificial Sequence
  derived and/or modified sequence opt6 from anti-HIV_Chain
gacauacaaaugacacaaucaccaucaucacuaucagcaucaguaggagacagaguaacaauaacaugccaagcaucacaaggaauaucaaacucacuaaacugguaccaacaaaaaccaggaaaagcaccaagacuauuaauauacggaacaagcacacuacaaagaggaguaccaucaagauucucaggaucaggaucaggaacaagauucacaguaacaauaaacucacuacaaccagaagacauagcaacauacuucugccaacacaacgaauucuucggaagaggaacaaaaguagacauaaaaagaacaguagcagcaccaucaguauucauauucccaccaucagacgaacaacua

SEQ ID NO: 50013 - RNA, 363 nt, Artificial Sequence
  derived and/or modified sequence opt6 from anti-HIV_Chain
gacauacaaaugacacaaucaccaucaucaguaucagcaucaguaggagacagaguaacaauaacaugccaagcaucaagagacacagacaacucacuaacaugguaccaacaaaaaccaggaagaccaccaaaacuacuaauauaccacguaguaaacuuaggaccaggaguaccaucaagauucucaggaucagcaucaucagcaacacaaucaacacuaauaauaucagacuuccaaccagacgacguagcaacauacuucugccaaaacuacgaauucuucggaccaggaacaaaaguagaaauaaaaagaacaguagcagcaccaucaguauucauauucccaccaucagacgaacaa

SEQ ID NO: 50014 - RNA, 363 nt, Artificial Sequence
  derived and/or modified sequence opt6 from anti-HIV_Chain
gaaauaguacuaacacaaucaccaggaacacuaucacuaucaccaggagaaagagcaacauuaucaugcagagcaucacaaucaguaucaucaaacaaccuagcaugguaccaacaaaaaccaggacaagcaccaagacuacuaaugucaggagcaucaucaagagcaacaggaauaccagacagauucucaggaucaggaucaggaacagacuucacacuaacaauaucaagacuagaaccagaagacuucgcaguauaccacugccaacaauacggaucaagcccaccaacauucggacaaggaacaaaaguagaaauaaaaagaacaguagcagcaccaucaguauucauauucccacca

SEQ ID NO: 50015 - RNA, 363 nt, Artificial Sequence
  derived and/or modified sequence opt6 from anti-HIV_Chain
gacauacaaaugacacaaucaccaucaucacuaucagcauacguaggagacagaguaacaauaacaugcagagcaucacaaaacauaaacacauaccuaaacugguaccaacaaagaccaggaaaagcaccaaaacuacuaauauacgcagcaucaacacuacaaucaggaguaccaucaagauucucaggaucaggaucaggaacagacuucacacuaacaauaucaaaccuagaaacagaagacuucgcaguauacuacugccaacaaacauacagaucaguaacauucggacaaggaacaaaacuagaaauaaaaagaacaguagcagcaccaucaguauucauauucccaccaucagac

SEQ ID NO: 50016 - RNA, 363 nt, Artificial Sequence
  derived and/or modified sequence opt6 from anti-HIV_Chain
gacauacaaaugacacaaucaccaucaucacuauccgcaucaguaggagacagaguaacaauaacaugccaagcaggacaaggaauaggaucaucacuucaaugguaccaacaaaaaccaggaaaagcaccaaaacuauuaguacacggagcaucaaacuuacaccgaggaguaccaucaagauucucaggaucaggauuccacacaacauucucacuaacaauaucaggacuacaaagagacgacuucgcaacauacuucugcgcaguaguagaauuuuucggaccaggaacaaaaguagacauaaaaagaacaguagcagcaccaucaguauucauauucccaccaucagacgaacaacua

SEQ ID NO: 50017 - RNA, 363 nt, Artificial Sequence
  derived and/or modified sequence opt6 from anti-HIV_Chain
caaguacaauuaguagaaagcggagcagaacuaagaaaaccaggagaaaguuuagaaauaaguuguaaagcaaguggauacucguucucaagccauuggauaggaugggcaagacaaaugccaggaaaaggacuagaauggaugggaauaauauauccaggagacucaaacacaauauauagcccaaguuuucaaggacaaguaacaauaagcgcagacaaaagcauaaacacagcauaucuacaauggucaagccuaaaagcaagcgauacagcaauguauuucugugcaucaaacuaucacgauuacuuuuacuggggacaaggaacauuaguaacaguaagcucagcaucaacaaaagga

SEQ ID NO: 50018 - RNA, 363 nt, Artificial Sequence
  derived and/or modified sequence opt6 from anti-HIV_Chain
uuuguacaauuaguagaaaguggaggaggaguaguacaaccaggaacaaguuuaagauuaaguuguacaacaaguggauuuauauuuagugauuauggaaugcauuggguaagacaagcagcaggaaaaggauuagaauggguagcaguaauauggcaugauggaaguaauagauuuuaugcagauaguguaaaaggaagauuuacaauaaguagagauaauaguaaaaaugcaguauauuuagaaaugaauaaucuaagaguagaagauacagcauuauauuauugugcaagaacaaguauggauauagauuauuggggacaaggaacaccagugacaguaaguagugcaaguacaaaagga

SEQ ID NO: 50019 - RNA, 363 nt, Artificial Sequence
  derived and/or modified sequence opt6 from anti-HIV_Chain
gaaccaauguuucaaccaggacaaaguggaggaguaguaguacaaaguggagaaaguuuacauuuaaguugugaagcaaguggauuuaaauuugcaagucaaaugaugcauuggguaagacauguaccaggaagaggauuagaauggguagcauuaauaaguugggauggaaguggaaaauuauuugcagauaguguaagaggaagauuuacaauacauagauggaaugauagaaauaguuuauauuuagauguaaaaaauguaagaccagaagaugcagcaauauauuauuguacaagaaauggauuugauguauggggacaaggaauauuaguaacaguaaguagugcaaguacaaaagga

SEQ ID NO: 50020 - RNA, 366 nt, Artificial Sequence
  derived and/or modified sequence opt6 from anti-HIV_Chain
agccaacauuuaguacaaaguggaacacaaguaaaaaaaccaggagcaaguguaagaauaucaugucaagcaaguggauauaguuuuacagauuauguauuacauugguggagacaagcaccaggacaaggauuagaauggaugggauggauaaaaccaguauauggagcaagaaauuaugcaagaagauuucaaggaagaauaaauuuugauagagauauauauagagaaauagcauuuauggacuuaaguggauuaagaagugaugauacagcauuauauuuuugugcaagagauggaaguggagaugauacaaguuggcauuuagauccauggggacaaggaacauuaguaauaguaagugca

SEQ ID NO: 50021 - RNA, 366 nt, Artificial Sequence
  derived and/or modified sequence opt6 from anti-HIV_Chain
gacauacaaaugacacaaucaccaucaucacuaucagcaucaguaggagacagaguaacaauaacaugcagagcaucacaaucaauauccagauaccuaaacugguaccaacaaaaaccaggaaaagcaccaaaacuacuaauauacgcagcaucaucacuacaaggaggaguaccaucaagauucucaggaucaggaucaggaacagacuucacacuaacaauaucaucacuacaaccagaagacuucgcaacauacuacugccaacaaucaucaucaaaaccauucacauucggaggaggaacaaaaguagaaauaaaaagaacaguagcagcaccaucaguauucauauucccaccaucagac

SEQ ID NO: 50022 - RNA, 366 nt, Artificial Sequence
  derived and/or modified sequence opt6 from anti-HIV_Chain
gaaauaguacuaacacaaucaccaggaacacuaucacuaucaccaggagaaagagcaacacuaucaugcagagcaucacaaucaauaucaucaaacuaccuagcaugguaccaacaaaaaccaggacaagcaccaagacuacuaauauacggagcaucaacaagagcaacaggaauaccagacagauucucaggaucaggaucaggaacagacuucacacuaucaauaucaagacuagaaccagaagacauagcaguauacuacugccaccaauacggaucaucacaaagauucggacaaggaacaaaaguagaaauaaaaagaacaguagcagcaccaucaguauucauauucccaccaucagac

SEQ ID NO: 50023 - RNA, 366 nt, Artificial Sequence
  derived and/or modified sequence opt6 from anti-HIV_Chain
gaaauaguaaugacacaaucaccagcaacacuaucaguaucaccaggagacagagcaacacuaucaugcagagcaucacaaucaguaucaacaaaccuagcaugguaccaacaaaaaccaggacaagcaccaagacuacuaauauacggagcaucaacaagagcaacaggaauaccagcaacauucucaggaucaggauucgcaacagaauucacacuaacaauaucaucacuacaaucagaagacuucgcaguauacuacugccaacaauauaacaacuggccaccagcauucggacaaggaacaaaaguagaaauaaaaagaacaguagcagcaccaucaguauucauauucccaccaucagau

SEQ ID NO: 50024 - RNA, 366 nt, Artificial Sequence
  derived and/or modified sequence opt6 from anti-HIV_Chain
gacauacaaaugacacaaucaccagcaucacuaucagcaucaguaggagacagaguaacaauaacaugcagagcaucacaaggaauaucacacuaccuagcaugguaccaacaaaaaccaggaaaaguaccaagacuacuaauauacgcagcauccagacuacaaucaggaguaacaucaagauucucaggaucaggaucaggcacagaauucacacuaacaauaucaucacuacuaccagaagacgcagcaguauacuucugccaaaaauacgacacagacccaaugacauucggacaaggaacaagauuagaaauaaaaagaacaguagcagcaccaucaguauucauauucccaccaucagac

SEQ ID NO: 50025 - RNA, 366 nt, Artificial Sequence
  derived and/or modified sequence opt6 from anti-HIV_Chain
caaucagcacuaacucaaccaccaucagcaucaggcgcaccaggacaaagaguaacaauaucaugcucaggaggaccaucaaacguaggaggaaacuauguauacugguacagacaauuuccaggaacagcaccaaacuuacuaauacuaagagacgaccaaagaccaucaggaguaccagacagauucucagcaucaaaaucaggaaacucagcaucacuagcaauaucaggacuaagaccagacgacgaagcauucuacuucugugcaacauacgacucagacggaucaauaagacuauucggaggaggaacaacacuaacaguacuaucacaaccaaaagcagcaccaucaguaacauuauuc

SEQ ID NO: 50026 - RNA, 366 nt, Artificial Sequence
  derived and/or modified sequence opt6 from anti-HIV_Chain
gacauacaaaugacacaaucaccaucaucacuaucagcaucaguaggagacagaguaacaauaaacugccaagcaggacaaggaauaggaucaucacuaaacugguaccaaaaaaaaccaggaagagcaccaaaacuacuaguacacggagcaucaaaccuacaaagaggaguaccaucaagauucucaggaucaggauuccacacaacauucacacuaacaauaucaucacuacaaccagacgacguagcaacauacuucugcgcaguauuccaaugguucggaccaggaacaaaaguagacauaaaaagaacaguagcagcaccaucaguauucauauucccaccaucagacgaacaacuaaaa

SEQ ID NO: 50027 - RNA, 366 nt, Artificial Sequence
  derived and/or modified sequence opt6 from anti-HIV_Chain
gacauacaaaugacacaaucaccaucaucacuaucagcaucaguaggagacagaguaacaauaaccugccaagcaucacaaggaauaggaucaucacuacaaugguaccaacaaaaaccaggaagagcaccaaaccuauuaguacacggagcaucaaaacuacacagaggaguaccaucaagauucucaggaucaggauuccacacaacauucucacuaacaauauccggacuacaaagagacgacuucgcaacauacuucugcgcaguacuagaauucuucggaccaggaacaaaaguagaaauaaaaagaacaguagcagcaccaucaguauucauauucccaccaucagacgaacaacuaaaa

SEQ ID NO: 50028 - RNA, 366 nt, Artificial Sequence
  derived and/or modified sequence opt6 from anti-HIV_Chain
caaguacaucuaguacaaucaggagcagaaguaaaaaaaccaggagcaaguguaaaaguaaguugcaaaguaucaggauauacauuaagugaacuaagcauacauuggguaagacaaggaccaggaagaggauuagaauggauggcaaacuuugacccagaagauggagaaacaauauacgcaccacaauuccaaggaagaguaacacuaacagaagauacaucaacagauacagcauacaugcaauuaacaucacuaagaagcgaagacacagcaguauacuauugcgcaacagauagauauacagauacaggaagauggggaccaggaacacuaguaacaguaagcucagcaucaacaaaagga

SEQ ID NO: 50029 - RNA, 366 nt, Artificial Sequence
  derived and/or modified sequence opt6 from anti-HIV_Chain
caaguacaauuaguagaaaguggagggggauuaauacaaccaggaggaaguuuaagauuaagcugugaagcaaguggauuugcaguaggagauauaaauuauaugaguuggguaagacaagcaccaggaaaaggauuagaauggguaaguguauuauauaguggaggaaguagucaauaugcagauaguguaaaaggaagauuuacaauaaguagagauaauaguagaaauacauuauauuuacaaauggauaauuuaagagcagaagauacagcaguauauuauugugcaagaggauuaagaguauauuuugauuuauggggacaaggaauauuaguaacaguaaguagugcaaguacaaaagga

SEQ ID NO: 50030 - RNA, 366 nt, Artificial Sequence
  derived and/or modified sequence opt6 from anti-HIV_Chain
caaguacaaaugguagcaagcggaggaggauuaguaaaaccaggaggaucauuaagauuaaguugugaagcaucaggauuuacauuuagugauuauuauaugaguuggguaagacaagcaccaggaaaaggauuagaauggauaucauauauaacaagcggaggaaaugcauuauauuaugcagauaguguaaaaggaagauuuacaauaaguagagauaaugcaaaaaauaguuuauaucuacaaaugaauagucuaagagcagaagauacagcaguauauuauugugcaagagauuuauuacaugcacaugauuuuggaagacaaggaacauuaguaacaguaaguucagcaaguacaaaagga

SEQ ID NO: 50031 - RNA, 366 nt, Artificial Sequence
  derived and/or modified sequence opt6 from anti-HIV_Chain
caacuacaauuaguagaaucaggaggaggaguaguacaaccaggaagaucgcuaagacuaucaugcgcagcaucaggauuuacauuuaguacauacacaaugcauuggguaagacaagcaccaggaaaaggauuagaauggguagcaguaauaaguuaugacggaacaaauaaauauuacgcagacucaguaaaaggaagauucacaauaucaagagauaacagcaaaaauacauuauacuuacaaaugaacucacuaagaggagaagacacagcaguauacuauugcgcaagaucaccaucauacuauuucgauuacuggggacaaggaacauuaguaacaguaucagcagcaucaacaaaagga

SEQ ID NO: 50032 - RNA, 369 nt, Artificial Sequence
  derived and/or modified sequence opt6 from anti-HIV_Chain
caaguacauuuaagucaaaguggagcagcaguaacaaaaccaggagcaaguguaagaguaaguugugaagcaaguggauauaaaauaucagaucauuuuauacauugguggagacaagcaccaggacaaggauuacaauggguaggauggauaaauccaaaaacaggacaaccaaauaauccaagacaauuucaaggaagaguaaguuuaacaagacaagcaaguugggauuuugauacauauucauuuuauauggauuuaaaagcaguaagaucagaugauacagcaauauauuuuugugcaagacaaagaagugauuuuugggauuuugauguauggggaaguggaacacaaguaacaguaucaagu

SEQ ID NO: 50033 - RNA, 369 nt, Artificial Sequence
  derived and/or modified sequence opt6 from anti-HIV_Chain
caaguacaacuauuacaaucaggagcaguaguaacaaaaccaggagcaucaguaagaguaucaugugaagcaucaggauauaaaauaagagauuacuuuauacauugguggagacaagcaccaggacaaggauuacaauggguaggauggauaaacccacaaacaggacaaccaaauauaccaagaccauuucaaggaagaguaacacuaacaagacaugcaucaugggauuuugauacauuuagcuuuuauauggacuuaaaagcauuaagaucagaugacacagcaauauauuuuugugcaagaagaagaagugacuauugugauuucgauguauggggaucaggaacacacguaacaguaucauca

SEQ ID NO: 50034 - RNA, 369 nt, Artificial Sequence
  derived and/or modified sequence opt6 from anti-HIV_Chain
caaguacaauuauuacaaaguggagcagcaguaacaaaaccaggagcaaguguaagaguaaguugugaagcaaguggauauaauauaagggauuauuuuauacauugguggagacaagcaccaggacaaggauuacaauggguaggauggauaaauccaaaaacaggacaaccaaauaauccaagacaauuucaaggaagaguaaguuuaacaagacaugcaaguugggauuuugauacauuuaguuuuuauauggauuuaaaaggauuaagaagugaugauacagcaauauauuuuugugcaagacaaagaagugauuauugggauuuugauguauggggaaguggaacacaaguaacaguaaguagu

SEQ ID NO: 50035 - RNA, 369 nt, Artificial Sequence
  derived and/or modified sequence opt6 from anti-HIV_Chain
caaguacaauuacuacaaaguggagcagcaguaacaaaaccaggagcaagcguaagaguaaguugugaagcaaguggauauaauauaagagauuauuuuauacauugguggagacaagcaccaggacaaggauuacaauggguaggauggauaaauccaaaaacaggacaaccaaauaauccaagauuauuucaaggaagaguaaguuuaacaagacaugcaaguugggauuuugauacauuuucauuuuauauggacuuaaaagcaguaagaucagaugauacagcaguauauuuuugugcaagacaaagaucagauuauugggauuuugauguauggggaaguggaacacaaguaacaguaucaagu

SEQ ID NO: 50036 - RNA, 369 nt, Artificial Sequence
  derived and/or modified sequence opt6 from anti-HIV_Chain
caaguaagauuauuacaaagcggagcagcaguaacaaaaccaggagcaaguguaagaguaaguugugaagcaaguggauaugaaauaagagauuauuuuauacauugguggagacaagcaccaggacaaggauuacaauggguaggauggauaaauccaaaaacaggacaaccaaauaauccaagacaauuucaaggaagaguaaguuuaacaagacaagcaaguugggauuuugauaguuauaguuuuuauauggauuuaaaagcauuaagaagugaugauacaggaguauauuuuugugcaagacaaagaagugauuauugggauuuugauguauggggaaguggaacacaaguaacaguaaguagu

SEQ ID NO: 50037 - RNA, 369 nt, Artificial Sequence
  derived and/or modified sequence opt6 from anti-HIV_Chain
caaguacaauuauuacaaaguggagcagcaguaacaaaaccaggagcaucaguaagaguaaguugugaagcaaguggauauaauauaagagauuauuuuauacauugguggagacaagcaccaggacaaggauuacaauggguaggauggauaaauccaaaaacaggacaaccaaauaauccaagacaauuucaaggaagaguaucauuaacaagacaugcaaguugggauuuugauacauuuaguuuuuauauggauuuaaaagcauuaagaagugaugauacagcaguauauuuuugugcaagacaaagaucagauuauugggauuuugauguauggggaaguggaacacaaguaacaguaagcagu

SEQ ID NO: 50038 - RNA, 369 nt, Artificial Sequence
  derived and/or modified sequence opt6 from anti-HIV_Chain
gaaguacaauuaguagaaaguggaggaggauuaauacaaagaggaggaaguuuaagauuaaguuguguagcaaguggauuuccaguaagugauaaucauaugaguuggguaagacaagcaccaggaaaaggacuagaauggguaaguauaauauauagugauggaggaacauauuaugcagauucaguaaaaggaagauuuacaauaaguagagauaauaguaaaaauacaguauauuuacaaaugaauaguuuaagagcaacagauacagcaguauauuauugugcaagagauccaggauuucauuauggauuagauguauggggacaaggaacaacaguaacaguaaguagugcaucaacaaaagga

SEQ ID NO: 50039 - RNA, 369 nt, Artificial Sequence
  derived and/or modified sequence opt6 from anti-HIV_Chain
caaguacaauuacaagaaaguggaccaggauuauuaagaccguuagaaacauuaaguuuaacauguagcguaaguggaggaaguauaagaggauauuuuuggaguuggguaagacaaccagcaggaagaggauuagaauggauaggaagaauauauaguaguggaacaacaagauuuaauccaaguuuaaaaaguagaguaagauuaagcauagauacagcaaaaagugaaguaaguuuaaauauaacaaguguaacagcagcagauagugcaaguuauuuuugugcaggaacaaguccaguacauggaggauuagauuuauggggauuaggauuaagaguaacaguaaguagugcaaguacaaaagga

SEQ ID NO: 50040 - RNA, 369 nt, Artificial Sequence
  derived and/or modified sequence opt6 from anti-HIV_Chain
gaaauaguacuaacacaaucaccaggaacauuaaguuuaagcccaggagaaagagcaacauuaagcuguagagcaagccaaagcguaagcucaaaccuagcaugguacgcacaaaaaccaggacaagcaccaagacuaauaauauauggagcaagcucaagagcaagcgcaauaccagacagauucagaggaucaggcucaggaacagacuuuacauuaacaauaagcagacuagaaccagaagacuuugcaguauacuauugccaacaauaugacgaugcaccaauaacauucggacacggaacaagacuagaaauaaaaagaacaguagcagcaccaagcguauucauauucccaccaucagacgaa

SEQ ID NO: 50041 - RNA, 369 nt, Artificial Sequence
  derived and/or modified sequence opt6 from anti-HIV_Chain
gaaauaguacuaacacaaucaccaggaacacuaucauuaucaccaggagacagagcagcacuaagcuguagagcaucagaaacauuaucaggaaacucacuagcaugguaucaacaaaaaagaggacaaccaccaagauuacuaauauucgcagcaucaucaagagcaacaggaauaccagaaagauuuucaggaggaggaucaggaacagauuucacacuaacaauaacaagauuagaaccagaagauuucgcaguauauuucugucaacaauacguagacgcaccaauaacauuuggacaaggaacaagauuagaaauaaaaagaaccguagccgcaccaucaguauuuauauuuccaccaagcgau

SEQ ID NO: 50042 - RNA, 369 nt, Artificial Sequence
  derived and/or modified sequence opt6 from anti-HIV_Chain
gacauacaaaugacacaaucaccaucaucacuaucagcaucaguaggagacagaguaacaauaacauguagagcaucacaagacauaacaacauaccuagcauggcuacaacaaaaaccaggaaaagcaccaaaaucacuaauauacucagcaucaacaguacaaucaggaguaccaucaagauucucaggaucaggaucaggaacagaauucacacuaacaauaucaggacuacaaccagaagacuucgcaacauacuacugccaacaauacaacuacuacccaauaacauucggacuaggaacaagacuagaaauaaaaagaacaguagcagcaccaucaguauucauauucccaccaucagacgaa

SEQ ID NO: 50043 - RNA, 369 nt, Artificial Sequence
  derived and/or modified sequence opt6 from anti-HIV_Chain
gacauacaaaugacacaaucaccaucaucacuaucagcaucaauaggagacagaguaacaauaacaugcagagcaaaccaacacauaagaucauuccuaaacugguaccaacaaacaccaggaaaagcaccaaaauuacuaauauacgcagcaucaacacuacaaagaggaguaccaucaagauucucaggaucaggaucaggaacagacuucacacuaacaauaacaucacuagaaagagaagaccuagcaacauacuacugccaacaaacauacacaucaccaauaacauucggacaaggaacaagacuagaaauaaaaagaacaguagcagccccaucaguauucauauucccaccaucagacgaa

SEQ ID NO: 50044 - RNA, 369 nt, Artificial Sequence
  derived and/or modified sequence opt6 from anti-HIV_Chain
ucagaaauaguacuaacacaaucaccagcaacacuaucacuaucaccaggcgaaucagcaacauuaucaugcagagcaucacaaucacuaucaucaucacuagcaugguaccaacaaaaaccaggacaagcaccaagacuacuaauauacgacacauccgacagagcaacaggaauaccagcaagauucucaggaagaggaucaggaacagacuucacacuaacaauaucaucacuagaaccagaagacuucgcaguauacuacugccaacaaagaucaaacugggcaauaacauucggacaaggaacaagauuagaaauaaaaagaacaguagcagcaccaucaguauucauauucccaccaucagac

SEQ ID NO: 50045 - RNA, 369 nt, Artificial Sequence
  derived and/or modified sequence opt6 from anti-HIV_Chain
caaguacuaucaguaucagguacaccaggacaaagaguaauaauaucaugcucaggaacaagcucaaacguaggaggaaacuuaguaucaugguaucaacauuuaccaggagcagcaccaagauuauuaauacacagagacgaucaaagaccaucaggaguaccagauagauuuagcggaaguaaaagcggaaacucagcaagccuaguaauaucaggacuaagaucagacgaugaagcagacuauuucugugcagcauacgauucaacauucucacuaccaguauuuggaggaggaacaagauuaacaguacuaucacaaccaaaagcagcaccaagcguaacauuauacgcaccaucaagcgaagaa

SEQ ID NO: 50046 - RNA, 369 nt, Artificial Sequence
  derived and/or modified sequence opt6 from anti-HIV_Chain
gacauacaaaugacacaaucaccaucaucacuaucagcaucaguaggagacagaguaacaauaacaugccaagcaggacaaggaauaggaucaucauuacaaugguaccaacaaaaaccaggaaaagcaccaaaacuacuaguacacggagcaucaaaccuacacagaggaguaccaucaagauucucaggaucaggauuccacacaacauucucacuaacaauaucaggacuacaaagagacgacuucgcaacauacuucugcgcaguacuagaauucuucggaccaggaacaaaaguagaaauaaaaagaacaguagcagcaccaucaguauucauauucccaccaucagacgaacaacuaaaauca

SEQ ID NO: 50047 - RNA, 369 nt, Artificial Sequence
  derived and/or modified sequence opt6 from anti-HIV_Chain
gaaauaguacuaacacaaucaccagcaacauuaagcuuaagcccaggagaaagagcaacauuaagcuguagagcaagccaaggauuaaacuuuguaguaugguaucaacaaaaaagaggacaagcaccaagauuauuaauacacgcaccaucagacagagcaccaggaguaccagauagauuuucagcaagaggaucaggaacagauuucucacuaguaauaucaucaguagaaccagacgauuucgcaauauauuacugucaagaauacucaucaacaccauauaacuuuggaccaggaacaagaguagacagaaaaagaacaguagcagcaccaucaguauuuauauuuccaccaucagaugaacaa

SEQ ID NO: 50048 - RNA, 369 nt, Artificial Sequence
  derived and/or modified sequence opt6 from anti-HIV_Chain
gaaauaguacuaacacaaucaccaacaacauuaaguuuaagcccaggagaaagagcaacauuaagcuguagagcaagccaaggaguaaacuuaguaguaugguaucaacaaaaaagaggacaagcaccaagauuauuaauauacggaccaucagacagagcaccaggaguaccagauagauuuagcgcaagaggaagcggaacagaauucucacuaguaauaucaagcguagaaccagacgauuucgcacuauauuacugucaagaauacucaagcacaccauauaacuuuggaacgggaacaagaguagacagaaaaagaacaguagcagcaccaucaguauuuauauuuccaccaagcgaugaacaa

SEQ ID NO: 50049 - RNA, 369 nt, Artificial Sequence
  derived and/or modified sequence opt6 from anti-HIV_Chain
gaaauaguacuaacacaaucaccagcaacauuaagcuuaagcccaggagaaagagcaacauuaagcuguagagcaagccaaggaguaaacuuuguaguaugguaucaacaaaaaagaggacaagcaccaagauuacuaauauacggaccaucaaacagagcaccaggaguaccagauagauuuagugcaagaggaagcggaacagaauucucauuaguaauaucaagcguagaaccagacgauuucgcacuauauuacugucaagaauacucaagcacaccauauaacuuuggaccaggcacaagaguagacagaaaaagaacaguagcagcaccaucaguauuuauauuuccaccaagcgaugaacaa

SEQ ID NO: 50050 - RNA, 369 nt, Artificial Sequence
  derived and/or modified sequence opt6 from anti-HIV_Chain
gaaauaguacuaacacaaucaccagcaacauuaagccuaagcccaggagaaagagcaacauuaagcuguagagcaagccaaggauuaaacuuuguaguaugguaucaacaaaaacgaggacaagcaccaagauuacuaauacacggaccaucacacagagcaccaggaguaccagauagauuuagcgcaagaggaagcggaacagaauuuagccuaguaauaucaucaguagaaccagacgauuucgcaauauauuacugucaagaauacucaagcacaccauauaacuucggaccaggaacaagaguagacagaaaaagaacaguagcagcaccaucaguauuuauauuuccaccaagcgaugaacaa

SEQ ID NO: 50051 - RNA, 369 nt, Artificial Sequence
  derived and/or modified sequence opt6 from anti-HIV_Chain
gaaauaguacuaacacaaucaccagcaacacuaucauuaagcccaggagaacgagcaacauuaagcuguagagcaagccaaggauuaaacuuuguaguaugguaucaacaaaaaggaggacaagcaccacgauuacuaauacacggaccaacagacagagcaccaggaguaccagauagauuuagcgcaagaggaaguggaacagaauuuagccuaguaauaucaaguguagaaccugacgauuucgcacuauauuacugucaagaauacucaagcacaccauauaacuucggaccaggaacaagaguagacagaaaaagaacaguagcagcaccaucaguauuuauauuuccaccaagcgaugaacaa

SEQ ID NO: 50052 - RNA, 369 nt, Artificial Sequence
  derived and/or modified sequence opt6 from anti-HIV_Chain
gaaauaguacuaacacaaucaccagcaaccuuaagcuuaagcccaggagaacgagcaacauuaagcuguagagcaagccaaggacuaaacuuuguaguaugguaucaacaaaaaaggggacaagcaccaagauuacuaauacacgcaccaucaggaagagcaccaggaguaccagauagauuuagcgcaagaggaagcggaacagaauucucacuaguaauaucaucaguagaaccagacgauuucgcaauauauuacugucaagaauacucaucaacaccauauaacuuuggaccaggaacaagaguagacagaaaaagaacaguagcagcaccaucaguauuuauauuuccaccaagcgaugaacaa

SEQ ID NO: 50053 - RNA, 369 nt, Artificial Sequence
  derived and/or modified sequence opt6 from anti-HIV_Chain
caaguacaauuaguacaaucaggagcagaaguaaaaaaaccaggaagcucaguaaaaguaucaugcaaaacaucaggaggaucauucucaaacuacgcauucucauggguaagacaagcaccaggagaaggacuagaauggaugggaagaauaauaccaauauucggaacagccaaauacacacaaaaacuacaaggaagaguaacaauaacagcagacaaauucacaucaacaguauacauggaacuaucaucacuaagaucagaagacacagcaauauacuacugcgcaucacuacaccaaggaccaauaggauacacaccauggcacccaccaccaagagcaccauuaggacaaucaguaugcgga

SEQ ID NO: 50054 - RNA, 369 nt, Artificial Sequence
  derived and/or modified sequence opt6 from anti-HIV_Chain
caaguacaauuaguagaaagcggaggaggauuaguacaaccaggaggaagucuaagaauaagcuguagcgcaacaggauucacauucucaacacaugcaaugcacuggguaagacaagcaccaggaaaaggacuagaauacguaagcgcaauaaauagcaauggaagaagcgcauucuaugcagauagcguaaaaggaagaguaacaauaagcagagacaauagcaaaaauacacuauuucuacaaaugacaucacuaagagcagaagauacagcaguauauuacuguguaaaaggaccauuauuaagauaucuagauagcuggggacaaggaacauuaguaacaguaagcagcgcaucaacaaaagga

SEQ ID NO: 50055 - RNA, 369 nt, Artificial Sequence
  derived and/or modified sequence opt6 from anti-HIV_Chain
gaaguacaauuaguagaaagcggaggaggauuaguacaaccaggaggaagccuaagaauaaguuguagcgcaacaggauucacauucucaacccaugcaaugcacuggguaagacaagcaccaggaaaaggacuagaauacguaagcgcaauaaauagcaauggaagaagcgcauucuaugcagauagcguaaaaggaagaguaacaauaagcagagacaauaguaaaaacacacuauuucuacaaaugacaagccuaagagcagaagauacagcaguauauuacuguguaaaaggaccacuauuaagauaucuagauagcuggggacaaggaacauuaguaacaguaagcucagcaucaacaaaagga

SEQ ID NO: 50056 - RNA, 369 nt, Artificial Sequence
  derived and/or modified sequence opt6 from anti-HIV_Chain
gaagaaucaggaccaggauuaguaaaaccaagccaaacauuaagccuaacauguagcguaagcggagacucaguaucaucaggaggauauuucuggucauggauaagacaacauccaacaaaaggacuagaaugcuuaggauauguauauuacacaggaaauacauauuacaacccaucacuaaaaagcccaccaacaauagaaguagcaauggcaaauaaucaaguaagccuaaaauuaggaucaguaacagcagcagacacagcaguauacuauugcgcaagaauaaaaagauucagaggaggaaacuauuucgauacauggggacauggauuauuaguaacaguaucaucagcaucaacaaaagga

SEQ ID NO: 50057 - RNA, 369 nt, Artificial Sequence
  derived and/or modified sequence opt6 from anti-HIV_Chain
caaguacaacuacaagaaucaggaucaggacuaguaaaaccaucaggaacacuaucauuaacaugcgcaguaucaaacggaccaauaagcucaggaaacugguggaguuggguaagacaaacaccagaaaaaggacuagaauggauaggagaaguauaccacucaggaucaacaaaccacaacccaucauuaaaaucaagagcaacaauacuaguagacaaaucaaaaaaucaauucagccuaaaccuaagaucaguaacagcagcagacacagcaguauacuacugcgcaagaguaagaggaaguuggaacuucgacuacuggggacaaggaauacuaguaacaguaucaucagcaaguacaaaagga

SEQ ID NO: 50058 - RNA, 369 nt, Artificial Sequence
  derived and/or modified sequence opt6 from anti-HIV_HeavyChain
gaaguacaauuacaacaaagcggaacaguacuagcaagaccaggagcaagcguaaaaaugagcuguaaagcaagcggauacacauucacaaguuauuggaugcacuggguaaaacaaaggccaggacaaggacuagaauggauaggagcaauauauccaggaaacucagacacaaguuauaaccaaaaauuuaaaggaaaagcaaaauuaacagcaguaacaagcgcaagcacagcauauauggaacuaagcucauuaacaaaugaagauagugcaguauauuacuguacaagauggccacacuauuacggaggaucaagauauuacuuugacuauuggggacaaggaacaacacuaacaguaucaagc

SEQ ID NO: 50059 - RNA, 372 nt, Artificial Sequence
  derived and/or modified sequence opt6 from anti-HIV_Chain
guaguacaauuaguagaaaguggagggggacuaguacaaccaggaggaaguuuaagauuaaguugugcagcaaguggauuugcauuuagaaguuauuggaugaguuggguaagacaagcaccaggaagaggauuagaauggguagcaaauauaaaacaagauggaagugaaaaauauuaugcagauaguguaaaaggaagauuuacaauaaguagagauaauacaaaaaauaguuuauauuuacaaaugaauaguuuaagagcagaagauacagcaguauuuuauugugcaaguagaggagauagauauggaccaauagauuauuggggacaaggaacauuaguaacaguaaguagugcaagcacaaaagga

SEQ ID NO: 50060 - RNA, 372 nt, Artificial Sequence
  derived and/or modified sequence opt6 from anti-HIV_Chain
caaguacaauuaguacaaaguggagcagaaauaaaaaaaccaggagaaagcuuaaaaauaaguuguaaagcaaguggauauacauuuaaugauuauuggauaggauggguaagacaaaugccaggaaaaggauuagaauggaugggaauauuuuauccagaugacagugauaguaauuauaguccaaguuuucaaggaagaguaacaauaagugcagauaaaaguauaacaacagcauauuuacaauggaguacauuaaaagcaagugauagugcaauguauuuuugugcaagauuauuaggagauaguggagcauuugauauauggggacaaggaacaaugguaauaguaucaagugcaaguacaaaagga

SEQ ID NO: 50061 - RNA, 372 nt, Artificial Sequence
  derived and/or modified sequence opt6 from anti-HIV_Chain
caaguacaauuaguacaaaguggaggaggauuaguaaaaccaggaggaaguuuaagauuaaguugugcagcaaguggauuuacauuuaguaguuauaguaugaauuggguaagacaagcaccaggaaaaggauuagaauggguaaguaguauaaguaguucaaguaguuauauauauuaugcagauaguguaaaaggaagauuuacaauaaguagagauaaugcaaaaaauaguuuauauuuacaaaugaauaguuuaagagcagaagauacagcaguauauuauugugcaagagaaggaaguuauuauuauggaauggauguauggggacaaggaacaacaguaacaguaagcagugcaaguacaaaagga

SEQ ID NO: 50062 - RNA, 372 nt, Artificial Sequence
  derived and/or modified sequence opt6 from anti-HIV_Chain
gaaauaguacuaacacaaucaccagcaacacuaucaguaucaccaggagaaagagcaacacuaucaugcagagcaggacaaucaguaucaucagaccuagcaugguaccaacacaaaccaggacaagcaccaagacuauuaauauacgacgcaucaaaaagagcaacaggaauaccagcaagauucucaggaucaggaucaggaacagacuucacacuaacaauaucaucacuagaaccagaagacuucgcaguauacuacugucaacacagaacaaacuggccaccaucaauaacauucggacaaggaacaagacuagaaauaaaaagaacaguagcagcaccaucaguauucauauucccaccaucagac

SEQ ID NO: 50063 - RNA, 372 nt, Artificial Sequence
  derived and/or modified sequence opt6 from anti-HIV_Chain
gaaauaguacuaacacaaucaccaggaacacuaucacuaucaccaggagaaagagcaacacuaagcugcagagcaucacaaucaguaucaucaagauaccuagcaugguaccaacaaaaaccaggacaagcaccaagacuaauaauauacgacgcaucaucaagagcaucaggaauaccagaccgauucucaggaucaggaucagaaacagacuucacacuaacaauaacaagacuagaaccagaagacuucgcaguauacuacugccaacuauacggaacaucaccaaaauucacauucggacaaggaacaaaauuagaaauaaaacgaacaguagcagcaccaucaguauucauauucccaccaucagac

SEQ ID NO: 50064 - RNA, 372 nt, Artificial Sequence
  derived and/or modified sequence opt6 from anti-HIV_Chain
gaaauaguacuaacacaaucaccaggaacacuaucacuaucaccaggagaaagagcaacacuaucaugcagagcaucacaauccguaucaaacaacuaccuagcaugguaccaacaaaaaccaggacaagcaccaagacuacuaauauacggagcaucaucaagagcaacaggaauaccagacagauucucaggaucaggaucaggaacagacuucacacuaacaauaucaagacuagaaccagaagacuucgcaguauacuacugccaacaauacgcaacaucaucacuauacacauucggacaaggaacaaaacuagaaauaaaaagaacaguagcagcaccaucaguauucauauucccaccaucagac

SEQ ID NO: 50065 - RNA, 372 nt, Artificial Sequence
  derived and/or modified sequence opt6 from anti-HIV_Chain
ccagcaacacuagcaguaucaccaggagaacgagcaacaauaucaugcaaaucaucacaaaaccuacuauacucagcaaacaaccaacacucacuagcaugguaccaacaaagaccaggacaaccaccaaaacuacuacuauacugggcaucaaccagacuauccggaguaccagacagauucucaggaucaggaucaggaacagacuucacacuaacaauaucaaaccuacaagccgaagacguagcaguauacuacugccaacaauacuacucaccaccaccaacauucggacaaggaacaaaaguagaaauaagaagaacaguagcagcaccaucaguauucauauucccaccaucagacgaacaacua

SEQ ID NO: 50066 - RNA, 372 nt, Artificial Sequence
  derived and/or modified sequence opt6 from anti-HIV_Chain
caaccaguacuaacacaaccaccaucagcaucaggagcaccaggacaaagaguaacaauaucaugcucaggaggaccaucaaaugucggaggaaacuauguauacugguacagacaauucccaggaacagcaccaaacuuacuaauacuaagagacgaccaaagaccauccggaguaccagacagauucucagcaucaaaaucaggaaacucagcaucacuagcaauaacaggauuaagaccagacgaugaagcauucuacuucugugcaacuuacgacucagacggaucaauaagacuauucggaggaggaacagcauuaacaguacuaucacaaccaaaagcagcaccaucaguaacauuauucccacca

SEQ ID NO: 50067 - RNA, 372 nt, Artificial Sequence
  derived and/or modified sequence opt6 from anti-HIV_Chain
aacuucaugcuaacacaaccaccaucagcaucaggagcaccaggacaaagaguaacaauaucaugcucaggaggaccauccaacguaggcggaaacuacguauacugguacagacaauucccaggaacagcaccaaacuuacuaauacuaagagacgaccaaagaccaucaggaguaccagacagauucucagcaucaaaaucaggaaacucagcaucacuagcaauaucaggacuaagaccagacgaugaagcauuuuacuucugcgcaacauacgacucagacggaucaauaagacuauuuggaggaggaacaacauuaacaguacuaucacaaccaaaagcagcaccaucaguaacacuauucccacca

SEQ ID NO: 50068 - RNA, 372 nt, Artificial Sequence
  derived and/or modified sequence opt6 from anti-HIV_Chain
gacauacaaaugacacaaucaccaccaucacuaucagcaucaguaggagacagaguaacaauaacaugccaagcaucccaagacauaaacaacuuccuaaacugguaccaacaaaaaccaggaaaagcaccaagacuacuaauauacgacgcaucaaaccuagaaucaggaguaucauccagauucucaggcucaagaucaggaacagacuucacacuaacaauaucaucccuacuaccagaagacauagcaacauacucaugccaacaauacucaaaccuaccauacacauucucacaaggaacaaaacuagaaauaaaaagaacaguagcagcaccaucaguauucauauucccaccaucagacgaacaa

SEQ ID NO: 50069 - RNA, 372 nt, Artificial Sequence
  derived and/or modified sequence opt6 from anti-HIV_Chain
caaguacaauuaguacaaucaggaacagcaguaaaaagaccaggagcaaguguaagaguaagcugucaagcaagcggauacacauuuauagaccauuucauauacugguggagacaagcaccaggacaaggauuagaaugguuaggauggauaaauccauuaacaucacaaccaaguuauccaucaagauuucaaggaagauuaacauuaacaagagacacauucgaugaaaugcuauauauggaucuaagaggauuaagaucagacgauacaggaauauauuucugugcaagaagacauagugauuacugugacuuugacauauggggaagcggaacacaaauaauaguaucaucagcaagcacaaaagga

SEQ ID NO: 50070 - RNA, 372 nt, Artificial Sequence
  derived and/or modified sequence opt6 from anti-HIV_Chain
caaguacaauuaguacaaagcggagcagcauuaaaaaaaccaggagcaagcuuaagaauaagcugucaagcauacggauauaaauuuacagaccauuuaauauauugguggagacaagcacccggacaaggacuagaauggauaggauggauaaaaccagaaacaggacaaccaaguuauaguuauaaauuucaaggaagaguaaguuuaacaagagauacauuucaagaaauauuauuuauggauuuaagaggauuaagaucagacgauacagcaauauauuucugugcaagaagacauagugauuacugugacuuugacguauggggaaguggaagucaaguaauaguaucaagugcaaguacaaaagga

SEQ ID NO: 50071 - RNA, 372 nt, Artificial Sequence
  derived and/or modified sequence opt6 from anti-HIV_Chain
caaguacaauuaguacaaaguggagcagcauuaaaaaaaccaggagcaaguuuaagaauaaguugucaaacauauggauauaaauuuacagaucauuuaauauauugguggagacaagcaccaggacaaggauuagaauggaugggauggauaaaaccagaaacaggacaaccaaguuauaguuauagauuucaaggaagaguaaguuuaacaagagauacauuugaagaaauaguauuuauggauuuaagaggacuaagaagugaugauacagcaauauauuuuugugcaagaagacauagugauuauugugauuuugauguauggggaaguggaagucaaguaauaguaaguagugcaaguacaaaagga

SEQ ID NO: 50072 - RNA, 372 nt, Artificial Sequence
  derived and/or modified sequence opt6 from anti-HIV_Chain
caaguacaauuaguacaaagcggagccgcacuaaaaaaaccaggagcaaguuuaagaauaagcugucaaacauacggauacaaauucacagaccaucuaauauacugguggagacaagcaccaggacaaggauuagaauggauaggauggauaaaaccagaaacaggacaaccaaguuauaguuauagauuucaaggaagaguaagucuaacaagagacacauucgaagaaauagcauuuauggaucuaagaggauuaagaucagacgauacagcaauauauuucugugcaagaagacauacagauuacuguguauuugacguauggggaucaggaagccaaauaauaguaucaucagcaagcacaaaagga

SEQ ID NO: 50073 - RNA, 372 nt, Artificial Sequence
  derived and/or modified sequence opt6 from anti-HIV_Chain
caaguacaauuaguccaaagcggaacagcaguaaaaagaccaggagcaagcguaagaguaagcugucaagcaagcggauacacauucacagacuauuuuauauacugguggagacaagcaccaggacaaggacuagaaugguuaggauggauaaauccauuaacaucacaaccaaguuauccaucaagauuucaaggaagauuaacauuaacaagagacacauucgaugaaaugcuauauauggaucuaagaggauuaagaucagacgauacaggaauauauuucugugcaagaagacauagugauuacugugacuuugacauauggggaagcggaacacaaauaauaguaucaagugcaagcacaaaagga

SEQ ID NO: 50074 - RNA, 372 nt, Artificial Sequence
  derived and/or modified sequence opt6 from anti-HIV_Chain
caaguacaauuaguacaaaguggagcagcauuaaaaaaaccaggagcaaguguaagaauaaguugucaagcauacggauauaaauuuacagaucaucuaauauauugguggagacaagcaccaggacaaggauuagaauggauaggauggauaaaaccagaaacaggacaaccaaguuaugcauauaaauuucaaggaagaguaacauuaacaagggacacauuugaagaaauacauuuuauggauuuaagaggaguaagaaaugaugauacagcaacauauuucugugcaagaagacauagugauuacugugacuuugauguauggggaaguggaagucaaguaauaguaucaagugcgaguacaaaagga

SEQ ID NO: 50075 - RNA, 372 nt, Artificial Sequence
  derived and/or modified sequence opt6 from anti-HIV_Chain
caaguacaacuaguacaaaguggagcagcauuaaaaaaaccaggagcaagcguaagaauaucaugucaaacauauggauauaaauuuacagaucauuuaauauauugguggagacaagcaccaggacaaggauuagaauggauaggauggauaaaaccagaaacaggacaaccaagcuauaguuauagauuucaaggaagaguaaguuuaacaagagacacauuugaagaaauaguauuuauggauuuaagaggauuaagaucagaugauacagcaauauauuucugugcaagaagacauagugauuauugugacuuugauguauggggaaguggaagccaaguauuaguaucaagugcaagcacaaaagga

SEQ ID NO: 50076 - RNA, 372 nt, Artificial Sequence
  derived and/or modified sequence opt6 from anti-HIV_Chain
caaguacaauuaguacaaaguggagcagcauuaaaaaaaccaggagcaaguuuaagaauaagcugucaaacauauggauauaaauuuacagaucauuuaauauauugguggagacaagcaccaggacaaggauuagaauggauaggauggauaaaaccagaaacaggacaaccaaguuauagcuauagauuucaaggaagaguaaguuuaacaagagauacauuugaagaaauaguauuuauggauuuaagaggauuaagaucagaugauacagcaauauauuuuugugcaagaagacauagcgauuauugugauuuugauguauggggaaguggaagucaaguacuaguaucaagugcaaguacaaaagga

SEQ ID NO: 50077 - RNA, 372 nt, Artificial Sequence
  derived and/or modified sequence opt6 from anti-HIV_Chain
caaguacaauuaguacaaaguggagcagcauuaaaaaaaccaggagcaaguguaagaauaaguugucaaacauauggauauaaauuuacagaucauuuaauacauugguggagacaagcaccaggacaaggauuagaauggauaggauggauaaaaccagauacaggacaaccaaguuauaguaguagauuucaaggaagaguaaguuuaacaagagauacauuugaagaaauaguauuuauggauuuaagaggauuaagaucagaugauacagcaauauauuuuugugcaagaagacauagugauuauugugauuuugauguauggggaagcggaagucaaguauuaguaucaagugcaaguacaaaagga

SEQ ID NO: 50078 - RNA, 372 nt, Artificial Sequence
  derived and/or modified sequence opt6 from anti-HIV_Chain
caaguacaauuaguacaaaguggagcagcauuaaaaaaaccaggagcaaguuuaagaauaaguugucaaacauauggauauaaauuuacagaucauuuaauauauugguggagacaagcaccaggacaaggauuagaauggauaggauggauaaaaccagaaacaggacaaccaaguuauaguuauagauuucaaggaagaguaaguuuaacaagagacacauuugaagaaauaguauuuauggauuuaagaggauuaagaucagaugauacagcaauauauuucugugcaagaagacauagugauuauugugacuuugauguauggggaaguggaagucaaguaauaguaucaagugcaagcacaaaagga

SEQ ID NO: 50079 - RNA, 372 nt, Artificial Sequence
  derived and/or modified sequence opt6 from anti-HIV_Chain
caaguacaauuaguacaaaguggagcagcauuaaaaaaaccaggagcaaguuuaagaauaaguugucaaacauauggauauaaauuuacagaucauuuaauauauugguggagacaagcaccaggacaaggacuagaauggauaggauggauaaaaccagaaacaggacaaccaaguuauaguuauagauuucaaggaagaguaaguuuaacaagagauacauuugaagaaauaguauuuauggauuuaagaggauuaagaucagaugauacagcaauauauuuuugugcaagaagacauagugauuauugugauuuugauguauggggaggaggaagucaaguaauaguaaguagugcaagcacaaaagga

SEQ ID NO: 50080 - RNA, 372 nt, Artificial Sequence
  derived and/or modified sequence opt6 from anti-HIV_Chain
caaguacaauuaguacaaaguggagcagcauuaaaaaaaccaggagcaaguuuaagaauaaguuguuuaacauauggauauaaauuuacagaucauuuaauauauugguggagacaagcaccaggacaaggauuagaauggauaggauggauaaaaccagaaacaggacaaccaagcuauaguuauagauuucaaggaagaguaaguuuaacaagagacacauuugaagaaauaguauuuauggauuuaagaggauuaagaucagaugauacagcaauauauuucugugcaagaagacauagugauuauugugacuuugauguauggggaaguggaagucaaguaauaguaucaagugcaagcacaaaagga

SEQ ID NO: 50081 - RNA, 372 nt, Artificial Sequence
  derived and/or modified sequence opt6 from anti-HIV_Chain
caaguacaauuaguacaaaguggagcaacauuaaaaaaaccaggagcaaguguaagaauaaguugucaagcauacggauauaaauuuacagaucauuuaauacauugguggagacaagcaccaggacaaggauuagaauggauaggauggauaaaaccagaaacaggacaaccaaguuaugcauauaaauuucaaggaagaguaaguuuaacaagagacacauuugaagaaauauuauuuauggauuuaagaggauuaagaucagaugauacagcaauauauuucugugcaagaagacauagugauuacugugacuuagauguauggggaggaggaacacaacuauuaguaucaagugcaucaacaaaagga

SEQ ID NO: 50082 - RNA, 372 nt, Artificial Sequence
  derived and/or modified sequence opt6 from anti-HIV_Chain
caaguacaauuaguacaaagcggagcagcacuaaaaaaaccaggagcaaguguaagaauaagcugucaagcauacggauacaaauucacagaccauuuaauauacugguggagacaagcaccaggacaaggacuagaauggauaggauggauaaaaccagaaacaggacaaccaaguuauaguuauaaauuucaaggaagaguaacauuaacaagagacacauuugaagaaauacauuuuauggaucuaagaggauuaagauaugacgauacagcaacauauuucugugcaagaagacauagugauuacugugacuuugacguauggggaagcggaagucaaguaucaguaucaagugcaaguacaaaagga

SEQ ID NO: 50083 - RNA, 372 nt, Artificial Sequence
  derived and/or modified sequence opt6 from anti-HIV_Chain
caaguacaauuaguacaaaguggagcagcacuaaaaaaaccaggagcaaguuuaagaauaagcugucaagcauacggauacaaauucacagaccaucuaauauacugguggagacaagcaccaggacaaggacuagaauggauaggauggauaaaaccagaaacaggacaaccaaguuauaguuauaaauuucaaggaagaguaagcuuaacaagagacacauuccaagaaauacuauuuaugaaccuaagaggacuaagaucagacgauacagcaauauauuucugugcaagaagacauagugauuacugugacuuugacguauggggaagcggaagccaaauauuaguaucaagcgcaaguacaaaagga

SEQ ID NO: 50084 - RNA, 372 nt, Artificial Sequence
  derived and/or modified sequence opt6 from anti-HIV_Chain
caaguacaauuaguacaaaguggaacagcaguaaaaaaaccaggagcaagcguaagaguaagcugucaagcaagcggauacacauucacagacuauuucauauacugguggagacaagcaccaggacaaggacuagaaugguuaggauggauaaauccaagaacaucacaaccaaguuauccauauagauuucaaggaagaguaacauuaacaagagacauauucgaagaaaugcuauauauggauuuaagaggauuaagaucagacgauacaggaauauauuuuugugcaagaagacauagugauuacugugacuuugacauauggggaagcggaacacaaauaauaguaucaagcgcaucaacaaaagga

SEQ ID NO: 50085 - RNA, 372 nt, Artificial Sequence
  derived and/or modified sequence opt6 from anti-HIV_Chain
caaguacaauuaguacaaaguggagcagcauuaaaaaaaccaggagcaaguuuaagaauaaguugucaagcauauggauauaaauuuacagauuaucuaauacauugguggagacaagcaccaggacaaggacuagaauggauaggauggauaaaaccagaaacaggacaaccaaguuauaguuauaaauuucaaggaagaguaaguuuaacaagagacacauuugaagaaauauuauuuauggauuuaagaggauuaagaucagaugauacagcaauauauuucugugcaagaagacauagugauuauugugacuuugauguauggggaggaggaagucaaguauuaguaucaagugcaaguacaaaagga

SEQ ID NO: 50086 - RNA, 372 nt, Artificial Sequence
  derived and/or modified sequence opt6 from anti-HIV_Chain
gaaguacaauugcuagaaagcggaggagcauuaguacaaccaggaggaagucuaagauuaagcugugcagcaagcggauucacauucucaacaucaagcaugagcuggguaagacaagcaccaggaaaaggacuagaauggguaagugcaauaggaagcggaagaggaagcacauucuaugcagauagcguaaaaggaagauuuacaauaagcagagacaauagcaaaaacacacuaucacuacaaaugaauagcuuaacagcagaagauacagcaacauauuacuguacaaaaacaggaggauuacuaagauucccagaaguaugggggaaaggaacaacaguaacaguaucaagcgcaagcacaaaagga

SEQ ID NO: 50087 - RNA, 372 nt, Artificial Sequence
  derived and/or modified sequence opt6 from anti-HIV_Chain
gaaguacaauuaguagaaagcggaggaggacuaguaaaaccaggaggaaguuuaagauuaagcugugcagauagcggauucacauucagaaguuauaguaugcauuggguaagacaagcaccaggaaaaggacuagcauggguaaguucaauaucaaguacaaguaauuauauauauuaugcagauaguguaaaaggaagauuuacaauaaguagggacaaugcaaaaaauucauuauauuuacaaaugaauaguuuaagagcagaagauacagcaguauauuacugugcaagaacauuuauaacagcaucaugguuugacucauggggacaaggaacauuaguaacaguaucaagugcaaguacaaaagga

SEQ ID NO: 50088 - RNA, 372 nt, Artificial Sequence
  derived and/or modified sequence opt6 from anti-HIV_Chain
caaguacaauuaguacaaaguggagcagaaguaaaaaaaccaggagcaaguguaaaaguaagcuguaaagcaagcggauacacauucacaaacuauggaguaagcuggguaagacaagcaccagggcaaggacuagaauggaugggauggauaucaccauauaguggaaacacaaacuaugcacaaagauuacaagauagaguaacaaugacaacagacacaagcacaaacacagcauauauggaacuaagaagcuuaagaucagacgauacagcaguauauuacugugcagcaagaucauacuauuacuauaguauggacguauggggacaaggaacaacaguaacaguaucaagcgcaagcacaaaagga

SEQ ID NO: 50089 - RNA, 372 nt, Artificial Sequence
  derived and/or modified sequence opt6 from anti-HIV_Chain
caaguacaauuaguacaaaguggagcagaacuaaaaaaaccaggaucaagcguaaaaguaagcuguaaagcaagcggaggaacauucucaaacuaugcaauaaacuggguaagacaagcaccaggacaaggauucgaauggaugggaggaauaauaccauuauucgcaacaccaacauaugcacaaaaauuucaaggaagaguaagaauaacagcagacgauagcacaagcacagcauauauggaacuaucaagcuuaagaucagacgauacagcaguauauuucugugcaagaccaaauguaguaagaucagcauuagacuauuggggacaaggaacauuaguaacaguaucaagcgcaagcacaaaagga

SEQ ID NO: 50090 - RNA, 372 nt, Artificial Sequence
  derived and/or modified sequence opt6 from anti-HIV_Chain
caaguacaauuaguagaaaguggaggaggaguaguacaaccaggaaaaagucuaagauuaaguugugcagcaaguggauuuacauuuaguacacaugcaaugcauuggguaagacaagcaccaggaaaaggauuagauuggguagcaguaauaagucaugauggagauaaucaauauuaugcagaugcaguaaaaggaagauuuacaauaaguagagaugauaguagagauacaguauuuuuacaaaugaauaguuuaagaacagaagauacaggaguauauuauugugcagcagauaguaguggaaguaauugguuugauuauuggggacaaggaauauuaguaacaguaaguagugcaaguacaaaagga

SEQ ID NO: 50091 - RNA, 375 nt, Artificial Sequence
  derived and/or modified sequence opt6 from anti-HIV_Chain
caaguaagauuaagucaaaguggaggacaaaugaaaaaaccaggagaaagcaugagauuaaguuguagagcaaguggauaugaauuuuuaaauuguccaauaaauuggauaagauuagcaccaggaagaagaccagaauggaugggaugguuaaaaccaagaggaggagcaguaaauuaugcaagaaaauuucaaggaagaguaacaaugacaagagauguauauagugauacagcauuuuuagaacuaagaaguuuaacaagugaugauacagcaguauauuuuuguacaagaggaaaauauuguacagcaagagauuauuauaauugggauuuugaacauuggggaagaggagcaccaguaacaguaaguagu

SEQ ID NO: 50092 - RNA, 375 nt, Artificial Sequence
  derived and/or modified sequence opt6 from anti-HIV_Chain
gaaguacaauuaguacaaucaggaucagacguaagaaaaccaggagcaacaguaacaguaucaugcaaagcagaugaagaugaagaugacuuuacagcauacaauuacuuuaugcauuggguaagacaagcaccgggacauggauuagaauggauaggauggauaaacccacgaacaggacaaccaaaucacgcaaaacaauuccaaggaagaguaacacuaacaagagaaagaucaacaucaacaguauucaugaaauuaacaaauuuaagacuagaugacacagcaguauacuuuugcgcaagaccacuaagaggaggagacacauggcauuaccauagcuggggaagaggaacaaguuuaacaguaagcuca

SEQ ID NO: 50093 - RNA, 375 nt, Artificial Sequence
  derived and/or modified sequence opt6 from anti-HIV_Chain
caaguacaauuaguacaaagcggaggaggauuaguacaaccaggagaaagccuaagacuaagcuguacagcaagcggauucacauucucaaguuauaacaugaacuggguaagacaagcaccaggaaaaggacuagaauggauaagcuauauaucagacaaaagcaaaaacaaauacuaugcagauagcguaagaggaagauuuacaauaagcagagacaaugcacaaaacucacuauuuuuacaaaugucaagccuaagagaugaagauacagcaguauauuacuguacaagagaaggaccacaaagaucauucuauuucgauuacuggggacaaggaauacaaguaacaguaagcucagcaucaacaaaagga

SEQ ID NO: 50094 - RNA, 375 nt, Artificial Sequence
  derived and/or modified sequence opt6 from anti-HIV_Chain
gaaguacaauuaguagaaaguggagcagaaguaaaaaaaccaggaaguaguguaaaaguaaguuguaaagcaaguggaggaacauuuaguaguuauaguauaaguuggguaagacaagcaccaggacaaggacuagaauggaugggaggaauaauaccaauauuugcaacaacacauuauggacaaaaauuucaaggaagaauaaaaauaacagcagauaaaaguacaaguacagcauauauggaauuaaguagacuaagaagugaagauacagcaguauauuauugugcaagagauagagaauuuuauuuuuauggaauggauguauggggacaaggaacaacaguaacaguaaguagugcaaguacaaaagga

SEQ ID NO: 50095 - RNA, 375 nt, Artificial Sequence
  derived and/or modified sequence opt6 from anti-HIV_Chain
caauuacaauuacaagaaagcggaccaggauuaguaaaaccaugggaaacauuaguauuaacauguagcguaagcggaggaucaauaucaagcggagacuauuacuggggauggauaagacaaucaccaggaaaaggaccagaauggauaggaaauauauuuuacucaagcggaaacacauacuauaacacaagccuaaaaucaagaguaacaauaaguguagacguaagcaaaaacagauucucauuaaaauuaacaagcaugacagcagcagauacagcaguauauuacuguggaagacuaucaaacaaaggaugguucgauccauggggacaaggaacauuaguaagcguaagcucagcaucaacaaaagga

SEQ ID NO: 50096 - RNA, 375 nt, Artificial Sequence
  derived and/or modified sequence opt6 from anti-HIV_Chain
gaaauaguacuaacacaaucaccagcaacacuaucacuaucaccaggagaaagagcaacacuaucaugcagagcaucacaaucaguaucaucauaccuagcaugguaccaacaaaaaccaggacaagcaccaagacuauuaauauacgacgcaucaaacagagcaacaggaauaccagcaagauucucaggaucaggaucagacacagacuucacccuaacaauaucaucacuagaaccagaagacuucgcaguauacuacugccaacaaagaggaauauggccacuacaaauaacauucggacaaggaacaagacuagaaauaaaaagaacaguagcagcaccaucaguauucauauucccaccaucagacgaa

SEQ ID NO: 50097 - RNA, 375 nt, Artificial Sequence
  derived and/or modified sequence opt6 from anti-HIV_Chain
ucagaaauaguacuaacacaaucaccaggaacacuaucacuaucaccaggagaaagagcaacauuaucaugcagagcaucacaaucaguaucaucuucauaccuagcaugguaccaacaaaaaccaguacaagcaccaagauuacuaauauacggagcaucaucaagagcaacaggaauaccagacagauucucaggaucaggaucaggaacagauuucacacuaacaauaucaagacuagaaccagaagacuucgcaguauacuacugccaacaauacggaacacuacacccaagaacauucggacaaggaacaaaaguagaaauaaaaagaacaguagcagcaccaucaguauucauauucccaccaucagac

SEQ ID NO: 50098 - RNA, 375 nt, Artificial Sequence
  derived and/or modified sequence opt6 from anti-HIV_Chain
ucacaagcaguaguaacacaaccaccaucaguaucaggagcaccaggacaaagaguaacaauaucaugcucaggaggaccaucaaacguaggaggaaaccuaguauacugguacaaacaauucccaggaacagcaccaaaacuacuaauaagaagagacgaccaaagaccaucaggaguaccagacagauucaguggaaguaaaucaggaaacucagcaagccuagcaauaucaggacuaagaccagacgacgaagcauucuacuucugcgcaacauacgacucacacggaucaauaagacuauucggaggaggaacacuauuaacaguacuaagucaaccaaaagcagcaccaucaguaacacuauuuccacca

SEQ ID NO: 50099 - RNA, 375 nt, Artificial Sequence
  derived and/or modified sequence opt6 from anti-HIV_Chain
gauauacaaaugacacaaucaccaucaacauuagcagcaucaauaggaggaacaguaagaguaucauguagagcaucacaaucaauaacaggaaacuggguagcaugguaucaacaaagaccuggaaaagcaccaagauuacuaauauacagaggagcagcauuacuaggaggaguaccaucaagauuuucaggaucagcagcaggaacagauuucacacuaacaauaggaaacuuacaagcagaagauuucggaacauuuuacugucaacaauacgauacauauccaggaacauuuggacaaggaacaaaaguagaaguaaaaagaacaguagcagcaccaucaguauuuauauuuccaccaucagaugaacaa

SEQ ID NO: 50100 - RNA, 375 nt, Artificial Sequence
  derived and/or modified sequence opt6 from anti-HIV_Chain
gaaauaguaaugacacaauccccagacacacuaucaguauccccaggagaaagagcaacacuaucaugcagagcaucacaaucaguaaacucaaaccuagcaugguaccaacaaaaaccaggacaagcaccaagacuauuaauauacggagcaucaacaagagcaacagcaguaccagcaagauucucaggaucaggaucaggaacagaauucacacuaacaauaucaucacuacaaucagaagacucagcaguauacuacugccaacaauacuaccaauggcuaucauacacauucggacaaggaacaaaacuagaaauaaaaagaacaguagcagcaccaucaguauucauauucccaccaucagacgaacaa

SEQ ID NO: 50101 - RNA, 375 nt, Artificial Sequence
  derived and/or modified sequence opt6 from anti-HIV_Chain
agacaaguacaacuaguacaaucaggagcagcauuaaaaaaaccaggagcaucacuaagaauaucaugccaagcauacggauauaaauuuacagaccacuuaauauauugguggagacaagcaccaggacaaggacuagaauggauaggauggauaaaaccagaaacaggacaaccaucauacucauacaaauuccaaggaagaguaucacuaacaagagacacauuucaagaaauauuauucauggacuuaagaggauuaagaucagacgacacagcaauauacuucugcgcaagaagacacucagacuacugcgacuucgacguauggggaucaggaucacaaauacuaguaucaucagcaucaacaaaagga

SEQ ID NO: 50102 - RNA, 375 nt, Artificial Sequence
  derived and/or modified sequence opt6 from anti-HIV_Chain
caaguacaauuaguacaaagcggagcagcauuaaaaaaaccaggagcaaguguaagaauaagcugucaagcauacggauauaaauuuacagacuauuuaauacacugguggagacaagcaccaggacaaggauuagaauggauaggauggauaaaaccagaaacaggacaaccaaguuauaguuauaaauuucaaggaagaguaacauuaacaagagacacauuugaagaaauauuauuuauggauuuaagaggauuaagaucagaugauacagcaauauauuuuugugcaagaagacauagugauuacugugacuuugacguauggggaagcggaagucaaguaauaguaucaagugcaaguacaaaaggagca

SEQ ID NO: 50103 - RNA, 375 nt, Artificial Sequence
  derived and/or modified sequence opt6 from anti-HIV_Chain
gaaguacaauuaguagaaaguggaggaggauuaguaaaaccaggaggaaguuuaagauuaaguugugcagcaaguggauuuaguuuuagcgaacauuauaugagcuggauaagauuagcaccaggaaaaggauuagaaugguuaagcuauauaaguaguaguacaagaacaacauauagugcagauaguguaagaggaagauuuacaauaaguagagauacagcaaaacaauuauuauuuuuacauaugaguaguuuaagagcagaagauacagcaguguauuauuguguaagauuauauggaggaauaaauggaugguucgaucaauggggacaaggaacauuaguaaguguaaguagugcaaguacaaaagga

SEQ ID NO: 50104 - RNA, 375 nt, Artificial Sequence
  derived and/or modified sequence opt6 from anti-HIV_Chain
caaguacaauuaguacaaaguggaccaggauuaguaaaaccaagcgaaacacuaucacuaacauguagcgugagcaauggaagcauaucaagcggaggauauuacuggagcuggcuaagacaauuuccaggaaaaggacuagaauggauaggaucaauacauuacacaggaagaacauuuuacaauccaucacuaaugggaagaacagcacuaucaauggauacaucaaacaaucaauuuaguuuaaaaguaagcucaguaacagcagcagacacagcauuauacuauugcgcaagagaauuacaauggauguucguaguagauccauggggacaaggaacauuaguaacaguaagcucagcaucaacaaaagga

SEQ ID NO: 50105 - RNA, 375 nt, Artificial Sequence
  derived and/or modified sequence opt6 from anti-HIV_Chain
caaguacaacuacaagaaagcggaccaggauuaguaaaaccaagcgaaacacuaaguuuaacauguagcguaagcaauggaucaauaucaagcggaggauauuacuggagcuggcuaagacaauuuccaggaaaaggacuagaauggauaggaucaauacauuacacaggaagaacaauguacaauccaucacuaaugggaagaccagcacuaucaauggauacaucaaacaaucaauuuagcuuaaaauuaagaucaguaacagcagcagacacagcauuauacuuuugcgcaagagaucuacaauggauauucguaguagauccauggggacaaggaacauuaguaacagugagcucagcaucaacaaaagga

SEQ ID NO: 50106 - RNA, 375 nt, Artificial Sequence
  derived and/or modified sequence opt6 from anti-HIV_Chain
gaaguacaauuauuagaaaguggaggaggauuaguacaaccaggaggaaguuuaagauuaaguugugcaguaaguggauuuacauuuggaggacaugcaguaagcuggguaagacaagcaccaggaaaaggauuagaaugguuaagucaaauaaguggaacaggaaguagaacagauuaugcagaugcaguaaaaggaagauuuacaguaaguagagauaauaguaaaaaaacaguauauuuacaaaugaauaguuuaagaguagaagauacagcauuauuuuauugugcaacaagaaguccaggaggaggauaugcauuugauauauggggacaaggagcaaugguaacaguaaguagugcaaguacaaaagga

SEQ ID NO: 50107 - RNA, 375 nt, Artificial Sequence
  derived and/or modified sequence opt6 from anti-HIV_Chain
caaguacaauuaguacaaagcggagcagaaguaaaaaaaccaggaucaagcguaaaaguaagcuguaaaguaagcuuuuucucaaacuauggaauaaguuggguaagacaaagaccaggacaaggacuagaauggaugggaagaauaauaccagcaauagaugacaugacauaugcacaaacauuuagaggaagaguaacauuuagcgcagacaaauucacaacaacagcauauauggaacuaacaggauuaacauuugaagauacagcaacauauuucugugcaagagacccacaaguaaacagaagaggaaacuguuucgaucacuggggacaaggaacacuaguaacaguaagcucagcaucaacaaaagga

SEQ ID NO: 50108 - RNA, 375 nt, Artificial Sequence
  derived and/or modified sequence opt6 from anti-HIV_Chain
caaguacaauuacaagaaagcggaccaggauuaguaaaaccaagugaaacauuaucauuaacauguacaguaagcggaggaucaauaucauacuauuacuggagcuggauaagacaaccaccaggaaaaggacuagaauggauaggagauauauauuacucaggaacaacagauuacaauccaucacuaaaaaguagaguaacaauaucaguagauacaagcaaaaaucaauuuagcuuaaaauuaagcucaguaacagcagcagacacagcaguauacuauugcgcaagaagaagaggacaaagacuauuagcauauuucgauuacuggggacaaggaagccuaguaacaguaucaucagcaucaacaaaagga

SEQ ID NO: 50109 - RNA, 375 nt, Artificial Sequence
  derived and/or modified sequence opt6 from anti-HIV_Chain
caaguacaacuacaagaaucaggaccaggaccaguaaaaccaucagaaacacuaucacuaacaugcacaguaucaggaggaucaaugauaucauacuacuggucauggauaagacaaccaccaggaaaaggacuagaauggauaggauacauauucacaaacggaagaacaacauacagcccaucacuaagaucaagaguaacaauaucacuagacacaucaacaaaccacuucucacuaagacuaaaaucaguaacagcagcagacacagcaauauacuacugcgcaagauuagacggagaagcauucagauacuaccuagaccuauggggacaaggaaacuuaguaacaguaucaucagcaagcacaaaagga

SEQ ID NO: 50110 - RNA, 375 nt, Artificial Sequence
  derived and/or modified sequence opt6 from anti-HIV_Chain
caaguacaauuaguacaaagcggagcagaaguaaaaaaaccaggagcaaguguaaaaguaagcuguaaaccaagcucaaacacauucacaagucauuacauacacuggguaagacaagcaccaggacaaggacuagaauggaugggaaugauaaauccaggaggaucaacaagauacgcaccaaaauuccaaggaagaguaacauuaacaagagauacaucaacaagaacaguauacauggaauuaagcucauuaagaagcgaagacacagcaguauauuauugcgcaagaccacaauauaacuuaggaagagacccacuagauguauggggcuuaggaacaaugguaacaguaaguucagcaucaacaaaagga

SEQ ID NO: 50111 - RNA, 375 nt, Artificial Sequence
  derived and/or modified sequence opt6 from anti-HIV_Chain
caaguacaacuacaacaauggggagcaggacuauuaaaaccaagcgaaacauuaucauuaacaugugcaguauacggaggaucauucucaggauauuacuggagcuggauaagacaaccaccaggaaaaggacuagaauggauaggagaaauaaaucacucaggaucaacaaauuacaauccaucacuaaaaagcagaguaacaauaucaguagauacaagcaaaaaucaauuuagcuuaaaauuaagcucaguaacagcagcagacacagcaguauacuauugcgcaagauuaccaauaggaucaggaugguacggaagagauuacuggggacaaggaacauuaguaacaguaagcucagcaucaacaaaagga

SEQ ID NO: 50112 - RNA, 375 nt, Artificial Sequence
  derived and/or modified sequence opt6 from anti-HIV_Chain
caaguacaauuaguacaaaguggagcagaaguaaaaaaaccaggagcaagcguaaaaguaaguuguaaagcaagcggaaacacauucacaagcuauggaauaacauggguaagacaagcaccaggacaaggacuagaauggaugggauggauaucagcauauaacggaaacacaaacuaugcacaaaaauuacaagauagauuaacaaugacaacagacacaaguacaucaacagcauauauggaacuaagaagcuuaagaucagacgauacagcaguauauuacugugcauuuagcagacacuauggaucaggaaauuacgauuacuggggacaaggaacacuaguaacaguaagcucagcaucaacaaaagga

SEQ ID NO: 50113 - RNA, 375 nt, Artificial Sequence
  derived and/or modified sequence opt6 from anti-HIV_Chain
caauuuagauuaguacaaagcggaccagaaguaaaaaacccaggaucaagcguaacaguaagcuguaaagcaagcggaggaacauucucaggauuaggaauaaacuggguaagacaagcaccaggacaaggacuagaaugguuaggagauauaaaaacaauguacggaacaacaaacuaugcaccgaaauuucaaggaagaguaacaauaacagcagacgaaaguacaagcacaagcuauauggaauuaucaggauuaagaucagaagauacagcaguauuuuacuguguaagagaauuauucggacaccauccagcauucggaguauggggacaaggaacaagcguaauaguaagcagugcaucaacaaaagga

SEQ ID NO: 50114 - RNA, 375 nt, Artificial Sequence
  derived and/or modified sequence opt6 from anti-HIV_Chain
agaguacaauuaguacaaagcggagccgaaguaaaaaaaccaggaucaagcguaacaguaagcuguaaagcaagcggaggaucauucucaagcuaugcaauaagcuggguaagacaagcaccaggacaaggacuagaauggguaggaggaguaaaaguaauguucggaacaguacacuauagucaaaaaguacaaggaagaguaacaauaacagcagacgauaguacaggaacaaguuaucuagaauuaucaggauuaagaucagcagauacagcaguauauuacugugcaagaaacgcaggagcauacuuuuacccauucgauauauggggacaaggaacacuaauaauaguaagcucagcaucaacaaaagga

SEQ ID NO: 50115 - RNA, 375 nt, Artificial Sequence
  derived and/or modified sequence opt6 from anti-HIV_Chain
caaguacaauuacaagaaagcggaccaggccuaguaaaaccaagcgaaacauuaagccuaacauguacaguaagcggaggaucaauaucaagcagaagcuauuacuggggauggauaagacaaccaccaggaaaaggacuagaauggguaggaucaauauauuacacaggaucaacauauuacucaccaucacuaaaaagcagaguaacaauaucaguagauacaucacaaaaucaauuuagcuuaaaauuaaacucaguaacagcagcagacacagcaguauacuauugcgcaagacaaaaaggaagcggaacaucacuauuauacuggggacaaggaacauuaguaacaguaagcucagcaucaacaaaagga

SEQ ID NO: 50116 - RNA, 375 nt, Artificial Sequence
  derived and/or modified sequence opt6 from anti-HIV_Chain
caaguacaauuaguacaaagcggaacagaaguaaaaaaaccaggaaguaguguaaaaguaagcuguaaagcaagcggaggaacauucucagacucagacauagcauggguaagacaagcaccaggacaaggacuagaauggaugggaggaauaacaccaauguucgauauggcaaaaucagcacaaaaauuuagaggaagauuaauaauaacagcagacaaaagcacaggaacagcauauauggaacuaucaagcuuaagauaugaagaugcagcaguauauuucugugcaagaagcucaggaaauuucgaauucgcauucgaaauauggggacaaggaacaaaaauaauaguaagcuuagcaucaacaaaagga

SEQ ID NO: 50117 - RNA, 375 nt, Artificial Sequence
  derived and/or modified sequence opt6 from anti-HIV_Chain
guaguacaauuaguacaaaguggaacagaaguaaaaaaaccaggaaguaguguaaaaguaaguuguaaagcaaguggaggaacauuuaguggaagugauauaagcuggguaagacaagcaccaggacaaggauuagaauggaugggaggaauaauaccaauguuugauauagaagaucaugcacaaaaauuuagaggaagauuaacaauaacagcagauaaaaguacaggagcagcauauauggaauuaaguagucuaagaagugaagaugcagcaguauauuauugugcaagaaguaguggaaauuaugauuuugcauuugauauauggggacaaggaacaagauuaauaguaagcagugcaaguacaaaagga

SEQ ID NO: 50118 - RNA, 375 nt, Artificial Sequence
  derived and/or modified sequence opt6 from anti-HIV_Chain
guaguacaauuaguagaaagcggaacagaaguaaaaaaaccaggaaguaguguaaaaguaagcuguaaagcaagcggaggaacauucaguggaucagacauaagcuggguaagacaagcaccaggacaaggacuagaauggaugggaggaauaauaccaauguucgauauagaaaaccaugcagaaaaauuuagaggaagauuaacaauaacagcaguaaaaagcacaggagcagcauauauggaacuaucaagcuuaagaagugaagaugcagcaguauauuacugugcaagaagcucaggaaauuacgauuucgcauacgauauauggggacaaggaacaagaguaauaguaagcucagcaucaacaaaagga

SEQ ID NO: 50119 - RNA, 378 nt, Artificial Sequence
  derived and/or modified sequence opt6 from anti-HIV_Chain
caaguacaauuaguacaaaguggaagugcaaugaaaaaaccaggagcaaguguaagaguaaguuguuggacaagugaagauauauuugauacaacagaauuaauacauuggguaagacaagcaccaggacaaggauuagaauggauaggauggguaaaagcaguaaguggagcaguaaauuauggaagucuagauuuuagacauagaguaaguuuaacaagagauagagauuuaaguacagcacauauggauauaagaggauuaacacaagaugauacagcaacauauuuuugugcaagacaaaaauuugcaagaggagaucaaggaugguuuuuugauuuauggggaagaggaacauuaauaguaguaaguagcgca

SEQ ID NO: 50120 - RNA, 378 nt, Artificial Sequence
  derived and/or modified sequence opt6 from anti-HIV_Chain
caaguacaauuacaagaaagcggaccaggauuaguaaaaccaagcgaaacauuaagccuaacauguacaguaagcggaggaucaauaucaaaccauuacuggagcuggauaagacaaccaccaggaaaaggacuagaauggauaggauauauauaucacucaggaaauauaaauuacaaaagcucauuaaaaagcagagcaacaauaucaauagauacaucaaacaaucaauuuagcuuaaaauuaagcucaguaauagcagcagacacagcaguauacuauugcgcaagaaauuucggaccaggaagcccaaacuauggaauggacguauggggacaaggaacaacaguaacaguaucaagcgcaagcacaaaagga

SEQ ID NO: 50121 - RNA, 378 nt, Artificial Sequence
  derived and/or modified sequence opt6 from anti-HIV_Chain
caaguacaauuaguacaaaguggaggaggaguaguacaaccaggaagaagucuaagauuaaguugugcagcaaguggauuuacauuuagucaucauggaauacauuggguaagacaagcaccaggagaaggacuagaauggguagcaguaauaagugaagauggaacaaauauacauuaugaagauaguguaagaggaagauuuacaauaaguagagauaauaguaaaaauacaguagauuuacaaaugaauaguuuaagagcagaagauacagcaguauauuauugugcaucauuaauaaguaugagagauggagaugcauuugauuuauggggacaaggaacaagaguaacaguaagcagugcaaguacaaaagga

SEQ ID NO: 50122 - RNA, 378 nt, Artificial Sequence
  derived and/or modified sequence opt6 from anti-HIV_Chain
caaguacaauuaguagaaaguggaggaggauuaggacaaccaggaggaaguuuaagauuaaguugugcagcaaguggauuuacauuuagaaauuaugcaaugaguuggguaagacaagcagcaggaaaaggauuagaauggguaaguggaguaagcggaggaggagauacaacauauuauggagauaguguaaaaggaagauuuacaauaaguagggauaauagcaaaaauacauuauauuuacaaaugaauaauuuaagagcagaagauacagcaguauauuauugugcaaaagauaaaggaguauggggaaguagugauuuugauuauuggggacaaggaacauuaguaacaguaaguagugcaaguacgaaagga

SEQ ID NO: 50123 - RNA, 378 nt, Artificial Sequence
  derived and/or modified sequence opt6 from anti-HIV_Chain
gaaguacaauuaguagaaaguggaggaggaguaguacaaccaggaagaaguuuaagauuaaguugugcagcaaguggauuuacauuuagucaucauggaauacauuggguaagacaagcaccaggagaaggauuagaauggguagcaguaauaagugaagauggaacaaauauacauuaugaagauaguguaagaggaagauuuacaauaagcagagauaauaguaaaaauacaguagauuuacaaaugaauaguuuaagagcagaagauacagcaguauauuauugugcaaguuuaauaaguaugagagauggagaugcauuugauuuauggggacaaggaacaagaguaacaguaagcagugcaaguacaaaagga

SEQ ID NO: 50124 - RNA, 378 nt, Artificial Sequence
  derived and/or modified sequence opt6 from anti-HIV_Chain
agaggaccaguaacacuagcaguaucacuaggagaaagagcaacaauaacaugcaaaucaucacaaucaguauuaguacacucaaacaacaaaaacuaccuaucaugguaccaacaaaaaccaggacaaccaccaaaacuacuaauauacugggcaucaacaagagaaucaggaguaccagaaagauucucaggaucaggaucaggaacagacuucacacuaucaauaucaucacuacaagcagaagacguagcaguauacuacugccaccaauacuucucaacaccaagaacauucggacaaggaacaaaaguagaaauaaaaggaacaguagcagcaccaucaguauucauauucccaccaucagacgaacaacua

SEQ ID NO: 50125 - RNA, 378 nt, Artificial Sequence
  derived and/or modified sequence opt6 from anti-HIV_Chain
ucagaaauaguaaugacacaaucaccagcaacacuaucaaugucaccaggagaaagagcaacacuaucaugcagagcaucacuaucaguaaacacaaaccuagcaugguaccaacaaaaaccaggacaagcaccaagacuacuaauauacggagcaucaacaagagcaacaggaauaccagcaagauucucaggaucaggaucaggaacagaauucacauuaacaauaucaucacuacaaucagaagacuucgcacuauacuacugccaacaauacaaccacuggccacaaacauucggacaaggaacaaaaguagaaauaaaaagaacaguagcagccccaucaguauucauauucccaccaucagacgaacaaaaa

SEQ ID NO: 50126 - RNA, 378 nt, Artificial Sequence
  derived and/or modified sequence opt6 from anti-HIV_Chain
ucagaaauaguauuaacacaaucaccagcaacacuaucacuaucaccaggagaaagagcaacacuaagcugcagagcaucacaaucaauaaacaacuaccuagcaugguaccaacaaaaaccaggacaagcaccaagacuacuaauauacgacgcaucaaacagagcaacaggaaucccagcaagauucucaggaggaggaucaggaacagacuucacacuaacaauaucaucacuagaaccagaagacuucgcaguauacuacugccaacaaagagcaaauuggagacuacuaacauucggaggaggaacaaaaguagaaauaaaaagaacaguagcagcaccaucaguauucauauucccaccaucagacgaacaa

SEQ ID NO: 50127 - RNA, 378 nt, Artificial Sequence
  derived and/or modified sequence opt6 from anti-HIV_Chain
caaguacaauuaguacaaaguggaggagcaguaaaaaaaccaggagcaaguguaaaaguaaguugugaaacauauggauauacauuuacagaucauuuuaugcauugguggagacaagcaccaggacaaggauuagaauggaugggauggauaaauccauauaguucagcaguaaguuauaguccaagauaucaaggaagaguaacaaugacaagagauacauuuuuagaaacaguauauauggaauuaagaggauuaaaauuugaugauacagcaauauauuauugugcaacaccaaaaaguggaagagauuauuggaguuuugauuuauggggacaaggaacauuaguaacaguaucaagugcaaguacaaaagga

SEQ ID NO: 50128 - RNA, 378 nt, Artificial Sequence
  derived and/or modified sequence opt6 from anti-HIV_Chain
ucacaaguacaauuaguagaaagcggaccaggauuaguaaaaccaagcgaaacacuaucacuaacauguagcguaagcaauggaagcauaucaagcggaggauauuacuggaguuggcuaagacaauuuccaggaaaaggauuagaauggauaggaucaauacauuacacaggaagaacaauguacaauccaucacuaaugggaagaccagcauuaucaauggauacaucaaacaaucaauuuagcuuaaaauuaagcucaguaacagcagcagacacagcacuauacuuuugcgcaagagaucuacaauggauauucguaguagauccauggggacaaggaacauuaguaacaguaagcucagcaucaacaaaagga

SEQ ID NO: 50129 - RNA, 378 nt, Artificial Sequence
  derived and/or modified sequence opt6 from anti-HIV_Chain
ucaguaguacaauuaguagaaagcggaccaggauuaguaaaaccaagcgaaacacuaagccuaacauguagcguaaguaauggaucaauaucaaguggaggauauuacuggagcuggcuaagacaauuuccaggaaaaggacuagaauggauaggaucaauacauuacacaggaagaacaauguacaauccaucacuaaugggaagaccagcacuaucaauggauacaucaaacaaucaauuuagcuuaaaauuaagaucaguaacagcagcagacacagcauuauacuuuugcgcaagagaucuacaauggauauucguaguagauccauggggacaaggaacauuaguaacaguaagcucagcaucaacaaaagga

SEQ ID NO: 50130 - RNA, 378 nt, Artificial Sequence
  derived and/or modified sequence opt6 from anti-HIV_Chain
aguggaggaagauuaguacaaccaggaggaagccuaagauuaagcuguagugcaagcggauucacacuaucaaacucggcaaugagcuggguaaggcaagcaccaggaaaaggacuagaauggguaagcucaauauuaaguucgggaguaggaacauucuaugcagauagcguaaaaggaagauuuacaguaaguagagacaauaguagaaacacacuauaucuacaaaugaaaucauuaagagcagaagauacagcacuauauuacugugcaaaaguacaaauacaacaauuaaacuuuggaguaauaacagacgcaggauuagacguauggggaaaaggaacaacacuaauaguaagcagugcaagcacaaaagga

SEQ ID NO: 50131 - RNA, 378 nt, Artificial Sequence
  derived and/or modified sequence opt6 from anti-HIV_Chain
caaguacaauuaguacaaaguggagcagcaguaaaaaaaccaggagcaagcguaaaaguaaguugugaagcauauggauauaaauuuacagaucauuuuaugcauugguggagacaagcaccaggacaaggauuagaauggaugggauggauaaauccauauacaucagcaguaaauuauaguccaaaauaucaaggaagaguaacaaugacaagggauacguuuuuagaaacaguauauauggaauuaagaggauuaagaguagaugauacagcaauauauuauugugcaacaccaaaaaguggaagagauuauuggaguuuugauuuauggggacaaggaacauuaguaacaguaucaagugcaaguacaaaagga

SEQ ID NO: 50132 - RNA, 378 nt, Artificial Sequence
  derived and/or modified sequence opt6 from anti-HIV_Chain
caaguacaauuaguacaaaguggagcagcaguaaaaaaaccaggagcaaguguaaaaguaaguugugaaacauauggauauaaauuuacagaucauuuuaugcauugguggagacaagcaccaggacaaggauuagaauggaugggauggauaaauccauauaguucagcaguaaguuauaguccaagauaucaaggaagaguaacaaugacaagagauacauuuuuagaaacaguauauauggaauuaagaggauuaagauuugaugauacagcaauauauuauugugcaacaccaaaaaguggaagagauuauuggagcuuugauuuauggggacaaggaacauuaguaacaguaucaagcgcaaguacaaaagga

SEQ ID NO: 50133 - RNA, 378 nt, Artificial Sequence
  derived and/or modified sequence opt6 from anti-HIV_Chain
caaguacaauuaguacaaaguggagcagcaguaaaaaaaccaggagcaaguguaaaaguaaguugugaaacauauggauauacauuuacagaucauuuuaugcauugguggagacaagcaccaggacaaggauuagaauggaugggauggauaaauccauauaguucagcaguaaguuauaguccaagauaucaaggaagaguaacaaugacaagagauacauuuuuagaaacaguauauauggaauuaagaggauuaaaauuugaugauacagcaauauauuauugugcaacaccaaaaaguggaagagauuauuggagcuuugauuuauggggacaaggaacauuaguaacaguaucaagugcaagcacaaaagga

SEQ ID NO: 50134 - RNA, 378 nt, Artificial Sequence
  derived and/or modified sequence opt6 from anti-HIV_Chain
caaguacaauuaguacaaagcggagcagaaguaaaaaaaccaggaaguaguguaaaaguaaguuguaaaacaaguggaguaagauuuucaagcaaugcaauaaguuggguaagacaagcaccaggacaaggauuagaauggaugggaagaacaacaccaaugcuaggaggagcaaaucaugcaccaaguuuuaaaggaagaguaacaauaagugcagaugaaaguacaagaacaguauauauggaaaugucaaguuuaagauaugaagauacagcaguauauuauugugcaaguggaagaagagaaggauuaaauuuuuuauuagauuauuggggacaaggaacauuaguaacaguaaguagugcaaguacaaaagga

SEQ ID NO: 50135 - RNA, 378 nt, Artificial Sequence
  derived and/or modified sequence opt6 from anti-HIV_Chain
caaguacaauuacaagaaucaggaccaggacuaguaaaaccaucagaaacauuaucacuaacaugcacaguaucaggaggaucaauaucaacauacuacuggucauggauaagacaaccaccaggaaaaggacuagaauggauaggauacauaucauacucaggaucaacaaacuacaacccaucacuaaaaucaagaguaacaauaucaguagacacaucaaaaaaccaauucucacuaaaacuaucaucaguaacagcagcagacacagcaguauacuacugcgcaagacacaaaucaguacuacuaugguucagagaacuagacuacuggggacaaggaacacuaguaacagucucaucagcaucaacaaaagga

SEQ ID NO: 50136 - RNA, 378 nt, Artificial Sequence
  derived and/or modified sequence opt6 from anti-HIV_Chain
caaguacaacuaguacaaagcggagcagaaguaaaaaaaccaggagcagcaguaaaaauaucaugcaaagcaucaagauucacauucucaucauacuacauacacuggguaagacaagcaccaggacaaggacuagaauggaugggaauaauaaacccaucaggaggaucaacaucaaacgcacaaaaauuccaagacagaguaacacuaacaagagacaugucaacaggaacaguauacauggaacuaucaagacuaacaucagaagacacagcaguauacuacugcgcaacaccagaaccaucaucaauaguagcaccauuauacuacuggggacaaggaacacuaguaacaguaagcagcgcaucaacaaaagga

SEQ ID NO: 50137 - RNA, 378 nt, Artificial Sequence
  derived and/or modified sequence opt6 from anti-HIV_Chain
caaguacaauuaguacaaagcggagcagaaaugaaaaaaccgggagcaagcguaaaaguaagcuguaaagcaagcggacacacauucacaaacuauuacaugcacuggguaagacaagcaccaggacaaggauuagaauggaugggaaugauaaauccaacaggagauagcacaagauaugcacaaagauuucaaggaagaguaacaaugacaagagacacaagcacaagaacaguauauauggaauuaucaagcuuaagaucggacgauacagcaguauauuacugugcaagagcacaucacgauuucuggagagcaccaguagacguauggggaaaaggaacaacaguaacaguaucaagcgcaagcacaaaagga

SEQ ID NO: 50138 - RNA, 378 nt, Artificial Sequence
  derived and/or modified sequence opt6 from anti-HIV_Chain
caaguaguacuaauacaaucaggagcagaaguaaaaagaccaggaagcucaguaaaaguaucauguaaagcaucaggaggaucauuuccaauaacauggguaagacaagcaccaggacacggacuagaauggaugggaggaauaaauccauuuuucggaacaacaaacuaugcacaaaaauuucaaggaagaguaagcauaacagcagacgaaagcacaagcacaacauauuuacaucuaucagacuuaagaucagaagauacagcaguauauuucugugcaagagaaaauagagaaaaauggcuaguacuaagaagcugguucgcaccauggggacaaggaacauuaguaacaguaagcucagcaucaacaaaagga

SEQ ID NO: 50139 - RNA, 378 nt, Artificial Sequence
  derived and/or modified sequence opt6 from anti-HIV_Chain
agucaacaauuaguacaaaguggagcacaaguaaaaaaaccaggagcaaguguaagaguaaguugucaagcaaguggauauacauuuacaaaucauuuuuuacauugguggagacaagcaccaagacaaggauuagaauggaugggauggauaaauccaguacauggaggaagaaauuaugcaagaagauuucaaggaagaauaaauuuuggaagagauguauaucaagaaacagcauauauggaauuaaguggauuaagaaaugaugauacagcaacauauuuuugugcaagaggaggaggagauggaagaaauuggcauuuacauccauggggacaaggaacauuaguaauaguaagcgcagcaaguacaaaagga

SEQ ID NO: 50140 - RNA, 378 nt, Artificial Sequence
  derived and/or modified sequence opt6 from anti-HIV_Chain
gaaguacaaguaguagaaaguggaggaggauuaguacaaccaggaggaaguuuaagauuaaguuguguagcaaguggauuuacauuuagugaauauuggaugaguuggguaagacaagcaccaggaaaaggauuagaauggguagcaacaauaaaaagagauggaagugaagaaaguuauguagauaguguaaaaggaagauuuacaauaaguagagauaaugcaaaaaauaguuuauauuuacaaaugaauaguuuaagagcagaagauacagcaguauauuauugugcaagaguaagagauccaaauuauaauuuacauuuugauagcuggggacaaggaacauuaguaacaguaaguagugcaaguacaaaagga

SEQ ID NO: 50141 - RNA, 378 nt, Artificial Sequence
  derived and/or modified sequence opt6 from anti-HIV_Chain
uuaguacaauuaguagaaaguggaggaggagugguacaaccaggaaaaaguuuaagauuaaguugugcaacaagcggauuuacauuuaguacauauggaaugcauuggguaagacaagcaccgggaaaaggauuagaauggguagcaguaauaugguaugauggaaguuauaaauauuaugcagauaguguaaaaggaagauuuacaauaaguagagauaauaguaaaaauacauuauuuuuacaaaugaauaguuuaagagcagaagauacagcaauguauuauuguggaagagaaauggcaguaggaggaacaaaagcauuagaucauuggggacaaggaacauuaguaacaguaaguagugcaaguacaaaaggg

SEQ ID NO: 50142 - RNA, 378 nt, Artificial Sequence
  derived and/or modified sequence opt6 from anti-HIV_Chain
gaauuccaacuaguacaaucaggaggaggacuaguaaaaccaggaggaucauuaagacuaucgugcacaggaucaacauuuagcuuuagcucagacgauaugaauuggguaagacaagcaccaggaaaaggauuagaauggguaucaagcaugagcgauagcggaagccauauauauuacgcagacuuuguaaaaggaagauucacaauaucaagagauaacgcaaaaaaaaguuuauacuuacaaaugaacucacuaagagcagaagacacagcaguauacuauugcgcacaaucaagaccaccacaaagauuauacggaauggauguauggggacaaggaacaacaguaacaguaagcucagcaucaacaaaagga

SEQ ID NO: 50143 - RNA, 381 nt, Artificial Sequence
  derived and/or modified sequence opt6 from anti-HIV_Chain
gaagugcaauuaguagaaaguggaggaggaguagugcaaccaggaggaaguuuaagacuaaguugugcagcaagcggauuuauguuuaaaaauuaugcaaugcauuggguaagacaaccaccaggaaaaggauuagaauggguagcaguaauaugguauggaggaagagaucaaaauuaugcagauaguguaaaaggaagauuuacaauaaguagagaugauagugauaauacauuauauuuacaaaugaauaguuuaagagcaggagauacagcaguauauuuuugugcaagaaauagucaaguaggaagauuaaugccagcagcaggaguauggggacaaggaacauuaguaacaguaaguagugcaaguacaaaagga

SEQ ID NO: 50144 - RNA, 381 nt, Artificial Sequence
  derived and/or modified sequence opt6 from anti-HIV_Chain
caaggacauuuaguacaaagcggaggaggaguaaaaaaauuaggaacaaguguaacaauaaguuguuuagcaagugaauauacauuuaaugaauuuguaauacauuggauaagacaagcaccaggacaaggaccauuaugguuaggauuaauaaaaagaaguggaagauuaaugacaaguuaucaauuucaagauagauuaaguuuaagaagagauagaaguacaggaacaguauuuauggaauuaagaggauuaagaguagaugauacagcaguauauuauugugcgagagauggauuaggagaaguagcaccagcauauuuauauggaauagaugcauggggacaaggaacaacaguaauaguaacaagugcaaguaca

SEQ ID NO: 50145 - RNA, 381 nt, Artificial Sequence
  derived and/or modified sequence opt6 from anti-HIV_Chain
caaguacaauuacuagaaagcggaggaggacuaguacaaagaggaggaagcuuaagauuaaguuguacagcaaguggauucguauuuaauaauuauuggaugacauggguaagacaagcaccaggaaacggauuagaauggguagcaaauauagaucaagauggaagugaaaaacacuauuuagauaguguaaaaggaagauuuacaauaaguagagauaaugcaaaaaacaguuuauauuuacaaaugaauaguuuaagagcagaagauacagcaauauauuacugugcaagaguaagauuuaaaguaacagcauggcacagauucgauagcugggggcaaggagauuuaguaacaguaagcaguacaaguacaaaagga

SEQ ID NO: 50146 - RNA, 381 nt, Artificial Sequence
  derived and/or modified sequence opt6 from anti-HIV_Chain
caaucagcacuaacacaaccaccaucagcaucaggaacaccaggccaaagaguaacaauaucaugcucaggaucauaccacaacauaggaucaaacgcaguaaacugguaccaacaacuaccaggaacagcaccaaaauuauuaauauacucaaacgaccaaagaccaucaggaguaccagacagauucucaggaucaaaaucaggaacaucagcaucacuagcaauaucaggacuacaaucagaagacgaagcagacuacuacugcgcagcaugggacgauucacuacacguauucggaacaggaacaaaaguaacaguacuaggacaaccaaaagcaaacccaacaguaacacuauucccaccaucaucagaagaacua

SEQ ID NO: 50147 - RNA, 381 nt, Artificial Sequence
  derived and/or modified sequence opt6 from anti-HIV_Chain
caaagcguacuaacacaaguacuaucaguaucaggaacaccaggacaaagaguaauaauaucaugcucaggaacaagcucaaacguaggaggaaacuuaguaucaugguaucaacaucuaccaggagcagcaccaagauuacuaauacacagagacgaucaaagaccaucaggaguaccagauagauuuagcggaucaaaaagcggaaacucagcaagucuaguaauaucaggauuaagaucagacgaugaagcagacuauuucugugcagcauacgauucaacauucucauuaccaguauuuggaggaggaacaagauuaacaguacuaucacaaccaaaagcagcaccaagcguaacauuauucccaccaucaagcgaa

SEQ ID NO: 50148 - RNA, 381 nt, Artificial Sequence
  derived and/or modified sequence opt6 from anti-HIV_Chain
caaguacaauuauuacaaaguggagcagcaguaacaaaaccaggagcaaguguaagaguaaguugugaagcaaguggauauaauauaagagauuauuuuauacauugguggagacaagcaccagggcaaggauuacaauggguaggauggauaaauccaaaaacaggacaaccaaauaauccaugucaauuucaaggaagaguaaguuuaacaagacaugcaaguugggauuuugauacauuuucauuuuauauggauuuaaaagcauuaagaucagaugauacagcaguauauuuuugugcaagacaaagaagcgauuauugggauuuugauguauggggaaguggaacacaaguaacaguaucaagugcaaguacaaaa

SEQ ID NO: 50149 - RNA, 381 nt, Artificial Sequence
  derived and/or modified sequence opt6 from anti-HIV_Chain
caaguacaauuaguacaaagcggaggagaaguaagaaaaccaggaucaagcguaaaaguaccauguaaaauaagcggaaacgcauucaguaacuauggaguaaacuggguaagacaagcaccaggacaaggacuagaauggguaggaagaauaauaccaguaauaggaguagcacaacaugcaccaaaauuucaaggaagaguaacaauaacagcagacaaaagcacaacaacagcauaucuagaacuaucaagccuaagaucagacgauacagcaguauauuucugugcaaaagaccauggagauccaagaacaggauauuauuucgauuacuggggacaaggagcauuaguaacaguaaguucagcaucaacaaaagga

SEQ ID NO: 50150 - RNA, 381 nt, Artificial Sequence
  derived and/or modified sequence opt6 from anti-HIV_Chain
caaguacaauuaggacaaucaggaacagaaguaaaaaaaccaggauuuucaguaaaaguuucauguaaagcaucaggaggaucaaguacagcauauggauauucauggguaagacaagcaccaggacaaggauucgaauggaugggaagaauaauaccauuuuacggaauaauaacauaugcaccaaaauuucaaggaagaguaacaauaacagcagacagaucaacaagcacaguauauauggaacuaacaucauuaacauuugcagauacagcacuauuuuucugugcaagagacuuuggagauccaagaaacggauacuauuucgauucaugggaccaaggauuaugguuaacaguaucaucagcaaguacaaaagga

SEQ ID NO: 50151 - RNA, 381 nt, Artificial Sequence
  derived and/or modified sequence opt6 from anti-HIV_Chain
caaguacaauuaguacaaagcggagcagaaguaaaaaaaccaggaucaaguguaaaaguaagcuguaaagcaagcggaggaacauucagcaacuaugcaauaagcuggguaagacaagcaccaggacaaggacuagaauggaugggaggaauaauaccaauauucgaagcagcaagcuaugcacaaaaauuucaagauagauuaacaauaacaacagacgaaaguacaacaacagcauauauggaucuaucaaguuuaagaucagaagauacagcaauauauuacugugcaagagcacaaggagauauauuaacagaaggauauuucgauuacuggggacaaggaacacuaguaacagugagcucagcaucaacaaaagga

SEQ ID NO: 50152 - RNA, 381 nt, Artificial Sequence
  derived and/or modified sequence opt6 from anti-HIV_Chain
caaguacaacuacaagaaucaggaccaggacuaguaaaaccaucagaaacauuaucacuaacaugcacaguaucaggaggaucaauaucaucagcaggauacuacuggucauggauaagacaacacccagaaaaaggacuagaauucauaggauacauauacuaccuaggaacaacauacuacaacccaucacuaaaaucaagaguaucaauaucaauagacacaucaaacaaccaauucucacuagaacuaucaucaguaucagcagccgacacagcaauauacuacugcgcaagagacuacacagcaucaggaagacacuucuucgacuacuggggacaaggaacacuaguaacaguaucaucagcaucaacaaaagga

SEQ ID NO: 50153 - RNA, 381 nt, Artificial Sequence
  derived and/or modified sequence opt6 from anti-HIV_Chain
caaguacaauuaguacaaaguggagcagaaguaaaaaaaccaggagcaucaguaaaaguaaguuguaaagcaccaggauauacauuuauaggacauuauaugcauuggauaagacaagcaccaggacaaggauuagaauggaugggauggauaaauccaaauaguggagauacaaauuaugcacaaacauuucaaggaagaguaacaaugacaagagauacaaguauaaguacagcauauauggaauuaacaagauuaagaagugaugauacagcaguauauuauugugcaagagauuuaagaccaaugagaggaaauugggcaaugcauguauggggagaaggaacaacaguaacaguaaguagugcaaguacaaaagga

SEQ ID NO: 50154 - RNA, 381 nt, Artificial Sequence
  derived and/or modified sequence opt6 from anti-HIV_Chain
caaguacaauuacaagaaucaggaccaggacuaguaaaaccaucagaaacauuaucacuaacaugcacaguauucggagcaucaauaagaucauucuacuggcacuggauaagacaaucaccaggaaaaggauuagaauggcuaggaucaguauucgacaacggacuaacaacauacaacccaucacuaaaaaacagacuaucaauaucagaagacccaucaagaaaccaaauaucauuaaacuuacgaucaaugacagcagcagacacagcaguauacuacugcgcaagagcagacuacgaccuacuaacaucaucauaccacuucgacucauggggacaaggaacacuaguaacaguaucaucagcaucaacaaaagga

SEQ ID NO: 50155 - RNA, 381 nt, Artificial Sequence
  derived and/or modified sequence opt6 from anti-HIV_Chain
agucaacaauuaguacaaucaggaacacaaguaaaaaaaccaggagcaucaguaagaguaaguugucaagcaaguggauauacauuuacagauuauguauuacauugguggagacaagcaccaggacaaggauuagaauggaugggauggauaaaaccaguauauggagcaagaaauuaugcacauagauuucaaggaagaauaaauuuugauagagauguauauagagaaauagcauauauggaucuaaguggauuaagaagugaugauacagcaguauauuuuugugcaagagauggaaguggagaugcaacaaguuggcauuuacauccauggggacaaggaacauuaguaauaguaaguagugcaaguacaaaagga

SEQ ID NO: 50156 - RNA, 381 nt, Artificial Sequence
  derived and/or modified sequence opt6 from anti-HIV_Chain
agucaacaauuaguacaaagcggaacacaagucaaaaaaccaggagcaagcguaagaguaaguugucaagcaaguggauacacauucacaaauuauauauuacacugguggagacaagcaccaggaagaggacuagaauggaugggauuaauaaaaccaguauauggagcaguaaacuaugcaagacaauuucaaggaagaauacaauuaacaagagacauauacagagaaauagcauuuuuagauuuaucaggacuaagaccagaugauacagcaguauauuauugugcaagagaugaaaguggauacgauuuaaacuggcauuuagauagcuggggacaaggaacacaaguaauaguaaguccagcaucaacaaaagga

SEQ ID NO: 50157 - RNA, 381 nt, Artificial Sequence
  derived and/or modified sequence opt6 from anti-HIV_Chain
agucaacaauuaguacaaaguggagcacaaguaaaaaaaccaggagcaaguuuaagaguaaguugucaagcaaguggauauacauuuaugaauuauuuauuacauugguggagacaagcaccaggacaaggauuagaauggaugggauggauaaauccaguauauggagcaguaaauuaugcacauagauuucaaggaagauuaacauuuagcagagauguauauagagaaauagcauauauggauuuaaauggauuaagaagugaugauacagcaguauauuuuugugcgagagauggaaguggagaugauagaaauuggcauuuagauccauggggacaaggaacauuaguaauaguaaguagugcaaguacaaaagga

SEQ ID NO: 50158 - RNA, 381 nt, Artificial Sequence
  derived and/or modified sequence opt6 from anti-HIV_Chain
agucaacaacuaguacaaaguggaacacaaguaaaaaaaccaggggcaaguguaagaauaaguugucaagcaaguggauauacauuuacagauuauguauuacauugguggagacaagcaccaggacaaggauuagaauggaugggauggauaaaaccaguauauggagcaagaaauuaugcaagaagauuucaaggaagaauaaauuuugauagagauauauauagggaaauagcauuuuuagauuuaucaggauuaagaagugaugauacagcaagauauuuuugugcaagagauggaaguggagaugauacaaguuggcauuuacauccauggggacaaggaacauuaguaauaguaagugcagcaaguacaaaagga

SEQ ID NO: 50159 - RNA, 381 nt, Artificial Sequence
  derived and/or modified sequence opt6 from anti-HIV_Chain
agucaacaauuaguacaaaguggaacacaaguaaaaaaaacaggagcaaguguaagaguaaguugucaagcaaguggauaugauuuuacaaaauauuuaauacauugguggagacaagcaccaggacaaggauuagaauggaugggauggaugaaaccaguauauggagcaacaaauuaugcacauagauuucaaggaagaauaaguuuuacaagagauauauauagagaaauagcauuuauggauuuaaauggauuaagaagugaugauacagcaguauauuuuugugcaagagauggaggaggagaugauagaacaugguuauuagaugcauggggacaaggaacauuaguaauaguaaguagugcaaguacaaaagga

SEQ ID NO: 50160 - RNA, 381 nt, Artificial Sequence
  derived and/or modified sequence opt6 from anti-HIV_Chain
agucaacaauuaguacaaaguggaacacaaguaaaaaaaccaggagcaaguguaagaguaaguugucaagcaaguggauauacauuuaugaauuauauaauacauugguggagacaagcaccaggacaaagauuagaauggaugggauggauaaauccaguauuuggagcaagaaauuaugcacauagauuucaaggaagaauaaauuuugauagagauauaaauagagaaacauuucaaauggauuuaacaggauuaagaagugaugauacagcaguauauuauugugcaagagauggaaguggagaugcaagagauuggcauuuacauccauggggacaaggaacauuaguaauaguaaguagcgcaaguacaaaagga

SEQ ID NO: 50161 - RNA, 381 nt, Artificial Sequence
  derived and/or modified sequence opt6 from anti-HIV_Chain
agucaacauuuaguacaaaguggaacacaaguaaaaaaaccaggagcaaguguaagaguaagcugucaagcaaguggauauacauuuacaaauuauauauuacauugguggagacaagcaccaggacaaggauuagaauggaugggauuaauaaaaccaguauuuggagcaguaaauuaugcaagacaauuucaaggaagaauacaauuaacaagagauauaaauagagaaauagcauuuuuagauuuaaguggauuaagaagugaugauacagcaguauauuauugugcaagagaugaaaguggagaugauuuaaaauggcauuuacauccaugggggcaaggaacacaaguaauaguaaguccagcaaguacaaaagga

SEQ ID NO: 50162 - RNA, 381 nt, Artificial Sequence
  derived and/or modified sequence opt6 from anti-HIV_Chain
agucaacaauuaguacaaaguggaacacaaguaaaaaaaccaggagcaaguguaagaguaaguugucaagcaaguggauauacauuuaugaauuauauaauacauugguggagacaagcaccaggacaaagauuagaauggaugggauggauaaauccaguauuuggagcaagaaauuaugcacauagauuucaaggaagaauaaauuuugauagagauauaaauagagaaacauuccaaauggaauuaacaggauuaagaagugaugauacagcaguauauuauugugcaagagauggaaguggagaugcaagagauuggcauuuagauccauggggacaaggaacauuaguaauaguaaguucagcaaguacaaaagga

SEQ ID NO: 50163 - RNA, 381 nt, Artificial Sequence
  derived and/or modified sequence opt6 from anti-HIV_Chain
agucaacaauuaguacaaaguggaacacaaguaaaaaaaccaggagcaaguguaagaauaaguugucaagcaaguggauauacauuuacagauuauguauuacauugguggagacaagcaccaggacaaggauuagaauggaugggauggauaaaaccaguauauggagcaagaaauuaugcaagaagauuucaaggaagaauaaauuuugauagagauauauauagagaaauagcauauauggauuuaaguggauuaagaagugaugauacagcaagauauuuuugugcaagagauggaaguggagaugauacaaguuggcauuuacauccauggggacaaggaacauuaguaauaguaagugcagcaagcacaaaagga

SEQ ID NO: 50164 - RNA, 381 nt, Artificial Sequence
  derived and/or modified sequence opt6 from anti-HIV_Chain
agucaacaauuaguacaaaguggaacacaaguaaaaaaaccaggagcaucaguaagaauaaguugucaagcaaguggauauaguuuuacagauuauguauuacauugguauagacaagcaccaggacaaggauuagaauggaugggauggauaaaaccaguauauggagcaagaaauuaugcaagaagauuucaaggaagaauaaauuuugauagggauauauauagagaaauagcauuuauggauuuaagcggauuaagaagugaugauacagcauuauauuuuugugcaagagauggaaguggagaugauacaaguugguauuuagauccauggggacaaggaacauuaguaauaguaagugcagcaaguacaaaagga

SEQ ID NO: 50165 - RNA, 381 nt, Artificial Sequence
  derived and/or modified sequence opt6 from anti-HIV_Chain
ucacaacaauuaguacaaaguggaacacaaguaaaaaaaccaggagcaaguguaagaauaaguugucaagcaaguggauauaguuuuacagauuauguacuacauugguggagacaagcaccaggacaaggauuagaauggaugggauggauaaaaccaguauauggagcaagaaauuaugcaagaagauuucaaggaagaauaaauuuugauagagauauauauagagaaauagcauuuauggauuuaaguggacuaaggagugaugauacagcauuauauuuuugugcaagagauggaaguggagaugauacaaguuggcauuuagauccauggggacaaggaacauuaguaauaguaagugcagcaaguacaaaagga

SEQ ID NO: 50166 - RNA, 381 nt, Artificial Sequence
  derived and/or modified sequence opt6 from anti-HIV_Chain
agucaacauuuaguacaaagcggaacacaaguaaaaaaaccaggugcaaguguaagaguaaguugucaagcaaguggauauacauuuacaaauuauauauuacauugguggagacaagcaccaggacaaggauuagaauggaugggauuaauaaaaccaguauuuggagcaguaaauuaugcaagacaauuucaaggaagaauacaauuaacaagagauauauauagagaaauagcauuuuuagauuuaucaggauuaagaucagaugauacagcaguauauuacugugcaagagaugaaaguggagaugauuuaaaauggcauuuacauccauggggacaaggcacacaaguaauaguaaguccagcaucaacaaaagga

SEQ ID NO: 50167 - RNA, 381 nt, Artificial Sequence
  derived and/or modified sequence opt6 from anti-HIV_Chain
caaguacaauuaguagaaagcggaggaggaguaguacaaccaggaaaaagcuuaagauuaaguugugcaauaagcggauucuuauuuaauaauuauggaggacaauggguaagacaagcaccaggaaaaggacuagaauggguagcagcaauaucauacgauggaaauaacagauacuaugcagauagcgcaaaaggaagauuucuaauaaguagagacacaccaaaaaacauacuauaucuacaaauauauaguuuaagauuagacgauacagcaguauauuacugugcaagagacucaguaucaaaaucauacucagcaccaccagaauucuggggacaaggaacaguaguaacaguaagcucagcaucaacaaaagga

SEQ ID NO: 50168 - RNA, 381 nt, Artificial Sequence
  derived and/or modified sequence opt6 from anti-HIV_Chain
caaguacaccuagaagaaagcggaccaggauuaguaaaaacaagccaaacauuaagccuaacauguucaguaagcucauacucaauaucaagaucaggauauuucuggacauggauaagacaaagaccaggaaaaggauuagaauggauaggauauauauauuucaauggaagaacaacauacaauccaucacuaaaaucaagaauaacaauaucaagagauacaucacacucacaauuuagccuaacauuaaacucacuaucagcagcagacacagcaguauacuacugcggaagaugucaagacggauuagcaucaagaccaauagauuucuggggacaaggaacauuaguaacaguaagcucagcaucaacaaaagga

SEQ ID NO: 50169 - RNA, 381 nt, Artificial Sequence
  derived and/or modified sequence opt6 from anti-HIV_Chain
caaguacaauuaguagaaaguggaggaggaguaguacaaccaggaagaagucuaagauuaaguugugcaacaaguggauuuacaaguaaaaauuauggaguacauuggguaagacaagcaccaggaaaaggauuagaauggguagcaguaauaugguaugauggaaguaauaaauuuuaugcagauaguguaaaaggaagauuuacaauaaguagagauagaaguaaaaauaugguauauuuacaaaugaauaguuuaagaguagaagauacagcaauauauuauugugcaagagauaguguagcauuuguauuagaaggaccaauagauuauuggggacaaggaacauuaguaacaguaaguagugcaaguacaaaagga

SEQ ID NO: 50170 - RNA, 384 nt, Artificial Sequence
  derived and/or modified sequence opt6 from anti-HIV_Chain
caaguacaauuaguacaaagcggaggaggaguaaaaaaaccaggaacaagcgcaagcuuuagcuguagaacaagcgaugacauauacgauaacgaauucuuugacucagcauuuaugcauuggguaagauuaauaccaggacaaagaccagaauggaugggauggaugaacccaagaucaggagcaguaaauuacgcaagacaacuacaaccaagaguaucaauguauagagauagagaucuaucaacagcauacauggaauuuaaaucacuaacaagugcagacacaggaacauacuuuugcgcaagaaaaaaaagaggagauggauuuaacuuauacuuugacuuauggggaagaggaagccaaguaauaguaucaagugca

SEQ ID NO: 50171 - RNA, 384 nt, Artificial Sequence
  derived and/or modified sequence opt6 from anti-HIV_Chain
caaggacauuuaguacaaaguggaggaggaguaaaaaaauuaggaacaaguguaacaauaaguuguuuagcaucagaagauacauuuaaugaauuuguaauacauuggauaagacaagcaccaggacaaggaccauuaugguuaggauuaauaaaaagaagcgggagauuaaugacaaguuaucaauuucaagauagauuaagcuuaagaagagauagaaguacaggaacaguauuuauggaauuaagaggauuaagaguagaugauacagcaguauauuauugugcaagagauggauuaggagaaguagcaccagcauauuuauauggaauagaugcauggggacaaggaacaacaguaauaguaacaagugcaaguacaagu

SEQ ID NO: 50172 - RNA, 384 nt, Artificial Sequence
  derived and/or modified sequence opt6 from anti-HIV_Chain
caaucagcauuaacacaaccaccaucaguaucaggagcaccaggacaaagaguaacaauaucauguucaggaggcccaucaaacguaggaggaaacuacguauacugguacagacaauucccaggaacagcaccaaaauuacuaauacuaagagacgaccaaagaccaucaggaguaccagacagauucucagcaucaaaaucaggaaacucagcaucauuagcaauaucaggacuaagaccagacgacgaagcauucuacuucugcgcaacauacgacucacaaggaucauucagagucuucggaggaggaacagcacuaacaguacuaucacaaccaaaagcagcaccaucaguaacacuauacccaccaucaucagaagaa

SEQ ID NO: 50173 - RNA, 384 nt, Artificial Sequence
  derived and/or modified sequence opt6 from anti-HIV_Chain
aacuucaugcuaacacaaccaccaucagcaucaggaacaccaggacaaagaguaacaauauccugcucaggaggaggaucaaacauaggagguaaccuaguaucaugguaccaacacuucccaggagcagcaccaaaacuauuaauauacagaaacgaccaaagaccaucaggaguaccagacagauucucaggaucaaaaucaggaacauccgcaucacuagcaauaucaggacuaagaucagacgacaaagcaacauacuucugcgcagcauacgacucaacacuaucacuaagacuauucggaggaggaacaacacuaacaguacuaucacaaccaaaagcagcaccaucaguaacacuauucccaccaucaucagaagaa

SEQ ID NO: 50174 - RNA, 384 nt, Artificial Sequence
  derived and/or modified sequence opt6 from anti-HIV_Chain
aacuucaugcuaacacaaccaccaucaguaucagcaacaccaggacaaacaguaacaauaucaugcucaggaucaggaucaaacguaggaggaaaccacguauacugguacagacaacuaccaggagcagcaccaacacuaguaauaucaaaaacagaccacagaccaucaagaguacccgauagauucucaggaucaaaaucaggaaacucagcaucacuagcaauaucaggacuaagaccagacgacgaagcaguauacuucugcgcaacauacgacacaggacuaucacuaagacuauucggaggaggaacaagacuaacaguacuaucacaaccaaaagcagcaccaucaguaacacaauucccaccaucaucagaagaa

SEQ ID NO: 50175 - RNA, 384 nt, Artificial Sequence
  derived and/or modified sequence opt6 from anti-HIV_Chain
caaucagcacuaacacaaccacccucagcaucuggagcaccaggacaaagaguaacaauaucaugcucaggaggaccaucaaacguaggaggaaacuauguauauugguauagacaauucccaggaacagcaccaaaauuacuaauacuaagagacgaucaaagaccaucuggaguaccagacagauuuucagcaucaaaaucaggaaacucagcaucacuagcaauaucaggauuaagaccagacgaugaagcacuauauuucugugcaacauacgauucagauggaucaauaagauuauucggaggaggaacagcauuaacaguacuaucacaaccaaaagcagcaccaucaguaacauuauucccaccaggaugggaagaa

SEQ ID NO: 50176 - RNA, 384 nt, Artificial Sequence
  derived and/or modified sequence opt6 from anti-HIV_Chain
caaguacaauuacuacaaagcggagcagcaguaacaaaaccaggagcaaguguaagaguaaguugugaagcaaguggauauaauauaagagauuauuuuauacauugguggagacaagcgccaggacaaggauuacaauggguaggauggauaaauccaaaaacaggacaaccaaauaauccaagauuauuucaaggaagaguaaguuuaacaagacaugcaaguugggauuuugauacauuuucauuuuauauggaucuaaaagcaguaagaagugacgauacagcaguauauuuuugugcaagacaaagaagugauuauugggauuuugauguauggggaaguggaacacaaguaacaguaucaagugcaaguacaaaagga

SEQ ID NO: 50177 - RNA, 384 nt, Artificial Sequence
  derived and/or modified sequence opt6 from anti-HIV_Chain
caaguacaauuauuacaaaguggagcaguaguaacaaaaccaggagcaaguguaagaguaaguugugaagcaaguggauauaaaauaagagauuauuuuauacauugguggagacaagcaccaggacaaggauuacaauggguaggauggauaaauccacaaacaggacaaccaaauauaccaagaccauuucaaggaagaguaacauuaacaagacaugcaaguugggauuuugauacauuuucauuuuauauggauuuaaaagcacuaagaagugaugauacagcaauauauuuuugugcaagaagaagaagugauuauugugauuuugauguauggggaaguggaacucauguaacaguaucaagugcaagcacaaaagga

SEQ ID NO: 50178 - RNA, 384 nt, Artificial Sequence
  derived and/or modified sequence opt6 from anti-HIV_Chain
caaguacaauuauuacaaaguggagcagcaguaacaaaaccaggagcaaguguaagaguaaguugugaagcaaguggauauaauauaagagauuauuuuauacauugguggagacaagcaccaggacaaggauuacaauggguaggauggauaaauccaaaaacaggacaaccaaauaauccaagacaauuucaaggaagaguaaguuuaacaagacaagcaaguugggauuuugauacaauaucauuuuauauggauuuaaaagcauuaagauuagaugauacagcaguauauuuuugugcaagacaaagaagugauuauugggauuuugauguauggggaaguggaacacaaguaacaguaucaagugcaaguacaaaagga

SEQ ID NO: 50179 - RNA, 384 nt, Artificial Sequence
  derived and/or modified sequence opt6 from anti-HIV_Chain
caaguacaauuauuacaaaguggagcagcaguaacaaaaccaggagcaaguguaagaguaaguugugaagcaagcggauauaauauaagagauuauuuuauacauugguggagacaagcaccaggacaaggauuacaauggguaggauggauaaauccaaaaacaggacaaccaaauaauccaagacaauuucaaggaagaguaaguuuaacaagacaugcaaguugggauuuugauacauuuucauuuuauauggauuuaaaagcauuaagaucagaugauacagcaguauauuuuugugcaagacaaagaagugauuauugggauuuugauguauggggaaguggaacacaaguaacaguauauagugcaaguacaaaagga

SEQ ID NO: 50180 - RNA, 384 nt, Artificial Sequence
  derived and/or modified sequence opt6 from anti-HIV_Chain
caaguacaauuauuaccauuuggaggagcaguaacaaaaccaggagcaaguguaagaguaaguugugaagcaaguggauauaauauaagagauuauuuuauacauugguggagacaagcaccaggacaaggauuacaauggguaggauggauaaauccaaaaacaggacaaccaaauaauccaugucaauuucaaggaagaguaaguuuaacaagaccagcaagcugggauuuugauacaauaucauuuuauauggauuuaaaagcauuaagauuagaugauacagcaguauauuuuugugcaagacaaagaagugauuauugggauuuugauguauggggaaguggaacacaaguaacaguaucaagugcaaguacaaaagga

SEQ ID NO: 50181 - RNA, 384 nt, Artificial Sequence
  derived and/or modified sequence opt6 from anti-HIV_Chain
caaguacauuuaagucaaaguggagcagcaguaacaaaaccaggagcaaguguaagaguaaguugugaagcaaguggauauaaaauaagugaucauuuuauacauugguggagacaagcaccaggacaaggauuacaauggguaggauggauaaauccaaaaacaggacaaccaaauaauccaagacaauuucaaggaagaguaaguuuaacaagacaagcaaguugggauuuugauacauauucauuuuauauggauuuaaaagcauuaagaucagaugauacagcaauauauuuuugugcaagacaaagaagugauuuuugggauuuugauguauggggaaguggaacacaaguaacaguaucaagcgcaaguacaaaagga

SEQ ID NO: 50182 - RNA, 384 nt, Artificial Sequence
  derived and/or modified sequence opt6 from anti-HIV_Chain
caaguacacuuaagucaaaguggagcagcaguaacaaaaccaggagcaaguguaagaguaaguugugaagcaaguggauauaaaauaucagaucauuuuauacauugguggagacaagcaccaggacaaggauuacaauggguaggauggauaaauccaaaaacaggacaaccaaauaauccaagacaauuucaaggaagaguaaguuuaacaagacaagcaagcugggauuuugauacauauucauuuuauauggauuuaaaagcaguaagaucagaugauacagcaauauauuuuugugcaagacaaagaagugauuuuugggauuuugauguauggggaaguggaacacaaguaacaguaucaagugcgaguacaaaagga

SEQ ID NO: 50183 - RNA, 384 nt, Artificial Sequence
  derived and/or modified sequence opt6 from anti-HIV_Chain
caagugcaauuauuacaaagcggagcagcaguaacaaaaccaggagcaaguguaagaguaaguugugaagcaaguggauauaaaauaucagaucauuuuauacauugguggagacaagcaccaggacaaggauuacaauggguaggauggauaaauccaaaaacaggacaaccaaauaauccaagacaauuucaaggaagaauaaguuuaacaagacaagcaaguugggauuuugauacauuuucauuuuauauggauuuaaaagcauuaagaucagaugauacagcaguauauuuuugugcaagacaaagaagugauuauugggauuuugauguauggggaagcggaacacaaguaacaguaucaagugcaagcacaaaagga

SEQ ID NO: 50184 - RNA, 384 nt, Artificial Sequence
  derived and/or modified sequence opt6 from anti-HIV_Chain
caaguacaauuauuacaaaguggagcagcaguaacaaaaccaggagcaaguguaagaguaaguugugaagcaaguggauauaauauaagagauuauuuuauacauugguggagacaagcaccaggacaaggauuacaauggguaggauggauaaauccaaaaacaggacaaccaaauaauccaagacaauuucaaggaagaguaaguuuaacaagacaugcaagcugggauuuugauacauuuucauuuuauauggaucuaaaaggauuaagaucagaugauacagcaauauauuuuugugcaagacaaagaagugauuauugggauuuugauguauggggaaguggaacacaaguaacgguaucaagugcaaguacaaaagga

SEQ ID NO: 50185 - RNA, 384 nt, Artificial Sequence
  derived and/or modified sequence opt6 from anti-HIV_Chain
caaguacaauuauuacaaaguggagcagcaguaacaaaaccaggagcaaguguaagaguaaguugugaagcaaguggauauaauauaagagauuauuuuauacauugguggagacaagcaccaggacaaggauuacaauggguaggauggauaaauccaaaaacaggacaaccaaauaauccaagacaauuucaaggaagaguaaguuuaacaagacaugcgagcugggauuuugauacauuuaguuuuuauauggauuuaaaagcauuaagaagugaugauacagcaguauauuuuugugcaagacaaagaagcgauuauugggauuuugauguauggggaaguggaacacaaguaacaguaaguagugcaaguacaaaagga

SEQ ID NO: 50186 - RNA, 384 nt, Artificial Sequence
  derived and/or modified sequence opt6 from anti-HIV_Chain
cauguacaauuauuacaaaguggagcagcaguaacaaaaccaggagcaaguguaagaguaaguugugaagcaaguggauauaauauaagagauuauuuuauacauugguggagacaagcaccaggacaaggauuacaauggguaggauggauaaauccaaaaacaggacaaccaaauaauccaagacaauuucaaggaagaguaaguuuaacaagacaagcaagcugggauuuugauacguuuucauuuuauauggauuuaaaagcauuaagauuagaugauacagcaauauauuuuugugcaagacaaagaagcgauuauugggauuuugauguauggggaaguggaacacaaguaacaguaucaagugcaaguacaaaagga

SEQ ID NO: 50187 - RNA, 384 nt, Artificial Sequence
  derived and/or modified sequence opt6 from anti-HIV_Chain
caaguacaucuaucacacucaggagcagcaguaacaaaaccaggagcaucaguaagaguaaguugcgaagcaucaggauauaaaauaucagaucacuuuauacauugguggagacaagcaccaggacaaggauuacaauggguaggauggauaaacccaaaaacaggacaaccaaauaacccaagacaauuccaaggaagaauaucauuaacaagacaagcaucaugggauuucgauacauuuucauuuuacauggacuuaaaagcacuaagaucagaugacacagcaguauacuuuugcgcaagacaaagaucagacuauugggauuucgauguauggggaucaggaacacaaguaacaguaucaucagcaucaacaaaagga

SEQ ID NO: 50188 - RNA, 384 nt, Artificial Sequence
  derived and/or modified sequence opt6 from anti-HIV_Chain
caaguacaucuaucacaaucaggagcaguaguaacaaaaccaggagcaucaguaagaguaucaugcgaagcaucaggauauaaaauaucagaucacuuuauacauugguggagacaagcaccaggacaaggauuacaauggguaggauggauaaacccaaaaacaggacaaccaaauaacccaagacaauuccaaggaagaauaucacuaacaagacaagcaucaugggauuucgauacauuuagcuuuuacauggacuuaaaagcacuaagaagcgaugacacagcaguauacuuuugcgcaagacaaagaucagacuauugggauuucgauguauggggaucaggaacacaaguaacaguaagcucagcaucaacaaaagga

SEQ ID NO: 50189 - RNA, 384 nt, Artificial Sequence
  derived and/or modified sequence opt6 from anti-HIV_Chain
caaguacaucuaucacaaucaggagcaguaguaacaaaaccaggagcaucaguaagaguaaguugcgaagcaucaggauauaaaauaucagaucacuuuauacauugguggagacaagcaccaggacaaggauuacaauggguaggauggauaaacccaaaaacaggacaaccaaauaacccaagacaauuccaaggaagaauaucacuaacaagacaagcaucaugggauauagauacauuuaguuuuuacauggacuuaaaagcacuaagaucagaugacacagcaguauacuuuugcgcaagacauagaucagacuauugggauuucgauguauggggaucaggaacacaaguaacaguaucaucagcaucaacaaaagga

SEQ ID NO: 50190 - RNA, 384 nt, Artificial Sequence
  derived and/or modified sequence opt6 from anti-HIV_Chain
caaguacauuuaagucaaaguggagcaguaguaacaaaaccaggagcaaguguaagaguaaguugugaagcaaguggauauaaaauaucagaucauuuuauacauugguggagacaagcaccaggacaaggauuacaauggguaggauggauaaauccaaaaacaggacaaccaaauauaccaagacaauuucaaggaagaauaaguuuaacaagacaagcaaguggagauuucgauacauuuucauuuuauauggauuuaaaagcauuaagaucagaugauacagcaguauauuuuugugcaagacaaagaagugauuauugggauuuuggaguauggggaaguggaacacaaguaacaguaucaagugcaaguacaaaagga

SEQ ID NO: 50191 - RNA, 384 nt, Artificial Sequence
  derived and/or modified sequence opt6 from anti-HIV_Chain
caaguacaucuaucacaaucaggagcaguaguaacaaaacccggagcaucaguaagaguaaguugcgaagcaucaggauauaaaauaucaggacacuuuauacauugguggagacaagcaccaggacaaggacuacaauggguaggauggauaaacccaaaaacaggacaaccaaauaacccaagacaauuccaaggaagaauaucacuaacaagacaagcaucaugggauuucgauacauuuagcuuuuacauggacuuaaaagcacuaagaucagaugacacagcaguauacuuuugcgcaagacauagaucagacuauugggauuucgauguauggggaucaggaacacaaguaacaguaagcucagcaucaacaaaagga

SEQ ID NO: 50192 - RNA, 384 nt, Artificial Sequence
  derived and/or modified sequence opt6 from anti-HIV_Chain
caaguacauuuaagucaaaguggagcagcaguaacaaaaccaggagcaaguguaagaguaaguugugaagcaaguggauauaaaauaucagaucauuuuauacauugguggagacaagcaccaggacaaggauuacaauggguaggauggauaaauccaaaaacaggacaaccaaauaauccaagacaauuucaaggaagaauaaguuuaacaagacaagcaaguugggauuuugauacauuuucauuuuauauggauuuaaaagcauuaagaucagaugauacagcaguauauuuuugugcaagacauagaagugauuauugggauuuugauguauggggaaguggaacacaaguaacaguaaguagugcaaguacaaaagga

SEQ ID NO: 50193 - RNA, 384 nt, Artificial Sequence
  derived and/or modified sequence opt6 from anti-HIV_Chain
caaguacauuuaagucaaaguggagcagcaguaacaaaaccaggagcaaguguaagaguaaguugugaagcaaguggauauaaaauaucagaucauuuuauacauugguggagacaagcaccaggacaaggauuacaauggguaggauggauaaauccaaaaacaggacaaccaaauaauccaagacaauuucaaggaagaguaaguuuaacaagacaagcaaguugggauuuugauacauauucauuuuauaugggauuaaaagcaguaagaucagaugauacagcaauauauuuuugugcaagacaaagaagugauuuuugggauuuugauguauggggaaguggaacacaaguaacaguaucaagugcaaguacaaaagga

SEQ ID NO: 50194 - RNA, 384 nt, Artificial Sequence
  derived and/or modified sequence opt6 from anti-HIV_Chain
caaguacauuuaagucaaaguggagcaguaguaacaaaaccaggagcaaguguaagaguaaguugugaagcaaguggauauaaaauaucagaucauuuuauacauugguggagacaagcaccaggacaaggauuacaauggguaggauggauaaauccaaaaacaggacaaccaaauaauccaagacaauuucaaggaagaauaaguuuaacaagacaagcaaguugggauuuugauacauuuucauuuuauauggauuuaaaagcauuaagaucagaugauacagcuguauauuuuugugcaagacauagaagugauuauugggauuuugauguauggggaaguggaacacaaguaacaguaucaagugcaaguacaaaagga

SEQ ID NO: 50195 - RNA, 384 nt, Artificial Sequence
  derived and/or modified sequence opt6 from anti-HIV_Chain
caaguacauuuaagucaaaguggagcaguaguaacaaaaccaggagcaaguguaagaguaaguugugaagcaagcggauauaaaauaucagaucauuuuauacauugguggagacaagcaccaggacaaggauuacaauggguaggauggauaaauccaaaaacaggacaaccaaauaauccaagacaauuucaaggaagaauaaguuuaacaagacaagcaaguugggauuuugauacauuuucauuuuauauggauuuagaagcauuaagaucagaugauacagcaguauauuuuugugcaagacaaagaagugauuauugggauuuugauguauggggaaguggaacacaaguaacaguaucaagugcaaguacaaaagga

SEQ ID NO: 50196 - RNA, 384 nt, Artificial Sequence
  derived and/or modified sequence opt6 from anti-HIV_Chain
caaguacauuuaagucaaaguggagcagcaguaacaaaaccaggagcaaguguaagaguaaguugugaagcaaguggauauaaaauaagagauuauaguauacauugguggagacaagcaccaggacaaggauuacaauggguaggauggauaaauccacaaacaggacaaccaaauauaccaagaccauuucaaggaagaauaaguuuaacaagacaagcaaguugggauuuugauacauuuucauuuuauauggauuuagaagcauuaagaucagaugauacagcaguauauuuuugugcaagacaaagaagugauuauugggauuuugauguauggggaaguggaacacaaguaacaguaucaagugcaaguacaaaagga

SEQ ID NO: 50197 - RNA, 384 nt, Artificial Sequence
  derived and/or modified sequence opt6 from anti-HIV_Chain
caaguacaucuaucacaaucaggagcagcaguaacaaaaccaggagcaucaguaagaguaucaugcgaagcaucaggauauaaaauaucagaucacuuuauacauugguggagacaagcaccaggacaaggauuacaauggguaggauggauaaacccaaaaacaggacaaccaaauaacccaagacaauuccaaggaagaauaucauuaacaagacaagcaucaugggauuucgauacauuuucauuuuacauggacuuaaaagcucuaagaucagaugacacagcaguauacuuuugcgcaagacaaagaagugacuauagagauuucgauguauggggaucaggaacacaaguaacaguaucaucagcaucaacaaaagga

SEQ ID NO: 50198 - RNA, 384 nt, Artificial Sequence
  derived and/or modified sequence opt6 from anti-HIV_Chain
caaguacauuuaagccaaagcggagcaguaguaacaaaaccaggagcaaguguaagaguaaguugugaagcaaguggauauaaaauaucagaucauuuuauacauugguggagacaagcaccaggacaaggaccacaauggguaggauggauaaauccaaaaacaggacaaccaaauaauccaagacaauuucaaggaagaauaaguuuaacaagacaagcaaguugggauuuugauacauuuucauuuuauauggauuuaaaagcauuaagaagugaugauacagcaguauauuuuugugcaagacauagaagugauuauugggauuuugauguauggggaaguggaacacaaguaacaguaaguucagcgaguacaaaagga

SEQ ID NO: 50199 - RNA, 384 nt, Artificial Sequence
  derived and/or modified sequence opt6 from anti-HIV_Chain
caaguaagauuauuacaaaguggagcagcaguaacaaaaccaggagcaaguguaagaguaaguugugaagcaaguggauaugaaauaagagauuauuuuauacauugguggagacaagcaccaggacaaggauuacaauggguaggauggauaaauccaaaaacaggacaaccaaauaauccaagacaauuucaaggaagaguaaguuuaacaagacaagcaaguugggauuuugauaguuauaguuuuuauauggauuuaaaagcauuaagaucagaugauacagcaguauauuuuugugcaagacaaagaagugauuauugggauuuugauguauggggaaguggaacacaaguaacaguaucaagugcaaguacaaaagga

SEQ ID NO: 50200 - RNA, 384 nt, Artificial Sequence
  derived and/or modified sequence opt6 from anti-HIV_Chain
caaguaagauuauuacaaaguggagcagcaguaacaaaaccaggagcaaguguaagaguaaguugugaagcaaguggauaugaaauaagagauuauuuuauacauugguggagacaagcaccaggacaaggauuacaauggguaggauggauaaauccaaaaacaggacaaccaaauaauccaagacaauuucaaggaagaguaaguuuaacaagacaagcaagcugggauuuugauaguuauaguuuuuauauggauuuaaaagcauuaagaucagaugauacaggaguauauuuuugugcaagacaaagaagugauuauugggauuuugauguauggggaaguggaacacaaguaacaguaaguagugcaaguacaaaagga

SEQ ID NO: 50201 - RNA, 384 nt, Artificial Sequence
  derived and/or modified sequence opt6 from anti-HIV_Chain
caaguaagauuauuacaaagcggagcagcaguaacaaaaccaggagcaaguguaagaguaaguugugaagcaaguggauaugaaauaagagauuauuuuauacauugguggagacaagcaccaggacaaggauuacaauggguaggauggauaaauccaaaaacaggacaaccaaauaauccaagacaauuucaaggaagaguaaguuuaacaagacaagcaagcugggauuuugauaguuauaguuuuuauauggauuuaaaagcauuaagaucagaugauacagcaguauauuuuugugcaagacaaagaagugauuauugggauuuugauguauggggaaguggaagucaaguaacaguaaguagugcaaguacaaaagga

SEQ ID NO: 50202 - RNA, 384 nt, Artificial Sequence
  derived and/or modified sequence opt6 from anti-HIV_Chain
caaguacaauuauuacaaagcggagcagcaguaacaaaaccaggagcaaguguaagaguaaguugugaagcaaguggauauaauauaagagauuauuuuauacauugguggagacaagcaccaggacaaggauuacaauggguaggauggauaaauccaaaaacaggacaaccaaauaauccaugucaauuucaaggaagaguaaguuuaacaagacaagcaaguugggauuuugauacaauaaguuuuuauauggauuuaaaagcauuaagauuagaugauacagcaguauauuuuugugcaagacaaagaagugauuauugggauuuugauguauggggaaguggaacacaaguaacaguaaguagugcaagcacaaaagga

SEQ ID NO: 50203 - RNA, 384 nt, Artificial Sequence
  derived and/or modified sequence opt6 from anti-HIV_Chain
caaguacaauuauuacaaaguggagcagcaguaacaaaaccaggagcaaguguaagaguaaguugugaagcaaguggauauaauauaagagauuauuuuauacauugguggagacaagcaccaggacaaggauuacaauggguaggauggauaaauccaaaaacaggacaaccaaauaauccaagacaauuucaaggaagaguaaguuuaacaagacaugcaaguugggauuuugauacauuuucauuuuauauggauuuaaaagcauuaagaucagaugauacagcaguauauuuuugugcaagacaaagaagugauuauugggauuuugauguauggggaaguggaacacaaguaauaguaucaagugcaaguacaaaagga

SEQ ID NO: 50204 - RNA, 384 nt, Artificial Sequence
  derived and/or modified sequence opt6 from anti-HIV_Chain
caaguacaauuaguacaaaguggagcagauguaaaaaaaccaggagcaacaguaacaguaagcuguaaaacagaugaagaugaagaugauuuuagagcacauuuaaugcaauggaugagacaagcaccaggacaaagauuagaauggguaggauggauaaaaccacaaacaggacaaccaaguuauggacaaaaauuucaaggaagaguaacauuaacaagagaaguaaguacaaguacaguauuuuuacaauuaagaaauuuaagaagugaugauacagcaguauauuacugugcaagaccaagaggaggaagagauaauuggaguuuucauguauggggaagaggaacauuaguaacaguaaguagugcaaguacaaaagga

SEQ ID NO: 50205 - RNA, 384 nt, Artificial Sequence
  derived and/or modified sequence opt6 from anti-HIV_Chain
gaaguacaauuaguagaaaguggagcagaaguaaaaaaaccaggagcaaguguaaaaguaaguuguaaaguaaguggaaauaguuuaacagaauuuaguauacauuggguaagacaagcaccaggaaaaggauuagaauggaugggaggauuugauccagaagaaggagaaacaguaccagcacaaaaauuuaaaggaagacuaacaaugacagaagauacaaguacaaauacagcauauauggaauuaaguaguuuaagaucagaagauacagcaguauauuacuguaguacagaaccaagagaaaugggaacauugacagcaggauuugaauauuggggacaaggaacauuaguaacaguaaguagugcaaguacaaaagga

SEQ ID NO: 50206 - RNA, 384 nt, Artificial Sequence
  derived and/or modified sequence opt6 from anti-HIV_Chain
agaguacaauuaggacaaagcggagcagaaguaaaaaaaccaggagcaaguguaaaaguaaguuguaaaguaaguggaaauaguuuaacagaauuuaguauacacuggguaagacaagcaccaggaaaaggacuagaauggaugggaggauuugauccagaagaaggagaaacaguaccagcacaaaaauuuaaaggaagaguaacaaugacagaagauacaaguacaaauacagcauauauggaauuaaguaguuuaagaagugaagauacagcaguauauuacuguaguacagaaccaagagaaaugggaacauuaacagcaggauuugaauauuggggacaaggaacauuaguaauaguaaguagugcaaguacaaaagga

SEQ ID NO: 50207 - RNA, 384 nt, Artificial Sequence
  derived and/or modified sequence opt6 from anti-HIV_Chain
caaguacaauuaguacaaagcggagcagauguaaaaaaaccaggagcaaguguaacaguaagcuguaaaacagaugaagacgaagacgauuucagagcacaucuaguacaauggaugagacaagcaccaggacaaagacuagaauggguaggauggauaaaaccacaaacaggacaaccaaguuaugcacaaaaauuucaaggaagaguaacacuaacaagagaaguaaguacaagcacaguauuucuacaauuaagaaauuuaagaucagacgauacagcaguauauuacugugcaagaccaagaggaggaagagauaacuggaguuuucauguauggggaagaggaacauuaguaacaguaucaagugcaaguacaaaagga

SEQ ID NO: 50208 - RNA, 384 nt, Artificial Sequence
  derived and/or modified sequence opt6 from anti-HIV_Chain
caaguacaacuacaagaaucaggaccaggacuaguaaaaccaucagaaacacuaucacuaacaugcucaguaucaggagcaucaauaucaaacuucuacuggacauggauaagacaaccagcaggaaaaggacuagaauggguaggaagauuauacucaucagacagaacaaacuacaacccaucacuaaacggaagaguaacaaugucacuagacacaucaaaaaaccaauucucacuaagacuaacaucaaugacagacgcagacacagcaauauacuucugcgcaagagaaaaaggacaauggcuaacaguaccaccauacuacuucgacucauggggacaaggaauacuaguaacaguaucaucagcaucaacaaaagga

SEQ ID NO: 50209 - RNA, 384 nt, Artificial Sequence
  derived and/or modified sequence opt6 from anti-HIV_Chain
caaguacaacuaguacaaucaggagcagaaguaagaaaaccaggagcaucaguaaaaguaucaugcaaaacaucaggauacacauucacaaacucauacauacacuggguaagacaagcaccaggacaaggacuagaauggaugggaauaauaaacccaccaggaggaaacacauacuacgcacaaaaauuccacggaagaguaacacuaacaagagacacaucaacaucaacaguauacauggaacuaaacucacuacgaucagaagacacagcaguauacuucugcgcaagaccacacucaccaacaaacauaccaucaagaccacuagacuacuggggacaaggaacauuaguaacaguaucaucagcaucaacaaaagga

SEQ ID NO: 50210 - RNA, 384 nt, Artificial Sequence
  derived and/or modified sequence opt6 from anti-HIV_Chain
caaguacaacuacaagaaucaggaccaggacuaguaaaaccaucaggaacacuaucacuaacaugcaauguauacggaggaucaaugauaucauacuacuggucauggauaagacaaccaccaggaaaaggauuagaauggauaggacacguauacaacucaggaaacacaaaauacucaccaucauuaaaaaacagaguaacaauaucaauggacacaucaagaaacuuauucucacuaaaaguaacaucaguaacaccagccgacacagcaguauauuacugcgcaagagcagacuacgacaacauaugggacucaagaggaggauucgacuuauggggacaaggaacacuaguaacaguaucaucagcaucaacaaaagga

SEQ ID NO: 50211 - RNA, 384 nt, Artificial Sequence
  derived and/or modified sequence opt6 from anti-HIV_Chain
caaguacaacuaguacaaucaggagcagaaguaaaaaaaccaggaucaucaguaaaaguaucaugcaaagcaucaggaggaacacuaagcucauacacaauaucauggguaagacaagcaccaggacaaggacuagaauggaugggaagacuaauaccacuaguagacauaacaacauacgcacaaaaauuccaaggaagaguaacaauaacagcagacacaucaacaaacacagcauacauggaauuaucaaaccuaagaucagaagacacagcaauauaccacugcgcaacaagcacaaugauagcagcaguaauaaacgacgcauucgaccuauggggacaaggaacaacaguaacaguaucaucagcaucaacaaaagga

SEQ ID NO: 50212 - RNA, 384 nt, Artificial Sequence
  derived and/or modified sequence opt6 from anti-HIV_Chain
caaguacaauuaguacaaaguggagcagaaguaaaaaaaccaggagcaaguguaaaaauaaguuguaaagcaaguggauauaguuuuagaaauuaugcaguacauuggguaagacaagcaccaggacaaggauuagaauggaugggagaaauaaauggaggaaauggaaauacagaauauagucaaaaaagucaaggaagacuaacaauaacaagggauauaagugcaacaacagcauauauggaauuaaguaguuuaagaagugaugauacagcaguauauuauugugcaagaguagcauauguacauguaguaacaacaagaagcuuagauaauuggggacaaggaacauuaguaacaguaaguagugcaaguacaaaagga

SEQ ID NO: 50213 - RNA, 384 nt, Artificial Sequence
  derived and/or modified sequence opt6 from anti-HIV_Chain
caaguaagauuaagucaaaguggagcagcaguaaugaaaacaggagcaaguguaacaauaaguugugaaacagaaggauuuaauuuuguaaauuauauaauacauuggguaagaagaccaccaggaagaggauuugaaugguuaggaaugauagauccaagaaauggacauccaugguuugcacaaacaguaagaggaagauuaagucuaagaagagauacauuuaaugaaauaguauauaugacauuaaguggauuaacaacagaugauacaggauuauauuuuugugcaagaaaugaaccacaauaucauagucuaccaggaauguuugauuauuggggacaaggaacaccaguaacaguaaguagcgcaagcacaaaagga

SEQ ID NO: 50214 - RNA, 384 nt, Artificial Sequence
  derived and/or modified sequence opt6 from anti-HIV_Chain
caaguaagauuaucacaaucaggagcagcaguaguaaaaacaggagcaucaguaacaauaucaugcgaaacagaaggauauaacuuuguaaauuacauaauacauuggguaagaagaccaccaggaagaggauuugaaugguuaggaaugauagacccaagaaauggacauccaugguucgcacaaacaguaagaggaagacuaucacuaagaagagauacauuuaaagaaacaguauacaugacauuaagcggacuaacaagcgaugacacaggaguguacuuuugcgcaagaaaugaaccacaauaucacucacuaccaggaauguucgauuacuggggacauggaacaccaguaacaguaaguucagcaucaacaaaagga

SEQ ID NO: 50215 - RNA, 384 nt, Artificial Sequence
  derived and/or modified sequence opt6 from anti-HIV_Chain
caaggacaauuaguacaaaguggaggaggaguaaaaaaacuaggaacaaguguaacaauaagcugucuagcaagugaauauacauuuaaugaauuuguaauacacuggauaagacaagcaccaggacaaggaccauuaugguuaggauuaauaaaaagaucaggaagacuaaugacaucauaccaauuccaagacagacuaagccuaagaagagauagaucaacaggaacaguauucauggaauuaagaggauuaagaguagaugacacagcaguauauuauugcgcaagagauggauuaggagaaguagcaccagcauaccuauacggaauagaugcauggggacaaggaacaacaguaauaguaacaucagcaaguacauca

SEQ ID NO: 50216 - RNA, 384 nt, Artificial Sequence
  derived and/or modified sequence opt6 from anti-HIV_Chain
caaguacaauuaguacaaagcggagcagaaguaaaaaaaccaggagcaagcguaaaaguaaguuguaaagcaaguggauauacauuuacaaguuaugauauaaauuggguaagacaagcaacaggacaaggauuagaauggaugggauggaugaauccaaauaguggaaauacaggauaugcacaaacauuucaaggaagaguaacaaugacaagaaauacaaguauaagcacagcauauauggaauuaucaaguuuaagaucagaagauacagcaguauauuacugugcaagagacagaugguuaccacaauauuauuauuauggaauggauguauggggacaaggaacaacaguaacaguaucaagugcaagcacaaaagga

SEQ ID NO: 50217 - RNA, 384 nt, Artificial Sequence
  derived and/or modified sequence opt6 from anti-HIV_Chain
caaguacaauuaguacaaucaggagcagaaguaaaaaaaccaggaagcucaaugaaaguaucaugcaaaagcucaggaggaacauuuagcaaucacgcaauaucauggguaagacaagcaccaggaaaaggauuagaauggaugggaggaauaauaccaaugucaggaacaacaaauuacuuacaaaaauuccaaggaagaguaacaauaacagcagaugaauuugcaacaacagcauacauggaauuaagcucacuaacaagcgaagacacagcaguauacuauugcgcaagagcaagagcagacucacacacaccaauagacgcauucgauauauggggaccaggaacaagaguaauaguaagcucagcaucaacaaaagga

SEQ ID NO: 50218 - RNA, 384 nt, Artificial Sequence
  derived and/or modified sequence opt6 from anti-HIV_Chain
caaguacaacuaguacaaaguggagcagaaguaaaaaaaccaggagcaaguguaaaaguaaguuguaaaguaaguggauauacauuaacagaauuaaguauacauuggguaagacaagcaccaggaaaaagauuagaauggaugggaggauuugauccagaagacggagaaagaauauaugcacaaaaauuucaaggaagaguaacaaugacagaagauacaaguacagauacagcauauauggaauuaaauagcuuaagaucagaugauacagcaguauauuacugugcaacaggaggauuauauuguucaaguauaaguuguauaauggauguauggggacaaggaacaacaguaacaguaucaagugcaaguacaaaagga

SEQ ID NO: 50219 - RNA, 384 nt, Artificial Sequence
  derived and/or modified sequence opt6 from anti-HIV_Chain
caaguacaauuaguacaaagcggagcagaaguaaaaaugccaggagcaaguguaaaaguaagcuguaaaguaagcggauacucacuaacagaauuaagcauacacuggguaagacaagcaccaggaaaaagacuagaauggaugggaggauucgauccagaagacgaugaaagaauauaugcacaaaaauuucaagauagaguaacaaugacagaagacacaagcacagacacagcauauauggaucuaaauagcuuaagaucagaagauacagcaguauauuacuguacaacaggaggacuauauugcucaaguauaagcuguauaauggacguauggggacaaggaacaacaguaauaguaucaagcgcaaguacaaaagga

SEQ ID NO: 50220 - RNA, 387 nt, Artificial Sequence
  derived and/or modified sequence opt6 from anti-HIV_Chain
gaaguacaauuaagugaaaguggaggaggauuuguaaaaccaggaggaaguuuaagauuaaguugugaagcaaguggauuuacauuuaauaauuaugcaaugaguuggguaagacaagcaccaggaaaaggauuagaauggguaaguguaacaagugcacauggaggaagugcauauuauggagaauuuguaaaaggaagauuuacaaugaguagagaucauuuuauagauacaguauauuuagaaaugaauggauuaacaguagaagauacagcaguauauuauuguguaagaguaacauuuuaucaugaaggaaguggauauuauuauagagcaggaaauuacuuugauaguuggggaaaaggaacaagaguaguaguaagugca

SEQ ID NO: 50221 - RNA, 387 nt, Artificial Sequence
  derived and/or modified sequence opt6 from anti-HIV_Chain
gaaguacaauuaagugagaguggaggaggauuuguaaaaccagggggaaguuuaagauuaaguugugaagcaaguggauuuacauuuaauaauuaugcaaugaguuggguaagacaagcaccaggaaaaggauuagaauggguaaguguaacaagugcacauggaggaagugcauauuauggagaauuuguaaaaggaagauuuacaaugaguagggaucauuuuauagauacaguauauuuagaaaugaauagauuaacaguagaagauacagcaguauauuauuguguaagaguaacauuuuaucaugaaggaaguggauauuauuauagagcaggaaauuauuuugauaguuggggaaaaggaacaagaguaguaguaagugca

SEQ ID NO: 50222 - RNA, 387 nt, Artificial Sequence
  derived and/or modified sequence opt6 from anti-HIV_Chain
gaaguacaauuaagugaaagugggggaggaguaguaaaaccaggaggaaguuuaagauuaagcugugaagcaagcggauuuacauuuaguaauuaugcaaugaguuggguaagacaagcaccaggaaaaggauuagaauggguaaguguaacaggaggacauggaacauauggauauuauggagaauuuguaaaaggaagauuuacaauaaguagagaucauagcauggauacaguauauuuacaaaugaauagauuaagaguagaagauacagcaguauauuauuguguaagaacaccauauuaucaugaaaguaguggauauuauuauagagcaggaaauuauuuugauuuuuggggaaaaggaacauuaguaauaguaagugca

SEQ ID NO: 50223 - RNA, 387 nt, Artificial Sequence
  derived and/or modified sequence opt6 from anti-HIV_Chain
gaaguacaauuaagugaaaguggaggaggauuuguaaaaccaggaggaaguuuaagauuaaguugugaagcaaguggauuuacauuuaauaauuaugcaaugggauggguaagacaagcaccaggaaaaggauuagaauggguaaguguaacaagugcacauggaggaagcgcauauuuuggagaauuuguaaaaggaagauuuacaaugaguagagaucauuuuauagauacaguauauuuagaaaugaauagauuaacaguagaagauacagcaguauauuauuguguaagaguaacauuuuaucaugaaggaaguggauauuauuauagagcaggaaauuauuuugauaguuggggacaaggaacauuaguaauaguaagugca

SEQ ID NO: 50224 - RNA, 387 nt, Artificial Sequence
  derived and/or modified sequence opt6 from anti-HIV_Chain
caaguacaauuaguagaaaguggaggaggauuaguacaaccaggaggaaguuuaagauuaaguugugcagcaaguggauuuacauuuaguacacauuggaugcauuggguaagacaagcaccaggaaaaggauuaguauggguaagcagaauacauagugauggaagaaguacaaguuaugcagauaguguaaaaggaagauuuacaauaaguagagauaaugcaaaaaauacauuauauuuacaaaugaauagcuuaagagcagaagauacagcaguauauuauugugcaagaggagcagcaguauuuggaguaguaauaauaggaggaauggauuuauggggacaaggaacaacaguaacaguaagcagugcaaguacaaaagga

SEQ ID NO: 50225 - RNA, 387 nt, Artificial Sequence
  derived and/or modified sequence opt6 from anti-HIV_Chain
caaguacaauuaguagaaagcggaggagcauugguacaaccaggaggaagccuaagauuaaguugugcagcaagcggauucucauucucaagcuaugcaaugagcuggguaagacaagcaccaggaaaaggacuagaauggguaagcgcaauaucaagaucaggaggaagcacauacuaugcagauaguguaaaaggaagauuuacaauaagcauagacaauaguaauaacacacuauaucuacaaaugaauagcuuaagaguagaagauacagcaguauauuacugugcaaaaagagaagcauuuuauuauggagcaggaggauacggaauggaugucuggggacaaggaacaacaguaacaguaagcucagcaucaacaaaagga

SEQ ID NO: 50226 - RNA, 387 nt, Artificial Sequence
  derived and/or modified sequence opt6 from anti-HIV_Chain
uuucaaggacacuuaguacaaagcggaggcggaguaaaaaaaccaggaacaaguguaacauuaaguugucuagcaagcgaauacacauucacagaauuuacaauacacuggauaagacaagcaccaggacaaggaccauuaugguuaggauuaauaaaaagaucaggaagacuaaugacaucauacagauuccaagacagacuaucauuaagaagagauagaucgacaggaacaguauucauggaauuaagaucacuaagaacagaugacacagcaguauacuauugcgcaagagauggauuaggagaacuagcaccagcauaccauuacggaauagaugcauggggacaaggaacaacaguaauaguaacaucagcaucaacauca

SEQ ID NO: 50227 - RNA, 387 nt, Artificial Sequence
  derived and/or modified sequence opt6 from anti-HIV_Chain
caaggacuauuaguacaaagcggaggaggaguaaaaaaauuaggaacaagcguaacaauaagcugucuagcaagugaauacacauucaaugaauuuguaauacacuggauaaggcaagcaccaggacaaggaccauuaugguuaggauuaauaaaaagaucaggaagacuaaugacaucauaccaauuccaagacagauuaucacuaagaagagauagaucaacaggaacaguauucauggaauuaagaggacuaagagucgaugacacagcaguauacuauugcgcaagagauggauuaggagaaguagcaccagcauacuuauacggaauagaugcauggggacaaggaacaacaguaauaguaacaucagcaucaacaaaagga

SEQ ID NO: 50228 - RNA, 387 nt, Artificial Sequence
  derived and/or modified sequence opt6 from anti-HIV_Chain
aacuucaugcuaacacaaccagcaucaguaucaggaucacccggacaaucaauaacaaucucaugcucaggaacaggaucagacauaggaguauacaacuacguaucaugguaccaacaacacccaggaaaagcaccaagacuaaugauauacgacguaacaaacagaccauccggaguaucaaacagauucucaggaucaaaaucaggauucacagcaucacuaacaauaucaggacuacaaggagacgacgaagcagacuacuacugcucaucauacucaucaacaaacacauacguauucggaacaggaacacacgucacaguacuaggacaaccaaaagcaaacccaacaguaacacuauucccaccaucaucagaagaacua

SEQ ID NO: 50229 - RNA, 387 nt, Artificial Sequence
  derived and/or modified sequence opt6 from anti-HIV_Chain
caaucagcacuaacacaaccaagaucaguaucaggaucaccaggacaaucaguaacaauaucaugcacaggaacaucaucagacguaggagcauacaacuacguaagcugguacagacaacacccaggaaaagcaccaaaacuaaugauaaacgacguaucaaaaagaccaucaggaguaccagacagauucucaggaucaaaaucaggaaacacagcaucacuaacaauaagcggacuacaagcagaagacgaagcagacuacuacugcugcucauacgcaggaacauacucauacguauucggaacaggaacaaaaguaacaguauuaggacaaccaaaagcaaacccaacaguaacacuauucccaccaucaucagaagaacua

SEQ ID NO: 50230 - RNA, 387 nt, Artificial Sequence
  derived and/or modified sequence opt6 from anti-HIV_Chain
caaggacaauuaguacaaagcggaggaggacuaaaaaaaccaggaacaagcguaacaauaagcugucuagcaagugaauacacauucaaugaauuuguaauacacuggauaagacaagcaccaggacaaggaccauuaugguuaggauuaauaaaaagaucaggaagauuaaugacagcauacaauuuccaagacagauuaucacuaagaagagauagaucaacaggaacaguauucauggaauuaagaggauuaagaccagaugacacagcaguauacuauugcgcaagagauggauuaggagaaguagcaccagauuacagauacggaauagauguauggggacaaggaaguacaguaauaguaacagcagcaucaacaaaagga

SEQ ID NO: 50231 - RNA, 387 nt, Artificial Sequence
  derived and/or modified sequence opt6 from anti-HIV_Chain
aacuucauguuaacacaaccaccaucagcaucaggagcaccaggacaaagaguaacaauaucaugcucaggaggaccaucaaacguaggaggaaacuacguauacugguacagacaauucccaggcacagcaccaaacuuacuaauacuaagagacgaccaaagaccaucaggaguaccagacagauuuucagcaucaaaaucaggaaauucagcaucacuagcaauaucaggacuaagaccagacgacgaagcauucuacuucugcgcaacauacgacucagacggaucaauaagacuauucggaggaggaacaacauuaacaguacuaucacaaccaaaagcagcaccaucaguaacacuauucccaccaucaucagaagaacua

SEQ ID NO: 50232 - RNA, 387 nt, Artificial Sequence
  derived and/or modified sequence opt6 from anti-HIV_Chain
caauuaguacuaacacaaccaccaucaguaucaggagcaccaggacaaagaguaacaauaucaugcucaggaggaccaucaaacguaggaggaaaccuaguauacugguacaaacaauucccaggaacagcaccaaaacuacuaauaagaagagacgaccaaagaccauccggaguaccagacagauucucaggaucaaaaucaggaaacucagcaucacuaacaauaucaggacuaagaccagacgacgaagcauucuacuucugcgcaacauacgacagccaaggaucaacaagacuauucggaggaggaacaguacuaacaguacuaucacaaccaaaagcagcaccaucaguaacauuauucccaccaucaucagaagaacua

SEQ ID NO: 50233 - RNA, 387 nt, Artificial Sequence
  derived and/or modified sequence opt6 from anti-HIV_Chain
aacuucaugcuaacacaaccaccaucaguaucaggagcaccaggacaaagaguaacaauaucaugcucaggaggaccaucaaacguaggaggaaaccuaguauacugguacaaacaauucccaggaacagcaccaaaacuacuaauaagaagagacgaccaaagaccaucaggaguaccagacagauucucaggaucaaaaucaggaaacucagcaucauuagcaauaucaggacuaagaccagacgacgaagcauucuacuucugcgcaacauacgacucacacggaucaauaagacuauucggaggaggaacacuacuaacaguacuaucacaaccaaaagcagcaccaucaguaacacuauucccaccaucuucagaagaauua

SEQ ID NO: 50234 - RNA, 387 nt, Artificial Sequence
  derived and/or modified sequence opt6 from anti-HIV_Chain
caaagcgcacuaacaagaacaccaucaguaucaggagcaccaggacaaagaguaacaauaucaugcucgggaggaccaucaaacguaggaggaaacuauguauauugguaucaacaauucccaggagcagcaccaaaauuauuaauaagaagagacgaucaaagaccaucaggaguaccagauagauuuaguggaagcaaaagcggaaacucagcaucacuagcaauaucaggauuaagauuagacgaugaagcauacuauuucugugcaacauacgauagcggauggucaauaagacuauuuggaggaggaacaagauuaacaguacuaucacaaccaaaagcagcaccaagcgugacauuauucccaccaucaagugaagaauua

SEQ ID NO: 50235 - RNA, 387 nt, Artificial Sequence
  derived and/or modified sequence opt6 from anti-HIV_Chain
caaucagcacuaacacaacccccaucaguaucagcaacaccaggacaaacaguaacaauaucuugcucaggaucaggaucaaacguaggaggaaaccacguauacugguacagacaacuaccaggagcagcaccaacacuacuaauaucaaaaacagaccacagaccaucaagaguaccagacagauucucagcaucaaaaucaggaaacucagcaucacuagcaauaucaggauuaagaccagacgacgaagcaauauacuucugcgcaacauacgacacaggacuauccuuaagacuauucggaggaggaacaagauuaacaguacuaucacaaccaaaagcagcaccaagcguaacacuauucccaccaucaucagaagaacua

SEQ ID NO: 50236 - RNA, 387 nt, Artificial Sequence
  derived and/or modified sequence opt6 from anti-HIV_Chain
caaguacaauuacuagaaucaggaccaggauuaguaacaccaucaggaacauuaucauuagcaugcgcaguaucaggagcaaguauaaguucaagucauugguggacauggguaagacaaucaccaggaaaaggauuagaauggauaggagaaauagacagaagaggaacaacaaauuauaauccaucauuaagaagcagaguaacaauauuauuagauaauaguaaaaaucaauuuucauuaaguuuaagaucaguaacagcagcagacacagcaguauauuauuguacaaaaguauacgcaggauuauuuaaugaaagaacauauggaauggacguauggggacacggaacaacaguauuaguaucaagugcaaguacaaaagga

SEQ ID NO: 50237 - RNA, 387 nt, Artificial Sequence
  derived and/or modified sequence opt6 from anti-HIV_Chain
caagcaguaguaacacaaccaccaucaguaucagcaacaccaggacaaacaguaacaauaucaugcucaggaucaggaucaaacguaggaggaaaccacguauacugguacagacaacuaccaggagcagcaccaacacuauuaauaucaaaaacaaaccgaagaccaucacaaguaccagacagauucucaggaucaaaaucaggaaacucagcaucacuagccauaucaggacuaagaccagacgacgaagcagacuacuucugcgcaacauacgacacagaccuaucacuaagacuauucggaggaggaacaagacuaacaguacuaucacaaccaaaagcagcaccaucaguaacacuauucccaccaucaucagaagaauua

SEQ ID NO: 50238 - RNA, 387 nt, Artificial Sequence
  derived and/or modified sequence opt6 from anti-HIV_Chain
caaucagcacuaacacaaccaccaucaguaucaggaacaccaggacaaaacguaacaauaucaugcucaggaggaggaucagacguaggaggaaaccuaguaucaugguaccaacacuucccaggagcagcaccaaaacuacuaauacacagagacaaccaaagaccaucaggaguaccagacagauucucagcacuaaaaucaggaaacucagcaucacuagcaauaucaggcuuaagaucagacgacgaagcauucuacuucugcgcaguauacgacucaucauuaucauuaggacuauucggaggaggaacaaaacuaacaguauuaucacaaccaaaagcagcaccaucaguaacauuauucccaccaucaucagaagaacua

SEQ ID NO: 50239 - RNA, 387 nt, Artificial Sequence
  derived and/or modified sequence opt6 from anti-HIV_Chain
caaucagcacuaacacaaccaccaucagcaucaggaacaccaggacaaagaguaacaauaucaugcucaggaggaggaucaaacauaggaggaaaccuaguaucaugguaccaacacuucccaggaacagcaccaaaacuacuaauauacagaaacgaccaaagaccaucuggaguaccagacagauucucaggaucaaaaucaggaacaucagcaucacuaacaauaucaggacucagaucagacgacgaagcaacauacuucugcgcagcauacgacucaucacuaucauuaagauuauucggaggaggaacaacacuaaacguacuaucacaaccaaaagcagcaccaucaguaacacuauucccaccaucaucagaagaacua

SEQ ID NO: 50240 - RNA, 387 nt, Artificial Sequence
  derived and/or modified sequence opt6 from anti-HIV_Chain
caaucagcauuaacacaaccaccaucaguaucagcaacaccaggacaaacaguaacaauaucaugcucaggaucaggaucaaacguaggaggaaaccacguauacugguacagacaacuaccaggagcagcaccaacacuauuaauaucaaaaacaaaccacagaccaucccaaguaccagacagauucucagcaucaaaaucaggaaacucagcaucacuagcaauaucaggacuaagaccagacgacgaagcagacuacuucugcggaacauacgacacaucacuaucacuaagacuauucggaggaggaacaagacuaacaguacuaucacaaccaaaagcagcaccaucaguaacauuauucccaccaucaucagaagaacua

SEQ ID NO: 50241 - RNA, 387 nt, Artificial Sequence
  derived and/or modified sequence opt6 from anti-HIV_Chain
caaucaguacuaacacaaguacuuucaguaucaggaacaccaggacaaagaguaauaaucucaugcucaggaacaucaucaaacguaggaggaaaccuaguaucaugguaucaacaccuaccaggagcagcaccaagacuacuaauacacagagacgaccaacgaccaucaggaguaccagacagauucucaggaucaaaaucaggaaacucagcaagucuaguaauaucaggacuaagaucagacgacgaagcagacuacuucugcggagcauacgacucaacauucucacuaccaguauucggaggaggaacaagacuaacaguacuaucacaaccaaaagcagcaccaucaguaacauuauucccaccaucaucagaagaauua

SEQ ID NO: 50242 - RNA, 387 nt, Artificial Sequence
  derived and/or modified sequence opt6 from anti-HIV_Chain
caaucagcacuaacacaaccacccgcaacaucaggaacaccaggacaaagaguaacaauaucaugcucaggaggaggaucaaacguaggaggcaacuuaguaucaugguaccaacaauucccaggagcagcaccaaaacuaauacuacacagagacggacaaagaccaucuggaguaccagacagauucucagcaucaaaaucaggaacaucagcaucacuaacaauaucaggacuaagaucagacgacgaagcaacauacuuuugcgcagcauucgacucagcacuaucacuaccauuauucggaggaggaacaaaauuaacaguacuaucacaaccaaaagcagcaccaucaguaacacuauucccaccaucaucagaagaacua

SEQ ID NO: 50243 - RNA, 387 nt, Artificial Sequence
  derived and/or modified sequence opt6 from anti-HIV_Chain
caauuaguacuaacacaaccaccaucaguaucagcaacaccaggacaaacaguaacaauaucaugcucaggaucaggaucaaacguaggaggaaaccauguauacugguauagacaacuaccaggagcagcaccaacauuaguaauaucaaaaacagaccacagaccaucaagaguaccagacagauucucaggaaguaaaucagguaacucagcaucacuagcaauaucaggacuaagaccagacgacgaagcagcauauuucugcgcaacauacgacacaggacuaucacuaagacuauuuggaggcggaacaagacuagcaguauuaucacaaccaaaagcagcaccaucaguaacacuauucccaccaucaucagaagaauua

SEQ ID NO: 50244 - RNA, 387 nt, Artificial Sequence
  derived and/or modified sequence opt6 from anti-HIV_Chain
caaucagcauuaacacaaccaccaucaguauccggaacaccaggacaaaacguaacaauaucaugcucaggaggaggaucaaacguaggaggaaaccuaguaucaugguaucaacauuucccaggagcagcaccaaaauuacuaauacacagagacaaccaaagaccaucuggaguaccagacagauucucaguacuaaaaucaggaaacucagcaucacuagcaauaucaggaccaagaucagacgacgaagcauucuauuucugcgcaguauacgacagcucacuaucauuaggacuauucggaggaggaacaaaacuaacaguacuaucacaaccaaaagcagcaccaucaguaacacuauucccaccaucaucagaagaacua

SEQ ID NO: 50245 - RNA, 387 nt, Artificial Sequence
  derived and/or modified sequence opt6 from anti-HIV_Chain
caaacaguaguaacacaaccaccaucagcaucaggaacaccaggacaaagaguaacaauaucaugcuccggaggaggaucaaacauaggaggaaaccuagucucaugguaccaacacuucccaggagcagcaccaaaacuacuaauauacagaaacgaccaaagaccaucaggaguaccagacagauucucaggaucaaaaucaggaacaucagcaucacuaacaauaucaggacuaagaucagacgacgaagcaacauacuucugcgcagcauacgacugcacauuaucacuaagacuauucggaggaggaacaacauuaaacguacuaucacaaccaaaagcagcaccaucaguaacacuauucccaccaucaucagaagaauua

SEQ ID NO: 50246 - RNA, 387 nt, Artificial Sequence
  derived and/or modified sequence opt6 from anti-HIV_Chain
caaagcgcauuaacacaaacaccaucaguaucaggagcaccaggacaaagaguaacaauaucaugcucaggaggaccaucaaacguaggaggaaacuauguauauugguaucaacaauucccgggagcagcaccaaaauuacuaauaagaagagacgaucaaagaccaucaggaguaccagauagauuuagcggaagcaaaagcggaaacucagcaucacuagcaauaucaggauuaagauuagacgaugaagcauacuauuucugugcaacauacgauagcggauggucaauaagacuauuuggaggaggaacaagauuaacaguacuaucacaaccaaaagcagcaccaagcguaacauuauucccaccaucaagcgaagaauua

SEQ ID NO: 50247 - RNA, 387 nt, Artificial Sequence
  derived and/or modified sequence opt6 from anti-HIV_Chain
caaucaguacuaacacaaccaccaucagcaucaggagcaccaggacaacgaguaacaauaucaugcucaggaggaccaucaaacguaggaggaaacuacguauacugguacagacaauucccaggaacagcaccaaauuuauuaauacuaagagacgaccaaagaccaucaggaguaccagacagauuuucagcaucaaaaucaggaaacucagcaucacuagcaauaucaggauuaagaccagacgacgaagcauucuacuucugcgcaacauacgacucagacggaucaguaagacuauucggaggaggaacaacauuaacaguacuaucacaaccaaaagcagcaccaucaguaacauuauucccaccaucaaacggaggaaga

SEQ ID NO: 50248 - RNA, 387 nt, Artificial Sequence
  derived and/or modified sequence opt6 from anti-HIV_Chain
caaggacaauuaguacaaagcggaggaggaguaaaaaaaccaggaacaaguguaacaauaagcugucuagcaagcgaauacacauucaaugaauuuguaauacacuggauaagacaagcaccaggacaaggaccauuaugguuaggauuaauaaaaagaucaggaagauuaaugacaucauacaaauuccaagacagacuaaaucuaagaagagauagaucaacaggaacaguauucauggaauuaagaggauuaaggccagaugacacagcaguauacuauugcgcaagagauggauuaggagaaguagcaccagauuacagauacggaauagauguauggggacaaggaucaacaguaauaguaacagcagcaucaacaaaagga

SEQ ID NO: 50249 - RNA, 387 nt, Artificial Sequence
  derived and/or modified sequence opt6 from anti-HIV_Chain
gaaguacaauuaguagaaaguggagcagaaguaaaaaaaccaggagcaaguguaaaaguagcauguaaaguaaguggaaaaaaauuaagugauuuaaguauacauuggguaagacaagcaccaggaaaaggacuagaauggaugggaggauuugaugaagaagauggaaaaauaaguuaugaaagaaaauuucaaggaagaguaacaaugacagaagauacagcaagagauacagcauuuauggaaaugaguagucuaagaagugaugauacagcaguauauuuuugugcagcagcaccaagacuagauuuaggagaauuaagcaguggauuucauuuuuggggauuaggaacauuaguaaguguaaguagugcaaguacaaaagga

SEQ ID NO: 50250 - RNA, 387 nt, Artificial Sequence
  derived and/or modified sequence opt6 from anti-HIV_Chain
caaggacaacuaguacaaaguggaggaggaggaaaaaaacuaggaacaaguguaacaauaaguuguuuagcaagugaauauacauuuaaugaauuuguaauacauuggauaagacaagcaccaggacaaggaccauuaugguuaggauuaauaaaaagaaguggaagauuaaugacaagcuaucaauuucaagauagauuaaguuuaagaagagauagaaguacaggaacaguauuuauggaauuaagaggauuaagaguagaugauacagcaguauauuauugugcaagagauggauuaggagaaguagcaccagcauauuuauauggaauagaugcauggggacaaggaacaacaguaauaguaaguagugcaaguacaaaagga

SEQ ID NO: 50251 - RNA, 387 nt, Artificial Sequence
  derived and/or modified sequence opt6 from anti-HIV_Chain
gaaguacaauuaguagaaaguggagcagaaguaaaaaaaccaggagcaaguguaaaaguaaguuguaaaguaaguggauauacauuaagcgauuuaaguaugcauuggguaagacaagcaccaggaaaaggacuagaauggaugggaggauuugaugaagaagauggagaaauaacauaugcacaaaaauuucaaggaagaguaaguaugacagaagauacaaguagagauacagcauauauggaauuaaguaguuuaagaagugaagauacagcaguauauuauugugcaacagcaccaagauuagaauuaggagaauuaaguaguggauuucauuauuggggauuaggaacauuaguaacaguaaguagugcaaguacaaaagga

SEQ ID NO: 50252 - RNA, 387 nt, Artificial Sequence
  derived and/or modified sequence opt6 from anti-HIV_Chain
caaggacaauuaguacaaagcggaggaggaguaaaaaaaacaggaacaagcguaacaauaagcugucuagcaagcgaauacacauucacagaauuuacaauacacuggauaagacaagcaccaggacaaggaccauuaugguuaggauuaauaaaaagaucaggaagacuaaugacagcgaacagauuccaagacagacuaagucuaagaagagauagaucaacaggaacaguauucauggaauuaagaucacuaaggauagaugacacagcaguauacuauugcgcaagagauggauuaggagaacuagcaccagcauaccauuacggaauagauguauggggacaaggaacaacaauaauaguaacaucagcaucaacaaaagga

SEQ ID NO: 50253 - RNA, 387 nt, Artificial Sequence
  derived and/or modified sequence opt6 from anti-HIV_Chain
caaggacaauuaguacaaaguggaggaggaguaaaaaaauuaggaacaaguguaacaauaaguuguuuagcaagugaauauacauuuaaugaauuuguaauacauuggauaagacaagcaccaggacaaggaccauuaugguuaggauuaauaaaaagaagcggaagauuaaugacaaguuaucaauuucaagauagauuaaguuuaagaagagauagaaguacaggaacaguauuuauggaauuaagaggauuaagaguagaugauacagcaguauauuauugugcaagagauggauuaggagaaguagcaccagcauauuuauauggaauagaugcauggggacaaggaacaacagugauaguaacaagugcaaguacaaaagga

SEQ ID NO: 50254 - RNA, 387 nt, Artificial Sequence
  derived and/or modified sequence opt6 from anti-HIV_Chain
caaggacaauuaguacaaagcggaggaggaguaaaaaaauuaggaacaaguguaacaauaccauguuuagcaagugaauauacauuuaaugaauuuguaauacauuggauaagacaagcaccaggacaaggaccauuaugguuaggauuaauaaaaagaaguggaagauuaaugacaagcuaucaauuucaagauagauuaaguuuaagaagagauagaaguacaggaacaguauuuauggaauuaagaggauuaagaguagaugauacagcaguauauuauugugcgagagauggauuaggagaaguagcaccagcauaucuauauggaauagaugcauggggacaaggaacaacaguaauaguaacaagugcaaguacaaaagga

SEQ ID NO: 50255 - RNA, 387 nt, Artificial Sequence
  derived and/or modified sequence opt6 from anti-HIV_Chain
caaggacaauuaguacaaagcggaggaggaguaaaaaaaccaggaacaagcguaacaauaagcugucuagcaagcgaauacacauucaaugaauuuguaauacacuggauaagacaagcaccaggacaaggaccaguaugguuaggauuaauaaaaagaucaggaagauuaaugacaucauacaaauuccaagacagacuaucacuaagaagagauagaucaacaggaacaguauucauggaauuaagaggacuaagacuagaugacacagcaguauacuauugcgcaagagauggauuaggagaaguagcaccagcauacuuauacggaauagaugcauggggacaaggaucaaaaguaauaguaacaccagcaucaacaaaagga

SEQ ID NO: 50256 - RNA, 387 nt, Artificial Sequence
  derived and/or modified sequence opt6 from anti-HIV_Chain
caagcaagacuagaucaauggggaacaggauuauuaaaaccaucagaaacacuaucauuaaaaugcgcaguauuuggaguacuauuuacagauuauaauuggacauggguaagacaaagcccaggaaaagaauuagaauggauaggacacuuagaccauagaggaggaggaaauuauaacccaucauuagaaagcagaguaacaauaaguuuagacuauagcaaagcacaauuuucauuacauuuaaaaaguguaacaguagcagauacagcaagauauuacugugcaggagcaguaaaaggauucugguuugaugacccauacacaugguuuggaccauggucacaaggaacauuaguaacaguagcaagugcaaguacaaaagga

SEQ ID NO: 50257 - RNA, 387 nt, Artificial Sequence
  derived and/or modified sequence opt6 from anti-HIV_Chain
caagcaagacuagaucaauggggaacaggauuauuaaaaccaucagaaacauuaucauuaaaaugcgcaguauuuggaguauuauuuacagauuauaauuggacauggguaagacaaagcccaggaaaaggauuagaauggauaggacacuuagaccauagaggaggaggaaguuauaacccaagucuagaaucaagaguaaguauaaguuuagacuauagcaaagcacaauuuucauuacauuuaaaaaguguaacaguagcagauacagcacuauauuacugugcaggagcaguaaaaggauucugguuugaugaaccaagcacaugguuuggaccauggucacaaggaacaaugguaacaguagcaagcgcaaguacaaaagga

SEQ ID NO: 50258 - RNA, 387 nt, Artificial Sequence
  derived and/or modified sequence opt6 from anti-HIV_Chain
caaggacauuuaguacaaaguggaggaggaguaaaaaaacuaggaacaucaguaacaauaaguuguuuagcaagcgaagauacauuuaaugaauuuguaauacauuggauaagacaagcaccaggacaaggaccauuaugguuaggauuaauaaaaagaaguggaagauuaaugacaaguuaucaauuucaagauagauuaaguuuaagaagagauagaaguacaggaacaguauuuauggaauuaagaggauuaagaguagaugauacagcaguauauuauugugcaagagauggauuaggagaaguagcaccagcauauuuauauggaauagaugcauggggacaaggaacaacaguaauaguaacaagugcaaguacaaaaggg

SEQ ID NO: 50259 - RNA, 387 nt, Artificial Sequence
  derived and/or modified sequence opt6 from anti-HIV_Chain
caaguacaauuaguacaaagcgaagcagaaguaaaaaaaccaggaucaagcguaaaaguaagcuguaaagcaagcggaggaacauucagaggauauacaauaagcuggguaagacaagcaccaggacaaggacuagaauggaugggaagaauaauaccaauacuaggaaaagcaauauaugcaccaagcuuucaaggaagaguaacauuaacagcagacaaaagcacaggaacagcauauauggaauuaucaagauuaagaucagacgauacagcaguauauuacugugcaaaaguaaaaaugagaggaucaagcggauacuauuacuuauucgaugacuggggacaaggaacacuaguaacaguaagcucagcaucaacaaaagga

SEQ ID NO: 50260 - RNA, 387 nt, Artificial Sequence
  derived and/or modified sequence opt6 from anti-HIV_Chain
caagcaagauuagaucaauggggaacaggauuauuaaaaccaagugaaacauuaaguuuaaaaugugcaguauuuggaguauuauuuacagauuauaauuggacauggguaagacaaaguccaggaaaaggauuagaauggauaggacauuuagaucauagaggaggaggaaauuauaauccaaguuuagaaaguagaguaacaauaaguuuagauuauaguaaagcacaauuuagcuuacauuuaaaaaguguaacaguagcagauacagcauuauauuauugugcaggagcaguaaaaggauuuugguuugacgaaguauauaauugguuuggaccauggagucaaggaacauuaguaacaguggcaagugcaaguacaaaagga

SEQ ID NO: 50261 - RNA, 387 nt, Artificial Sequence
  derived and/or modified sequence opt6 from anti-HIV_Chain
caaggacaauuaguacaaagcggaggaggaguaaaaaaaccaggaacaagcguaacaauaagcugucuagcaagcgaauacacauucacagaauuuacaauacacuggauaagacaagcaccaggacaaggaccauuaugguuaggauuaauaaaaagaaguggaagacuaaugacagcauacagauuccaagacagauuaucacuaagaagagauagaucaacaggaacaguauucauggaauuaagaaaucuaagaauggaugacacagcaguauacuauugcgcaagagauggauuaggagaacuagcaccagcauaccaauacggaauagauguauggggacaaggaacaacaguaauaguaagcucagcaucaacaaaagga

SEQ ID NO: 50262 - RNA, 387 nt, Artificial Sequence
  derived and/or modified sequence opt6 from anti-HIV_Chain
caaguaagauuaguacaaaguggaccacaaguaaaaagaccaggagcaagcauaagauuaaguugugaaaguaguggauauagauuucaagauuauauaguagcauggauaagacaaacaagaggacaaggauuugaauuuguaggaaugguaaauccaagaggaggaagaccauggccaagcaguagauuuagagauagaguaacauuaacaagagauauagaaagugaaacauuuuauuuaggauuaaaugauuuaacaagugaugauacagcaacauauuuuugugcaagauuagaagcagauggaagugauuauucaccaaaaauguuugauuuuuggggacaaggaacaaaaauaguaguaaguccagcaaguacaaaagga

SEQ ID NO: 50263 - RNA, 387 nt, Artificial Sequence
  derived and/or modified sequence opt6 from anti-HIV_Chain
caaguaagauuaguacaaagcggaccacaaguaaaaacaccaggagcaagcaugagaguaagcugugaagcaagcggauacagauucuuagacuauauaauaguauggauaagacaaacacacggacaacauuucgaauacguaggaaugauaaauccaagaggaggaacaccauggccaagcucaaaauuuagagauagauuaucauuaacaagagacauacacacagacacauucuauuuaggacuaaauaacuuaggaagcgacgauacagcaauauauuucugugcaagacuagaagcagauggagaugacuauagcccaaaaauguucgaucacuggggacaaggaacaagaauaauaguaagcgcagcaucaacaaaagga

SEQ ID NO: 50264 - RNA, 387 nt, Artificial Sequence
  derived and/or modified sequence opt6 from anti-HIV_Chain
caaguaagauuaguacaaagcggaccacaaguaaaaacaccaggagcaagcauaagauuaagcugugaagcaaguggauacagauucuuagacuauuuuauaguauggguaagacaaacaccaggacaaggauucgaauacguaggaaugauaaauccaagaggaggaagaccauggucaaguuggaaauuuagagauagauuaaguuuaacaagagaaauagacacagacacauucuauuuaggacuaucaaacuuaagaucagacgauacagcaauauauuucugugcaagacuagaagcagauggagaugacuauaguccaaaaaugguagauuacuggggacaaggaacaaaaauaauaguaagcgcagcaucaacaaaagga

SEQ ID NO: 50265 - RNA, 387 nt, Artificial Sequence
  derived and/or modified sequence opt6 from anti-HIV_Chain
caaguaagauuaguacaaagcggaccacaagucaaaagaccaggagcgagcauaagauuaagcugugaaacaagcggauacagauuccaagacuauauaguagcauggauaaggcaaacaagaggacaaagauucgaauuuguaggaaugguaaauccaagaggaggaagaccauggccaagcucaaaauucagagauagaguaacauuaacaagagacauagaaucagaaacauuccaucuaggacuaaaugacuuaacaucagacgauacagcaacauauuucugugcaagauuagaagcagauggagcagacuauagcccaaaaauguucgauuucuggggacaaggaacaaaaauaguaguaaguccagcaucaacaaaagga

SEQ ID NO: 50266 - RNA, 387 nt, Artificial Sequence
  derived and/or modified sequence opt6 from anti-HIV_Chain
caaguaagauuaguacaaagcggaccacaaguaaaaacaccaggagcaagcaugagaauaagcugugaagcaagcggauacagauuccaagacuauauaauaguauggauaagacaaacacacggacaaggauucgaauacguaggaaugauaaauccaagaggaggaacaccauggucaagcucaaaauuuagagauagauuaucauuaacaagagacauauacacagacacauucuauuuaggacuaaauaacuuaggaagcgacgauacagcaauauauuucugugcaagacuagaagcagauggaggagacuauagcccaaaaauguucgauuacuggggacaaggaacaagaauaauaguaagcgcagcaucaacaaaagga

SEQ ID NO: 50267 - RNA, 387 nt, Artificial Sequence
  derived and/or modified sequence opt6 from anti-HIV_Chain
caaggacaauuaguacaaaguggaggaggaguaaaaaaaccaggagcaaguguaacaauaaguuguuuagcaagcgaauauacauuuaaugaauuuguaauacauuggauaagacaagcaccaggacaaggaccauuaugguuaggauuaauaaaaagaaguggaagauuaaugacagcauauaaauuucaagauagauuaucauuaagaagagauagaagcacaggaacaguauuuauggaauuaagaggauuaagaccagaagauacagcaguauauuauugugcaagagauggauuaggagaaguagcaccagauuauagauauggaauagauguauggggacaaggaaguacaguaauaguaagugcagcaaguacaaaagga

SEQ ID NO: 50268 - RNA, 387 nt, Artificial Sequence
  derived and/or modified sequence opt6 from anti-HIV_Chain
caaguaagauuaguacaaagcggaccacaaaugaaaacaccaggagcaucauuaagauuaagcugugaagugagcggauacagauucuuagacuauuucauaguauggguaagacaaacaggaggacaaggauucgaauacguaggaaugauaaauccaagaggaggaagaccauggagcagcuggaaauuuagagauagauuaucauuaacaagagacauagaaacagacacauucuauuuaggacuaaauaacuuaagaagcgacgauacagcaauauauuucugugcaagacuagaagcagauggagauaacuauaguccaaaaaugguagauuacuggggacaaggaacaaaaauaauaguaaguccagcaucaacaaaagga

SEQ ID NO: 50269 - RNA, 387 nt, Artificial Sequence
  derived and/or modified sequence opt6 from anti-HIV_Chain
caaguaaguuuaguacaaagcggaccacaaguaaaaacaccaggagcaagcaugagaguaaguugugaaacaaguggauacagauucuuagacuauauaauaguauggauaagacaaacacacggacaacauuucgaauacguaggaaugauaaauccaagaggaggaacaccauggccaagcucaaaauuuagagauagauuaacaaugacaagagacauacacacagacacauucuaucuaggacuaaauaauuuaagaucagacgauacagcaauauauuucugugcaagacuagaagcagauggagaugacuauagcccaaaaauguucgauuacuggggacaaggaacaagaauaauaguaagcgcagcaucaacaaaagga

SEQ ID NO: 50270 - RNA, 387 nt, Artificial Sequence
  derived and/or modified sequence opt6 from anti-HIV_Chain
caaguaagauuaguacaaagcggaccacaaguaaaaacagcaggagcaagcaugagaguaagcugugaagcaagcggauacagauuccuagacuauauaauaguauggauaagacaaacacacggacaacauuucgaauacguaggaaugauaaauccaagaggaggaacaccauggccaagcucaaaauuuagagauagauuaacauuaacaagagacauauacacagacacauucuaucuaggauuaaauaacuuaggaucaggagauacagcaauauauuucugugcaagauuagaagcagauggagaugacuauagcccaaaaauguucgauuacuggggacaaggaacaagaauaauaguaagcgcagcaucaacaaaagga

SEQ ID NO: 50271 - RNA, 387 nt, Artificial Sequence
  derived and/or modified sequence opt6 from anti-HIV_Chain
caaggacaauuaguacaaagcggaggaggaguaaaaaaaccaggaacaaguguaacaauaagcugucuagcaagcgaauacacauucaaugaauuuguaauacacuggauaagacaagcaccaggacaaggaccaguaugguuaggauuaauaaaaagaucaggaagacuaaugacaaguuacaaauuccaagacagacuaucacuaagaagagauagaucaacaggaacaguauucauggaauuaagaggacuaagacuagaugacacagcaguauacuauugcgcaagagauggauuaggagaaguagcaccagcauacuuauacggaauagaugcauggggacaaggaucaacaguaauaguaacaucagcaucaacaaaagga

SEQ ID NO: 50272 - RNA, 387 nt, Artificial Sequence
  derived and/or modified sequence opt6 from anti-HIV_Chain
caaggacaauuaguacaaagcggaggaggauuaaaaaaaccaggaacaagcguaacaauaagcugucuagcaagugaauacacauucaaugaauuuguaauacacuggauaagacaagcaccaggacaaggaccauuaugguuaggauuaauaaaaagaagcggaagacuaaugacagcauacaauuuccaagacagacuaagacuaagaagagauagaucaacaggaacaguauucauggaauuaagaggacuaagaccagaugauacagcaguauacuauugcgcaagagauggauuaggagaaguagcaccagauuacagauacggaauagauguauggggacaaggaucaacaguaauaguaacagcagcaucaacaaaagga

SEQ ID NO: 50273 - RNA, 387 nt, Artificial Sequence
  derived and/or modified sequence opt6 from anti-HIV_Chain
caaggacauuuaguacaaagcggaggaggaguaaaaaaauuaggaacaaguguaacaauaaguuguuuaguaagugaauauacauuuaaugaauuuguaauacauuggauaagacaagcaccaggacaaggaccauuaugguuaggauuaauaaaaagaaguggaagauuaaugacaagcuaucaauuucaagauagauuaaguuuaagaagagauagaaguacaggaacaguauuuauggaauuaagaggauuaagaguagaugauacagcaguauauuauugugcaagagauggauuaggagaaguagcaccagcauauuuauauggaauagaugcauggggacaaggaacaacaguaauaguaacaagugcaaguacaaaagga

SEQ ID NO: 50274 - RNA, 387 nt, Artificial Sequence
  derived and/or modified sequence opt6 from anti-HIV_Chain
caaggacaauuaguacaaaguggaggaggaguaaaaaaauuaggaacaaguguaacaauaaguuguuuagcaagugaauauacauuuaaugaauuuguaauacauuggauaagacaagcaccaggacaaggaccauuaugguuaggauuaauaaaaagaucaggaagauuaaugacaaguuaucaauuucaagauagauuaaguuuaagaagagauagaaguacaggaacaguauuuauggaauuaagaggauuaagaguagaugauacagcaguauauuauugugcaagagauggauuaggagaaguagcaccagcauaucuauauggaauagaugcauggggacaaggaacaacaguaauaguaagcagugcaaguacaaaagga

SEQ ID NO: 50275 - RNA, 387 nt, Artificial Sequence
  derived and/or modified sequence opt6 from anti-HIV_Chain
caaggacauuuaguacaaaguggaggaggaguaaaaaaauuaggaacaaguguaacaauaaguuguuuagcaagugaauauacauuuaaugaauuuguaauacauuggauaagacaagcaccaggacaaggaccauuaugguuaggauuaauaaaaagaaguggaagauuaaugacaaguuaucaauuucaagauagauuaaguuuaagaagagauagaaguacaggaacaguauuuauggaauuaagaggauuaagaguagaugauacagcaguauauuauugugcaagagauggauuaggagaaguagcaccagcauauuuauauggaauagaugcauggggacaaggaacaacaguaauaguaacaagugcaaguacaaaagga

SEQ ID NO: 50276 - RNA, 387 nt, Artificial Sequence
  derived and/or modified sequence opt6 from anti-HIV_Chain
caaguacaauuaguacaaagcggaagcgaauuaaaaaaaccaggagcaaguguaaaaguaagcuguaaagcaagcggauacacauucacaagcuaugcaauaaacuggguaagacaagcaccaggacaaggacuagaauggaugggauggauaaauacaaauacaggaaacccaacauaugcacaaggauuuacaggaagauuuguauuuagcuuagaaacaucaguaagcacagcauaucuacaaauaaauagcuuaaaagcagaagauacagcaguauauuacugugcaagagacuuacuagaaagcagaacauauuacaaugacauaagagauugcuggggacaaggaacacuaguaacaguaagcucagcaaguacaaaagga

SEQ ID NO: 50277 - RNA, 387 nt, Artificial Sequence
  derived and/or modified sequence opt6 from anti-HIV_Chain
caaguacaacuaguacaaucaggagcagaaguaaaaaaaccaggagcaucaguaaaaguaucaugcaaagcaucaggauacacauucacagacuacuacauacacuggguaagacaagcaccaggacaaggacuagaauggaugggauggauaaacccaucaacaggcggaacaaacuucguacaaaaauuccuaggaagaguaacaaugacaucagacacaucaauaaacacagcauacauggaacuaagaagacuaaaaaacgacgacgcagcaauauacuacugcgcaacauacucaacaagacaauucuuccacuacuacuacguaacagacguauggggacaaggaacaacaguaacaguaucaucagcaucaacaaaagga

SEQ ID NO: 50278 - RNA, 387 nt, Artificial Sequence
  derived and/or modified sequence opt6 from anti-HIV_Chain
uuucaaggacaauuaguccaaagcggaggaggaguaaaaaaaccaggaucaagcguaacaauaagcuguuuagcaagcgaauacacauucacagaauuuacaauacacuggauaagacaagcaccaggacaaggaccauuaugguuaggauuaauaaaaagaucaggaagacuaaugacaucauacggauuccaagacagacuaucaguaagaagagauagaucaacaggaacaguauucauggaauuaagaucacuaagaacagaugacacagcaguauacuauugcgcaagagauggauuaggagaacuagcaccagcauaccauuacggaauagauguauggggacaaggaacaacaguaauaguaacaucagcaucaacauca

SEQ ID NO: 50279 - RNA, 387 nt, Artificial Sequence
  derived and/or modified sequence opt6 from anti-HIV_Chain
caaguacaauuaguagaaagcggaggaggaguaguacaaccaggaagaaguuuaagauuaaguugugcagcaaguggauuuacauuuaguaguuaugcaaugcauuggguaagacaagcaccaggaaaaggauuagaauggguagcaguaauaaguuaugauggaucaaauaaauauuaugcagauaguguaaaaggaagauuuacaauaaguagagaugauaguaaaaguacaguauauuuacaaauaaauaguuuaagagcagcagauacagcaguauauuucugugcaagagaaggaggauuaagauuuuuagaaugguuauuuuggggacaaggaacauuaguaacaguaaguaguggagaaaguagugcaaguacaaaagga

SEQ ID NO: 50280 - RNA, 390 nt, Artificial Sequence
  derived and/or modified sequence opt6 from anti-HIV_Chain
caaguacaauuaguacaaagcggagcaguaguaaaaaguccaggaucaucagcaaaauuaagcugucgauuacuaggagacgaauuuggaacauauuucauaaguuggauaagacaagcaccaggaagaggacuagaauggguaggaggaauaguuccacauagucaacuacaaagcucagcacaaaaauuccauggaagauuuuucauaacaggaggaguaacaccaccaauaauauuucuacaacuaacaaacguaacauuugaagauacaggaacauauuucugugcaagagaaagaggaagacacagagacccaaaaacaggaaaaucauuaagaggaagauauuucgauuucuggggaagaggaacaggagugacaguaagucca

SEQ ID NO: 50281 - RNA, 390 nt, Artificial Sequence
  derived and/or modified sequence opt6 from anti-HIV_Chain
caaauagaauuaagacaaaguggagcagcaaugaaaaguccaggaaguaguguaaaauuaaguuguacaguacuaggagaaaauuucggaacauauuucauaagcuggauaagacaagcaccaggacaaggacuagaauggguaggaggaauaguaccacauagucaacuacaaagcagugcacaaaaauuucacggaagaauaaaaauaaguggaggaggaacaccaccaguaguaagucuagaauuaacaaauguaacauuugaugauacaggaacauauuucugugcaagagaaagaggaagacacguagaaccaaaaacaggagauagauuagcaggaagauauuuugauauauggggaagaggaacaggauuaagaguaagccca

SEQ ID NO: 50282 - RNA, 390 nt, Artificial Sequence
  derived and/or modified sequence opt6 from anti-HIV_Chain
gaaguacaauuaguagaaagcggaggaggauuaguaaaaccaggagggagccuaagauuaaguugugaagcaagcggauucacauucacaaacgcauggaugaacuggguaagacaagcaccaggaaaaggauuagaauggguaggaagaauaaaaagccaaacacauggaggaacaacaagauaugcagcaccaguaaaaggaagauuuacaauaagcagagacgauagcaaacacacacuauaucuacaaauggauagauuaacaacagaagauacagcaguauauuacuguacaggaacaauaacaggaaguacauucuauuacuauggaauggacguauggggacaaggaacaacaguaacaguaaguccagcaagcacaaaagga

SEQ ID NO: 50283 - RNA, 390 nt, Artificial Sequence
  derived and/or modified sequence opt6 from anti-HIV_Chain
guaguacaauuaguacaaucaggaccaggacuaguaaaacccucacaaacacuaucacuaacaugcacaguaucaggaggaucaauaucaucaggagacuucuacuggucauggauaagacaaccaccaggaaaaggacuagaauggauaggauacauauacuacucaggaucaacauacuacaacccaucacuaaaaucaagacuaacaauaucaguagacacaucaaaaaaccaauucucauuaagacuaucaucaguaacagcagcagacacagcaguauacuacugcgcaagagaccuaaacucaagaauaguaggagcacuagacgcauucgacauauggggacaaggaacaaugguaacaguaucaucagcaucaacaaaagga

SEQ ID NO: 50284 - RNA, 390 nt, Artificial Sequence
  derived and/or modified sequence opt6 from anti-HIV_Chain
gaaguacaauuaguacaaagcggaggaggauuaguacaaccaggaagaaguuuaagauuaaguugugcagcaaguggauuuacauuugaugauuaugcaaugcauuggguaagacaagcaccaggaaaaggauuagaauggguaaguggaauaaguuggaauaguggaacaauaggauaugcagauaguguaagaggaagauuuacaauaagcagagaugaugcaaaaaguaguuuauauuuacaaaugaauaguuuaagaacagaagauacagcauuauauuauugugcaaaagauggauggguaggaaguggaaguaguacauuaagaggaagugauuauuggggacaaggaacauuaguaacaguaaguagugcaaguacaaaagga

SEQ ID NO: 50285 - RNA, 390 nt, Artificial Sequence
  derived and/or modified sequence opt6 from anti-HIV_Chain
caaucaguauuaacacaaccaccaucagcaucaggaucaccaggacaaucaauaacaauaucaugcacaggaacaucaucagacguaggaggauacaacuacguaucaugguaccaacaaccaccaggaaaagcaccaaaaguaauaauauacgaaguaagcaaaagaccaucaggaguaccagacagauucucaggaucaaaaucaggaaacacagcaucauuaacagucucaggacuacaagcagaagacgaagcagacuacuacugcucaucauacgcaggaucaaacaauuucguauucggaacaggaacagaaguaacaguaguaggacaaccaaaagcaaacccaacaguaacacuauucccaccaucaagcgaagaauuacua

SEQ ID NO: 50286 - RNA, 390 nt, Artificial Sequence
  derived and/or modified sequence opt6 from anti-HIV_Chain
caagcaguaguaacacaagaaccaucacuaacaguaucaccaggaggaacaguaacauuaacaugcgccucaucaacaggagcaguaacaucaggauucuacccacacugguuccaacaaaaaccaggacaagcaccaagagcauuaauauacucaacaucaaacagauacucauggacaccagcaagauucucaggaucacuacuaggaggaaaagcagcacuaacacuaucaggaguacaaccagaagacgaagcagaauacuacugcuuacuacuaccauacuacggaggaccauggauauucggaggaggaacaaaauuaacaguacuaggacaaccaaaagcagcaccaucaguaacacuauucccaccaucaucagaagaacua

SEQ ID NO: 50287 - RNA, 390 nt, Artificial Sequence
  derived and/or modified sequence opt6 from anti-HIV_Chain
caaucagcacuaacacaaccaccaucagcaucaggagcaccaggacaaagagucacaauaucaugcucaggaggaccaucaaacguaggaggaaacuacguauacugguacagacaauucccaggaacagcaccaacacuacuaauacuaagagacgaccaaagaccaucaggaguaccagacagauucucagcaucaaaaucaggaaacucagcaucacuagcaauaucaggacuaagaccagacgacgaaggauucuacuucugcgcaacauaugacucagacggaucaauaagacuauucggaggaggaacagcacuaacaguacuaucacaaccaaaagcagcaccaucaguaacacuauucccaccauccucagaagaacuaaaa

SEQ ID NO: 50288 - RNA, 390 nt, Artificial Sequence
  derived and/or modified sequence opt6 from anti-HIV_Chain
caaguacaauuaguagaaaguggaagcgauguaagaaaaccaggagcaacaguaacaguaagcuguaaagcagaugaagacgaagacgauuucacagcauauaauuauuuuaugcacuggguaagacaagcaccaggacacggacuagaauggauaggauggauaaauccaagaacaggacaaccaaaucaugcaaaacaauuucaaggaagaguaacauuaacaagagaaagaaguacgaguacaguauuuaugaaauuaacaaacuuaagauuagacgauacagcaguauauuucugugcaagaccauuaagaggaggagauacauggcauuaucauucauggggaagaggaacaucauuaacaguaucaagugcaagcacaaaagga

SEQ ID NO: 50289 - RNA, 390 nt, Artificial Sequence
  derived and/or modified sequence opt6 from anti-HIV_Chain
gaaguacaauuaguagaaaguggaagugauguaagaaaaccaggagcaacaguaacaguaagcuguaaagcagaugaagaugaagacgauuuuacagcauauaauuauuuuaugcacuggguaagacaagcaccaggacacggacuagaauggauaggauggauaaauccaagaacaggacaaccaaaucaugcaaaacaauuucaaggaagaguaacauuaacaagagaaagaagcacaaguacaguauuuaugaaauuaacaaauuuaagauuagacgauacagcaguauauuucugugcaagaccauuaagaggaggagauacauggcauuaucauucauggggaagaggaacaucauuaacaguaucaagugcaaguacaaaagga

SEQ ID NO: 50290 - RNA, 390 nt, Artificial Sequence
  derived and/or modified sequence opt6 from anti-HIV_Chain
gaaguacaauuaguacaaucaggaucagacguaagaaaaccaggagcaacaguaacaguaucaugcaaagcagaugaagaugaagaugacuuuacagcauaugauuacuuuaugcauuggguaagacaagcaccaggacauggacuagaauggauaggauggauaaacccaagaacaggacaaccaaaucacgcaaaacaauuccaaggaagaguaacacuaacaagagaaagaucaacaucaacaguauucaugaaauuaacaaaucuaagacuagaugacacagcaguauacuuuugcgcaagaccacuaagaggaggagacacauggcauuaccauagcuggggaagaggaacaucauuaacaguaaguucagcaucaacaaaagga

SEQ ID NO: 50291 - RNA, 390 nt, Artificial Sequence
  derived and/or modified sequence opt6 from anti-HIV_Chain
caaguacaauuaguacaaucaggaucagacguaagaaaaccaggagcaacaguaacaguaucaugcaaagcagaugaagacgaagacgacuuuacagcauacaauuacuuuaugcacuggguaagacaagcaccaggacacggacuagaauggauaggauggauaaacccaagaacaggacaaccaaaucacgcaaaacaauuccaaggaagaguaacacuaacaagagaaagaucaacaucaacaguauucaugaaauuaacaaauuuaagacuagacgacacagcagucuacuucugcgcaagaccauuaagaggaggagacacauggcauuaccauucauggggaagaggaacaucauuaacaguaucaucagcaucaacaaaaggc

SEQ ID NO: 50292 - RNA, 390 nt, Artificial Sequence
  derived and/or modified sequence opt6 from anti-HIV_Chain
caaguacaauuaguacaaagcggaagcgauguaagaaaaccaggagcaacaguaacaguaagcuguaaagcagacgaagacgaagacgauuucacagcauauaauuauuucaugcacuggguaagacaagcaccaggacacggacuagaauggauaggauggauaaauccaagaacaggacaaccaaaccaugcaaaacaauuucaaggaagaguaacauuaacaagagaaaggagcacaaguacaguauuuaugaaacuaacaaaccuaagauuagacgauacagcaguauauuucugugcaagaccauuaagaggaggagauacauggcauuaucauucaagaggaagaggaacaagucuaacaguaucaagcgcaaguacaaaagga

SEQ ID NO: 50293 - RNA, 390 nt, Artificial Sequence
  derived and/or modified sequence opt6 from anti-HIV_Chain
gaaguacaauuaguagaaaguggaagugauguaagaaaaccaggagcaacaguaacaguaaguuguaaagcagaugaagaugaagaugauuuuacagcauauaauuauuuuaugcauuggguaagacaagcaccaggacaaggacuagaauggauaggauggauaaauccaagaacaggacaaccaaaucaugcaaaacaauuucaaggaagaguaacauuaacaagagaaagaaguacaaguacaguauuuaugaaauuaacaaauuuaagauuagaugauacagcaguauauuuuugugcaagaccauuaagaggaggagauacauggcauuaucauaguuggggaagaggaacaaguuuaacaguaaguagugcaagcacaaaagga

SEQ ID NO: 50294 - RNA, 390 nt, Artificial Sequence
  derived and/or modified sequence opt6 from anti-HIV_Chain
guaguacaauuaguacaaucaggaucagacguaagaaaaccaggagcaacaguaacaguaucaugcaaagcagaugaagaugaagaugacuuuacagcauacaauuacuuuaugcauuggguaagacaagcaccaggacauggauuagaauggauaggauggauaaacccaagaacaggacaaccaaaucacgcaaaacaauuccaaggaagaguaacacuaacaagagaaagaucaacaucaacaguauucaugaaauuaacaaaucuaagacuagaugacacugcaguauacuuuugcgcaagaccacuaagaggaggagacacauggcauuaccauaguuggggaagaggaacaagccuaacaguaagcucagcaucaacaaaagga

SEQ ID NO: 50295 - RNA, 390 nt, Artificial Sequence
  derived and/or modified sequence opt6 from anti-HIV_Chain
gaaguacaauuaguacaaucaggaucagacguaagaaaaccaggagcaacaguaacaguaucaugcaaagcagaugaagaugaagaugacuuuacagcauacaauuacuuuaugcauuggguaagacaagcaccaggacauggacuagaauggauaggauggauaaacccaagaacaggacaaccaaaucacgcaaaacaauuccaaggaagaguaacacuaacaagagaaagaucaacaucaacaguauucaugaaauuaacaaaucuaagacuagaugacacagcaguauacuuuugcgcaagaccacuaagaggaggagacacauggcauuaccauagcuggggaagaggaacaaguuuaacaguaagcucagcaucaacaaaagga

SEQ ID NO: 50296 - RNA, 390 nt, Artificial Sequence
  derived and/or modified sequence opt6 from anti-HIV_Chain
gaaguacaacuaguacaaucaggaucagacguaaaaaaaccaggaacaacaguaacaauaagcugcaaagcagaugaagacgaagacgacuucacagcauacaauuacuuuaugcacuggguaagacaagcaccaggacaaggacuagaauggauaggauggauaaacccaagaacaggacaaccaaaucacgcaaaacaauuacaaggaagaguaacacuaacaagagaaagaucaacaucaacaguauucaugaaauuaacaaacuuaagacuagacgacacagcaguauacuucugcgcaagaccacuaagaggaggagacacauggcacuaccauucauggggaagaggaacaucauuaauaguaagcucagcaucaacaaaagga

SEQ ID NO: 50297 - RNA, 390 nt, Artificial Sequence
  derived and/or modified sequence opt6 from anti-HIV_Chain
caaguacaauuaguagaaaguggaggaggauuaguaaaaccaggaggaagucuaagauuaaguugugcagcaaguggauuuaguuuuaaugaauauuauaugaguuggauaagacaagcaccaggacaaggauuagaauggguagcaaauauaggaagcagugaugcauauacaauauacgcagauaguguaaaaggaagauuuacaauaaguagagauaaugcagaaaauacaguauaucuacaaaugaauaguuuaagaggagaagauacagcaguauauuauugugcaagaauagaaggauauuguaguaauaguagauguaguaauuauuuugauccauggggacaaggagcauuaguaacaguaaguagugcaaguacaaaagga

SEQ ID NO: 50298 - RNA, 390 nt, Artificial Sequence
  derived and/or modified sequence opt6 from anti-HIV_Chain
caaguacaauuaguacaaagcggagcagaaguaaaaaaaccaggagcaaguguaaaaguaaguuguaaaguaaguggauauccauuagcagaauuaaguguacacuggguaagacaaguaccaggaaaaggauuagaauggguaggaggauuugauccagaagaaggaaaaacaguauaugcacaaaaauuucaaggaagaguaacaaugacagaagacagaucaacagauacaguauauauggaauuaauaaguuuaagauaugaagauacagcaguauauuauugugcaacagauaauccaguauuacaauuaggagaauuaaguaguagucuagauuauuggggacaaggaacauuaguaacaguaaguagcgcaaguacaaaagga

SEQ ID NO: 50299 - RNA, 390 nt, Artificial Sequence
  derived and/or modified sequence opt6 from anti-HIV_Chain
gaaguacaauuaguacaaagcggagcagaaguaaaaaaaccaggagaaaguuuaagaauaagcuguaaaacaagcggauauaauuuuaaugacgauuggauagcauggguaagacaaagaccagauaaaggaccagaauggaugggaauauuuuauccaggagacucacaagcaacauauaguccaaguuuucaaggacacguaacauuuagugcagacacaagcauaaguacagcauauuuacaauggacaaguuuaaaagcaagugacacagcaauauauuacugugcaagaacaagaugcuuuggagcaaauuguuucaauuucauggacguauggggaaaaggaacagcacuaacaguaacaguaucaagcgcaaguacaaaagga

SEQ ID NO: 50300 - RNA, 390 nt, Artificial Sequence
  derived and/or modified sequence opt6 from anti-HIV_Chain
caaguacaauuaguacaauuauuacaaaguggagcagaaguaaaaaaaccaggaaguaguguaaaaguaaguugucaaauaaguggauauggauuuaguaauuaugcaauaaguuggguaagacaagcaccaggacaaggauuagaaugguuaggaagaauaguaccagcaguaggaaugacagaauaugcacaaaaauuucaaggaagaguaacauuuacagcagauagaaguacaauaacagcauauauggauuuaagaggauuaagaagugaugauacagcaguauauuauuguguaagagauccacaaguagaaguaagagggaaugcauuugauauauggggacaaggaacaaugguaacaguaaguagugcaagcacaaaagga

SEQ ID NO: 50301 - RNA, 390 nt, Artificial Sequence
  derived and/or modified sequence opt6 from anti-HIV_Chain
caaguacaucuacaacaauggggagcaggauuacuaaaaccaucagaaacacuaucacuaacaugcgcaguaucaggaggcagcuuuagcggauucuuuuggacauggauaagacaaagcccaggaaaaggauuagaauggauaggagaaguaaaccauagcggauucacacacucuaacccaucauuagaaagcagagcaacaauaagcguagcagcaagcaauacacaauucucauuaagacuagcaaguguaacagcagcagauacagcaauauauuucugugcauuaagauauuucgauuggucaccauuuagaagagacacauacggaacagauguauggggacaaggaacaacaguaauaguaagcucagcaucaacaaaagga

SEQ ID NO: 50302 - RNA, 390 nt, Artificial Sequence
  derived and/or modified sequence opt6 from anti-HIV_Chain
caaguaagauuagaacaaagcggaggagcacuaagaaaaccaggagcaagcguaacauuaaguugucaagcaaguggauacaauuucguaaaauauauaauacacuggguaagacaaagaccaggacuaggauucgaauggguaggaaugauagauccauauagaggaagaccaugguaugcacauagcuuugcaggaagauuaaguuuaagcagagacacaagcacagaaacacuauauaugacacuaagcucauuaaaaucagacgauacagcaacauauuucugugcaagagcagaagcagcaagcgauagccauagcagaccaauaauggauuggacauggagaauauuaugcuuacuagcaguaguaccagcaaguacaaaagga

SEQ ID NO: 50303 - RNA, 390 nt, Artificial Sequence
  derived and/or modified sequence opt6 from anti-HIV_Chain
caaguaagauuagaacaaagcggagcagcaguaagaaaaccaggagcaaguguaacauuaagcugucaagcaaguggauauaauuuuguaaauuauauaauacacuggguaagacaaagaccaggacuagauuucgaauggguaggaaugauagauccauauagaggaagaccauggucagcacauaaauuucaaggaagauuaaguuuaagcagagacguaaguacagaaauauuauauaugacauuaaauaguuuaagaucagaugauacagcaacauauuuuugugcaagagcagaagcagaaagucaaagucauaguagaccaauaauguuugauucauggggacaaggaagcagaguaacaguaucaagcgcaaguacaaaagga

SEQ ID NO: 50304 - RNA, 390 nt, Artificial Sequence
  derived and/or modified sequence opt6 from anti-HIV_Chain
caaguaagauuagaacaaaguggagcagcaguaaaaaaaccaggagcaaguguaacaauaaguugucaagcaagcggauauaauuuuguaaaauuuuuuauacauuggguaagacaaagaccaggacaaggauuugaaugggugggaaugauagaaccauauagaggaagaccauggucagcaggaaauuuucaaggaagauuaagcuuaaguagagauguaaguacagaaacauuauauaugacauuaaauaaucuaagaucagaugauacagcaguauauuuuugugcaagacuagaagcagaaagugauagucauaguagaccaauaauguuugaucauugggggcauggaaguuuaguaacaguaucaagugcaaguacaaaagga

SEQ ID NO: 50305 - RNA, 390 nt, Artificial Sequence
  derived and/or modified sequence opt6 from anti-HIV_Chain
caaguaagacuagaacaaucaggagcagcaguaagaaaaccaggagcaucaguaacauuaucaugucaagcaucaggauauaauuuuguaaauuauauaauacauuggguaagacaaagaccaggauuagauuuugaauggguaggaaugauagauccauauagaggaagaccauggagugcacauaaauuugaaggaagauuaucauuaucaagagauguaaguacagaaguauuauauaugacauuaaguucauuaagaagugaugauacagcaacauauuuuugugcaagagcagaagcagaaucacaaucacauucaagaccaauaauguuugauuauuggggucaaggaucaagaguaacaguaaguucagcaucaacaaaagga

SEQ ID NO: 50306 - RNA, 390 nt, Artificial Sequence
  derived and/or modified sequence opt6 from anti-HIV_Chain
caaguaagauuagaacaaaguggaacagcaguaagaaaaccaggagcaaguguaacaauaagcugucaagcaaguggauauaauuuuguaaaauuuuuuauacauggaguaagacaaagaccaggacaaggauuugaauggguaggaaugauagaaccuuuuagaggaagaccauggucagcaggaaauuuucaaggaagauuaaguuuaaguagagauguaaguacagaaacauuauauaugacauuaaauaauuuaagaucagaugauacagcaguauauuuuugugcaagauuagaagcagaaagugauagccauaguagaccaauaauguuugaucauuggggacauggaaguuuaguaacaguaucaagugcaaguacaaaagga

SEQ ID NO: 50307 - RNA, 390 nt, Artificial Sequence
  derived and/or modified sequence opt6 from anti-HIV_Chain
caaguaagauuagaacaaucaggaacagcaaugagaaaaccaggagcaaguguaacauuaucaugucaagcaucaggauauaauuuuguaaaauauauaguacauuggguaagacaaaaaccaggauuaggauuugaauggguaggaaugauagauccauauagaggaagaccauggagugcacauaaauuucaaggaagacuaaguuuaucaagagauacaucaauggaaauauuauacaugacauuaacaucauuaaaaagugaugacacagcaacguauuuuugugcaagagcagaagcagcaucagacucacauucaagaccaauaauguuugaucacuggggacaaggaucaagaguaacaguaaguucagcaucaacaaaagga

SEQ ID NO: 50308 - RNA, 390 nt, Artificial Sequence
  derived and/or modified sequence opt6 from anti-HIV_Chain
caaguaagauuagaacaaagcggagcagcaaugagaaaaccaggagcaagcguaacauuaucaugucaagcaagcggauauaauuuuguaaaauauauaguacacuggguaagacaaaaaccaggacuaggauucgaauggguaggaaugauagauccauauagaggaagaccauggucagcacauaaauuucaaggaagauuaaguuuaagcagagacacaaguauggaaauauuauauaugacacuaacaaguuuaaaaucagaugauacagcaacauauuucugugcaagagcagaagcagcaagcgauagccauagcagaccaauaauguuugaccauuggggacaaggaagcagaguaacaguaucaagugcaagcacaaaagga

SEQ ID NO: 50309 - RNA, 390 nt, Artificial Sequence
  derived and/or modified sequence opt6 from anti-HIV_Chain
caaguaagauuagaacaaaguggagcagcaaugagaaaaccaggagcaaguguaacauuaagcugucaagcaaguggauauaauuuuguaaaauauauaauacacuggguaagacaaaaaccaggauuaggauuugaauggguaggaaugauagauccauauagaggaagaccauggucagcacauaaauuucaaggacgauuaaguuuaaguagagacacaaguauggaaauauuauauaugacauuaacaaguuuaaaaagugaugauacagcaacauauuucugugcaagagcagaagcagcaagugauagucauaguagaccaauaauguuugaucauuggggacaaggaaguagaguaacaguaucaagugcaaguacaaaagga

SEQ ID NO: 50310 - RNA, 390 nt, Artificial Sequence
  derived and/or modified sequence opt6 from anti-HIV_Chain
caaguaagauuagaacaaaguggaaaugcaguaagaaaaccaggagcaaguguaacaauaaguugucaagcaagcggauauaauuuuguaaaauucuuuauacauuggguaagacaaagaccaggacaaggauuugaauggguaggaaugauagaaccauuuagaggaagaccauggucagcaggaaauuuucaaggaagauuaaguuuaagcagagauguaaguacagaaacauuauauaugacauuaaauaauuuaagaucagaugauacagcaguauauuuuugugcaagauuagaagcagaaagugauagucauaguagaccaauaauguuugaucauuggggacauggaaguuuaguaacaguaucaagugcaaguacaaaagga

SEQ ID NO: 50311 - RNA, 390 nt, Artificial Sequence
  derived and/or modified sequence opt6 from anti-HIV_Chain
caaguaagauuagaacaaaguggagcagcaguaagaaaaccaggagcaaguguaacauuaaguugucaagcaaguggauauaauuuuguaagauauauaauacauuggguaagacaaagaccaggauuagauuuugaauggguaggaaugauagauccauauagaggaagaccauggagugcacauaaauuuggaggaagauuaaguuuaacaagagauguaaguacagaaauauuauauaugacauuaacaaguuuaagaagcgaugauacagcaacauauuuuugugcaagagcagaagcagaaagucaaagucauagcagaccaauaauguuugauaguuggggacaaggaaguagaguaacaguaaguagugcaaguacaaaagga

SEQ ID NO: 50312 - RNA, 390 nt, Artificial Sequence
  derived and/or modified sequence opt6 from anti-HIV_Chain
caaguaagauuagaacaaucaggagcagcaguaagaaaaccaggagcaucaguaacauuaucaugucaagcaucagguuauaauuuuguaaauuauauaauacauuggguaagacaaagaccaggacuagacuuugaauggguaggaaugauagacccauauagaggaagaccauggagugcacauaaauuucaaggaagacuaucacuaaguagagauguaucaacagaaauauuauauaugacauuaaguucauuaagaagcgaugacacagcaacauauuuuugugcaagagcagaagcagaaucacaaucacauucaagaccaauaauguuugauuucuggggacaaggaucaagaguaacaguaaguucagcaaguacaaaagga

SEQ ID NO: 50313 - RNA, 390 nt, Artificial Sequence
  derived and/or modified sequence opt6 from anti-HIV_Chain
caaguaagauuagaacaaaguggaacagcaguaagaaaaccaggagcaaguguaacaauaaguugucaagcaaguggauauaauuuuguaaaauuuuuuauacauuggguaagacaaagaccaggacaaggauuugaauggguaggaaugauagaaccauuuagaggaagaccauggagugcaggaaauuuucaaggaagauuaaguuuaaguagagauguaaguacagaaacauuauauaugacauuaaauaauuuaagaucagaugauacagcaguauauuuuugugcaagauuagaagcagaaagugauagucauaguagaccaauaauguuugaucauuggggacauggaaguuuaguaacaguaaguagugcaaguacaaaagga

SEQ ID NO: 50314 - RNA, 390 nt, Artificial Sequence
  derived and/or modified sequence opt6 from anti-HIV_Chain
caaguaagauuagaacaaagcggagcagcaaugagaaaaccaggagcaaguguaacauuaagcugucaagcaaguggauauaauuuuguaaaauauauaguacacuggguaagacaaaaaccaggacuaggauuugaauggguaggaaugauagauccauauagaggaagaccauggagugcacauaaauuucaaggaagacuaaguuuaagcagagacacaaguauggaaauauuauauaugacauuaacaaguuuaacaucagaugauacagcaacauauuucugugcaagagcagaagcagcaagugauagucauaguaggccaauaauguuugaucauuggggacaaggaagcagaguaacaguaucaagugcaaguacaaaagga

SEQ ID NO: 50315 - RNA, 390 nt, Artificial Sequence
  derived and/or modified sequence opt6 from anti-HIV_Chain
gaaguacaauuaguacaaaguggaggaggauuaguacaaccaggaggaaguuuaagauugaguugugcagcaaguggauuaacauucagaaauuuugcaaugaguuggguaagacaagcaccaggaaaaggauuagaaugggugaguaguauaaguggaaguggaggaaguacauauuaugcagacaguguaaaaggaagauuuacaauaaguagagauaauaguaaaaauacauuauaucuacaaaugaauaguuuaagaggagaagauacagcaguauauuuuugugcaaaaggaguaggauaugauauauuaacaggauuaggagaugcauuugauauauggggacaaggaacaguaguagcaguaaguagugcaaguacaaaagga

SEQ ID NO: 50316 - RNA, 393 nt, Artificial Sequence
  derived and/or modified sequence opt6 from anti-HIV_Chain
caaguacaauuaguacaaucaggagcagcaguaagaaaaccaggagcaucaguaacaguaagcuguaaauuugcagaagacgaugacuauucaccacacuggguaaauccagcaccagaacacuauauacauuucuuaagacaagcaccaggacaacaauuagaauggcuagcauggaugaacccaacaaauggagcaguaaauuacgcauggcaauuacauggaagacuaacagcaacaagagauggaucaaugacaacagcauucuuagaaguaagaucacuaagaucagaugacacagcaguauacuauugcgcaagagcacaaaaaagaggaagaucagaaugggcauaugcacauuggggacaaggaacaccaguauuaguaucauca

SEQ ID NO: 50317 - RNA, 393 nt, Artificial Sequence
  derived and/or modified sequence opt6 from anti-HIV_Chain
caaguacaauuacaacaauggggagcaggacuauuaaaaccaucagaaacauuaucauuaacaugugcaguauacgcaggaucauucucaggauauuacuggacauggauaagacaaccaccaggaaaaggacuagaauggauaggagaaguaaaucacggaggaucaacaaauuacaauccaucacuaaaaucaagaguaacauuaucaguagacacaagcaaaaaucaauuuucauuaaaauuaacaucaguaacagcagcagacacagcaguauacuacugcgcaagaguaucaagauacgacuucuggucaggaaacuauggaucauacggacuagacguauggggacaaggaacaacaguaacaguaucaucagcaucaacaaaagga

SEQ ID NO: 50318 - RNA, 393 nt, Artificial Sequence
  derived and/or modified sequence opt6 from anti-HIV_Chain
gaaguacaauuaguacaaagcggaggaggaguaguacaaccaggaagaaguuuaagauuaagcuguguaguaaguggauuuacauuuaguaguuuuacauuucauuggguaagacaagcaccaggaaaaggauuagaauggguagcaggaaugaguuuucaugcaacauauauauauuaugcagauaguguaaaaggaagauuuacaauaagcagagaugauagucaagauacauuauauuuagaaauggauaguuuaagaagugaagauacagcaauauauuauugugcaagagauccaggaauacaugauuauggagauuaugcaccaggagcauuugauuauuggggacaaggaaguccaguaacaguaaguagugcaaguacaaaagga

SEQ ID NO: 50319 - RNA, 393 nt, Artificial Sequence
  derived and/or modified sequence opt6 from anti-HIV_Chain
caaguacaauuaguacaaaguggaacagaaguacaaaaaccaggagcaucaguaaaaguaaguuguaaaacaaguggauauacauuuaguaaauauuauauacauuggguaagacaagcaccaggacaaggauuagaauggguaggaagaauaaauacagauaguggaggaacagauuaugcagaaaaauuucaaggaagaguaacaaugacaagagacacaaguauaacaacaguauauuuagaaaugagaggauuaacaucagaugauacagcagcauuuuauugugcaagaggaccaccacaugcaggaggauggacaauauauuauuauggauuagauguauggggacaaggaacaaguguaauaguaaguagugcaaguacaaaagga

SEQ ID NO: 50320 - RNA, 393 nt, Artificial Sequence
  derived and/or modified sequence opt6 from anti-HIV_Chain
agaacaguaguaacacaaccaccaucaguaucaggagcaccaggacaaagaguaacaauaucaugcacaggaucaucaucaaacauaggagcaggcuacgacguacacugguaccaacaacuaccaggaacagcaccaaaacuacuaauauacggaaacucaaacagaccaucaggaguaccagacagauucucaggaucaaaaucaggaacaagcgcaucacuagcaauaacaggacuacaagcagaagacgaagccgacuacuacugccaaucauacgacucaucacuaucaggaucaggaguauucggaacaggaacaaaaguaacaguacuaggacaaccaaaagcaaacccaacaguaacacuauucccaccaucaucagaagaacua

SEQ ID NO: 50321 - RNA, 393 nt, Artificial Sequence
  derived and/or modified sequence opt6 from anti-HIV_Chain
caaguacaacuacaacaauggggaaguggauuauuaaaaccaagugaaacauuaaguuuaacaugugcaguauauggaggaaguuuuagaaguuauuauuggaauuggauaagacaaaguccaggaaaaggauuagaauggauaggagaaguaagucauaguggaaguacaaauuauaauccagcauuaaaaaguagaguaacaauaaguguagauacaaguaaaaaucaauuuagcuuaaaaguaaaaaguguaacagcagcagauacagcacuauauuauuguaguagaggaagaggaaaaagauguaguggagcauauuguuuugcaggauauuuugauaguuggggacaaggaggauuaguaguaguaagcagugcaaguacaaaagga

SEQ ID NO: 50322 - RNA, 393 nt, Artificial Sequence
  derived and/or modified sequence opt6 from anti-HIV_Chain
caaguacauuuaguacaaucaggagcagaaguaaaaaaaccaggaaguucaguaagaguaucaugcgaagcaucaggauggacauuuggaucaguaaauagugcaauaacauggguaagacaagcaccaggacaaggauuagaauggaugggaagaacaauaccauucuuaggaauaagcaauuacgcacaaaaauuccaaggaagaguaacaauaacagcagauaaaaguacaaauauagcauacguagacguaacaucacuaacaagucaagacacagcaguauacuauugcgcaagacuaauaacaggaaugacagcaccaugguucuauuauauggauguauggggaaaaggaacaacaguaacaguaucaagcgcaagcacaaaagga

SEQ ID NO: 50323 - RNA, 393 nt, Artificial Sequence
  derived and/or modified sequence opt6 from anti-HIV_Chain
caaguacaccuacaagaaucaggaccaagacuaguaagaucaucagaaacacuaucacuaacaugcucaguaccaggaggaucaauaguaaacccaauaacaaacuacuacuggucauggauaagacaaucaccaagaaaaggacuacaauggauaggagacauauacuacacaggaacaagcucaagaaacccaucacuagacucaagaguaucaauaucaauggacguaucaagaaaacaaauaucauuaacacuauacucaguaacagcagcagacacagcaguacacuacugcgcaucacaaagccuaucaugguacagaccaucaggauacuucgaaucauggggacaaggaauacuaguaacaguaucaucagcaucaacaaaagga

SEQ ID NO: 50324 - RNA, 393 nt, Artificial Sequence
  derived and/or modified sequence opt6 from anti-HIV_LightChain
augaaacuaccaguaagacuauuaguacuaauguucuggauaccagcaucaucaucagacauaguaaugacacaaucaccacuaucacuaccaguaacaccaggagaaccagcaucaauaucaugcagaucaucacaaagacuacuaucaucauacggacacacauaccuacacugguaccuacaaaaaccaggacaaucaccacaacuacuaauauacgaaguaucaaacagauucucaggaguaccagacagauucucaggaucaggaucaggaacagacuucacacuaaaaauaucaagaguagaagcagaagacguaggaguauacuacugcucacaaucaacacacguaccacuaacauucggacaaggaacaaaaguagaaauaaaa

SEQ ID NO: 50325 - RNA, 396 nt, Artificial Sequence
  derived and/or modified sequence opt6 from anti-HIV_Chain
caaguacaauuacaagaaagcggaccaggauuaguaaaaccaagcgaaacauuaagcguaacauguagcguaaguggagacucaaugaauaacuauuacuggacauggauaagacaaucaccaggaaaaggacuagaauggauaggauauaucucagacagagccucagcaacauacaauccaucacuaaauagcagaguaguaauaucaagagauacaagcaaaaaucaauuaagccuaaaauuaaacucaguaacaccagcagacacagcaguauacuauugcgcaacagcaagaagaggacaaagaauauacggaguaguaucauuuggagaauuuuucuacuauuacaguauggauguauggggaaaaggaacaacaguaacaguaagcuca

SEQ ID NO: 50326 - RNA, 396 nt, Artificial Sequence
  derived and/or modified sequence opt6 from anti-HIV_Chain
caaguacaauuacaagaaagcggaccaggauuaguaaaaccaccagaaacacuaagcuuaacauguagcguaagcggagcaucaguaaaugacgcauacuggagcuggauaagacaaucaccaggaaaaagaccagaauggguaggauauguacaucacucaggagauacaaauuacaauccaucacuaaaaagaagaguaacauucucacuagauacagcaaaaaaugaaguaagcuuaaaauuagucgcacuaacagcagcagacucagcaguauacuuuugcgcaagagcacuacauggaaaaagaauauacggaauaguagcauuaggagaacuauuuacauauuucuauauggauguauggggaaaaggaacaacaguaacaguaagcuca

SEQ ID NO: 50327 - RNA, 396 nt, Artificial Sequence
  derived and/or modified sequence opt6 from anti-HIV_Chain
caaguacaauuacaagaaagcggaccaggauuaguaaaaccaagcgaaacauuaucauuaacauguagcguaaguggagcaucaauaucagacucauacuggagcuggauaagaagaucacccggaaaaggacuagaauggauaggauauguacauaaaucaggagauacaaauuacucaccaucacuaaaaagcagaguaaaucuaucacuagauacaagcaaaaaucaaguaaguuuaucauuaguagcagcaacagcagcagacagcggaaaauacuauugcgcaagaacacuacauggaagaagaauauacggaauaguagcauuuaacgaaugguuuacauauuucuauauggauguauggggaaauggaacacaaguaacaguaagcuca

SEQ ID NO: 50328 - RNA, 396 nt, Artificial Sequence
  derived and/or modified sequence opt6 from anti-HIV_Chain
caaguacacuuacaagaaagcggaccaggauuaguaaaaccaagcgaaacacuaucacuaacauguaacguaagcggaacauuaguaagagacaauuacuggagcuggaugagacaaccacuaggaaaacaaccagaauggauaggauauguacaugacucaggagauacaaauuacaauccaucacuaaaaagcagaguacaucuaucacuagauaaaucaaacaaucuaguaucauuaagauuaacagcaguaacagcagcagacucagcaacauacuauugcgcaaccacaaaacauggaagaagaauauacggaauaguagcauuuaacgaaugguuuacauauuucuauauggauguauggggaaaaggaacaacaguaacaguaucauca

SEQ ID NO: 50329 - RNA, 396 nt, Artificial Sequence
  derived and/or modified sequence opt6 from anti-HIV_Chain
caaguacaauuacaagaaagcggaccaggauuaguaaaaccaagcgaaacauuaagcguaacauguagcguaagcggagacucaaugaauaacuauuacuggacauggauaagacaaucaccaggaaaaggacuagaauggauaggauauauaucagacagagaaucagcaacauacaauccaucauuaaauagcagaguaguaauaucaagagauacaucaacaaaucaauuaagccuaaaauuaaacucaguaacaccagcagacacagcaguauacuauugcgcaacagcaagaagaggacaaagaauauacggaguaguaucauuuggagaauuuuucuacuauuacagcauggauguauggggaagaggaacaacaguaacaguaagcuca

SEQ ID NO: 50330 - RNA, 396 nt, Artificial Sequence
  derived and/or modified sequence opt6 from anti-HIV_Chain
caaguacaauuaguagaaagcggaccaggauuaguaacaccaagcgaaacauuaucauuaacauguacaguaaguaauggaucaguaucaggaagauucuggagcuggauaagacaaucaccaggaagaggacuagaauggauaggauauuucucagacacagacagaagcgaauacucaccaucacuaagaagcagauuaacauuaucacuagaugcaucaagaaaucaauuaagccuaaaauuaaaaucaguaacagcagcagacucagcaacauacuauugcgcaagagcacaacaaggaaaaagaauauacggaauaguuagcuuuggagaauuuuucuacuauuacuauauggacgcauggggaaaaggaacagcaguaacaguaaguuca

SEQ ID NO: 50331 - RNA, 396 nt, Artificial Sequence
  derived and/or modified sequence opt6 from anti-HIV_Chain
caaguacaauuacaagaaagcggaccaggacuaguaaaaccaccagaaacauuaagucuaacauguucaguaaguggagcaucaauaaaugacgcauacuggagcuggauaagacaaucaccaggaaaaagaccagaauggguaggauauguacaucacucaggagauacaaauuacaauccaucacuaaaaagaagaguaacauucucauuagauacagcaaaaaaugaaguaagcuuaaaauuaguagaucuaacagcagcagacucagcaguauacuuuugcgcaagagcacuacauggaaaaagaauauacggaauaguagcauuaggcgaacuauuuacauauuucuauauggauguauggggaaaaggaacaacaguaacaguaucauca

SEQ ID NO: 50332 - RNA, 396 nt, Artificial Sequence
  derived and/or modified sequence opt6 from anti-HIV_Chain
caaguacaauuacaagaaagcggacccggacuaguaaaaccaccagaaacauuaucauuaacauguagcguaagcggagcaucaauaaaugacgcauacuggagcuggauaagacaaucaccaggaaaaagaccagaauggguaggauauguacaucacucaggagauacaaauuacaauccaucacuaaaaagaagaguaucauucucacuagauacagcaaaaaaugaaguaagucuaaaauuaguagaucuaacagcagcagacucagcaauauacuuuugcgcaagagcacuacauggaaaaagaauauacggaauaguagcauuaggagaacuauuuacauauuucuauauggauguauggggaaaaggaacaacaguaacaguaagcuca

SEQ ID NO: 50333 - RNA, 396 nt, Artificial Sequence
  derived and/or modified sequence opt6 from anti-HIV_Chain
caaguacaauuacaagaaagcggacccggauuaguaaaaccaagcgaaacauuaagcguaacauguagcguaagcggagacucaaugaauaacucauacuggacauggauaagacaaucaccaggaaaaggacuagaauggauaggauauauaucaaaaucagaaucagcaaauuacaaucccucacuaaauagcagaguaguaauaucaagagauacaagcaaaaaucaacuaagccuaaaauuaaacucaguaacaccagcagacacagcaguauacuauugcgcaacagcaagacauggacaaagaauauacggaguaguaucauuuggagaauuuuucacauauuacucaauggauguauggggaaaaggaacaacaguaacaguaaguuca

SEQ ID NO: 50334 - RNA, 396 nt, Artificial Sequence
  derived and/or modified sequence opt6 from anti-HIV_Chain
caaguacaacuacaagaaucaggaccaggauuaguaaaaccaucagaaacacuaucacucacaugcucaguaucaaacggaucaguaucaggaagauucuggucauggauaagacaaucaccaggaagaggacuagaauggauaggauacuucagcgacacagaaaaaucaaacuacaacccaucacuaagaucaagacuaacacuaucaguagacgcaucaaaaaaccaacuaucacuaaaacuaaacucaguaacagcagcagacucagcaacauacuacugcgcaagaacacaacaaggaaaaagaauauacggaguaguaucauucggagaauucuuccacuacuacuacauggacgcauggggaaaaggaacagcaguaacaguaucauca

SEQ ID NO: 50335 - RNA, 396 nt, Artificial Sequence
  derived and/or modified sequence opt6 from anti-HIV_Chain
caaguacaauuaguacaaagcggaacagcacuaaaaaguccaggaucaagcgcaaaauuaagcuguacaguacuaggagacgaauuuggaacauauuucauaagcuggauaagacaagcaccaggacaaggacuagaauggguaggaggaauaguaccacauagccaacuacaaagcucagcacaaaaauuccacggaagaauaauaauaagcgcaggagcaggaguaacaccaccaguaguaucacuacaacuaacaaacuuaacauuugaagauacaggaacauauuucugugcaagagaaagaggaagacacagagacccaaaaacaggagaugcauuaagaggaagauauuucgauuucuggggaagaggaacaggaguaaguguaagugca

SEQ ID NO: 50336 - RNA, 396 nt, Artificial Sequence
  derived and/or modified sequence opt6 from anti-HIV_Chain
caaguacaauuaguacaaagcggaacagcacuaaaaagcccaggaucaagcgcaaaauuaagcuguacaguacuaggagacgaauuuggaacauauuucauaagcuggauaagacaagcaccaggacaaggacuagaauggguaggaggaauaguaccacauagccaacuacaaagcucagcacaaaaauuccacggaagaauaauaauaagcgcaggagcaggaguaacaccaccaguaguaucacuacaacuaacaaacuuaacauuugaagauacaggaacauauuucugugcaagagaaagaggaagacacagagacccaaaaacaggaaaagccccaagaggaagauauuucgauuucuggggaagaggaacaggaguaacaguaagcgca

SEQ ID NO: 50337 - RNA, 396 nt, Artificial Sequence
  derived and/or modified sequence opt6 from anti-HIV_Chain
caaguacaauuaguacaaagcggaacagcacuaaaaaguccaggaucaagcgcaaaacuaaguuguacaguacuaggagacgaauuuggaacauauuucauaaguuggauaagacaagcaccaggacaaggacuagaauggguaggaggaauaguaccacauagccaacuacaaagcagugcacaaaaauuccacggaagaauaacaauaagcgcaggagcaggaguaacaccaccaguaguaucacuacaacuaacaaacuuaacauuugaagauacaggaacauauuucugugcaagagaaagaggaagacacagagacccaaaaacaggagaugcauuaagaggaagauauuucgauuucuggggaagaggaacaggaguaagaguaagcaca

SEQ ID NO: 50338 - RNA, 396 nt, Artificial Sequence
  derived and/or modified sequence opt6 from anti-HIV_Chain
caaguacaauuaguacaaaguggagcagcaguaaaaaguccgggaaguagugcaaaauuaaguuguacaguauuaggagaugaauuuggaacauauuuuauaaguuggauaagacaagcaccaggacaaggauuagaauggguaggaggaauaguaccacauagucaauuacaaaguagugcacaaagauuucauggaagaauaacaauaagugcaggagcaggaguaacaccaccaguaguaaguuuacaauuaacaaauuuaacauuugaugaugcaggaacauauuuuugugcaagagaaagaggaagacauagagauccaaaaacaggagaugcauuaagaggaagauauuuugauuuuuggggaagaggaacaggaauaaguguaagccca

SEQ ID NO: 50339 - RNA, 396 nt, Artificial Sequence
  derived and/or modified sequence opt6 from anti-HIV_Chain
gaaguacaauuaguacaaagcggagcagaaguaaaaaaaccaggagcaagcguaaaaguaagcuguaaaguaagcggauacacacuaacagaauuaaguauacacuggguaagacaagcaccaggaaaaggacuagaauggaugggaggauuugauccagaagacgaugaagcaauauaugaaccaaaauuucaaggaagacuaacaaugacagaagacacaaguacagacacagcauauauggaauuaucaaguuuaagaucagaagauacagcaguauauuacugugcaacagcagauccauuuaaaguagcacaagaugaaggauuauacguaauauuugacuauuggggacaaggaacauuaguaacaguaucaagugcaaguacaaaagga

SEQ ID NO: 50340 - RNA, 396 nt, Artificial Sequence
  derived and/or modified sequence opt6 from anti-HIV_Chain
gaaguacaauuaguagaaaguggaggaggauuauuacaaccaggaggaaguuuaagauuaaguugugcagcaaguggauuuaguuuuaaugauuuugaaaugaauuggguaagacaagcaccaggaaaaggauuagaauggguaagcuauauaaguaaugauggaacaaugauacauuaugcagauaguguaaaaggaagauuuacaauaaguagagauaaugcaaaaaaaaguuuauuuuuacaaaugaauaguuuaagagcagaagauacagcaguauauuauugugcaagauuagcagaaguaccaccagcaauaagaggaaguuauuauuauggaauggauguaugggggcaaggaacaacaguaacaguagcaagugcaaguacaaaagga

SEQ ID NO: 50341 - RNA, 396 nt, Artificial Sequence
  derived and/or modified sequence opt6 from anti-HIV_Chain
caaguacaauuaaugcaaaguggagcagaaguaaaaagaccaggagcaaguguaaaaguaaguuguaaagcauuuagacauagucuaaauaauuuaggaauaaguuggauaagaagagcaccaggaagaggacuagaaugguuaggauggauaaauguauaugaaggaaauacaaaauauggaagaagauuucaaggaagaguaacaaugacaacagauagaaguacaaauacaguaaguauggaauuaagaaguuuaacaagugaugauacagcaguauauuauugugcaagagauaaucauuuuuggaguggaaguaguagauauuauuauuuuggaauggauguauggggacaaggaacaacaguaauaguaaguagcgcaaguacaaaagga

SEQ ID NO: 50342 - RNA, 396 nt, Artificial Sequence
  derived and/or modified sequence opt6 from anti-HIV_Chain
caaguacaauuaguacaauggggagcaggauuauuaaaaccauuagaaacauuaaguuuaacaugugcaguauauggaggaaguuuuaauggauauuuuuggaguuggauaagacaaacaccaggaaaaggauuagaauggauaggagaaauaaaucauggaggaagugcaaauuuuaauccaaguuuaaaaaguagaguaacaaugaguguagauacaaguaaaaaucaauuuaguuuaaaauuagcaaguguaacagcagcagauacagcaauauauuauugugcaagaggaagaauaacaaugguaagaggagauccacaaagaggaggaguaagaauggauguauggggacaaggaacaaguguaacaguaaguagugcaaguacaaaagga

SEQ ID NO: 50343 - RNA, 396 nt, Artificial Sequence
  derived and/or modified sequence opt6 from anti-HIV_Chain
cuaguacaauuaguacaaaguggagcagaaguaaaaaaaccaggagcaaguguaaaaguaaguuguaaaguaagcggacauacauuaagugaauuaaguauaaauuggguaagacauguaccaggaaaaggauuagaauggaugggaggauuagauccagaagauggagaagcaauacaugaaccaaaauuucaaggaagauuaacaaugacagaagauacaaguacagauacagcauauaguacauuaucaguaugggcaccaguagcagcagcaauguauuauugugcaacagcagauccauuuaaaguagcacaagaugaaggauuauauguaauauuugauuauuggggacaaggaacauuaguaacaguaaguagugcaaguacaaaagga

SEQ ID NO: 50344 - RNA, 396 nt, Artificial Sequence
  derived and/or modified sequence opt6 from anti-HIV_Chain
caaguacaauuauuacaaagcggaggagaaguaaaaaaaccaggagcaagcguaaaaguaagcuguaaaguaagcggauacacacuaacagaauuaagcauacacuggguaagacaagcaccaggaaaaggacuagaauggaugggaggauucgauccagaagacgaugaagcaauauaugaaccaaaauuccaaggaagauuaacaaugacagaagacacaagcacagacacagcauauauggaacuaucaagcuuaagaucagaagauacagcaguauauuacugugcaacagcagauccauuuaaaguagcacaagacgaaggacuauacguaauauuugacuauuggggacaaggaacauuaguaacagucucaagcgcaagcacaaaagga

SEQ ID NO: 50345 - RNA, 396 nt, Artificial Sequence
  derived and/or modified sequence opt6 from anti-HIV_Chain
caaguacaauuaguacaaagcggagcagaaguaaaaaaaccaggagcaagcguaaaaguaagcugcaaaguaagcggauacacacuaacagaauuaaguauacacuggguaagacaagcaccaggaaaaggacuagaauggaugggaggauuugauagcgaagacggagaagcauucuauaaacaaaacuuucaaggaagaguaacaaugacagaagacacaaguacagacacagcauauauggaacuaagaagauuaagaucagaagauacagcaguauauuacugugcaacagcagauagauuuaaaguagcacaagacgaaggauuauucguaauauuugauuauuggggacaaggaacauuaguaacaguaucaagcgcaagcacaaaagga

SEQ ID NO: 50346 - RNA, 396 nt, Artificial Sequence
  derived and/or modified sequence opt6 from anti-HIV_Chain
caaguacaucuaguacaaucaggagcagaaguaaaaaaaccaggagcaucaguaagaguaucaugcaaagcaucaggauauacauuuacaacauacggaauaucauggguuagacaagcaccaggacaaggauuagaauggaugggauggauaagugcacacaguggagauacaaauuacgcacaaaaacuacaagcaagaguaacaaugacaacagauacaucaacaaauacagcauacauggaauuaagaucacuaacaagcgaugacacagcaguauacuauugcgcaagagauagaccaagacauuacuaugacagaggaggauacuauagcccauucgauuacuggggacaaggaacacuaguaacaguaagcucagcaucaacaaaagga

SEQ ID NO: 50347 - RNA, 396 nt, Artificial Sequence
  derived and/or modified sequence opt6 from anti-HIV_Chain
cuaguacaauuacuacaaagcggagcagaaguaaaaaaaccaggcgcaagcguaaaaguaagcuguaaaguaaguggauacacacuaacagaauuaaguauacacuggguaagacaagcaccaggaaaaggauuagaauggaugggaggauuugauccagaagacgaugaagcaauauaugaaccaaaauuucaaggaagauuaacaaugacagaagacacaagcacagacacagcauauauggaacuaucaagcuuacgaucagaagauacagcaguauauuacugugcaacagcagauccauuuaaaguagcacaagacgaaggauuauacguaauauuugacuauuggggacaaggaacauuaguaacaguaucaagcgcaagcacaaaagga

SEQ ID NO: 50348 - RNA, 396 nt, Artificial Sequence
  derived and/or modified sequence opt6 from anti-HIV_Chain
caaguacaauuaguacaaaguggagcagaaguaaaaaaaccaggagcaagugugaaaguaaguuguaaaguaagcggacauacauuaagugaauuaaguauaaauuggguaagacauguaccaggaaaaggauuagaauggaugggaggauuagauccagaagacggagaagcaauacaugaaccaaaauuucaaggaagauuaacaaugacagaagauacaaguacagauacagcauauguagaauuaaguaguuuaagaagugaagauacagcaauguauuauugugcaacagcagauccauuuaaaguagcacaagaugaaggauuauauguaauauuugauuauuggggacaaggaacauuaguaacaguaaguagugcaaguacaaaagga

SEQ ID NO: 50349 - RNA, 396 nt, Artificial Sequence
  derived and/or modified sequence opt6 from anti-HIV_Chain
caaguacaauuacuacaaagcggagcagaaguaaaaaaaccaggagcaagcguaaaaguaagcuguaaaguaagcggauacacacuaacagaauuaagcauaaacuggguaagacaagcaccaggaaaaggacuagaauggaugggaggauucgauccagaagacgaugaagcaauauaugaaccaaaauuucaaggaagauuaacaaugacagaagacacaagcacagacacagcauauauggaacuaaguagcuuaagaucagaagauacagcaguauauuacugugcaacagcagauccauuuaaaguagcacaagacgaaggauuauacguaauauuugacuauuggggacaaggaacauuaguaacaguaucaagcgcaagcacaaaagga

SEQ ID NO: 50350 - RNA, 396 nt, Artificial Sequence
  derived and/or modified sequence opt6 from anti-HIV_Chain
caaccacaauuaguacaaucaggaucaggagcagaaguaaaaaaaccaggagcaucaguaagaauaucaugugaagcaucagaauauaauguauuugaucauuuuaugcaauggguaagacaagcaccaggacaaggauuagaauggaugggauggauaaauccaagaggaggauauccaucauauaguccaacauuucaaggaagauuaacauuuacaagacaaccaaguugggaugauucaacaauaacauuucauauggaauuaagaggauuaggacaugaugauacagcaguauauuauugugcaagaccacauaguccagaugaugcauggucauuagauguauggggaagaggaacauuaguaacaguaaguucagcaucaacaaaagga

SEQ ID NO: 50351 - RNA, 396 nt, Artificial Sequence
  derived and/or modified sequence opt6 from anti-HIV_Chain
caaccacaauuaguacaaaguggaaguggagcagaaguaaaaaaaccaggagcaaguguaagaauaaguugugaagcaagugaauauaauguauuugaucauuuuaugcaauggguaagacaagcaccaggacaaggauuagaauggaugggauggauaaauccaagaggaggauauccaaguuauagcccaagauuucaaggaagauuaacauuuacaagacaaccaaguugggaugauaguaguguaacauuucauauggaauuaagaggauuaagacaugaugauacagcaguauauuauugugcaagaccacauaguccagaugaugcauggagcuuagauguauggggaagaggaacauuaguaacaguaucaagugcaaguacaaaagga

SEQ ID NO: 50352 - RNA, 396 nt, Artificial Sequence
  derived and/or modified sequence opt6 from anti-HIV_Chain
gaaguacaauuaguagaaaguggaggaggaguaguagaaccaggagaaaguuuaagauuaaguugugcagcaaguggauuuacauuuagaaguuaugauauguuuuggguaagacaagcgacaggaaaaucauuagaauggguaagugcaauaggaauagcaggagauacauauuauucaggaucaguaaaaggaagauuuacaauaaguagagaaaaugcaagaacaaguuuauauuuacaauuaaguggauuaagaguagaagauucagcaguauauuuuuguguaagaggaaguccaccaagaauagcagcaacagaauauaauuauuauuauggauuggauguauggggacaaggaacaacaguaucaguauuuagugcaaguacaaaagga

SEQ ID NO: 50353 - RNA, 396 nt, Artificial Sequence
  derived and/or modified sequence opt6 from anti-HIV_Chain
caaguacaauuaguacaaaguggagcagaaguaaaaaaaccaggaaguaguguaaaaguaaguuguaaagcaaguggaggaacauuuacaacauaugauauaaguuggguaagacaagcaccaggacaaggauuagaauggaugggaggaauauuaccagauuucggagcaccaaguuaugcacaaaaauuucaagauagaguaacaauaacaacagaugaaagcaguaguacagcauauauggaauuaaauagucuaagaagugaagauacagcaauauauuacugugcaagaggaagaggagaugauuuuuggaguggagaaagcccaaguugguauuuugauuauuggggacaaggaacauuaguaacaguaaguagugcaaguacaaaagga

SEQ ID NO: 50354 - RNA, 396 nt, Artificial Sequence
  derived and/or modified sequence opt6 from anti-HIV_Chain
caaccacaauuaguacaaucaggaucaggagcagaaguaaaaaaaccaggagcaucaguaagaauaucaugugaagcaucagaauauaauguauuugaucauuuuaugcaauggguaagacaagcaccaauggaaggauuagaauggaugggauggauaaauccaagaggaggauauccaucauauucaccaacauuucaaggaagauuaacauuuacaagacaaccaucaugggaugauucaacaauaacauuucauauggaauuaagaggauuaagacaugaugauacagcaguauauuauugugcaagaccacauucaccagaugaugcauggucauuagauguauggggaagaggaacauuaguaacaguaaguucagcaucaacaaaagga

SEQ ID NO: 50355 - RNA, 396 nt, Artificial Sequence
  derived and/or modified sequence opt6 from anti-HIV_Chain
gaaguaagauuacuagaaagcggaggaggauuaguacaaccaggaggaaguuuaagauuaaguuguagugcaaguggauucacauuuucaaauucagcauuaaguuggguaagacaagcaccaggaaaaggacuagaauggguaaguucaguaguaagcucaggaggagacacauuuuaugcagauaguguaaaaggaagauuuacaauaaguagagacaauaguagaaauacauuauauuuacaaaugaaaaguuuaagagcagaagauacagcauuauauuacugugcaaaaguacaaauacaacaauuaaauuuuggaguaauaacagacgcaggaauggacguauggggaaaaggaacaacaguaauaguaucaagugcaagcacaaaagga

SEQ ID NO: 50356 - RNA, 396 nt, Artificial Sequence
  derived and/or modified sequence opt6 from anti-HIV_Chain
caaguacaauuaguagaaaguggaggaggaguaguacaaccaggaagaaguuuaagauuaagcuguguaggaaguggauuuacauuuaguaguucaggaaugcauuggguaagacaagcaccaggaaaaggauuagaauggguagcaguaauaaguagcgauggaucagaugaauauuauggagauaguguagaaggaagauuuacaauaagcagagauaauaguaaaaauacauuauuuuuacaauuagauaguuuagaagcagaagauagugcaguauauuauugugcaaaaacaccaccacauuaugaugcauuaacaggauauccaaguaguguauuagaauuuuggggauuaggaacauuaguaacaguaaguagugcaaguacaaaagga

SEQ ID NO: 50357 - RNA, 396 nt, Artificial Sequence
  derived and/or modified sequence opt6 from anti-HIV_Chain
gaaguacaauuaguacaaaguggagcagaaguaaaaaaaccaggaaguaguguaaaaguaaguuguaaagcaagcggaggaacauuuacaacauaugauauaaguuggguaagacaagcaccaggacaaggauuagaauggauaggaggaauauuaccagauuuuggagcaccaaguuaugcacaaaaauuucaagauagaguaacaauaacaacagaugaaaguaguagaacagcauauauggaauuaaauaguuuaagaagugaagauacagcaauauauuauugugcaagaggaagaggagaugauuuuuggucaggagaaaguccaaguugguauuuugauuauuggggacaaggaacacaaguaacaguaaguagugcaaguacaaaagga

SEQ ID NO: 50358 - RNA, 396 nt, Artificial Sequence
  derived and/or modified sequence opt6 from anti-HIV_Chain
caaguacaauuacuacaaagcggaacagaaguaaaaaaaccaggaucaaguguaaaaguaagcuguagagcaagcggauggacacuaggaaacucgccaaauagcgcaauaggauggguaagacaagcaccaggacaaggauuagaauggauaggaagaauaauaccaauauuagacguaacaaauuacgcacaaaaauuccaaggaagaguaacaauaucagcagauaaaucaacaaauauagcauacauggaaauaagcucauuaggaagugaagacacagcauuuuacuauugcgcaagaguaauaacaggaaugacaucaccaugguacuuuuacauggacguauggggagaaggaacaacaguaauaguaucaagcgcaaguacaaaagga

SEQ ID NO: 50359 - RNA, 396 nt, Artificial Sequence
  derived and/or modified sequence opt6 from anti-HIV_Chain
caaguacacuuaguacaaagcggagcagaaguaaaaaaaccaggaucaaguguaagaguaagcuguaaagcaagcggauggacguucggagauucaguaaauagcgcaauaacauggguaagacaagcaccaggacaaggauuagaauggaugggaagauuuauaccaauauuaggauuaagcaauuacgcacaaaaauuccaagacagaguaacaauaaauguagauagaucaacaaauacagcauacauggaauuaagcggacuaagaagugaagacacagcaguauacuauugcgcaagauuaauaacaggaaugaaugcaccaugguucuauuacauggacguauggggaaaaggaacaacaauaacaguaucaagcgcaagcacaaaagga

SEQ ID NO: 50360 - RNA, 396 nt, Artificial Sequence
  derived and/or modified sequence opt6 from anti-HIV_Chain
caaguacauuuaguacaaagcggagcagaagcuaaaagaccaggaaguaguguaagaguaaguuguagagcaaguggaggagauuuuucaaguuauacauuaagcuggguaagacaagcaccaggacaaggauuagaaagaaugggaggaguaguaccaauguuagauacaguacauuaugcacaaaaauuucaaggaagauuaacauuaaguguagaugaaggaacaagcacagcauauauggaauuaucaaguuuaagaucagaagauacagcaauguauuacuguacaagaggaagacaaacauucagagcaauauggucaggaccaccaguaguauuugauauauggggacaaggaacauuaguaucaguaucaagugcaaguacaaaagga

SEQ ID NO: 50361 - RNA, 396 nt, Artificial Sequence
  derived and/or modified sequence opt6 from anti-HIV_Chain
caaguacauuuaguacaaaguggagcagaagcaaaaagaccaggaaguaguguaagaguaaguuguagagcaaguggaggagauuuuaguaguuauacauuaaguuggguaagacaagcaccaggacaaggaauagaauggaugggaggaguaguaccaauguuagauacaguacauuaugcacaaaaauuucaaggaagauuaacauuaaguguagaugaagggacaaguacagcauauauggaauuaaguaguuuaagaagugaagauacagcaauguauuauuguacaagaggaagacaaacauuuagagcaauauggaguggaccaccagcaguauuugauauauggggacaaggaacauuaguaauaguaaguagugcaaguacaaaagga

SEQ ID NO: 50362 - RNA, 396 nt, Artificial Sequence
  derived and/or modified sequence opt6 from anti-HIV_Chain
caaguacaauuaguacaaagcggagcagaacuaaaaaaaccaggaucaagcguaaaaguaagcuguaaagcaagcggaggaacauucaauaaccauacauuuaacuggguaagacaagcaccaggacaaggacuagaauggaugggaagaacaauaccaauacuaggaaguagagacuaugcaaaaacauuccaagauagaguaacaauaauagcagacaaaagcacaaguacaguauaucuagaauuaagaagauuaaaaucagaagauacaggaguauauuacugugcaacaagcauguacuauuucgauagcggaggauauuacagaaacacagacuuagacaaauggggacaaggaagcuuaguaacaguaucaagcgcaagcacaaaagga

SEQ ID NO: 50363 - RNA, 396 nt, Artificial Sequence
  derived and/or modified sequence opt6 from anti-HIV_Chain
caaguauacuuaguacaaagcggaccagaauuaaaaaaaccaggagcaagcguaaaaauaagcuguaaagcaagcggauacaauuucccaaaauaugcaauacacuggguaagacaagcaccaggacaaggacuacaauggaugggauggauaaauggagauaacggagacgcaagauauagccaaaaauuacaaggaagaguaacaccgagcacagacacaagcgcaagcguaguauauauggaacuaaaaagauuaagaucagaagauacagcaguauauuacugugcaagagcauuauacccaugggaaauaggaggaguaccaucaacaaugggagaugacuauuggggacaaggaacauuaauaacaguaucaagcgcaagcacaaaagga

SEQ ID NO: 50364 - RNA, 396 nt, Artificial Sequence
  derived and/or modified sequence opt6 from anti-HIV_Chain
caaguacaauuaguacaaucaggaccugaauuaaugaaaccaggaucaucaguaaaaguaucaugcagagcaagcggagauaauuuucuaacaucaacauuuaauugguuaagacaagcaccaggacaaagauuagaauggaugggaagauuuauaccaucauuaggauuaauaacaucagcaccaaaauuuucagacagacuaacaauaacugcagaucaagcaacauuaacagcauauauggaauuaacaggauuaacaagugaagacacugcauuauauuauugugcaagaggauuauguagaggaggaaauuguagacuaggaccaucaggauggcuagauccauggggaagaggaacacaaguaacaguaucaagugcaucaacaaaagga

SEQ ID NO: 50365 - RNA, 396 nt, Artificial Sequence
  derived and/or modified sequence opt6 from anti-HIV_Chain
ggaguacacuuucaaggacacuuaguacaaagcggaggaggaguaaaaaaaccaggaucaaguguaacaauaagcugucuagcaagugaauacacauuuacagaauuuacaauacacuggauaagacaagcaccaggacaaggaccauuaugguuaggauuaauaaaaagaucaggaagacuaaugacaucauacagauuccaagacagacuaucauuaagaagagauagaucaacaggaacaguauucauggaauuaagaggauuaagaauagaugacacagcaguauacuauugcgcaagagauggauuaggagaaguagcaccagcauaccuauacggaauagauguauggggacaaggaucaacaguaauaguaacaucagcaucaacauca

SEQ ID NO: 50366 - RNA, 396 nt, Artificial Sequence
  derived and/or modified sequence opt6 from anti-HIV_Chain
caaguacaauuacuacaaagcggagcagaaguaaaaaaaccaggagcaagcguaaaaguaagcuguaaaguaagcggauacacacuaacagaauuaaguauacacuggguaagacaagcaccaggaaaaggacuagaauggaugggaggauucgauccagaagacgaugaagcaauauaugaaccaaaauuucaaggaagauuaacaaugacagaagacacaagcacagacacagcauauauggaauuaucaagcuuaagaucagaagauacagcaguauauuacugugcaacagcagauccauuuaaaguagcacaagacgaaggauuauacguaauauuugacuauuggggacaaggaacauuaguaacaguaucaagcgcaagcacaaaagga

SEQ ID NO: 50367 - RNA, 396 nt, Artificial Sequence
  derived and/or modified sequence opt6 from anti-HIV_Chain
caaguacaauuaguacaaagcggagcagaaguaaaaaaaccaggagcaaguguaaaaguaaguuguaaaguaaguggauauacauuaacagaauuaaguauacauuggguaagacaagcaccaggaaaaggacuagaauggaugggaggauuugauccagaagacggagaagcaaguuuugaaccaaaauuucaaggaagauuaacaaugacagaagacacaaguacagauacagcauauauggaauuaucaaguuuaagaucagaagauacagcaguauauuacugugcaacagcagauccauuuaaaguagcacaagaugaaggauuauauguaauauuugauuauuggggacaaggaacauuaguaacaguaucaagugcaaguacaaaagga

SEQ ID NO: 50368 - RNA, 396 nt, Artificial Sequence
  derived and/or modified sequence opt6 from anti-HIV_Chain
ggaguacacuuucaaggacacuuaguacaaagcggaggaggaguaaaaaaaccaggaucaaguguaacaauaaguuguuuagcaagcgaauacacauucacagaauuuacaauacacuggauaagacaagcaccaggacaaggaccauuauggcuaggauuaauaaaaagaucaggaagacuaaugacaucauacagauuccaagauagauuaucacuaagaagagauagaucaacaggaacaguauucauggaauuaagaggauuaagaauagaugacacagcaguauauuauugcgcaagagauggauuaggagaaguagcaccagcauacuuauacggaauagauguauggggacaaggaacaacaguaauaguaacaucagcaucaacauca

SEQ ID NO: 50369 - RNA, 396 nt, Artificial Sequence
  derived and/or modified sequence opt6 from anti-HIV_Chain
caaguacaauuaggagaaaguggaggaggauuaguagaaccaggaggaaguuuaagauuaaguugugcagcaaguggauuuuuguuuucagauuaucaaaugaguuggauaagauuagcaccaggaaaaggauuagaauggauaaguuuuauaucaggauuuggaucaguauauuaugcagauucaguagaaggaagauuuacaauaucaagagauaaugcaagaaauaguuuauauuuacaaaugaauaauuuaagagcagaagauacagcaguauauuauugugcaagagcauauggaacaggaaauuggagaggauuauauuauuauuauuauggaauggauguauggggacauggaacaacaguaacaguaucaagugcaaguacaaaagga

SEQ ID NO: 50370 - RNA, 399 nt, Artificial Sequence
  derived and/or modified sequence opt6 from anti-HIV_Chain
caaguacaauuaguacaaaguggaacagcauuaaaaagcccaggaucaagcgcaaaacuaucauguacaguacuaggagacgaauuuggaacauauuucauaagcuggauaagacaagcaccaggacaaggacuagaauggguaggaggaauaguaccacauagccaacuacaaucaucagcacaaaaauuccacggaagaauaauaauaagugcaggagcaggaguaacaccaccaguaguaucacuacaacuaacaaacuuaacauuugaagauacaggaacauauuucugugcaagagaaagaggaagacacagagacccaaaaacaggagaugcauuaagaggaagauauuucgauuucuggggaagaggaacaggauuaagaguaucaacaagc

SEQ ID NO: 50371 - RNA, 399 nt, Artificial Sequence
  derived and/or modified sequence opt6 from anti-HIV_Chain
gaaguacaauuaguacaaaguggaggaggauuaguaaaaccaggaggaaguuuaagauuaaguugugcagcaaguggauuuacauuuaaaaaugcauggaugaguuggguaagacaagcaccaggaaaaggauuagaauggguaggacauauaaaaaguaaaacagauggaggaacaauagauuaugcagcaccaguaaaaggaagauuuacaauaagcagagaugauagcaaaaauacacuauauuuacaaaugaauaguuuaaaaauagaagauacagcaguauauuauuguacaacagauauaggaaguggaagaggaugggauuuucauuauuaugauaguaaugauuggggacaagggacauuaguaacaguaagcagugcaaguacaaaagga

SEQ ID NO: 50372 - RNA, 399 nt, Artificial Sequence
  derived and/or modified sequence opt6 from anti-HIV_Chain
caaguacaauuaguagaaaguggaggaggaguaguacaaccaggaagaaguuuaagauuauuuugugcagcaaguggauuugcauuuaauacauauggaaugcauuggguaagacaagcaccaggaaaaggacuagaauggguagcaguaacauggcacgauggaucacaaaaauauuaugcagauaguguaaaaggaagauuuacaauaaguagagauaauaguaaaaauacguuauauuuacaaaugaauagcuuaagagcagaagauacagcaauauauuauugugcaagugaucaaggaggauuugaugauaguaguggauauuuugcaccaggaggaauggauguauggggaagaggaacaacaguaauaguaaguagugcaccaacaaaagga

SEQ ID NO: 50373 - RNA, 399 nt, Artificial Sequence
  derived and/or modified sequence opt6 from anti-HIV_Chain
ggauacucagaaguacaauuaguacaaaguggaccaggauuaguaaaaccaagccaaacacuaucauuaacauguacaguaaguggaggaucaauaucaaacggaggacauuacuggaacuggauaagacaacauccaggaaaaggacuagaauggauaggacauauauauaauauagcaacaacauauuacaauccaucacuaaaaaguagaguaucaauaucaguagauacaagcaaaaaucaauuuaguuuaaaauuaagcucaguaacagcagcagacacagcaguauacuauugcgcaagaggaagcggaagauggacaauaggagcaagaauauacuuugacaauuggggacaaggagcauuaguagcaguaucaagcgcaagcacaaaagga

SEQ ID NO: 50374 - RNA, 399 nt, Artificial Sequence
  derived and/or modified sequence opt6 from anti-HIV_Chain
caauuacaauuaaaagaaagcggaccaggaaugguaaaaccaagcgaaacauuaucauuaacauguagcguaagcggagcaucaguaguaagcgcaaacgauuacuggggauggauaagacaagcaccaggaaaaggacuagaaugcauaggaauaauauuauacacaggaucaacauuuuacaauccaucgcuacaaagcagaguaacaauaucaagagauccaagcaaaaaucacguaucauuaacauuaacaagcguaacagcagcagacucagcaguauacuauugcgcaagaauaccauaucacucagaaucauacuauaacguaguaauaggaggauucgauguauggggacaaggaacaagaguaacaguaagcucagcaucaacaaaagga

SEQ ID NO: 50375 - RNA, 399 nt, Artificial Sequence
  derived and/or modified sequence opt6 from anti-HIV_Chain
ugucaaguacaauuaguagaaaguggaggaggaguaguacaaccaggaagaaguuuaagauuaaguuguguaggaaguggauuuacauuuaguaguaguggaaugcauuggguaagacaagcaccaggaaaaggauuagaauggguagcaguaauaaguagugauggaucagaugaauauuauggagauaguguagaaggaagauuuacaauaaguagagauaauaguaaaaauacauuauuuuuacaauuagauaguuuagaagcagaagauagugcaguauauuauugugcaaaaacaccaccacauuaugaugcauuaacaggauauccaaguaguguauuagaauuuuggggauuaggaacauuaguaacaguaaguagugcaaguacaaaagga

SEQ ID NO: 50376 - RNA, 399 nt, Artificial Sequence
  derived and/or modified sequence opt6 from anti-HIV_Chain
caaguacaauuaguacaaaguggagcagauguaaaaaaaccaggagcaaguguaaaaguaaguuguaaaguaaguggauauacaguaagugaauuaaguauacauuggguaagacaagcaccaggaaaaggauuagaauggaugggaggauuugauccagaagauggaaaaacaguaagugcacaaaauuuucaaggaagaguaacaaugacagaagauaaaaguacaggaacagcaaauauggaauuaagaaguuuaaggagugaagauacagcaguauauuauugugcaacaacaguacaauuaauaguagauuuuuguaauggaggaccauguuauaauuuugaugauuggggacaaggaacauuaguaacaguaagcagugcaaguacaaaagga

SEQ ID NO: 50377 - RNA, 399 nt, Artificial Sequence
  derived and/or modified sequence opt6 from anti-HIV_Chain
ggauuagauuuagaacaugauggacaucauaaagaagaaccaagagcaaguguaacaguaaguugugaagcaagcggauauaauuuuguaaauuauauaauacauuggguaagauuaacaccaggaagaggauuugaauggaugggaaugauagauccaagaagaggaagaccauggagugcacaaaaauuucaaggaagauuaacauuaacaagagauauagauagugaaagauuauauaugcaauuaaguggauuaagaggagaugauacagcaguauauuuuugugcaagacaagaaccagauuuucaugauggacauggacauacauuaagaggaauguuugauagcuggggacaaggaaguccaguaaguguaaguagugcaaguacaaaagga

SEQ ID NO: 50378 - RNA, 399 nt, Artificial Sequence
  derived and/or modified sequence opt6 from anti-HIV_Chain
caaguaagauuaguacaaaguggagcacaauuaaaaaaaccaggagcaaguguaacaguaaguugugaagcaaguggauauaauuuuguaaauuauauaauaaauuggguaagacaaacaccaggaagaaguuuugaauggguaggaaugauagauccaagaagaggaagaccauggagugcacaaaaauuucaaggaagauuaacauuaacaagagauauagauagugaaaaauuauauaugcauuuaaguggauuaagaggagaugauacagcaguauauuauugugcaagacaagauagugauuuucaugauggacauggacauacauuaagaggaauguuugauaguuggggacaaggaaguccaguaacaguaucaagugcaagcacaaaagga

SEQ ID NO: 50379 - RNA, 399 nt, Artificial Sequence
  derived and/or modified sequence opt6 from anti-HIV_Chain
caaguaagauuaagucaaaguggagcagcaguaguaaaaacaggagcaaguguaacaauaaguugugaaacagaaggauauacauuuguaaauuauauaauacauuggguaagacaaccaccaggaagaggauuugaaugguuaggaaugauagauccaagaaauggacauccaugguuuggacaaagauuuagaggaagauuaaguuuaagaagagauagaaguacagaaacaguauuuaugacauuaaguggauuaacaagugaugauaauggaauauacuuuugugcaagaaaugaaccacaauauuaugauggaaguggacauaguuuaccaggaauguuugauuauuggggacaagguacaagaguaguaguaagcagugcaaguacaaaagga

SEQ ID NO: 50380 - RNA, 399 nt, Artificial Sequence
  derived and/or modified sequence opt6 from anti-HIV_Chain
caaguaagauuaucacaaagcggagcagcaguaaugaaaacaggagcaucaguaacaauaaguugugaaacagaaggauauaauuuuguaaauuauauaauacauuggguaagaagaccaccaggaagaggauuugaaugguuaggaaugauagauccaaaaaauggacauccaugguuugcacaagcaguaagaggaagauuaaguuuaagaagagauacauuuaaugaaguaguauauaugacauuaaguggacuaacaagugaugauacaggauuauauuuuugugcaagaaaugaaccacaauaucaugauggaaauggacauaguuuaccaggaauguuugauuuuuggggacaaggaacauuaguaacaguaaguagugcaaguacaaaagga

SEQ ID NO: 50381 - RNA, 399 nt, Artificial Sequence
  derived and/or modified sequence opt6 from anti-HIV_Chain
caaguaagauuaagucaaagcggagcagcaguaguaaaaacaggagcaaguguaacaauaaguugugaaacagaaggauauacauuuguaaauuauauaauacauuggguaagacaaccaccaggaagaggauuugaaugguuaggaaugauagauccaagaaauggacauccaugguuuggacaaagauuacaaggaagauuaaguuuaagaagagauagaaguacagaaacaguauuuaugacauuaaguggauuaacaagugaugauacaggaauauauuuuugugcaagaaaugaaccacaauauuaugauggaaguggacauaguuuaccaggaauguuugauuauuggggacaaggaacaagaguaguaguaaguagugcaaguacaaaagga

SEQ ID NO: 50382 - RNA, 399 nt, Artificial Sequence
  derived and/or modified sequence opt6 from anti-HIV_Chain
caaguaagauuaagccaaagcggagcagcaguaguaaaaacaggagcaaguguaacaauaaguugugaaacagaaggauauacauuuguaaaucauauaauacauuggguaagacaaccaccaggaagaggauuugaaugguuaggaaugauagauccaagaaauggacauccaugguuuggacaaagauuaagaggaagacuaagucuaagaagagauagaaguacagaaacaguauuuaugacauuaaguggauuaacaagugaugauauaggaauauauuuuugcgcaagaaaugaaccacaauauuuugauggaaguggacauucauuaccaggaauguuugauuauuggggacaaggaacaagaguaguaguaaguagugcaaguacaaaagga

SEQ ID NO: 50383 - RNA, 399 nt, Artificial Sequence
  derived and/or modified sequence opt6 from anti-HIV_Chain
caaguacaauuuuuccaaucaggaagcucaaugaaaaaaucaggagcaaguguaacaauaagcugugaagcaacaggauacaauauaaaaaaccauauauuacacuggguaagacaaaaaccaggaagaggauucgaauggguaggaaugauagauccaauaaacggaagaccaugguuuggacaagcauuuagaggaagauuaacauuaacaagagacuuaagcacagaaacauucuauaugucacuaucaggauuaacaucagacgauacagcaacauauuucugugcaagaagagaagcagauuaccaugacggaaacggacacacacuaccaggaauguucgauuucuggggaccaggaacacuaguaacaguaaguucagcaucaacaaaagga

SEQ ID NO: 50384 - RNA, 399 nt, Artificial Sequence
  derived and/or modified sequence opt6 from anti-HIV_Chain
caaguaagauuaagucaaagcggagcagcaguaguaaaaacaggagcaaguguaacaauaaguugugaaacagaaggauauacauuuguaaauuauauaauacauuggguaagacaaucaccaggacgaggauuugaaugguuaggaaugauagauccaagaaauggacauccaugguuuggacaaagauuaagaggaagauuaaguuuaagaagagauagaaguacagaaacaguauuuaugacauuaucaggauuaacaucagaugauacagcaauauauuuuugugcaagaaaugaaccacaauauuaugauggaaguggacauucauuaccaggaauguuugauuauuggggacaaggaacaagaguaguaguaaguucagcaucaacaaaagga

SEQ ID NO: 50385 - RNA, 399 nt, Artificial Sequence
  derived and/or modified sequence opt6 from anti-HIV_Chain
caaguaagauuaagucaaaguggagcagcaaugaaaaaaccaggagcaaguguaacaauaaguugugaaacagaaggauauacauuuauaaauuauauaauacauuggguaagacaaccaccaggaagaggauuugaaugguuaggaaugauagauccaagaaauggaagaccaugguuuggacaaagcguacaaggaagauuaaguuuaagaagagauacauauacagaaguaguauauaugacauuaucaggauuaacaucagaugaugcaggauuauauuuuugugcaagaaaugaaccacaauaucaugauggaaauggacauucauuaccaggaauguuugauuauuggggacaaggaacauuaguagcaguaaguucagcaucaacaaaagga

SEQ ID NO: 50386 - RNA, 399 nt, Artificial Sequence
  derived and/or modified sequence opt6 from anti-HIV_Chain
caaguaagauuaguacaaaguggagcacaauuaaaaaaaccaggagcaaguguaacaguaaguugugaagcaaguggauauaauuuuguaaauuauauaauaaauuggguaagacaaacaccaggaagaggauuugaauggguaggaaugauagauccaagaagaggaagaccauggagugcacaaaaauuucaaggaagauuaacauuaacaagagauauagauucagaaaaauuauauaugcauuuaaguggauuaagaggagaugauacagcaguauauuauugugcaagacaagauagugauuuucaugauggacauggacauacauuaagaggaauguuugauaguuggggacaaggaaguccaguaacaguaaguagugcaaguacaaaagga

SEQ ID NO: 50387 - RNA, 399 nt, Artificial Sequence
  derived and/or modified sequence opt6 from anti-HIV_Chain
caaguacacacauuccaaagcggaagcucaaugaaaaaaucaggagcaagcguaacaauaucaugugaagcaacaggauacaauauaaaaaacuauauauuacacuggguaagacaaaaaccaggaagaggauucgaauggguaggaaugauagauccaauaaacggaagaccaugguuuggacaaccauuuagaggaagauuaacacuaacaagagacuuaaguacagaaacauucuauaugucacuaucaggauuaacaucagacgauacagcaacauauuucugugcaagaagagaagcagauuaccaugacggaaacggacacacauuaccaggaauguucgauuucuggggaccaggaacacuaauaacaguaagcucagcaucaacaaaagga

SEQ ID NO: 50388 - RNA, 399 nt, Artificial Sequence
  derived and/or modified sequence opt6 from anti-HIV_Chain
caaguaagauuauuucaaaguggagcagcaaugaaaaaaccaggagcaaguguaacaauaaguugugaagcaaguggauauaauuuuaugaauuauuuuguacauuggguaagacaaagaccaggaagaggauuugaaugguuaggaaugauaaauccaagaggaggaagaccauggagcgcacaaaguguacaaggaagauuaacauuaacaagagauauaaguacagaaauguuuuauaugagauuagauggauuaagaagugaugauacagcaacauauuuuugugcaagaaaugaagcagauuaucaugauggaaauggacauaguuuaagaggaauguuugauuauuggggacaaggaaguuuaauaacaguaaguagugcaaguacaaaagga

SEQ ID NO: 50389 - RNA, 399 nt, Artificial Sequence
  derived and/or modified sequence opt6 from anti-HIV_Chain
caaguacaauuauuucaaaguggagcagcaaugagaaaaccaggagcaagcguaacaauaaguugugaagcaaguggauauaauuuuaugaauuauuuuguacauuggguaagacaaagaccaggaagaggauuugaaugguuaggaaugauaaauccaagaggaggaagaccauggagugcacaaaguguacaaggaagauuaacauuaacaagagauacaaguacagaaauguuuuauaugagauuagauggauuaagaagugaugauacagcaacauauuuuugugcaagaaaugaagcagauuaucaugauggaaauggacauagucuaagaggaauguuugauuauuggggacaaggaaguuuaauaacaguaaguagugcaucaacaaaagga

SEQ ID NO: 50390 - RNA, 399 nt, Artificial Sequence
  derived and/or modified sequence opt6 from anti-HIV_Chain
caaguaagauuaagucaaaguggagcagcaauaaaaaaaccaggagcaagcguaacaauaaguugugaaacagaaggauauacauuuauaaauuauauaauacauuggguaagacaaccaccaggaagaggauuugaaugguuaggaaugauagauccaagaaauggaagaccaugguuuggacaaaguguacaaggaagauuaagcuuaagaagagauacauauacagaaguaguauauaugacauuaucaggauuaacaucagaugauacaggauuauauuuuugugcaagaaaugaaccacaauaucaugauggaaauggacauucauuaccaggaauguuugauagcuggggacaaggaacauuaguagcaguaaguagugcaucaacaaaagga

SEQ ID NO: 50391 - RNA, 399 nt, Artificial Sequence
  derived and/or modified sequence opt6 from anti-HIV_Chain
caaguaagauuauuucaaaguggagcagcaaugagaaaaccaggagcaagcguaacaauaaguugugaagcaaguggauauaauuuuuuaaauuauuuuguacauuggguaagacaaagaccaggaagaggauuugaaugguuaggaaugauaaauccaagaggaggaagaccauggagugcacaaaguguacaaggaagauuaacauuaacaagagauacaaguacagaaauguuuuauaugagauuagauggauuaaggagugaugauacagcaacauauuuuugugcaagaaaugaagcagauuaucaugauggaaauggacauaguuuaagaggaauguuugauuauuggggacaaggaaguuuaauaacaguaaguagugcaaguacaaaagga

SEQ ID NO: 50392 - RNA, 399 nt, Artificial Sequence
  derived and/or modified sequence opt6 from anti-HIV_Chain
caaguaagauuaagucaaaguggagcagcaguaaaaaaaccuggagcaaguguaacaauaguaugugaaacagaaggauauaauuuuauagauuauauaauacauuggguaagacaaccaccaggaagaggauuugaaugguuaggaaugauagauccaagaaauggaagaccauggaguggacaaaaaguacauggaagauuaaguuuauggagagauacaaguacagaaaaaguauauaugacauuaacaggauuaacaagugaugauacaggauuauacuuuuguggaagaaaugaaccacaauaucaugaugauaauggacauaguuuaccaggaaugauagauuauuggggacaaggaacaaugguaacaguaagcagugcaaguacaaaagga

SEQ ID NO: 50393 - RNA, 399 nt, Artificial Sequence
  derived and/or modified sequence opt6 from anti-HIV_Chain
caaguaagauuaagucaaaguggagcagcaauaaaaaaaccaggagcaagcguaacaauaaguugugaaacagaaggauauacauuuauaaauuauauaauacauuggguaagacaaccaccaggaagaggauuugaaugguuaggaaugauugauccaagaaauggaagaccaugguuuggacaaaguguacaaggaagauuaagucuaagaagagauacauauacagaaguaguauauaugacauuaucaggauuaacaucagaugaugcaggacauuauuuuugugcaagaaaugaaccacaauaucaugauggaaauggacauucauuaccaggaauguuugauuauuggggacaaggaacauuaguagcaguaaguucagcaucaacaaaagga

SEQ ID NO: 50394 - RNA, 399 nt, Artificial Sequence
  derived and/or modified sequence opt6 from anti-HIV_Chain
caaguaagauuauuucaaaguggagcagcaaugagaaaaccaggagcaaguguaacaauaaguugugaagcaaguggauauaauuuuaugaauuauuuuguacauuggguaagacaaagaccaggaagaggauuugaaugguuaggaaugauaaauccaagaggaggaagaccauggagugcacaaaguguacaaggaagauuaacauuaacaagagauacaaguacagaaauguuuuauaugagacuagauggauuaagaagugaugauacagcaacauauuuuugugcaagaaaugaagcagauuaucaugauggaaauggacauagcuuaagaggaauguuugauuauuggggacaaggaaguuuaauaacaguaaguucagcaaguacaaaagga

SEQ ID NO: 50395 - RNA, 399 nt, Artificial Sequence
  derived and/or modified sequence opt6 from anti-HIV_LightChain
augaaacuaccaguaagacuauuaguacuaauguucuggauaccagcauccucaucagacauaguaaugacacaaucaccacuaucacuaccaguaacaccaggagaaccagcaucaauaucaugcagaucaucacaaagacuacuaucaucauacggacacaccuaccuacacugguaccuacaaaaaccaggacaaucaccacaacuacuaaucuacgaaguaucaaacagauucucaggaguaccagacagauucucaggaucaggaucaggaacagacuucacacuaaaaauaucaagaguagaagcagaagacguaggaguauacuacugcucacaaucaacacacguaccacuaacauucggacaaggaacaaaaguagaaauaaaaagaaaa

SEQ ID NO: 50396 - RNA, 402 nt, Artificial Sequence
  derived and/or modified sequence opt6 from anti-HIV_Chain
caaccauauauaguacaaucaggaccagcaguaaaaggagcaggaaguucaguaacaguaacauguaaaguagauggagaugaugauggaauauuuucauuuggaacauauuucaugguauggguaagacaagcaccaggacaaggauuacaauauaugggaggauuaguaccaucauaugcaccaacauaugcacauaaauuugaaggaagaauaacaauaucagcagcaggaacaccaccaguaguaaguuuaacauuauuaaaucuaacaaaugaugacgcagcaacauauuuuugugcaagagaaagaggaagacauuaugauaguaaaacaagagaaaauagaagaggaagauauuuugauauguggggaagaggaacaagaauaacaguaucacca

SEQ ID NO: 50397 - RNA, 402 nt, Artificial Sequence
  derived and/or modified sequence opt6 from anti-HIV_Chain
caaccauauauaguacaaucaggaccagcaguaaaaggagcaggaaguucaguaacaguuacauguagaguagauggagaugaugauggaauauuuaauuuuggaacauauuuuaugguauggguaagacaagcaccaggacaaggauuacaauauaugggaggauuaguaccaaguuaugcaccaacauaugcacauaaauuugaaggaagaauaacaauaucagcagcaggaacaccaccaguaguaaguuuaacauuaauaaauuuaacaaaugcagaugcagcaacauauuuuugugcaagagaaagaggaagacauuaugauaguaaaacaagagaaaauagaagaggaagauauuuugauauguggggaagaggaacaagaauaacaguaagucca

SEQ ID NO: 50398 - RNA, 402 nt, Artificial Sequence
  derived and/or modified sequence opt6 from anti-HIV_Chain
agaguacacagccaaguacaauuaguagaaucaggaccaggauuaguaaaaccaucacaaacacuaucacuaacaugcacaguaucaggaggaaguauaucaaacggaggacauuacuggaacuggauaagacaacacccaggaaaaggacuagaauggauaggacacauauacaacauagcaacaacauacuacaacccaucacuaaaaucaagaguaucaauaucaguagacacaaguaaaaaccaauucucacuaaaacuaucaucaguaacagcagcagacacagcaguauacuacugcgcaagaggaucaggaagauggacaauaggagcaagaauauacuuugacaacuggggacaaggagcauuaguagcaguaucaucagcaucaacaaaagga

SEQ ID NO: 50399 - RNA, 402 nt, Artificial Sequence
  derived and/or modified sequence opt6 from anti-HIV_Chain
agcguagacgaaagauuauuagaauuuggaggaagauuaguacaaccaggaggaaguuuaagauuaagcuguagugcaagcggauucacauucucaaacucagcaaugagcuggguaagacaagcaccaggaaaaggacuagaauggguaagcucaauauuaagcucaggaguaggaacauucuaugcagauagcguaaaaggaagauucacaguaagcagagacaauagcagaaacacacuauaucuacaaaugaaaagccuaagagcagaagauacagcacuauauuacugugcaaaaguacaaauacaacaauuaaacuuuggaguaauaacagacgcaggauuagacguauggggaaaaggaacaacacuaauaguaucaagugcaagcacaaaagga

SEQ ID NO: 50400 - RNA, 402 nt, Artificial Sequence
  derived and/or modified sequence opt6 from anti-HIV_Chain
guacaaagucaaguauauuuaguacaaaguggaggagaaguaaaaaaaccaggaagcaguguaaaaguaaguuguaaagcaaguggagauagcuuuaguaguaguguaauaacauggguaagacaagcaccagggcaaggaccagaauggaugggaagaauaauaccaguauuaggaguagcagcauaugcacaaaauuuuuaugggagaguaacaauaagugcagauacaaguaguaauacagcauauauggaauuaaguagcuuaagauuugaagauacagcaguauuuuauugugcaagagaaacaggaagaggaggaaauuuagcauuaagacaauauuuuuuugauaguuggggacaaggaacauuaguaacgguaaguaguccaaguacaaaagga

SEQ ID NO: 50401 - RNA, 402 nt, Artificial Sequence
  derived and/or modified sequence opt6 from anti-HIV_Chain
caacuacaauuacaagaaucaggaccaggauuaguaaaaccaucagaaacacuaucacuaacaugcucaguaucagacggaaguauaaacucaaacucauacuauugggcauggauaagacaaagcccaggaaaaggacuagaauggauaggaagcguauacuauuucggaggaacauacuauagcccaagccuaaaaucaagaguaacaaugagcguagacagaagcaaaaaccaauucucacuaaauguaucaagcguaacagcagcagauacagcaauauauuacugugcaagacacguaagaccauacgauagaucaggauauccagaaagaccaaacugguucgauccauggggaagaggaacauuaguaacaguaaguucagcaucaacaaaagga

SEQ ID NO: 50402 - RNA, 402 nt, Artificial Sequence
  derived and/or modified sequence opt6 from anti-HIV_Chain
caaguacaauuacaucaauggggagcaggauuacuaaaaccaucagacacacuaucacuaacaugcggaauauuaggaguaagcccaccaggaucauuaacaggauacuauuggacauggauaagacaaccaccaggaaaaggauuagaauggauaggagaaguauaccauucaggaucaacaaacuauaacccaucauuagcaucaagaguaacaauaucaaugggaacaacaaaaacacaauucucauuaagacuaacaucaguaacagcagcagauucagcaguauauuacugugcaucaggaaaaguauggggaauaacagcaagaccaagagaugcaggacuagauguauggggacaaggaacuacaguaacaguaacaucagcaucaacaaaagga

SEQ ID NO: 50403 - RNA, 402 nt, Artificial Sequence
  derived and/or modified sequence opt6 from anti-HIV_Chain
caaguacaauuaguacaaaguggagcagaaguaaaaaaaccaggaaguagcguaaaaguaaguuguagagcaaguggaggaucauuuggaaauuaugcaauaaauuggguaagacaagcaccaaugcaaggauuagaauggaugggaggaauaauaccaauauuuggaacaacaaauuaugcacaaaauuuuagaggaagaguaacaauaaaugcagauacauuuacaaauacaguaaauauggauuuaaguaguuuaagaagugaagauacagcaguauauuauuguggaagaaguauaaaugcagcaguaccaggauuagaaggaguauauuauuauuauggaauggcaguauggggacaaggaacaacaguaacaguaaguagugcaaguacaaaagga

SEQ ID NO: 50404 - RNA, 402 nt, Artificial Sequence
  derived and/or modified sequence opt6 from anti-HIV_Chain
uuuguacaauuaguagaaaguggaggaggauuaguacaaccaggaggaaguuuaagauuaaguugugcagcaaguggauuuaauuuuaauacauauuggaugaauuggguaagacaagcaccaggaaaaggauuagaauggguugcaaauaugaaagaagauggaagugaaaaauauuauguagauaguguaaaaggaagauuuacaauaaguagagauaaugcaaaaaauaguuuauauuuacaaaugaauagcuuaagagcagaagauacagcaguauauuauugugcaagaaauccagaaaguagauguauaguaggaagaaauagaggaugguguagauauuuugauuuauggggaagaggaagucuaguaacaguaaguccagcaaguacaaaagga

SEQ ID NO: 50405 - RNA, 405 nt, Artificial Sequence
  derived and/or modified sequence opt6 from anti-HIV_Chain
caacuacaacuagaucaaccaggagcagcaaugaaaucacuaggaucaucacuaacaauaacaugcagaguaucaggagaugacuuaggaucauuccauuucggaacauauuucaugauauggguaagacaaggaccaggacaaggacuagaauacaugggaggaauacuaccaucaacaaaaacaccaacauaugcacauaaauuuagaggaagaguaucaauaucagcaccaggaguaccaccaguacuaucacuagcacuaacaaaccuaacauaugacgauacagcaacauauuucugugcaagagaaagaggaagacacuuugaaccaaaaaauagagaucacuuagaaggaaaauuucuagaucuauggggaagaggaacauucguaagaguaucacca

SEQ ID NO: 50406 - RNA, 405 nt, Artificial Sequence
  derived and/or modified sequence opt6 from anti-HIV_Chain
caaguacaauuaguacaaccaggaacagcaaugaaaucacuaggaagcucacuaacaauaacaugcagaguaucaggagaugacuuaggaucauuccauuucggaacauauuucaugauauggguaagacaagcaccaggacaaggacuagaauacaugggaggaauauuaccaucaacaaaaacaccaacauaugcacauaaauuuagaggaagaguaagcauaucagcaccaggaguaccaccaguauuaucacuagcacuaacaaacuuaacauaugacgauacagcaacauauuucugugcaagagaaagaggaagacacuuugaacccaaaaauagagauaacuuagaaggaaaauuuuucgauuuauggggaagaggaacauucguaagaguaagccca

SEQ ID NO: 50407 - RNA, 405 nt, Artificial Sequence
  derived and/or modified sequence opt6 from anti-HIV_Chain
caaguacaauuaguacaaccaggaacagcaaugaaaacauuaggaaguucauuaacaauaucauguagaguaucaggagacgauggaaauuuccauuucggaacauauuucauggcauggguaagacaaguaccaggacaaggacuagaauacaugggaggaauacuaccaucaacaaaaucaccaacauaugcacauaaauuuagaggaagaguaucaauaucaacagcaggaguaccaccaguaguaucacuagcacuaacaaacuuaacauaugacgauacagcaacauauuucugugcaagagaaagaggaagacacuaugacucaaaaaaacaagaaaacuauagaggaaaauuuuucgaucuauggggaagaggaacauggguaagaguaucaccaaca

SEQ ID NO: 50408 - RNA, 405 nt, Artificial Sequence
  derived and/or modified sequence opt6 from anti-HIV_Chain
caucuaguacaaucaggaacagaaguaaaaaaaccaggaagcucaguaacaguaucaugcaaagcauauggaguaaacacauucggacuauaugcaguaaacuggguaagacaagcaccaggacaaucacuagaauacauaggacaaauauggagauggaaaucaagcgcaagucaucacuuuagaggaagaguauuaauaagcgcaguagauuuaacaggaucaagcccaccaauaagcucacuagaaauaaaaaacuuaacaucagacgauacagcaguauauuucuguacaacaacaucaacauaugaccaauggucaggacuacaccaugacggaguaauggcauuuagcucauggggacaaggaacacuaauaucaguaucagcagcaagcacaaaagga

SEQ ID NO: 50409 - RNA, 405 nt, Artificial Sequence
  derived and/or modified sequence opt6 from anti-HIV_Chain
caaguacaauuaguacaaucaggagcagaaguaaaaaaaccaggaagcucaguaaaaguaucaugcaaagcaucaggaggaacauuuagcacauacgcauucucauggguaagacaagcaccaauagaaggauuagaauggaugggaggaauaauaccaauauucggaacagaaaauuacgcacaaaaauuccaaggaagaguaacaauaacagcagauaaaucgacaucaacagcauacauggaauuaaguucacuaagaagcgaagacacagcaguauacuauugcgcaagagauagaucaagcgcaauaggauacuguaguucaauaucaugcuauaaaggaagcuuugacauauggggacaaggaacaaugguaacaguaucaagcgcaagcacaaaagga

SEQ ID NO: 50410 - RNA, 405 nt, Artificial Sequence
  derived and/or modified sequence opt6 from anti-HIV_Chain
caaguacaauuaguacaaaguggagcagaaguaaaaaaaccaggaaguaguguaaaaguaaguuguaaagcaaguggaggaacauuuaguacauaugcauuuaguuggguaagacaagcaccaggacaaggauuagaauggaugggaggaauaauaccaauauuuggaacagaaaauuaugcacaaaaauuucaaggaagaguaacaauaacagcagauaaaaguacaaguacagcauauauggaauuaaguaguuuaagaagugaagauacagcaguauauuauugugcaagagauagaagcagugcaauaggauauuguaguaguauaaguuguuauaaaggaaguuuugauauauggggacaaggaacgaugguaacaguaagcagcgcaaguacaaaagga

SEQ ID NO: 50411 - RNA, 405 nt, Artificial Sequence
  derived and/or modified sequence opt6 from anti-HIV_Chain
gaaguacaauuaguagaaucaggaggaggacuaguacaaccaggaggaucauuaagauuaucaugugcagcaucaggauucacauucucaucauauucaaugaacuggguaagacaagcaccaggaaaaggauuagaauggguaucauauauaucaggaaguucauauacaauauacuaugcagauucaguaagaggaagauuuacaauaucaagagacaaugcaaaaaacucacuauaucuacaaaugaauagcuuaagagaugaagauacagcaguauauuucugugcaagagcaacaccaccaaacccacuaaaucuauauaacuaugacucaucaggaagcucauucgauuacuggggacaaggaacacuaguaacaguaucaagugcaucaacaaaagga

SEQ ID NO: 50412 - RNA, 405 nt, Artificial Sequence
  derived and/or modified sequence opt6 from anti-HIV_Chain
gaaguacaauuaguacaaaguggagcagaaguaaaaaaaccaggaaguucaguaaaaguaucaugcaaagcaucaggaggaacauuuaguacauacgcauucucauggguaagacaagcaccaggacaaggauuagaauggaugggaggaauuauaccaauauuuggaacagaaaauuaugcacaaaaauuucaaggaagaguaacaauaacagcagauaaaucaacaucaacagcauauauggaauuaagcucauuaagaagugaagacacagcaguauauuauugugcaagagauagaucaagugcaauaggauacuguagcucaauaaguuguuauaaaggaaguuuugacauauggggacaaggaacaaugguaacaguaucaagcgcaaguacaaaagga

SEQ ID NO: 50413 - RNA, 405 nt, Artificial Sequence
  derived and/or modified sequence opt6 from anti-HIV_Chain
gaaguacaauuaguagaaucaggagcagaaguaaaaaaaccaggaaguucaguaaaaguaucaugcaaagcaucaggaggaacauuuagcacauacgcauucucauggguaagacaagcaccaggacaaggauuagaauggaugggaggaauaauaccaauauuuggaacagaaaauuacgcacaaaaauuucaaggaagaguaacaauaacagcagauaaaucaacaucaacagcauauauggaauuaaguucauuaagaagugaagacacagcaguauauuauugcgcaagagauagaucaagugcaauaggguacuguaguucaauaucauguuauaaaggaaguuuugauauauggggacaaggaacaaugguaacaguaucaagugcaaguacaaaagga

SEQ ID NO: 50414 - RNA, 405 nt, Artificial Sequence
  derived and/or modified sequence opt6 from anti-HIV_Chain
ccacuaguacaauuagaaccaaguggaguagaaguaaaaaaaagaggagcaaguguaaaaguaagcuguaaaguaaguggauauucauuaacagaauuaaguaugcauuggguaagacaagcaccaggaaaaggauuagaauggaugggaaguuuugauccauuagauggagauacaauauaugcacaaaaauuccaaggaagaguaacaaugacaguagauacaaguacagauacagcauauauggauuuaaguaguuuaagauucgaagauacagcaguauauuauugugcaacaccaucaaaagcauauuauuaugauaguccaaauuaugaaggagauuuuuauauggauguauggggaaaaggaacaacaguaauaguaucaagugcaaguacaaaagga

SEQ ID NO: 50415 - RNA, 408 nt, Artificial Sequence
  derived and/or modified sequence opt6 from anti-HIV_HeavyChain
caaauacaucuaguacaaucaggaacagaaguaaaaaaaccaggaagcucgguaacaguaucaugcaaagcauauggaguaaacacauucggacuauaugcaguaaacuggguaagacaagcaccaggacaaucacuagaauacauaggacaaauauggagauggaaaucaagcgcaagccaucacuuuagaggaagaguacuaauaagcgcaguagaucuaacaggaucaagcccaccaauaagcucacuagaaauaaaacuaacaagcgaugacacagcaguauacuuuugcacaacaacaagcacauacgauaaauggagcggacuacaucacgauggaguaauggcauucucaagcagaggacaaggaacacuaauaagcguaagugcagcaucaacaaaagga

SEQ ID NO: 50416 - RNA, 408 nt, Artificial Sequence
  derived and/or modified sequence opt6 from anti-HIV_HeavyChain
caaauacaucuaguacaaucaggaacagaaguaaaaaaaccaggaaguucaguaacaguaucaugcaaagcauauggaguaaauacauucggacuauaugcaguaaacuggguaagacaagcaccaggacaaggacuagaauacauaggacaaauauggagauggaaaucaagcgcaagccaucacuuuagaggaagaguacuaauaagcgcaguagaucuaacaggaucaagcccaccaauaagcucacuagaaauaaaaguaacaagcgaugacacagcaguauacuuuugcacaacaacaagcacauacgaugaauggagcgaucuacaucacgauggaguaauggcauucucaagcuggggacaaggaacacuaauaagcguaagcgcagcaucaacaaaagga

SEQ ID NO: 50417 - RNA, 408 nt, Artificial Sequence
  derived and/or modified sequence opt6 from anti-HIV_HeavyChain
caaauacaucuaguacaaucaggaacagaaguaaaaaaaccaggaagcucaguaacaguaucaugcaaagcauauggaguaaacacauucggacuauaugcaguaaacuggguaagacaagcaccaggacaaucauuagaauacauaggacaaauauggagauggaaaucaagcgcaagccaucacuuuagaggaagaguauuaauaagcgcaguagaucuaacaggaucaaguccaccaauaaguucacuagaaauaaaacuaacaagugaugacacagcaguauacuuuugcacaacaacaagcacauacgauagauggagcggacuacaucacgauggaguaauggcauucucaagcuggggacaaggaacauuaauaagcguaagcgcagcaucaacaaaagga

SEQ ID NO: 50418 - RNA, 408 nt, Artificial Sequence
  derived and/or modified sequence opt6 from anti-HIV_Chain
uguaauccaagaguacauagugaaguacaauuaguagaaaguggagcagaaguaaaaaaaccaggagcaaguguaaaaguagcauguaaaguaaguggaaaaaaauuaagugauuuaaguauacauuggguaagacaagcaccaggaaaaggauuagaauggaugggaggauuugaugaagaagauggaaaaauaaguuaugaaagaaaauuucaaggaagaguaaguaugacagaagauacagcaagagauacagcauuuauggaaaugaguagucuaagaagugaugauacagcaguauauuuuugugcugcagcaccaagauuagauuuaggagaauuaaguagcggauuucauuuuuggggauuaggaacauuaguaacaguaaguagugcaaguacaaaagga

SEQ ID NO: 50419 - RNA, 408 nt, Artificial Sequence
  derived and/or modified sequence opt6 from anti-HIV_Chain
auaugggcaccacuaauagcaguaacauuucuaguauuacauugcgaaucauuaggaacaugcuguugcugucaagcaucaggaggaacauucaauacauuugcaauaaacuggguaagacaagcaccaggacaaggauuagaauggguaggaggaauaauaccaguauucggaacagcaucauaugcacaaaaauuucaaggaagaguaacaguaacaacagacgaaucaagaggaacagcauauauggaacuaaauucauuaagaucagaagauacagcaguauauuacugugcaagaggacaaacagauuuaaaugacgauuuauggucagauuauucaacaccaggauuugacuauuggggacaaggaacauuaguaacaguaucaucagcaucaacaaaagga

SEQ ID NO: 50420 - RNA, 408 nt, Artificial Sequence
  derived and/or modified sequence opt6 from anti-HIV_Chain
uuacaaccaagaguacauagugaaguacaauuaguagaaaguggagcagaaguaaaaaaaccaggagcaaguguaaaaguaaguuguaaaguaagcggauauacauuaagugauuuaaguaugcauuggguaagacaagcaccaggaaaaggauuagaauggaugggaggauuugaugaagaagauggagaaauaacauaugcacaaaaauuucaaggaagaguaaguaugacagaagauacaaguagagauacagcauauauggaauuaaguaguuuaagaagugaagauacagcaguauauuauugugcaacagcaccaagauuagaauuaggagaauuaaguaguggauuucauuauuggggauuaggaacauuaguaacaguaaguagcgcaaguacaaaagga

SEQ ID NO: 50421 - RNA, 408 nt, Artificial Sequence
  derived and/or modified sequence opt6 from anti-HIV_Chain
caaucacaaguacacuuaguacaaagcggagcagaaguaaaaaaaccaggaucaagcguaaaaguaagcugucaagcaagcggaggaacauucaauacauuugcaauaaacuggguaagacaagcaccaggacaaggacuagaauggguaggaggaauaauaccaguauucggaacagcuagcuaugcacaaaaauuucaaggaagaguaacaguaacaacagacgaaagcagaggaacagcauauauggaacuaaauagccuaagaucagaagauacagcaguauauuacugugcaagaggacaaacagaucuaaaugacgaucuauggagcgauuacucaacaccaggauuugacuauuggggacaaggaacauuaguaacaguaucaagcgcaaguacaaaagga

SEQ ID NO: 50422 - RNA, 408 nt, Artificial Sequence
  derived and/or modified sequence opt6 from anti-HIV_Chain
ggaucagaaguacaauuaguagaaaguggagcagaaguaaaaaaaagaggagcaagugugaaaguaaguuguaaaguaaguggauauucauuaacagaauuaagcaugcauuggguaagacaagcaccaggaaaaggauuagaauggaugggaucauuugauccauuagacggagauacaauauaugcacaaaaauuucaaggaagaguaacaaugacaguagauacaaguacagauacagcauauauggauuuaucaaguuuaagauuugaagauacagcaguauauuauugugcaacaccaucaaaagcauauuauuaugauagcccaaauuaugaaggagauuuuuauauggauguauggggaaaaggaacaacaguaauaguaucaagcgcaaguacaaaagga

SEQ ID NO: 50423 - RNA, 408 nt, Artificial Sequence
  derived and/or modified sequence opt6 from anti-HIV_Chain
caaguacaauuaguacaaagcggaggagaaguaaaaaaaccaggagcaagcguaaaaguaagcuguaaaguaagcggauacucacuaacagaauuaagcaugcacuggguaagacaagcaccaggaaaaggacuagaauggaugggaguauucgauccacuagaaggagacggaguauauguacaaaaauuuagaggaagaguaauaaugacagaagacacaagcacagacacagcauauauggaacuaacaagcuuaagaucagaagauacagcaauauauuacugugcaacaaaagcaaaagauuacuauuacgaaagcucagacuauaguccauacuauuacuauuacauggacguauggggaaaaggaacaacaguaacaguaucaagcgcaagcacaaaagga

SEQ ID NO: 50424 - RNA, 408 nt, Artificial Sequence
  derived and/or modified sequence opt6 from anti-HIV_Chain
gaaguacaauuaguacaaagcggagcagaaguaaaaaaaccaggagcaagcguaaaaguaagcuguaaaguaagcggauacacacuaacagaauuaagcaugcacuggguaagacaagcaccaggaaaaggacuagaauggaugggaguauucgauccauuagaaggagacggaguauaugcagaaaaauuuagaggaagaguaauaaugacagaagacacaagcacagacacgggauauauggaacuaacaagcuuaagaucagaagauacagcaauauauuacugugcaacaaaagcaaaagauuacuauuacgaaagcucagacuauaguccauacuauuacuauuacauggacguauggggaaaaggaacaacaguaacaguaucaagcgcaagcacaaaagga

SEQ ID NO: 50425 - RNA, 408 nt, Artificial Sequence
  derived and/or modified sequence opt6 from anti-HIV_Chain
caaguacaauuaguacaaagcggagcagaaguaaaaaaaccaggagcaagcguaaaaguaagcuguaaagcaagcggauacacauucacaagauaucacauacacuggguaagacacgcaccaggacaaggacuagaauggaugggaaaaauaaauccaucaagagcaagcacaaaauaugcaaaaaaauuucaagauagaguaacaaugacaagagacacaagcacaagcacaguauauauggaacuaucaagccuaagaggagacgauacagcaguauauuacuguggaagagaaaugggaacauucacacuauuaggaguaguaauagaccauuacgauuucuauccaauggacguauggggacaaggaacaccaguaacaguaucaagcgcaagcacaaaagga

SEQ ID NO: 50426 - RNA, 408 nt, Artificial Sequence
  derived and/or modified sequence opt6 from anti-HIV_Chain
ucacguccaccuucaugucuacuuggauguugguguuguucuggauuucuauuaccagcuguaauucuaccuaaccuucacucuccaugucuaucucuacuugaaucucaaccuccaucucuagcugaccuuguaucugcuuuugcaguuauggauauaccuauauauauagguacauauagaucucaagcaucauuacacucuucauccacaaaauucccuacagauuuccuuggaucucaaacuggauccguagcuguaggucaaggucaaauuucacaucuacguucaguugaauggagacuuagaaugugggaauuuauuacagcucuaaaaguacauauguuccuaucuagaucugaccguggaccuagauggaaaaauguaucuucacuucuaaauucacgu

SEQ ID NO: 50427 - RNA, 411 nt, Artificial Sequence
  derived and/or modified sequence opt6 from anti-HIV_HeavyChain
caaauacaccuaguacaaucaggaacagaaguaaaaaaaccaggaucaucaguaacaguaucaugcaaagcauacggaguaaacacauucggucuauacgcaguaaacuggguaagacaagcaccaggacaaucauuagaauacauaggacaaauauggagauggaaaucaucagcaucacaccacuucagaggaagagucauaauaucagcuguagaccuaacaggcucaucaccaccaauaucaccacuagaaauaaaaaaccuaacaucagacgacacagcaguauacuucugcacaacaacaucaacaucagacagauggucaggacuacaccacgacggaguaauggcauucucaucauggggacaaggaacauuaauaucaguaucagcagcaucaacaaaagga

SEQ ID NO: 50428 - RNA, 411 nt, Artificial Sequence
  derived and/or modified sequence opt6 from anti-HIV_HeavyChain
caaauacaccuaguacaaucaggaacagaaguaaaaaaaccaggaucaagcguaacaguaucaugcaaagcauacggaguaaacacauucggacuauacgcaguaaacuggguaagacaagcaccaggacaaucacuagaauacauaggacaaauauggagauggaaaagcucagcaucacaccacuucagaggaagaguaauaauaucagcaguagacuuaacaggaucaucaccaccaauaucaucauuagaaauaaaaaaccuaacaucagacgacacagcaguauacuucugcacaacagcaucaacauacgacaaauggucaggauuacaccacgacggaguaauggcauucucaucauggggacaaggaacacuaauaucaguaagcgcagcaucaacaaaagga

SEQ ID NO: 50429 - RNA, 411 nt, Artificial Sequence
  derived and/or modified sequence opt6 from anti-HIV_HeavyChain
caaauacaccuaguacaaucaggaacagaaguaaaaaaaccaggaucaucaguaacaguaucaugcaaagccuacggaguaaacacauucggacuauacgcaguaaacuggguaagacaagcaccaggacaaucacuagaauacauaggacaaauauggagauggaaaucaucagcaucacaccacuucagaggaagaguacuaauaagcgcaguagaucuaacaggaccaagcccaccaauaucaucacuagaaauaaaaaaccuaacaagugacgacacagcaguauauuucugcacaaccacaucaacauacgacaaauggucaggauuacaccacgacggaguaauggcauucucaucauggggacaaggaacacuaauaucaguaucagcagcaucaacaaaagga

SEQ ID NO: 50430 - RNA, 411 nt, Artificial Sequence
  derived and/or modified sequence opt6 from anti-HIV_HeavyChain
caaauacacuuaguacaaucaggaacagaaguaaaaaaaccaggaucaucaguagcaguaucaugcaaagcauacggaguaaacacauucggacuauaugcaguaaacuggguaagacaagcaccaggacaaucacuagaauacauaggacaaauauggagauggaaaucaucagcaucacaugacuucagaggaagaguaauaauaucagcaguagaucuaacaggaucaucaccaccaauaucaucacuagaaauaaaaaacuuaacaucagacgacacagcaguauauuucugcacagcaacaucaacaccagacuauuggucaggacuacaccaugacggaguaauggcauuuucaucauggggacaaggaacauuaauaucaguaucagcagcaucaacaaaagga

SEQ ID NO: 50431 - RNA, 411 nt, Artificial Sequence
  derived and/or modified sequence opt6 from anti-HIV_HeavyChain
caaauacauuuaguacaaucaggaacaggaguaaaaaaaccaggaagcucaguaacaguaucaugcaaagcauauggaguaaacacauucggacuauaugcaguaaacuggguaagacaagcaccaggacaaggacuagaauacauaggacaaauauggagauggaaaaguagugcaagccaucacuuuagaggaagaguacuaauaagugcaguagaucuaacaggaaguaguccaccaauaacaucacuagaaauaaaaaauguaacaucagacgauacagcaguauauuucuguacaacaacaaguacauaugacaaauggucaggacuauaccaugacggaguaauggcauuuaguucauggggacaaggaacauuaauaucaguaagugcagcaaguacaaaagga

SEQ ID NO: 50432 - RNA, 411 nt, Artificial Sequence
  derived and/or modified sequence opt6 from anti-HIV_HeavyChain
caaauacaccuaguacaaucaggaacagaaguaaaaaaaccaggaucaucaguaacaguaucaugcaaagcauacggaguaaacacauucggacuauacgcaguaaacuggguaagacaagcaccaggacaaucacuagaauacauaggacaaauauggagauggaaaucaucagcaucacaccacuucagaggaagaguaauaauaucagcaguagaccuaacaggaucaucaccaccaauaucaucacuagaaauaaaaaaccuaacaucagacgacacagcaguauacuucugcacaacaacaucaacaucagacuacuggucaggacuacaccacgacggaguaauggcauucucaucauggggacaaggaacacuaauaucaguaucagcagcaucaacaaaagga

SEQ ID NO: 50433 - RNA, 411 nt, Artificial Sequence
  derived and/or modified sequence opt6 from anti-HIV_HeavyChain
caaauacacuuaguacaaagcggaacagaaguaaaaaaaccaggaaguagcguaacaguaagcuguaaagcauacggaguaaauacauuuggauuauacgcaguaaauuggguaagacaagcaccaggacaaagcuuagaauauauaggacaaauauggagauggaaaaguucagcaucacaccauuucagaggaagaguauuaauaucagcaguagacuuaacaggaaguucaccaccaauaucaagcuuagaaauaaaaaaucuaacaagugaugacacagcaguauacuuuugcacaacaacaagcacauacgauagauggagcggacuacaucacgauggaguaauggcauucucaaguuggggacaaggaacacuaauaagcguaagcgcagcaucaacaaaagga

SEQ ID NO: 50434 - RNA, 411 nt, Artificial Sequence
  derived and/or modified sequence opt6 from anti-HIV_HeavyChain
caaauacaucuaguacaaucaggaacagaaguaagaaaaccaggaagcucuguaacaguaucaugcaaagcauauggaguaaacacauucggacuauaugcaguaaacuggguaagacaagcaccaggacaaucacuagaauacauaggacaaauauggagauggaaaucaagugcaagccaucacuuuagaggaagaguacuaauaagcgcaguagauuuaacaggaucaagcccaccaauaaguucacuagaaauaaaaaacuuaacaucagacgauacagcaguauauuucuguacaacaacaucaacauaugacaaauggucaggauuacaccaugacggaguaauggcauuuaguucauggggacaaggaacauuaauaucaguaucagcagcaagcacaaaagga

SEQ ID NO: 50435 - RNA, 411 nt, Artificial Sequence
  derived and/or modified sequence opt6 from anti-HIV_HeavyChain
caaauacaucuaguacaaucaggaacagaaguaaaaaaaccaggaucaucaguaacaguaucaugcaaagcauacggaguaaacacauucggacuauaugcaguaaacuggguaagacaagcaccaggacaaucucuagaauacauaggacaaauauggagauggaaaucaucagcaucacaucacuuuagaggaagaguauuaauaucagcaguagaccuaacaggaucaucaccaccaauaagcucacuagaaauaaaaaacuuaacaucagacgacacagcaguauauuucugcacaacaacaucaacauaugaccaauggucuggacuacaccaugacggaguaauggcauucucaucauggggacaaggaacauuaauaucaguaucagcagcaucaacaaaagga

SEQ ID NO: 50436 - RNA, 411 nt, Artificial Sequence
  derived and/or modified sequence opt6 from anti-HIV_HeavyChain
caaauacacuuaguacaaucaggaacagaaguaaaaaaaccaggaaguucaguaacaguaucauguaaagcauacggaguaaauacauucggacuauacgcaguaucauggguaagacaagcaccaggacaaagacuagaauacauaggacaaauaagaagauggaaaucaucagcaucacaccauuucagaggaagaguaacaguaucagcaguagacccaacaggaucaucaccaccaauaucaagccuagaaauaagagaccuaacaacagacgacacagcaguauacuucugcacaacaacaucaacaucagacuacuggucaggccuacauaacgaaagaggaacagcauucucaagcuggggacaaggaacacuaauaucaguaucagcagcaucaacaaaagga

SEQ ID NO: 50437 - RNA, 411 nt, Artificial Sequence
  derived and/or modified sequence opt6 from anti-HIV_HeavyChain
caaauacaucuaguacaaucaggaacagaaguaaaaaaaccaggaagcucaguaacaguaucaugcaaagcauauggaguaaacacauucggauuauaugcaguaaacuggguaagacaagcaccaggacaaggauuagaauacauaggacaaauauggagauggaaaucaagcgcaagccaucacuuuagaggaagaguacuaauaagcgcaauagacuuaacaggaucaaguccaccaauaagcucacuagaaauaaagaacguaacaucagacgauacagcaguauauuucuguacaacaaugucaacauaugacaaauggucaggauuacaccaugacggaguaauggcauuuagcucguggggacaaggaacauuaauaucaguaucagcagcaagcacaaaagga

SEQ ID NO: 50438 - RNA, 411 nt, Artificial Sequence
  derived and/or modified sequence opt6 from anti-HIV_HeavyChain
caaauacaccuaguacaaucaggaacagaaguaaaaaaaccaggaucaucaguaacaguaucaugcaaagcauacgaaguaaacacauucggacuauacgcaguaaacuggguaagacaagcaccaggacaaucacuagaauacauaggacaaauauggagauggaaaagcucagcaucacaccacuucagaggaagaguacuaauaucagcaguagaccuaacaggaucaucaccaccaauaucaucacuagaaauaaaaaacguaacaucagacgacacagcaguauacuucugcacaacaacaucaacacacgacaaauggucaggacuacaccacgacggaguaauggcauucucaagcuggggacaaggaacacuaauaucaguaucagcagcaucaacaaaagga

SEQ ID NO: 50439 - RNA, 411 nt, Artificial Sequence
  derived and/or modified sequence opt6 from anti-HIV_HeavyChain
caaauacaucuaguacaaucaggaacagaaguaaaaaaaccaggaagcucaguaacaguaucaugcaaagcauauggaguaaacacauucggacuauaugcaguaaacuggguaagacaagcaccaggacaaggacuagaauacauaggacaaauauggagauggaaaucaucagcaagccaucacuuuagaggaagaguacuaauaagcgcaguagaucuaacaggaucgagcccaccaauaagcucacuagaaauaaaaaacguaacaucagacgauacagcaguauauuucuguacaacaacaucaacauaugacaaauggucaggauuacaccaugacggaguaguagcauuuagcucauggggacaaggaacauuaauaucaguaucagcagcaagcacaaaagga

SEQ ID NO: 50440 - RNA, 411 nt, Artificial Sequence
  derived and/or modified sequence opt6 from anti-HIV_Chain
caaguaacauuaguacaaaguggagcagaaguaaaaaaaccaggagcaaguguaagaauaaguuguagagcaaguggauuuacauuugaugauuauagugauuauucauuuauaccaacaacauauuuaauacacugguucagacaagcaccaggacaaggauuagaauggauggcauggauaaauaguguaaauggaggaagaaauauagcaagacaauuucaaggaagaguaacaguagcaagagacagaaguaauagcauagcauuuuuagaauuuucaggauuacgacaugaugauacagcaguauauuucugugcaagagacagaagagaugacgauagagcaugguuauuagauccauggggacaaggaacaagaguaacaguaagcucagcaucaacuaaagga

SEQ ID NO: 50441 - RNA, 411 nt, Artificial Sequence
  derived and/or modified sequence opt6 from anti-HIV_Chain
caaauacaucuaguacaaucaggaacugaaguaaaaaaaccaggaucaucaguaacaguauccugcaaagcauacggaguaaacacauucggacuauacgcaguaaacuggguaagacaagcaccaggacaaucacuagaauacauaggacaaauauggagauggaaaucaucagcaucacaccacuucagaggaagaguacuaauaagcgcaguagacuuaacaggaucaucaccaccaauaucaucacuagaaauaaaaaaccuaacaucagacgacacagcaguauacuucugcacaacaacaucaacauacgacaaauggucaggacuacaccacgacggaguaauggcauucucaucauggggacaaggaacacuaauaucaguaucagcagcaucaacaaaagga

SEQ ID NO: 50442 - RNA, 414 nt, Artificial Sequence
  derived and/or modified sequence opt6 from anti-HIV_Chain
guaguacaauuaguacaaaguggagcagaaguaagaaaaccaggaagcaguuuaaaaguaaguuguaaaaguaguggaggaacauuuaguagauuuguaguaaauuggguaagacaagcaccaggacaaggacuagaauggaugggaggaaugauaccaauauuuggaauagcaaaauaugcacaaaaauuucaagauagaguaacaaugacagcagaugaaaguaaaaauacaguauauuuagauuuuaguaguuuaagaagugaugauacagcaguauauuauugugcaagagauagaggagauacaagauuauuagauuauggagauuaugaagaugaaagauauuauuauggaauggauguauggggacaaggaacaacaguaauaguaagcagugcaaguacaaaagga

SEQ ID NO: 50443 - RNA, 414 nt, Artificial Sequence
  derived and/or modified sequence opt6 from anti-HIV_Chain
caaguacaauuaguacaaaguggagcagaaguaagaaaaccaggaaguaguuuaaaaguaagcuguaaaaguaguggaggaacauuuaguagauuuguaguaaauuggguaagacaagcaccaggacaaggauuagaauggaugggaggaaugauaccaauauuuggaauagcaaaauaugcacaaaaauuucaagauagaguaacaaugacagcagaugaaaguaaaaauacaguauauuuagauuuuagcaguuuaagaagcgaugauacagcaguauauuauugugcaagagauagaggagauacaagauuauuagauuauggagauuaugaagaugaaagauauuauuauggaauggauguauggggacaagggacaacaguaauaguaaguagugcaaguacaaaagga

SEQ ID NO: 50444 - RNA, 414 nt, Artificial Sequence
  derived and/or modified sequence opt6 from anti-HIV_Chain
gaaguacaauuaguagaaaguggagcagaaguaagaaaaccaggaaguaguuuaaaaguaaguuguaaaaguaguggaggaacauuuaguagauuuguaguaaauuggguaagacaagcaccaggacaaggauuagaauggaugggaggaaugauaccaauauuuggaauagcaaaauaugcacaaaaauuucaagauagaguaacaaugacagcagacgaaaguaaaaauacaguauauuuagauuuuaguaguuuaagaagugaugauacagcaguauauuauugugcaagagauagaggagauacaagauuauuagauuauggagauuaugaagaugaaagauauuauuauggaauggauguauggggacaaggaacaacaguaauaguaaguagugcaaguacaaaagga

SEQ ID NO: 50445 - RNA, 414 nt, Artificial Sequence
  derived and/or modified sequence opt6 from anti-HIV_Chain
caaguacaauuaguagaaaguggagcagaagugagaaaaccaggaaguaguuugaaaguaaguuguaaaucaaguggaggaacauuuaguagauauguaguaaauuggguaagacaagcaccaggacaaggauuagaauggaugggaggaauaauaccaauauuuggaauagcaaaauaugcacaaaaauuucaagauagaguaacaaugacagcagaugaaccaaaaaauacaguauauuuagauuuuaauaguuuaagaagugaugauacagcaguauauuauugugcaagagauagaggagauacaagauuauuagauuauggagauuaugaagaugaaagauauuauuauggaauggauguauggggacaaggaacaacaguaauaguaaguagugcaaguacaaaagga

SEQ ID NO: 50446 - RNA, 414 nt, Artificial Sequence
  derived and/or modified sequence opt6 from anti-HIV_Chain
caaguacaauuaguacaaaguggagcagaaguaagaaaaccaggaucaagucuaaaaguaaguuguaaaucaaguggaggaacauuuagcagauauguaguaaauuggguaagacaagcaccaggacaaggauuagaauggaugggaggaaugauaccaauauucggaauagcaaaauaugcacaaaaauuucaagauagaguaacaaugacagcagaugaaaguaaaaauacaguauauuuagauuuuaguaguuuaagaucagaugauacagcaguauauuauugugcaagagauagaggagauacaagauuauuagauuauggagauuaugaagaugaaagauauuauuauggaauggauguauggggacaaggaacaacaguaauaguaaguagugcaaguacaaaagga

SEQ ID NO: 50447 - RNA, 414 nt, Artificial Sequence
  derived and/or modified sequence opt6 from anti-HIV_Chain
caaguacaauuaguacaaaguggagcagaaguaagaaaaccaggaaguaguuuaaaaguaaguuguaaaucaaguggaggaacauuuaguagauauguaguaaauuggguaagacaagcaccaggacaaggauuagaauggaugggaggaauaauaccaauauuuggaauagcaaaauaugcacaaaaauuucaagauagaguaacaaugacagcagaugaaaguaaaaauacaguauauuuagauuuuaguaguuuaagaagugaugauacagcaguauauuauugugcaagagauagaggagauacaagauuauuagauuauggagauuaugaagaugaaagauauuauuauggaauggauguauggggacaaggaacaacaguaauaguaaguagugcaagcacaaaagga

SEQ ID NO: 50448 - RNA, 414 nt, Artificial Sequence
  derived and/or modified sequence opt6 from anti-HIV_Chain
caaguacaauuaguagaaagcggagcagaaguaagaaaaccaggaaguaguuuaaaaguaaguuguaaaagcaguggaggaacauuuaguagauauguaguaaauuggguaagacaagcaccaggacaaggauuagaauggaugggaggaauaauaccaauauuuggaauagcaaaauaugcacaaaaauuucaagauagaguaacaaugacagcagaugaaaguaaaaauacaguauauuuagauuuuagcaguuuaagaagugaugauacagcaguauauuauugugcaagagacagaggagauacaagauuauuagauuauggagauuaugaagaugaaagauauuauuauggaauggauguauggggacaaggaacaacaguaauaguaaguagugcaagcacaaaagga

SEQ ID NO: 50449 - RNA, 414 nt, Artificial Sequence
  derived and/or modified sequence opt6 from anti-HIV_Chain
caaguacaauuaguacaaaguggagcagaaguaagaaaaccaggaucaaguuuaaaaguaagcuguaaaaguaguggaggaacauuuaguagauauguaguaaacuggguaagacaagcaccaggacaaggauuagaauggaugggaggaauaauaccaauauucggaauagcgaaauaugcacaaaaauuucaagauagagugacaaugacagcagaugaaccaaaaaauacaguauauuuagauuuuaauagcuuaagaagugaugauacagcaguauauuauugugcaagagauagaggagauacaagacuauuagauuauggagauuaugaagaugaaagauauuauuauggaauggauguauggggacaaggaacaacaguaauaguaaguagugcaaguacaaaagga

SEQ ID NO: 50450 - RNA, 414 nt, Artificial Sequence
  derived and/or modified sequence opt6 from anti-HIV_Chain
guaguacaauuaguacaaaguggagcagaaguaagaaaaccaggaaguaguuuaaaaguaaguuguaaaaguaguggaggaacauuuaguagguauguaguaaauuggguaagacaagcaccaggacaaggauuagaauggaugggaggaaugauaccaauauuuggaauagcaaaauaugcacaaaaauuucaagauagaguaacaaugacagcagaugaaaguaaaaauacaguauauuuagauuuuagcaguuuaagaagugaugauacagcaguauauuauugugcaagagauagaggagauacaagauuauuagauuauggagauuaugaagaugaaagauauuauuauggaauggauguauggggacaaggaacaacaguaauaguaagcagugcaaguacaaaagga

SEQ ID NO: 50451 - RNA, 414 nt, Artificial Sequence
  derived and/or modified sequence opt6 from anti-HIV_Chain
uucauaugcuuuaguguaguaguaagauuacuagaauuuggaggaagauuaguacaaccaggagggaguuuaagauuaagcuguagugcaaguggauucacauucucaaacucagcaaugaguuggguaagacaagcaccaggaaaaggacuagaauggguaagcucaauauuaagcucaggaguaggaacauucuaugcagauagcguaaaaggaagauucacaguaaguagagacaauagcagaaacacacuauaucuacaaaugaaaagccuaagagcagaagauacagcacuauauuacugugcaaaaguacaaauacaacaauuaaacuuuggaguaauaacagacgcaggauuagacguauggggaaaaggaacaacacuaauaguaucaagcgcaagcacaaaagga

SEQ ID NO: 50452 - RNA, 414 nt, Artificial Sequence
  derived and/or modified sequence opt6 from anti-HIV_Chain
caaguucaauuaguacaaaguggagcagaaguaagaaaaccaggaaguagcuuaaaaguaaguuguaaaaguaguggaggaacauuuaguagauauguaguaaauuggguaagacaagcaccaggacaaggauuagaauggaugggaggaauaauaccaauauuuggaauagcaaaauaugcacaaaaauuucaagauagaguaacaaugacagcagaugaaagcaaaaauacaguauauuuagauuuuaguaguuuaagaucaggagauacagcaguauauuauugugcaagagauagaggagauacaagauuauuagauuauggagauuaugaagaugaaagauauuauuauggaauggauguauggggacaaggaacaacaguaacaguaagcagugcaagcacaaaagga

SEQ ID NO: 50453 - RNA, 417 nt, Artificial Sequence
  derived and/or modified sequence opt6 from anti-HIV_Chain
caaguacaauuaguagaaagcggagcagaaguaaaaaaaccaggaucaagcguaaaaguaagcuguaaagcaagcggaggaacauucaauauauuugcauuuaguuggguaagacaagcaccaggacaaggacuagaauggaugggaggaauaauaccaauauucgcaagcccaaacuaugcacaaagauuucaaggaagaguaacaauaacagcagacgaaagcacgagcacaguacauauggaauuaucaagcuuaagaucagaagauacagcaauauauuacugugcaaaagacgcacacaugcacauagaagaaccaagagacuaugacuauauauggggaacaagcccauacuauuucgauuacuggggacaaggaacauuaguaacaguaagcucagcaucaacaaaagga

SEQ ID NO: 50454 - RNA, 417 nt, Artificial Sequence
  derived and/or modified sequence opt6 from anti-HIV_Chain
caaguacaauuaguagaaaguggagcagaaguaaaaaaaccaggagcaaguguaaaaguaagcuguaaagcaaguggauauacauuuacaagucaugauauaaauuggguaagacaagcaacaggacaaggauuagaauggaugggauggaugaauccaaauagcggagauacaggauaugcacauaaauuucaaggaagaguaacaaugacaagaaauacaccaauaaguacagcauauauggaauuaaguaguuuaagaagugaagauacagcaguauauuauugugcaagaggaagagcaacaaguagaaauacaccaugggcacauuauuaugauaguaguggauauuauggagcaggagauuauuggggacaaggaacauuaguaacaguaaguagugcaaguacaaaagga

SEQ ID NO: 50455 - RNA, 417 nt, Artificial Sequence
  derived and/or modified sequence opt6 from anti-HIV_Chain
caaguacaaauaagacaaagcggacccggauuaguaaaaccacuagaaacacuaagccuaagcuguauaguauucggaggaucauucauagcauaucacuggacauggauaagacaagcaccauuaaaaggacuagaauggauaggagauauagaucaaggaggagauauaacauacucaccaucauuaaaaaguagaguaacaaugucagucgauagaucaaaaucacaauuuagcuuaaaauuaagcucaguaacagcagcagacgcagcaguauacuauugcguaagaggaccaccaaacagauacgcaguaacaucauuuacaagcggaacacacagagaaagaagcucauacuauuucgauuacuggggaccaggaacauuaguaacaguaagcucagcaucaacaaaagga

SEQ ID NO: 50456 - RNA, 423 nt, Artificial Sequence
  derived and/or modified sequence opt6 from anti-HIV_Chain
aauggaggaagucuaagauuaaguuguagaguaaguggauuuggauuucauuuauaugaaaugaauuggguaagacaagcaccaggaaaaggauuagaauggauaaguucaauaucaggaucaggagaaaguacacauuauagugauaguauaacaggaagauuuaguaugaguagagaugaggcaaaagacaguuuauauuuacaaaugaauaauuuaagaguagaagauacagcaguauauuauuguacaagaggauuuaguaugggagauggaacaggauuuagcuuugauacauggggaagaggaacaaugguaacaguaaguaguggauuagauacaguaaguuuagcaaguacaaaaggaccaagcguauuuccauuagcaccauguaguagaaguacaagugaugcaagauuaagu

SEQ ID NO: 50457 - RNA, 423 nt, Artificial Sequence
  derived and/or modified sequence opt6 from anti-HIV_Chain
caaguacaauuaguacaaucaggagcagaaguaaaaaaaccaggaaguucaguaaaaguaucauguaaagcaucaggaggaacauuuaguacauacgcaauaucauggguaagacaagcaccaggacaaggauuagaauggaugggaggaauaauaccaaguuuuaguaugaguaauuaugcacaagauuuucaaggaagauuaacaauaacagcagaugaaucaacaucaaguguauacauggaauuaaacucauuaagaagcgaagacacagcaguauacuauugugcaagagauuuuccaagauuucacagauuaguaggaaauuaugauuucuggagaggaacauuagacagauucucauauauggauuuauggggaagaggaacagcaguaacaguaucaagugcaagcacaaaagga

SEQ ID NO: 50458 - RNA, 423 nt, Artificial Sequence
  derived and/or modified sequence opt6 from anti-HIV_Chain
cuaguacaauuaguagaaucaggaggaggaguaguacaaccaggaagaucauuaagauuaucaugugcagcaucaggauuuacauuuucaacauaugcaaugcauuggguaagacaagcaccaggaaaaggacuagaauggguagcaguaauaucauaugauggaucaaauaaauucuaugcagauucaguaaaaggaagauuuacaauaucaagagacaauaguaaaaacacacuauauuuacaaaugaacucauuaagagcagaagauacagcaguauauuacugugcaagaccaaaauucuuaccaggagcagauauaguaguaguaguagcagcaacaccauuugacuauuggggacaaggaaauccaggacauagauuacuaucauuucaucaaggaccaauaggauuaccaccagga

SEQ ID NO: 50459 - RNA, 423 nt, Artificial Sequence
  derived and/or modified sequence opt6 from anti-HIV_HeavyChain
auggaauggaguggaguauuuauauuuuuauuaaguguaacagcaggaguacauagugaaguacaauuaguagaaaguggaggaggauuaguaaaaccaggaggaaguuuaagauuaaguugugcagcgagcggauauacauucaguaauuauuggauaggauggguaagacaagcaccaggaaaaggauuagaauggauaggagauauauauccaggaggaaauuauauaagaaauaaugaaaaauuuaaagauaaaacaacauuaagugcagacacaaguaaaaauacagcauauuuacaaaugaauaguuuaaaaacagaagauacagcaguauauuauuguggaaguaguuuuggaaguaauuauguauuugcaugguuuacauacuggggacaaggaacauuaguaacaguaaguagu

SEQ ID NO: 50460 - RNA, 423 nt, Artificial Sequence
  derived and/or modified sequence opt6 from anti-HIV_HeavyChain
auggaauggagcggaguauuuauauuucuauuaaguguaacagcaggaguacacucacaaguacaauuaguacaaagcggaccagauguaaaaaaaccaggaacaaguaugaaaaugagcuguaaaacaagcggauacacauucucaaacuauuggauaggauggguaagacaagcaccaggacaaggacuagaauggauaggagauauauauccaggaggaaauuacauacgaaauaacgaaaaauuuaaagauaaaacaacacuaacagcagacacaagcacaaguacagcauauaugcaacuaggaagcuuaagaucagaagauacagcaguauauuacuguggaucaaguuuuggaucaaacuauguauuugcaugguucacauacuggggacaaggaacacuaguaacaguaagcuca

SEQ ID NO: 50461 - RNA, 429 nt, Artificial Sequence
  derived and/or modified sequence opt6 from anti-HIV_Chain
caaguauucguacaauuaguacaaagcggaggaggauuaguacaaccaggaggaagcguaagauuaaguuguacagcaaguggauucuuauucucaacauauaguaugaacuggguaagacaagcaccaggaaaaggacuagaauggguaagcucaauaucaacaacaagcaauuacauauacuaugcagauaguguaaaaggaagauuuacaauaagcagaagcaauggacaaggaucacuauaucuacaacuaaauaguuuaagaguagaagauacagcaguauauuacugugcaagagacacaaaaguaggagcaccaagacaagauugcuaugcaauggacuuauggggacaaagagaccauggacauagauuacuaucauuccaucaaggaccaauaggauuaccaccaggagcacuauuacaa

SEQ ID NO: 50462 - RNA, 432 nt, Artificial Sequence
  derived and/or modified sequence opt6 from anti-HIV_Chain
auaauauuauucuuaguagcaacagcaacaggaguacacucagacauacaaaugacacaaucaccaucaucacuauccgcaucaguaggagacagaguaacaauaaccugcagagcaucacaaucaauagaccgauaccuaaacugguaccaacacaaaccaggaaaagcaccaaaacuacuaauauacgcagcaucaaaccuacacacagacguaccauccagauucucaggauccggagcaggaacauacuucacacuaacaauaacaucacuacaaccagaagacuucgcaacauacuacugccaacaaucacacucaccaucauucggacaagaauccuacucaauagcauucggacaaggaacaagacuagaaauaaaaagaacaguagcagcaccaucaguauucauauucccaccaucagacgaa

SEQ ID NO: 50463 - RNA, 432 nt, Artificial Sequence
  derived and/or modified sequence opt6 from anti-HIV_Chain
uuacaacaauuacaaguaccaagauuaagcauguggagaguauuuaaaguagcagcagcaacaggagcacaaacauuaacaguagaagaaccuggaaguucaguaaaaguaucauguaaagcaucaggaggaaguucaacagcauauggauauaguuggguaagacaagcaccaggacaaggauuugaauggaugggaagaauaauaccauuuuauggaauaauaacauaugcaccaaaauuucaaggaagaguaacaauaacagcagauagaucaacaucaacaguauauauggaauuaacaucauuaacauuugcagauacagcuuuauucuuuugugcaagagauuuuggagauccaagaaauggauauuauuuugauaguugggaucaaggacuaugguuaacaguaucaagcgcaaguacaaaagga

SEQ ID NO: 50464 - RNA, 432 nt, Artificial Sequence
  derived and/or modified sequence opt6 from anti-HIV_Chain
caaguaagauuagaacaaagcggaguagcaaugagaaaaccaggagcaagcguaacauuaagcugucaagcaagcggauacaauuucguaaaauauauaauacacuggguaagacaaaaaccaggauuaggauucgaauggguaggaaugauagauccauauagaggaagaccauggucagcacauaaauuucaaggaagauuaaguuuaagcagagacacaagcauggaaauacuauauaugacauuaacaaguuuaaaaucagacgacacagcaacauauuucugugcaagagcagaagcagcaagcgauauacauagcagaccaauaauauuaacaggaccaggagaauauggauuagacuuagaacauauggauuggacauggagaauacuaugcuuacuagcaguagcaccagggugccauagucaa

SEQ ID NO: 50465 - RNA, 435 nt, Artificial Sequence
  derived and/or modified sequence opt6 from anti-HIV_Chain
auguucuuauucuuaguagcaggagcaacaggaguacaaagucaaguauauuuaguaccauuuggaccagaaguaaaaaaaccaggaagcucaguaaaaguaucauguaaagcaaguggagauaguuuuacaucaaguguaauaacauggguaagacaagcaccaggacaaggaccagaauggaugggaagaguaauaccaguauuaggaguagcagcauaugcacaaaaauuuuauggaagaguaacaauaacagcagauacaucaaguaauacagcauacauggaaguaaauucauuaagauuugaagacacagcaguauauuauugugcaagagaaacaggaagaggaggaaauuuagcacuaagacaauauuuuuuugacaguuggggacaaggaacauuaguaacaguaucaaguccaagcacaaaagga

SEQ ID NO: 50466 - RNA, 438 nt, Artificial Sequence
  derived and/or modified sequence opt6 from anti-HIV_Chain
caaguacaauuacaagaaucaggaccaggauuaguaaaaccaucaggaacauuaucauuaacaugugcaguaagcggagccucaauaucaucaagaaacugguggacauggguaagacaaccaccaggaaaaggacuagaauggauaggagaaauauacgaaucaggagcaacaaacuauaacccaucauuaaaaucaagaguaacaauaucaguagacaaaagcaaaaaccaauucucacuaagacuaacaucaguaacagcagcagauacagcaguauauuucugugcaagacuaaugacauuuggaggacuaauaggaacacuagacuacuggggacaaggaacauuaguaacaguacuacaaccaccaccaagagcacacagauaucacccaagaaaccuacuacaagaacacuuaugcgcaagaguaaugcca

SEQ ID NO: 50467 - RNA, 444 nt, Artificial Sequence
  derived and/or modified sequence opt6 from anti-HIV_HeavyChain
auggaauggagcggaguauuuauauuucuauuaagcguaacagcaggaguacacucagaaguacaauuaguagaaagcggaggaggauuaguaaaaccaggaggaagccuaagauuaaguugugcagcaagcggauacacauucaguaauuauuggauaggauggguaagacaagcaccaggaaaaggacuagaauggauaggagauauauauccaggaggaaauuacauaagaaauaacgaaaaauuuaaagauaaaacaacauuaagcgcagacacaagcaaaaacacagcauauuuacaaaugaauagcuuaaaaacagaagauacagcaguauauuacuguggaucgaguuuuggaucaaacuauguauuugcaugguucacauacuggggacaaggaacauuaguaacaguaagcucaggagaaagccuaaaaccauua

SEQ ID NO: 50468 - RNA, 444 nt, Artificial Sequence
  derived and/or modified sequence opt6 from anti-HIV_HeavyChain
auggaauggagcggaguauuuauauuucuauuaagcguaacagcaggaguacacucacaaguacaauuaguacaaagcggaccagauguaaaaaaaccaggaacaagcaugaaaaugagcuguaaaacaagcggauacacauucucaaacuauuggauaggauggguaaggcaagcaccaggacaaggacuagaauggauaggagauauauauccaggaggaaauuacauaagaaauaacgaaaaauuuaaagauaaaacaacauuaacagcagacacaagcacaagcacagcauauaugcaacuaggaaguuuaagaucagaagauacagcaguauauuacuguggaucaagcuuuggaucaaacuauguauuugcaugguucacauacuggggacaaggaacacuaguaacaguaaguucaggagaaagcuuaaaaccacua

SEQ ID NO: 50469 - RNA, 447 nt, Artificial Sequence
  derived and/or modified sequence opt6 from anti-HIV_Chain
caagcaagacuagaucaauggggaacaggauuacuaaaaccaucagaaacacuaucauuaaaaugcgcaguauuuggaguacuauuuacagauuacaauuggacauggguaagacaaucaccaggaaaaggacuagaauggauaggacacuuagaccauagaggaggaggaaacuauaacccaucacuagaaucaagaguaacaauaucauuagacuauucaaaagcacaauucucacuacaucuaaaaucaguaacaguagcagauacagcacuauauuacugugcaggagcaguaaaaggauucugguucgaugaaguauacaauugguuuggaccaggaguaagagaaccauggcuaccaucaccacaaccaccaccaagagcacacagaucaucaccauggcacccaccaccaagagcaccauuaguaacagcaacaguacca

SEQ ID NO: 50470 - RNA, 447 nt, Artificial Sequence
  derived and/or modified sequence opt6 from anti-HIV_Chain
caagcacgacuagaccaauggggaacaggauuauuaaaaccaucagaaacacuaucacuaaaaugcgcaguauuuggaguacuauucacagauuacaauuggacauggguaagacaaucaccaggaaaaggauuagaauggauaggacacuuagaccauagaggaggaggaaacuauaacccaucauuagaaucaagaguaacaauaucauuagacuacucaaaagcacaauuuucacuacacuuaaaaucaguaacaguagcagauacagcauuauauuacugugcaggagcaguaaaaggacuaugguucgaugaaacauacacaugguuuggaccauggucacaaggaacaagaguaacaguagcaucagcaucaacaaaaggaccaucaguauuuccauuagcaccaucaaguaaaucaacaucaggaacaagagaccuauca

SEQ ID NO: 50471 - RNA, 447 nt, Artificial Sequence
  derived and/or modified sequence opt6 from anti-HIV_Chain
gcagcaagauuagaccaauggggaacaggacuaguaaaaccaagcgaaacauuaagcuuaaaaugugcaguauucggaguagauuucccagacuauacauggacaugggcaagacaagcaccaggaaaaggacuagaauggauaggacauagagaucacagaggaggaaguucauauaauccaucacuaucaggaagagcaacaauaucauuagauacaucaaaagcacaauuuaguuuacacauaaaaucaguaacaguagcagacacagcaacauacuauugugcaggagcaguagcaggauuaugguuugaagaugcauauaacugguucggaccauggagucaaggaacauuaguaacaguagcagcagcaucaacaaaaggaccaagcguauucccauuagcaccaucaaguaaaagcacaagcggacaugcaagcguacua

SEQ ID NO: 50472 - RNA, 450 nt, Artificial Sequence
  derived and/or modified sequence opt6 from anti-HIV_Chain
uuagcacaacuagaacaaagcggaggaggaguaguaaaaccaggcggaagcuuaagauuaccaugugcagcaagcggauucacauucauagacuauuacauggcauggauaagacuagcaccaggaaaaggacuagaauggcuaagcuauauaucaaaaaauggagauuacacaaaauauagcgaaagcuuaaaaggaagauuuacaauaagcagagacaaugcaaaaaaccuaguaauauuacaacuaaauagauuaagagcagacgauacagcaauauauuucugugcaagagcagauggauuaacauauuucggagaauuauuacaauacauauucgaucuauggggacaaggagcaagaguaauaguaaguucagcaucaacaaaaggaccaagcguauucccacuagcaccaucaagcaaaagcacaagcggacacgcaagugua

SEQ ID NO: 50473 - RNA, 459 nt, Artificial Sequence
  derived and/or modified sequence opt6 from anti-HIV_Chain
caaguacaauuaguacaaagcggagcagaaguaaaaaaaccaggagcaagcguaaaaguaagcuguaaaguaagcggauacacauuaacagaauuaagcauacacuggguaagacaagcaccaggaaaaggacuagaauggaugggaggauucgauagugaagacggagaagcaauauauaaacaaaacuuucaaggaagaguaacaaugacagaagacacaucaacagacacagcauauauggaacuaucaagacuaagaucagaagauacagcaguauauuacugugcaacagcagauagauuuaaaguagcacaagacgaaggauuauucguaauauuugacuauuggggacaaggaaacccaggacauagauuacuaucacuacaucaagggccaauaggauuaccaccaggaacauuaccaccaaaagcaacaagcggacacgcagcaagaaga

SEQ ID NO: 50474 - RNA, 462 nt, Artificial Sequence
  derived and/or modified sequence opt6 from anti-HIV_Chain
cuaguacaauuaguacaaagcggagcagaaguaaaaaaaccaggagcaagcguaaaaguaagcuguaaaguaagcggauacucacuaacagaacuaucaauacacuggguaagacaagcaccaggaaaaggacuagaauggaugggaggauucgauagcgaagacggagaagcaauauauaaacaaaacuuucaaggaagaguaacaaugacagaagacacaaguacagacacagcauauauggaacuaucacgauuacgaucagaagauacagcaguauauuacugugcaacagcagauccauuuaaaguugcacaagacgaaggauuauucguaauauuugacuauuggggacaaggaacaacaggacauagauuacuaucauuacaucaaggaccacauagauuauacucacuaggaacauuauuaucaagagcaccaauaguacaaacacauauggca

SEQ ID NO: 50475 - RNA, 471 nt, Artificial Sequence
  derived and/or modified sequence opt6 from anti-HIV_Chain
caaauacaccuaguacaaucaggaaccgacguaaaaaaaccaggaucaucaguaacaguaucaugcaaagccuacggaguaaacacauucggacuauacgcaguaaacuggguaagacaagcaccaggccaaucauuagaauacauaggacaaauauggagauggaaaucaucagcaucacaccacuucagaggaagaguacuaauaucagccguagaccuaacaggaucaucaccaccaauaucaucacuagaaauaaaaaaccuaacaucagacgacacagcaguauacuucugcacaacaacauccacauacgaccaauggucaggacuacaccacgacggaguaauggcauucucaucaagaggacaaggcacauuaauaucaguaucagcagcaucaacaaaaggaccaucaguauuuccacuagcaccauccucaaaaucaacauacggacuagcacacguacua

SEQ ID NO: 50476 - RNA, 477 nt, Artificial Sequence
  derived and/or modified sequence opt6 from anti-HIV_Chain
caacaucaauuaguaccauguguagcagaaguaagaaaaccaggagcaaguguaaaaguaaguuguaaaguaaguggauauacauuaacagaaauaaguaugcauuggguaagacaagcaccaggaaaaggauuagaauggaugggaggauuugauagagaagauggagaaacaauauaugcacaaaaauuucaaggaagaguaacaaugacagaagauacaaguacagauacagcauauauggaauuaaguaguuuaagaagugaagauacagcaguauauuauugugcaacaacauauuuagcaguaguaccagauggauuugauggauauucaaguaguugguauugguuugauccauggggacaaggaacauuaguaacaguaaguagugcaaguaugcaaggaccaauguuauuaagcccaacaggaacauuauuaccaagagcaccucuaguacaaacaagaccaggacca

SEQ ID NO: 50477 - RNA, 642 nt, Artificial Sequence
  derived and/or modified sequence opt6 from anti-HIV_LightChain
gacauaguaauaacacaaucaacaaaauucaugagcacaucaguaggcgacagaguaagcauaaccugcaaagcaucacaagacguaucaacagcaguagcaugguaucaacaaaaaccaggacaaucaccaaaauuacuaauauacugggcaagcacaagacacacaggaguaccagacagauucacaggaucaggcucaggaacagacuacacacuaacaauaucaagaguacaagcagaagaccuagcauuauauuacugccaacaacacuacacaaccccauggacauucggcggcggaacaaaacucgaaauaaaacgaacaguagcagcaccaucauucguaauauucccaccaagcgacgaacaauuaaaaucaggaacagcaucaguaguaugccuacuaaauaacuucuacccaagagaagcaaaaguacaauggaaaguagacaacgcacuacaaagcggaaacucacaagaaagcguaaccgaacaagauaguaaagacucaacauacucauuaucauccacacuaacacuaucaaaagcagacuacgaaaaacacaaaguauacgcaugcgaaguaacacaccaaggacuaucaucaccaguaacaaaaucauucaacagaggagaaugc

SEQ ID NO: 50478 - RNA, 651 nt, Artificial Sequence
  derived and/or modified sequence opt6 from anti-HIV_Chain
caaucaguacuaacccaaccaccaucaguaucagcagcaccaggacaaaaaguaacaauaucaugcucaggaucuucaucaaacauaggaaacaacuacguacuaugguaccaacaauucccaggaacagcaccaaaacuauuaauauacggaaacaacaaacgaccaucaggaauuccagacagauucucaggcucaaaauccggaacaucagcaacacuaggaauaacaggacuacaaaccggagacgaagcagacuacuucugcgcaacaugggacuccggccuauccgcagacuggguauucggcggaggaacaaaauuaacaguacuaucacaaccaaaagcagccccaucaguuacuuuauuccccccauccucagaagaacuacaagcaaacaaagcaacacucguaugccuaauaucagacuucuacccaggagcaguaacaguagcauggaaagcagauuccucaccaguaaaagccggaguagaaacaacaacaccaucaaaacaauccaacaacaaauacgcagcaucauccuaccucucacuaacaccagaacaauggaaaucacacagaucauacuccugccaaguaacacacgaaggcucaacaguagaaaaaacaguagcaccaacagaaugcucc

SEQ ID NO: 50479 - RNA, 657 nt, Artificial Sequence
  derived and/or modified sequence opt6 from anti-HIV_Chain
gacauaguaaugacacaaagcccagacucacucgcaguaucccuaggagaaagagucacaaugaacugcaaaucaucacaaucacuacuauacucaacaaaccaaaaaaacuaccuagcaugguaucaacaaaaaccaggccaaucaccaaaacuacuaauauacugggcaaacucaacagaaucaggaguaccagacagauuuucaggaucaggauccggaacagauuucacacuaacaaucucaagcguacaagcagaagacguagcaguauacuacugccaacaauacuacucauacagaacauucggcggaggaacaaaauuagaaauaaaaagaacaguagcagcaccaucaguauucauauucccaccaucagacgaacaauuaaaaucaggaacagcaucaguagucuguuuacuaaacaacuuuuacccaagagaagcaaaaguacaauggaaaguagacaacgcacuacaaucaggaaauucacaagaauccguaacagaacaagacucaaaagacucaacauacucacuaucaucaacacuaacauuaucaaaagccgauuacgaaaaacauaaaguauacgccugcgaaguaacacaccaaggacuaucaucaccaguaacaaaaucauucaaccgaggagaaugc

SEQ ID NO: 50480 - RNA, 753 nt, Artificial Sequence
  derived and/or modified sequence opt6 from anti-HIV_SingleChain
augcaaguacaauuagaacaaagcggagcagaaguaaaaaaaccaggagcaagcguaaaaguaaguugucaagcaaguggauauagauuuucaaauuuuacaguacacuggguuagacaagcaccaggacaaagguuugaauggaugggauggauaaauccauauaauggaaauaaagaauuuagugcaaaauuucaagauagaguaacauuuacagcagauacaagugcaaauacagcauauauggaauugagaucauuaaggucagcagauacagcaguauauuauugcgcaagaguaggagaauggggaugggacgauaguccacaagauaauuauuauauggauguauggggaaaaggaacaacaguaauaguaaguucuggaggaggaggaucgggaggaggaggaaguggaggagggggaagugauauagaauuaacacaaaguccgggaacauuaucauuaagcccaggagaaagggcaacauuuucauguagaaguagucauucaauaagaaguaggagaguagcaugguaucaacauaaaccaggacaagcaccaagauuaguaauccauggaguaaguaauagagcaagugggauaagugauagauuuaguggcaguggaaguggaacagacuuuacauuaacaauaacaagaguagaaccagaagauuuugcauuauauuauugucaaguauauggagcaaguaguuauacauuuggacaaggaacaaaacuagaacgaaaa

SEQ ID NO: 50481 - RNA, 1338 nt, Artificial Sequence
  derived and/or modified sequence opt6 from anti-HIV_LightChain
gaaguaaaacuagaagaauccggaggcggccuaguacaaccaggagguucaagaaaauuaucgugcgcagcaucuggauucaccuuuucauccuucggcaugcauuggguacgucaagcucccgaaaaaggacuagaauggguagcauacauuucuucaggcuccucaacacuacauuacgcagacacaguuaaaggacgcuuuacaauaucacgagauaacccaaaaaauacacuauucuuacaaaugaaauuaccaucauuauguuacggacuacuaggcuccagaaaucuaucacacagacuacuaucacaaaaugacacacccauaugccuaacaguuucauccgccucaacaaaaggcccaucaguauucccacuagcacccuccuccaaaaguacaucaggaggcacggcugcacuaggaugcuuagucaaagacuacuuuccagaaccaguaacaguaucauggaacucuggagcccuuaccucaggaguacauacauuuccagccguuuuacaaucaucaggauuauacucauuauccucaguaguaacaguaccaucaucaucacucggcacacaaacauacauuuguaacguaaaccauaaaccuucaaauacaaaaguagacaaaaaaguagaaccaaaaucuugcgacaaaacacauaccugcccaccaugcccagcaccagaauuacuuggaggaccaucaguauuccuauucccaccuaaaccaaaagacacacuuaugauaagucgaacaccagaagucaccugcguaguaguagacguaagccaugaagauccagaaguaaaauuuaacugguauguugacggaguagaaguacacaacgcaaaaacaaaacccagagaagaacaauacaacucaacauaucgaguaguaucuguauuaacaguacuacaccaagacuggcuaaacggcaaagaauauaaaugcaaaguuucaaacaaagcacuuccagcaccaauagaaaaaacaauaucaaaagcaaaagggcaacccagagaaccacaaguauauacacucccuccaucuagagaagaaaugaccaaaaaccaagucucucuaaccugccuaguuaaaggcuuuuaucccagugacauagccguagaaugggaaucaaacggacaaccagaaaauaauuacaaaacaacacccccaguacuagacucugauggaagcuucuuccuauacucuaaacuaacagucgauaaaucuagauggcaacaaggaaacguauucucaugcucaguaaugcacgaagcauuacacaaucacuacacacaaaaaucacuaucccuuucaccaggaaaa

SEQ ID NO: 50482 - RNA, 1380 nt, Artificial Sequence
  derived and/or modified sequence opt6 from anti-HIV_Chain
gaaguacaacuaguagaaaguggaggaggacuagucaaaccaggaggaucccuacgacuaacauguguagcaucaggauucacauucucagacguauggcuaaacuggguacgacaagcuccaggaaaaggauuagaaugggucggcagaauuaaaagccguaccgacgguggaacaacagacuacgcagcaucaguuaaaggacgauucaccauaucacgagaugacucaaaaaacacauuauauuuacaaaugaauagucuaaaaacagaagauacugcuguauacucaugcacaacagacggcuucauaaugaucagaggaguaucagaagauuacuauuacuacuacauggacguauggggaaaagguacaacaguaacaguaucaagcgcuucaacaaaaggcccaucaguuuuuccacuagcaccaucuuccaaaucaacaucaggaggaaccgcagcacuaggaugucuaguaaaagacuacuuccccgaaccagucacaguauccuggaauucaggagcccuuacauccggaguucacacauucccagcaguauuacaaucaaguggacuauauucucucuccucagucguaacaguaccauccucuucauuaggaacacaaacauacauaugcaauguaaaccacaaaccaucaaacacuaaaguagauaaaaaaguagaaccuaaaucgugugacaaaacccacacauguccaccaugcccagcaccagaauuacuaggaggcccauccguuuuccuauucccaccaaaacccaaagacacauuaaugauaagcagaacacccgaagucacaugcguaguaguagauguaucacacgaagacccagaaguuaaauucaauugguacguagauggaguagaaguacacaacgcuaaaacgaaaccccgugaggaacaauauaacaguacauauagagucguaucaguauuaacuguucuccaucaagacugguuaaaugguaaagaauacaaaugcaaaguuuccaacaaagccuuaccagcaccaauugaaaaaacaauaucaaaagcaaaaggucaaccaagagaaccacaagucuacacauuaccaccaucaagagacgaacuaacaaaaaaccaaguaucauuaacauguuuaguaaaagguuuuuacccaucagauauugcuguagaaugggaauccaauggacaaccugaaaacaauuauaaaacaacaccaccaguacuggacucagacggaucauuuuuccuauacucaaaauuaacugucgacaaaucaagauggcaacaaggcaacguauucucaugcucaguuaugcacgaagcauuacacaaucacuacacucaaaaaucacuaucacuauccccagga

SEQ ID NO: 50483 - RNA, 1413 nt, Artificial Sequence
  derived and/or modified sequence opt6 from anti-HIV_Chain
auggaauggucuggaguauuuauguuucuccuaucagucacagcaggaguacacucacaaguacaacuacaacaaucaggaccagaagucgucaaacccggagcaucaguaaaaaugucauguaaagcuucaggauacacauucacaucauacguuauucacuggguaagacaaaaaccuggacaaggcuuagacuggauuggauauauaaauccauacaacgacggaacagauuacgaugaaaaauuuaaaggcaaagcaacauuaacaucagauacaucaaccucaacagcauacauggaacucucaucacuaagaucagaagauacagcaguauacuacugcgcaagagaaaaagacaacuaugcuacaggugccugguucgcauauuggggucaaggaacauuaguaaccguaagcuccgccucaacaaaaggaccaucagucuuuccccuagcaccaucuucaaaaucaacaucuggcggcacagcugcacuugggugccuaguaaaagacuauuuuccagaaccaguaacaguuucauggaauucuggagcauuaacaucagggguacacacauuuccagccgucuuacaaucuucaggcuuauauucauuaucuucuguaguaacaguaccauccaguucccuaggaacacaaaccuacauaugcaacguaaaccauaaaccaucaaacacaaaaguagacaaaaaaguagaaccaaaauccugcgacaaaacacacacaugucccccaugcccugcaccagaauucgaaggagguccaucugucuucuuauuccccccaaaaccaaaagacacauuaaugauaucaagaacuccagaaguaacaugcguaguaguagaugucucccaugaagauccagaaguaaaauucaacugguauguagacggaguagaaguacacaacgccaaaacaaaacccagagaagaacaauacaacuccacauacagaguaguaaguguacuaacuguauuacaucaagacuggcugaauggaaaagaauacaaaugcaaaguaucaaauaaagcuuuaccagccucaauugaaaaaacaauauccaaagcuaaaggacaaccaagagaaccucaaguauacacucuccccccgucaagagaugaauuaacaaaaaaccaaguaucacuaaccugucuaguaaaaggauuuuauccaucagacauagcaguagaaugggaaucuaacggacaaccagaaaauaacuauaaaacaacaccacccguacuagacucagacgguucauucuuccuauacuccaaacuaacuguagauaaaucuagauggcaacaaggaaacguauucaguuguuccguaaugcacgaagcacuacacaaccacuacacacaaaaaucacuaucucuuucaccaggaaaa

SEQ ID NO: 50484 - RNA, 645 nt, Artificial Sequence
  derived and/or modified sequence opt6 from anti-influenza_Fab
auaguauuaacacaaucaccagccacauuaagcguaucaccaggagaaagagcaacacuaucaugccgagcaucacaaguaauaagccacaaccuagcaugguaccaacaaaaaccaggacaagcaccaagacuacucaucuacggagcaucaacacgagcaucaggaauaccagcaagauucucaggcucaggaucugguacagacuacacauuaacaauaacaucacuacaaccugaagacuucgccguauacuacugccaacacuacagcaacuggccacccagacuaacauucggaggaggaacaaaaguagaaauaaaaagaacaguagcagcaccaagcguauuuauauucccacccuccgacgaacaauuaaaaucaggaacagcaucaguaguaugccuacuaaacaacuucuaccccagagaagcaaaaguacaauggaaaguagacaacgcauuacaaucaggaaacucacaagaaagcguaacagaacaagacucaaaagacucaacauacucacuaucaucaacauuaacacuaucaaaagcagacuacgaaaaacacaaaguauacgcaugcgaaguaacacaccaaggacuaucaucaccaguaacaaaauccuucaacagaggagaaugc

SEQ ID NO: 50485 - RNA, 681 nt, Artificial Sequence
  derived and/or modified sequence opt6 from anti-influenza_Fab
guacaauuaguagaaucaggaggaggaguaguacaaccaggcaaaucaccaagacuaucaugugcagcaagcggacccacauucucuucauaugcaguacacuggguaagacaagcaccaggaaaaggacuagaauggguaaccuuaauaaguuacgacggagcaaaccaauacuaugcagacucaguaaaaggaagauuuacaauaucaagagacaacucaaaaaacacagucuaucuacaaaugaauucauuaagaccagaagauacagcaguauauuacugugcaguacccggaccaguauuuggaauauucccaccuuggucauacuuugacaauuggggucaagguauauuaguaacaguaucaucagcauccacaaaaggaccaucagucuuuccacuagcaccaucaucaaaaucaacaucaggaggaaccgcagcauuaggcuguuuaguaaaagauuacuuuccagaaccaguuacaguaucauggaacucaggcgcauuaacaucaggaguacauacauuuccagcaguauuacaaucaucaggacuauauucauuaucaucaguaguaacaguaccauccucaucacuaggaacacaaacauauauauguaacguaaaccauaaaccaucaaauacaaaaguagauaaaaaaguagaaccaaaaucaugu

SEQ ID NO: 50486 - RNA, 1515 nt, Artificial Sequence
  derived and/or modified sequence opt6 from anti-influenza_Fab
gcaggaucaacggcuacauuaugucuaggacaucacgcaguuccaaauggaacaauagucaaaacaauaacaaaugaccaaauagaaguaacaaaugcaacagaauugguacaaucauccaguacaggcgaaauaugcgacucaccccaccaaauacucgacggaaaaaauugcacccuaauugacgcauuauuaggugacccccaaugcgauggguuccaaaacaaaaaaugggaucuuuucguagaaagauccaaagccuacagcaauugcuaccccuacgacguaccagacuaugcaucccugagaagccuaguagccuccucaggaacacucgaauuuaauaaugaaucauucaauuggacaggaguaacacaaaauggaacaagcagcgcaugcauaagaagaaguaaaaacucauucuucucacgacuaaacugguuaacucaccucaacuucaaauacccugcacuuaauguuacaaugccaaacaacgaacaauucgacaaacuauauauauggggaguucaucacccaggaacagacaaagaccaaauauuccuauacgcacaagcaucaggcagaauaaccguaucaacaaaaagaucacaacaaacaguaaguccaaacauaggaucaaggcccagaguccgaaauauaccuucaagaaucagcauauacuggacaauaguuaaaccaggagauauauuacuaauaaacaguacaggaaaccuaauugcccccagaggauauuucaaaauaagauccggaaaaucaucaauaaugcgauccgacgcaccaauaggaaaaugcaacucagaaugcauaacaccaaauggaucaaucccaaacgacaaaccauuccaaaauguuaaccgaauaacauacggagcauguccaagauauguaaaacaaaauacacucaaacuagcaacagguaugcgcaacguaccagaaaaacaaacacgaggaauauucggcgccauagcaggauucauagaaaacggaugggaaggaaugguagacggaugguauggauucagacaccaaaacagcgaaggacgaggacaagcagcagacuuaaaaaguacacaagcagcaauagaccaaauaaauggaaaacuaaaucgauuaauagguaaaaccaaugaaaaauuccaccaaauagaaaaagaauuuucagaaguagaaggacgaauacaagaccuagaaaaauacguagaagacaccaaaauagauuuauggagcuauaacgcagaauuacuaguagcauuagaaaaccaacauacaauagaucucacagauuccgaaaugaacaaacuauucgaaaaaacaaaaaaacaauuacgagaaaaugcagaagacaugggcaauggaugcuucaaaauauaccauaaaugcgacaaugcaugcauaggaucaauaagaaauggaacguacgaccacgauguauauagagacgaagcacuaaacaacagauuccaaauaaaaggaucaggaagacuaguaccacga

SEQ ID NO: 50487 - RNA, 657 nt, Artificial Sequence
  derived and/or modified sequence opt6 from anti-influenza_Fab
caaguacaauuaguacaaucaggaggaggaguuguacaaccagguagaucucuaagacuaucaugcgcagcaucagaauuuacauuuagaauguacgcaacacauuggguaagacaagcaccaggaaaaggauuagaauggguagcacuaauaucauaugacgguuccaauaaauauuacgcagacucaguaaaaggaagauuuacaauaucaagagauaacucuaugaauacaguuuacuuacaaaugaacacacuaagaccagaagacacagcaguauacuauugcgcuagagauuuaggaggauauuucauaagaggaauaauggacguauggggacaaggaacauuaguaacaguaucaagcgcaucaacaaaaggaccaucaguauuuccauuagcaccaucaagcggaggaacagcagcauuaggcugucucguaaaagauuacuuuccagaacccguaacaguaucauggaacucaggagcacuaacaaguggaguacauaccuuuccagcugucuuacaaucaucaggauuauauaguuuaucaucaguaguaacaguaccaucaucaucacuaggaacacaaacauauauauguaacguaaaccauaaaccaucaaauacaaaaguagauaaaagaguagaaccaaaa

SEQ ID NO: 50488 - RNA, 642 nt, Artificial Sequence
  derived and/or modified sequence opt6 from anti-influenza_Fab
gaacuacaaaugacccaaagcccaucaagcguaucagcaucaguaggcgaccgaguaacaauaacaugcagagcaagccaaggaauaucaucuuggcuagcaugguaccaacaaaaaccaggaaaagcaccaaaauuacuaauauacgcagcaucaucacuacaaagcggaguaccuucaagauucucaggaucaggaucaggaacagacuucacacuaacaauauccucacuacaaccagaagacuucgcaacauacuacugccaacaagcaaacucauucccacucacauucggaggcggaacaaaaguagaaauaaaaagaacaguagcagcaccaucaguauucauauucccaccaucagacgaacaacuaaaaucaggaacagcaucaguaguaugccuacuaaacaacuucuacccaagagaagcaaaaguccaauggaaaguagacaacgcauuacaaagcggaaacucacaagaaagcguaacagaacaagacuccaaagacucaacauauucacuauccuccacacuaacacuaucaaaagccgacuacgaaaaacauaaaguauacgcaugcgaaguaacacaccaaggauuaucaucaccaguaaccaaaucauucaacagaggagaaugc

SEQ ID NO: 50489 - RNA, 993 nt, Artificial Sequence
  derived and/or modified sequence opt6 from anti-influenza_Fab
gcagacccaggugacacaauaugcauaggauaccacgcaaauaacucaacagacacaguagacacaguuuuagaaaaaaauguaacaguaacacauuccguaaacuuacuagaagacucacacaacggaaaacuauguaaacuuaaaggaauagcaccauuacaacuaggaaaaugcaauauagcaggauggcuacuaggaaacccagaaugcgaccuauuacuaacagcaagcaguuggucauacauaguagaaacaucaaacucagaaaacggcacuugcuacccaggagacuucauagacuacgaagaauuaagagaacaauuaucaucuguaucaucauucgaaaaauucgaaauauucccaaaaacaagcucauggccuaaccacgaaacaacaaaaggaguaacagcagcaugcucauaugcaggcgcaucaucauucuaccgaaacuuacuauggcuaacaaaaaaaggaucaucauauccaaaauuaucaaaaagcuacguaaacaacaaaggaaaagaaguccuagucuuauggggcguacaccacccaccaacaggaacagaccaacaaucccuauaccaaaaugcagacgcauacguaucagucgguagcucaaaauacaauagaagauucacaccagaaauagcagcaagaccaaaaguaagagaccaagcaggaagaaugaacuacuacuggacacuauuagaacccggagacacaauaacauucgaagcaaccggaaauuuaaucgcaccaugguaugcauucgcacucaacagaggaucaggaucaggaaucauaaccucagacgcaccaguacacgacuguaacacaaaaugccaaacaccacacggagcaauaaacuccucauuaccauuccaaaacauacacccaguaacaauaggagaaugucccaaauacguaagaucaacaaaauuacgaauggcaacaggauuaagaaauauacccuccauacaaucacgc

SEQ ID NO: 50490 - RNA, 537 nt, Artificial Sequence
  derived and/or modified sequence opt6 from anti-influenza_Fab
ggacuauucggagcaauagcaggauucauagaaggaggauggacaggaaugauagacggaugguacggauaccaccaccaaaacgaacaaggaagcggauacgcagcagaccaaaaaagcacacaaaaugcaauagacggaauaacaaacaaaguaaacagcguaauagaaaaaaugaacacacaauucacagcaguaggaaaagaauucaacaacuuagaaagaagaauagaaaaccuaaacaaaaaaguagacgauggauucuuagacauauggacauacaaugcagaauuacuaguacuacuagaaaacgaacgaacacuagauuuccacgacucaaacguaagaaaccuauacgaaaaaguaaaaagccaauuaaaaaacaacgcaaaagaaauaggaaacggaugcuucgaauucuaccacaaaugcgacgacgcaugcauggaaucaguaagaaacggaacauacgacuacccaaaauacucagaagaaagcaaacuaaacagagaagaaauagacggaguaucaggaaga

SEQ ID NO: 50491 - RNA, 642 nt, Artificial Sequence
  derived and/or modified sequence opt6 from anti-influenza_Apo
caaucaguacuaacucaaccaccaucaguaucaguagcaccaggacaaacagcaagaauaacaugcggaggaaacgacauaggaagaaaaucaguacacuggaaccaacaaaaaccaggacaagcaccaguacuaguaguaugcuacgacucagacagaccaucaggaauaccagaaagauucaguggaucaaacucagguaacacagcaacacucacaauaucacgaguagaagcaggagacgaagcagacuacuacugccaaguaugggacucuucaucagaccacguaauauucggaggaggaacaaaacuaacaguacuaggacaaccaaaagccgcaccaaguguaacacuauucccaccaucaucagaagaacuacaagcaaacaaagcaacacuaguaugcuuaauaucagacuucuacccaggagcaguaacaguagcauggaaagcagacucaucaccaguaaaagcaggaguagaaacaacaacaccaucuaaacaaucaaacaacaaauacgcagcaucaucauacuuaucacuaacaccagaacaauggaaaucacacagaucauacagcugccaaguaacacacgaaggcucaacaguagaaaaaacaguagcaccuacagaaugcuca

SEQ ID NO: 50492 - RNA, 687 nt, Artificial Sequence
  derived and/or modified sequence opt6 from anti-influenza_Apo
gaaguacaauuaguacaaagcggagcagaaguaaaaaaaccaggagcaucaguaaaaguaucaugcaaagcaucaggauauacauuuacagauuaccacauaaauuggguaagacaagcaccaggacaaggacuagaauggaugggauggauacacccaaacagcggagacacaaauuacgcacaaaaauuccaaggauggguaacaaugacaagagauacagcaauaucaaccgcauacauggaaguaaauggacuaaaaucagaugacacagcaguauacuauugcgccagaggaggauuagaaccaagaaguguagauuacuauuacuaugguauggacguauggggacaaggaacaacuguaacuguaucaucagcaucaacaaaaggacccucagucuuucccuuagcaccaucaucaaaaucaacaucaggaggaacagcagcacuaggaugucuaguaaaagauuacuuuccagaaccaguaacaguaucauggaacagcggagcauuaacaucaggaguacauacauucccagcaguauuacaaucaucaggacuauauucacuaucaucaguaguaacaguaccaucaucaagucuaggaacacaaacauauauauguaacguaaaccauaaaccaucaaauacaaaaguagauaaaagaguagaaccaaaaucaugu

SEQ ID NO: 50493 - RNA, 333 nt, Artificial Sequence
  derived and/or modified sequence opt6 from anti-influenza-A_kappa_LightChain_V-Region
gacauaguaaugacacaaucaccagacucacuagcaguaucacuaggagcaagagcaacaauaaacugcaaaucaucacaaucaguaacauucaacuacaaaaacuaccuagcaugguaccaacaaaaaccaggacaaccaccaaaaguacuaauauacugggcaucagcaagagaaucaggaguaccagacagauucucaggaucaggaucaggaacagacuucacacuaacaauaagcucacuacaagcagaagacguagcaguauacuacugccaacaacacuacagaacaccaccaacauucggacaaggaacaaaaguagaaauaaaa

SEQ ID NO: 50494 - RNA, 333 nt, Artificial Sequence
  derived and/or modified sequence opt6 from anti-influenza-A_kappa_LightChain_V-Region
gacauaguaaugacacaaucaccagacucacuagcaguaucacuaggagaaagagcaacaauaaacugcaaaucaucacaaucaguaucaucaaacaacaaaaacuacuuagcaugguaccaacaaaaaccaggacaaccaccaaaaguacuaauauacugggcaucagcaagagaaucaggaguaccagacagauucucaggaucaggaucaggaacagacuucacacuaacaauaucaucacuacaagcagaagacguagcaguauacuacugccaacaacacuacagaacaccaccaacauucggacaaggaacaaaaguagaaauaaaa

SEQ ID NO: 50495 - RNA, 333 nt, Artificial Sequence
  derived and/or modified sequence opt6 from anti-influenza-A_kappa_LightChain_V-Region
gacauaguaaugacacaaucaccagacagccuagcaguaucacuaggagaaagagcaacaauaaacugcagaucaucacaaucaguaucaucaaacaacaaaaacuuccuagcaugguaccaagaaaaaccaggacaaccaccaaaaguacuaauauacugggcaucagcaagagaaucaggaguaccagacagauucucaggaucaggaucaggaacagacuucacacuaacaauaucaggacuacaagcagaagacguagcaguauacuacugccaacaacacuacagaacaccaccaacauucggacaaggaacaaaaguagaaauaaaa

SEQ ID NO: 50496 - RNA, 333 nt, Artificial Sequence
  derived and/or modified sequence opt6 from anti-influenza-A_kappa_LightChain_V-Region
gacauaguaaugacacaaucaccagacucacuagcaguaucacuaggagaaagagcaacaauaaacugcaaaucaucacaaucaguaacauucaacuacaaaaacuaccuagcaugguaccaacaaaaaccaggacaaccaccaaaacuacuaauauacugggcaucaacaagagaaucaggaguaccagacagauucucaggaucaggaucaggaacagacuucacacuaacaauaucaucacuacaagcagaagacguagcaguauacuacugccaacaacacuacagaacaccaccaacauucggacaaggaacaaaaguagaaauaaaa

SEQ ID NO: 50497 - RNA, 339 nt, Artificial Sequence
  derived and/or modified sequence opt6 from anti-influenza-A_kappa_LightChain_V-Region
gacauaguaaugacacaaucaccagauucacuagcaguaucccuaggagaaagagcaacaauaaacugcaaaucaucacaaucaguacuauacucaucaaacaacaaaaacuaccuagcaugguaccaacaaaaaccaggacaaccaccaaaacuacuaauauacugggcaucaacaagagaaucaggaguaccagacagauucucaggaucaggauccggaacagacuucacacuaacaauaucaucacuacaagcagaagacguagcaguauacuacugccaacaauacuacucaacaccaccaacauucggacaaggaacaaaaguagaaauaaaa

SEQ ID NO: 50498 - RNA, 333 nt, Artificial Sequence
  derived and/or modified sequence opt6 from anti-influenza-A_kappa_LightChain_V-Region
gacauacaaaugacacaaucaccagacucacuagcaguaucacuaggagcaagagcaacaauaaacugcaaaucaucacaaucaguaacauucaacuacaaaaacuaccuagcaugguaccaacaaaaaccaggacaaccaccaaaaguacuaauauacugggcaucagcaagagaaucaggaguaccagacagauucucaggaucaggaucaggaacagacuucacacuaacaauaucaucacuacaagcagaagacguagcaguauacuacugccaacaacacuacagaacaccaccaacauucggacaaggaacaaaaguagaaauaaaa

SEQ ID NO: 50499 - RNA, 387 nt, Artificial Sequence
  derived and/or modified sequence opt6 from anti-influenza-A_HeavyChain_V-Region
caaguacaauuaguagaaucaggaggaggaguaguacaaccaggaagaucacuaagacuaucaugcgcagcaucaggauuuacauuuagcucauacggaaugcauuggguaagacaagcaccaggaaaaggacuagaauggguagcaguaauaagcuaugacggaaguaauaaauauuacgcagacucaguaaaaggaagauucacaauaucaagagauaauagcaaaaauacauuauacuuacaaaugaacucacuaagagcagaagacacagcaguauacuauugcgcaaaagauucacaacuaagaagucuacuauauuucgauugguuaagccaaggauauuucgauuacuggggacaaggaacauuaguaacaguaaguuca

SEQ ID NO: 50500 - RNA, 387 nt, Artificial Sequence
  derived and/or modified sequence opt6 from anti-influenza-A_HeavyChain_V-Region
caaguacaauuaguacaaucaggaggaggaguaguacaaccaggaagaucacuaagacuaucaugcguagcaucaggauuuacauucucaacauacgcaaugcacuggguaagacaagcaccaggaagaggacuagaauggguagcaguaauaucauacgacggaaacuauaaauauuacgcagacucaguaaaaggaagauucucaauaucaagagauaacucaaauaauacacuacaccuagaaaugaacacacuaagaacagaagacacagcauuauacuacugcgcaaaagacucacaacuaagaucauuacuauauuucgaauggcuaucacaaggauauuuugacccauggggacaaggaacauuaguaacaguaucauca

SEQ ID NO: 50501 - RNA, 387 nt, Artificial Sequence
  derived and/or modified sequence opt6 from anti-influenza-A_HeavyChain_V-Region
caaguacaauuaguacaaucaggaggaggaguaguacaaccaggaagaucacuaagacuaucaugcgcagcaucaggauuuacauucucaacauacggaaugcacuggguaagacaagcaccaggaaaaggacuagaauggguagcaguaauaucauaugacggaaacuauaaauauuacgcagacucaguaaaaggaagauucacaauaaguagagauaacaguaaaaauacauuauacuuagaaaugaacucacuaagaacagaagacacagcauuauacuacugcgcaaaagacucacaacuaagaucauuacuauauuucgacugguuaucacaaggauauuucgaucacuggggacaaggaacauuaguaacaguaucauca

SEQ ID NO: 50502 - RNA, 387 nt, Artificial Sequence
  derived and/or modified sequence opt6 from anti-influenza-A_HeavyChain_V-Region
caaguacaauuaguacaaaguggaggaggaguaguaccaccaggaagaucacuaagauuaucaugugcagcaucaggauuuacauuuagcacauacggaaugcauuggguaagacaagcaccaggaaaaggauuagaauggguagcaguaauaaguuaugacggaaauuauaaauauuacgcagacaguguaagaggaagauuuacaauaucaagagauaauaguaaaaauacauuaaauuuagauaugaacucacuaagaacagaagacacagcauuauauuauugugcaaaagauucacaauuaagaaguuuauuauauuuugauugguuaagucaaggauauuuugaucacuggggacaaggaacauuaguaacaguaaguuca

SEQ ID NO: 50503 - RNA, 387 nt, Artificial Sequence
  derived and/or modified sequence opt6 from anti-influenza-A_HeavyChain_V-Region
caaguacaauuaguagaaucaggaggaggaguaguacaaccaggaagaucacuaagacuaucaugcgcagcaucaggauuuacauuuagcacauacgcaaugcauuggguaagacaagcaccaggaaaaggacuagaauggguagcaguaauaagcuaugacgcaaacuauaaauauuacgcagacucaguaaaaggaagauucacaauaucaagagauaacagcaaaaauacacuauacuuacaaaugaacucacuaagagcagaagacacagcaguauacuauugcgcaaaagauagccaacuaagaucauuacuauauuucgaaugguuaagccaaggauauuucgauuacuggggacaaggaacauuaguaacaguaagcuca

SEQ ID NO: 50504 - RNA, 387 nt, Artificial Sequence
  derived and/or modified sequence opt6 from anti-influenza-A_HeavyChain_V-Region
caaguacaauuaguagaaaguggaggaggaguaguacaaccaggaagaagccuaagauuaaguugugcagcaaguggauuuacauuuucaacauaugcaaugcacuggguaagacaagcaccaggaaaaggacuagaauggguagcaguaauaucauaugauggaaauuauaaauauuaugcagauaguguaaaaggaagauuuacaauaaguagagauaauaguaaaaauacauuauauuuacaaaugaauaguuuaagagcagaagauacagcaguauauuauugugcaaaagauucacaauuaagaucauuauuauauuuugaaugguuaagucaaggauauuuugauccauggggacaaggaacauuaguaacaguaucaagc

SEQ ID NO: 50505 - RNA, 387 nt, Artificial Sequence
  derived and/or modified sequence opt6 from anti-influenza-A_HeavyChain_V-Region
caaguacaauuaguacaaucaggaggaggaguaguacaaccaggaagaucacuaagacuaucaugcguagcaucaggauucacauucucaacauacgcaaugcacuggguaagacaagcaccaggaagaggacuagaauggguagcaguaauaucauaugacggaaacuauaaauauuacgcagacucaguaaaaggaagauucucaauaucaagagacaacucaaacaauacacuacacuuagaaaugaacacacuaagaacagaagacacagcauuauacuacugcgcaaaagacucacaacuaagaucacuauuauauuucgaauggcuaucacaaggauauuucgacccauggggacaaggaacauuaguaacaguaacauca

SEQ ID NO: 50506 - RNA, 330 nt, Artificial Sequence
  derived and/or modified sequence opt6 from anti-influenza-A_LightChain_V-Region
aacuuuaugcuaacacaaccaccaucagcaucaggaacaccaggacaaagaguaacaauaucaugcucaggaucaucaucaaauauaggaggaaacacaguacacugguuccaacaacuaccaggaacagcaccaaaacuacuaauauauacaaauucacuaagaccaucaggaguaccagacagauucucaggaucaaaaucaggaacaucagcaucacuagcaauaucaggacuacaaucagaagacgaagcagacuacuacugcgcagcaugggacgacucacuaaacggacaaguauucggaggaggaacaaaacuaacaguacua

SEQ ID NO: 50507 - RNA, 390 nt, Artificial Sequence
  derived and/or modified sequence opt6 from anti-influenza-A_HeavyChain_V-Region
caaguacaauuacuagaaaguggaggaggaguaguacaaccaggaagaagccuaagauuaagcugugcagcaagcggauucacauucucaaacuauggaaugcacuggguaagacaagcaccaggaaaaggacuagaauggguagcaauaauaucauucgauggaucaaaaaaauacuaugcaaauagcguaaaaggaagaucaacaauaagcagagacaauagcaaaaacacacuaucacuacaaaugaauagcuuaggaccagaagauacagcacuauauuacugugcaaaacuaccaucaccauacuauuucgauagcagauucguauggguagcagcaagcgcauuccauuucuggggacaaggaauacuaguaacaguaagcuca

SEQ ID NO: 50508 - RNA, 132 nt, Artificial Sequence
  derived and/or modified sequence opt6 from anti-influenza_Chain
aacguaccagaauggucauacauaguagaaaaagcaaacccagcaaacgaccuaugcuacccaggaaacuucaacgacuacgaagaacuaaaacaccuacuaucaagaauaaaccacuucgaaaaaauacaa

SEQ ID NO: 50509 - RNA, 162 nt, Artificial Sequence
  derived and/or modified sequence opt6 from anti-influenza_Chain
ucaggaagauuaguaccaagaggaucaccaggaagcggauacauaccagaagcaccaagagauggacaagcauauguaagaaaagauggagaauggguacuacuaagcacauuuuuaggaaaaccaauaccaaauccauuacuaggacuagauagcacagga

SEQ ID NO: 50510 - RNA, 291 nt, Artificial Sequence
  derived and/or modified sequence opt6 from anti-influenza_Chain
augucacuauuaacagaaguagaaacaccaauaagaaacgaauggggaugcagaugcaauggaucaagcgauccauuagcaauagcagcaaacauaauaggaauauuacacuuaauauuauggauacuagauagauuauucuuuaaauguauauauagaagauucaaauacggacuaaaaggaggaccaucaacagaaggaguaccaaaaagcaugagagaagaauauagaaaagaacaacaaucagcaguagacgcagacgauggacauuucguaagcauagaauuagaa

SEQ ID NO: 50511 - RNA, 300 nt, Artificial Sequence
  derived and/or modified sequence opt6 from anti-influenza_Chain
augaacaacgcaacauucaacugcacaaacauaaacccaauaacacacauaagaggaucaauaauaauaacaauaugcguaucacuaauaguaauacuaauaguauucggaugcauagcaaaaauauucauaaacaaaaacaacugcacaaacaacguaauaagaguacacaaaagaauaaaaugcccagacugcgaaccauucugcaacaaaagagacgacauaucaacaccaagagcaggaguagacauaccaucauucauacuaccaggacuaaaccuaucagaaggaacaccaaac

SEQ ID NO: 50512 - RNA, 300 nt, Artificial Sequence
  derived and/or modified sequence opt6 from anti-influenza_Chain
gaacuaacacaaucaccaucaucacuaucagcaucaguaggagacucaguaacaauaacaugcagaacaucagaaagaauaucaacauaccuaaacugguaccaacaaaaaccaggaaaagcaccaagacuauuaguaucaggagcaucaacacuacaaggaggaguaccaucaagauucucaggaucaggaucaggaacagcauucacacuaacaauaaacucacuacaaccagaagacuucgcaacauacuacugccaacaaucauacucaacaccacuaacauucggaggaggaaca

SEQ ID NO: 50513 - RNA, 300 nt, Artificial Sequence
  derived and/or modified sequence opt6 from anti-influenza_Chain
augacacaaucaccaucaucaaugucaguaucacuaggagacacaguaucaauaacaugccacgcaucacaagacauaucaggacacauaggauggcuacaacaaaaaccaggaaaaucauucaaaggacuaauauaccacggaacaaaccuagaagacggaguaccaucaagauucucaggaucaggaucaggagcagacuucucacuaacaauaucaucacuagaaucagaagacuucgcagacuacuacugcguacaauacguacaauucccauggacauucggaggaggaacaaaa

SEQ ID NO: 50514 - RNA, 306 nt, Artificial Sequence
  derived and/or modified sequence opt6 from anti-influenza_Chain
gauauacaaguaacacaaucaccaagcucauuaagcgcaagcguaggagauagaguaacaauaagcuguagagcacaaucacuaucaagcuaucuacauugguaucaacaaaaaccaggacaaccaccaaaauuacuaauauacgcagcaacaacauuacaaucaggaguaccaucaagauuuagcggaagcggaaguggaacagauuucacacuaacaauaucaacauuucaagcagaagauguagcaacauauuacugucaacaaagcagaacauuuggacaaggaacaaaaguagaaauaaaa

SEQ ID NO: 50515 - RNA, 306 nt, Artificial Sequence
  derived and/or modified sequence opt6 from anti-influenza_Chain
gacauacaaaugacacaaucaccaucaucacuaucagcaucaguaggagacagaguaacaauaucaugcagagcacaaucacuaucaucauaccuacacugguaccaacaaaaaccaggacaaccaccaaaacuacuaauauacgcagcaacaacacuacaaucaggaguaccaucaagauucucaggaucaggaucaggaacagacuucacacuaacaauaucaacauuccaagcagaagacguagcaacauacuacugccaacaaucaagaacauucggacaaggaacaaaaguagaaauaaaa

SEQ ID NO: 50516 - RNA, 309 nt, Artificial Sequence
  derived and/or modified sequence opt6 from anti-influenza_Chain
gacauacaaauaacacaaucaccaucaucacuaucagcaucaguaggagacagaguaacaauaacaugcagaacaucacaaucacuaucaucauaccuacacugguaccaacaaaaaccaggaaaagcaccaaaacuacuaauauacgcagcaucaucacuccaaucaggaguaccaucaagauucucaggaucaggaucaggaacagacuucacacuaacaauaucaucacuacaaccagaagacuucgcaacauacuacugccaacaaucaagaacauucggacaaggaacaaaaguagaaauaaaa

SEQ ID NO: 50517 - RNA, 309 nt, Artificial Sequence
  derived and/or modified sequence opt6 from anti-influenza_Chain
gacauacaaaugacacaaucaccaucaucacuaucagcaucaguaggagacagaguaacaauaacaugcagaacaucacaaucacuaucaucauaccuacacugguaccaacaaaaaccaggaaaagcaccaaaacuacuaauauacgcagcaucaucacuacaaucaggaguaccaucaagauucucaggaucaggaucaggaacagacuucacacuaacaauaucaucacuacaaccagaagacuucgcaacauacuacugccaacaaucaagaacauucggacaaggaacaaaaguagaaauaaaa

SEQ ID NO: 50518 - RNA, 309 nt, Artificial Sequence
  derived and/or modified sequence opt6 from anti-influenza_Chain
gacauacaaguaacacaaucaccaucaucacuaucagcaucaguaggagacagaguaacaauaucaugcagagcaucacaaagacuaaacucauaccuacacugguaccaacaaacaccaggacaagcaccaaaacuacuaauauacgcaacaucaacacuacaaucaggaguaucaccacgauucucaggaucaggaucaggaacagacuucacacuaacaauaucaucacuacaaccagaagacguagccacauacuacugccaacuaucaagaacauucggacacggaacaaaaguagaaauaaaa

SEQ ID NO: 50519 - RNA, 309 nt, Artificial Sequence
  derived and/or modified sequence opt6 from anti-influenza_Chain
gacauacaaaugacacaaucaccaucaucacuaucagcaucaguaggagacagaguaacaauaucaugcagagcaucacaaagacuaaacucauaccuacacugguaccaacaaacaccaggacaagcaccaaaacuacuaauauacgcaacaucaacacuacaaucaggaguaucaccaagauucucaggaucaggaucaggaacagacuucacacuaacaauaucaucacuacaaccagaagacguagcaacauacuacugccaacuaucaagaacauucggacacggaacaaaaguagaaauaaaa

SEQ ID NO: 50520 - RNA, 309 nt, Artificial Sequence
  derived and/or modified sequence opt6 from anti-influenza_Chain
gacauacaaguaacacaaucaccaucaucacuaucagcaucaguaggagacagaauaacaauaucaugcagaacaucacaaucacuaagaucauaccuacacugguaccaacaaaaaccaggaaaagcaccaaaacuacuaauauacgcaucaucaacacuacaaucaggaguaccaucaagauucucaggaucaggaucaggaacagacuucacacuaacaauaucaaaccuacaaccagaagacuucgcaacauacuacugccaacuaucaagaacauucggacaaggaacaaaaguagaaauaaaa

SEQ ID NO: 50521 - RNA, 309 nt, Artificial Sequence
  derived and/or modified sequence opt6 from anti-influenza_Chain
gacauacaaaugacacaaucaccaucaucacuaucagcaucaguaggagacagaauaacaauaucaugcagaacaucacaaucacuaagaucauaccuacacugguaccaacaaaaaccaggaaaagcaccaaaacuacuaauauacgcaucaucaacacuacaaucaggaguaccaucaagauucucaggaucaggaucaggaacagacuucacacuaacaauaucaaaccuacaaccagaagacuucgcaacauacuacugccaacuaucaagaacauucggacaaggaacaaaaguagaaauaaaa

SEQ ID NO: 50522 - RNA, 309 nt, Artificial Sequence
  derived and/or modified sequence opt6 from anti-influenza_Chain
gacauacaaaugacacaaucaccaucaucacuaucagcaucaguaggagacagaguaacaauaacaugcagaacaucacaaucacuaucaucauacacacacugguaccaacaaaaaccaggaaaagcaccaaaacuacuaauauacgcagcaucaucaagacuaucaggaguaccaucaagauucucaggaucaggaucaggaacagacuucacacuaacaauaucaucacuacaaccagaagacuucgcaacauacuacugccaacaaucaagaacauucggacaaggaacaaaaguagaaauaaaa

SEQ ID NO: 50523 - RNA, 309 nt, Artificial Sequence
  derived and/or modified sequence opt6 from anti-influenza_Chain
gacauacaaaugacacaaucaccaucaucacuaucagcaucaguaggagacagaguaacaauaacaugcagaacaucacaaucacuaucaucauacacacacugguaccaacaaaaaccaggaaaagcaccaaaacuacuaauauacgcagcaucaucaagaggaucaggaguaccaucaagauucucaggaucaggaucaggaacagacuucacacuaacaauaucaucacuacaaccagaagacuucgcaacauacuacugccaacaaucaagaacauucggacaaggaacaaaaguagaaauaaaa

SEQ ID NO: 50524 - RNA, 309 nt, Artificial Sequence
  derived and/or modified sequence opt6 from anti-influenza_Chain
gacauacaaaugacacaaucaccaucaucacuaucagcauccguaggagacagaguaacaauaacaugcagaacaucacaaucacuaucaucauacgaccacugguaccaacaaaaaccaggaaaagcaccaaaacuauuaauauacgcagcaucaucaagacuaucaggaguaccaucaagauucucaggaucaggaucaggaacagacuucacacuaacaauauccucacuacaaccagaagacuucgcaacauacuacugccaacaaucaagaacauucggacaaggaacaaaaguagaaauaaaa

SEQ ID NO: 50525 - RNA, 318 nt, Artificial Sequence
  derived and/or modified sequence opt6 from anti-influenza_Chain
gaaauaguaaugacacaaucaccagacacacuaucaguaucaccaggagaaagagcaacauuaucaugcagagcaucacaaucaguaaacagaagacuagcaugguaccaacaaaaaccaggacaagcaccaagacuacuaauacacgacgcaucaacaagagcaacaggaauaccagcaagauucucaggaucaggaucaggaacagaauucacacuaacaauaucaucacuacaaucagaagacuucgcaguauacuacugccaacaauacgacaacuggcuaucauucggacaaggaacaagacuagaaauaaaa

SEQ ID NO: 50526 - RNA, 318 nt, Artificial Sequence
  derived and/or modified sequence opt6 from anti-influenza_Chain
gacauacaacuaacacaaucaccaucaucacuaucagcaucaguaggagacagaguaacaauaacaugcagagcaucacaaggaauacuaaacugccuagcaugguaccaacaaaaaccaggaaaaguaccaaaccuauuaauguacgcagcaucaacacuacaaucaggaguaccaucaagauucucaggaucaggauucggaacagacuucacacuaacaauaucaucacuacaaccagaagacguagcaacauacuacugccaaacauacggaggaguaucaacauucggaggaggaacaaaaguagaaauaaga

SEQ ID NO: 50527 - RNA, 318 nt, Artificial Sequence
  derived and/or modified sequence opt6 from anti-influenza_Chain
aguuauguauuaacacaaccaccaaguguaaguguagcaccaggacaaacagcaagaauaaguuguggaggaaguaauauaggaggaaaaaguguacauugguaucaacaaaaaccaggacaagcaccaguauuaguaguauaugaugauagcggaaggccaaguggaauaccagaaagauuuaguggaaguaauaguggagauacagcaacauuaacaauaaguagaguagaagcaggagaugaagcagauuauuuuugucaaguaugggauaauuuuggaggaguauuuggaacaggaacaaaaguaacaguacua

SEQ ID NO: 50528 - RNA, 318 nt, Artificial Sequence
  derived and/or modified sequence opt6 from anti-influenza_Chain
gacauacaaaugacacaaucaccaucaucauuaucagcaucaguaggagacagaguaacaauaacaugcagaacaucacaaucaauaucaucauaccuaaacugguaccaacaaaaaccaggaaaagcaccaaaacuacuaauauacgcagcaucaucccuacaaucaggaguaccaucaagauucucaggaucaggaucaggaacagacuucacacuaacaauaucaggacuacaaccagaagacuucgcaacauacuacugccaacaaucauacucaaugccagcauucggacaaggaacaaaacuagaaauaaaa

SEQ ID NO: 50529 - RNA, 318 nt, Artificial Sequence
  derived and/or modified sequence opt6 from anti-influenza_Chain
gacauacaaaugacacaaucaccacuaucaguaucaguaucaguaggagacagaguaacaauagcaugcagagcaucacaaucaauagacaaauuccuaaacugguaccaacaaaaaccaggaaaagcaccaaaacuauuaauauacggagcaucaaaccuacacucaggagcaccaucaagauucucagcaucaggaucaggaacagacuucacauuaacaauaacaaacauacaaacagaagacuucgcaacauaccuaugccaacaaucauucucaguaccagcauucggaggaggaacaaaaguagaaauaaaa

SEQ ID NO: 50530 - RNA, 318 nt, Artificial Sequence
  derived and/or modified sequence opt6 from anti-influenza_Chain
gacauacaaaugacacaaucaccaucaucccuaucagcaucaguaggagacagaguaacaauaaccugcagagcaucacaaucaauaucaacauaccuaaacugguaccaaaaaagaccaggaaaagcaccaaaauuacuaguauacggagcaucaacacuacaaucaggaguaccaucaagauucucaggaucaggaucaggaacagacuucacacuaacaauagcaucacuacaaccagaagacucagcaacauacuacugccaacaaacauacucaauaccacuauucggacaaggaacaagacuagaaauaaaa

SEQ ID NO: 50531 - RNA, 318 nt, Artificial Sequence
  derived and/or modified sequence opt6 from anti-influenza_Chain
gacauacaaaugacacaaucaccaucaucacuaucagcaucaguaggagacagaguaacaauaacaugcagagcaucacaauccauaucaacauaccuaaacugguaccaaaaaagaccaggaaaagcaccaaaacuacuaguauacggagcaucaucacuacaaucaggaguaccaucaagauucucaggaucaggaucaggaacagacuucacacuaacaauagcaucauuacaaccagaagacucagcaguauacuacugccaacaaacauacucaauaccacuauucggacaaggaacaagacuagaaauaaaa

SEQ ID NO: 50532 - RNA, 318 nt, Artificial Sequence
  derived and/or modified sequence opt6 from anti-influenza_Chain
gacauacaaaugacacaaucaccaucaucacuaucagcaucaguaggagacagaguaacaauaacaugcagagcaucacaaucaauaucaagauacuuaaacugguaccaacaaaaaccaggaaaagcaccaaaacuacuaauauacggagcaucaacacuacaaaacggagcaccaucaagauucucaggaucaggaucaggaacagacuucacacuaacaauaucaucacuacaaccagaagacucagcaacauaccuaugccaacaaucauacucaguaccagcauucggaggaggaacaaaaguagaaguaaaa

SEQ ID NO: 50533 - RNA, 318 nt, Artificial Sequence
  derived and/or modified sequence opt6 from anti-influenza_Chain
ggaauacaaaugacacaaucaccaucaucacuaucagcaucaguaggagacagaguaacaauaacaugcagagcaucacaaucaauaucaagauaccuaaacugguaccuacaaaaaccaggaaaagcaccaaaacuacuaauaucaggagcaucaucacuacaaucaggaguaccaucaagauucucaggaacaggaucaggaacagaauucacacuaacaauaucaucacuacaaccagaagacuucgcaacauacuacugccaacaaacauucucaauaccacuauucggacaaggaacaaaaguagaaauaaaa

SEQ ID NO: 50534 - RNA, 321 nt, Artificial Sequence
  derived and/or modified sequence opt6 from anti-influenza_Chain
gacauacaaaugacacaaucaccaucaucacuaucagcaucaguaggagacagaguaucaauaacaugccaagcaucacaagacauaucaagauaccuaaacugguaccaacaaaaaccaggagaagcaccaaaacuacuaauauacgacgcaucaaacuuagaaacaggaguaccaucaagauucucaggaucaggaucaggaacagacuucacauucacaauaucaucacuacaaccagaagacauagcaacauacuucugccaacaauacggauaccuaccacuaacauucggaccaggaacaaaaguagacucaaaa

SEQ ID NO: 50535 - RNA, 321 nt, Artificial Sequence
  derived and/or modified sequence opt6 from anti-influenza_Chain
gacauacaaaugacacaaucaccaucaucauucucaguaucacuaggagacagaguaacaauaacaugcaaagcaucagaagacauauacaacagacuagcaugguaccaacaaaaaccaggaaacgcaccaagacuacuaauaucagacacaacaaaccuauggauaggaguaccaucaagauucucaggaucaggaucaggaaaagacuacacacuaucaauaacaucacuacaaucagaagacguagcaacauacuacugccaacaauacuggucaucaagaacauucggaggaggaacaaaacuagaaauaaaaaga

SEQ ID NO: 50536 - RNA, 321 nt, Artificial Sequence
  derived and/or modified sequence opt6 from anti-influenza_Chain
gacauacaaaugacacaaagcccaagcagcuucucaguaucacuaggagacagaguaacaauaacaugcaaagcaucagaagacauauauaacagaguagcaugguaucaacaaaaaccaggaaaugcaccaagauuacuaaugagcgaugcaacaucauuaggagcaggaguaccaagcagauuuagcggaagcggaagcggaaaagaucacacauuaucaauaacaucauuacaaacagaagauguagcaacauauuacugucaacaauacuggaacacaagaacauucggaggaggaacaaaacuagaaauaaaaaga

SEQ ID NO: 50537 - RNA, 321 nt, Artificial Sequence
  derived and/or modified sequence opt6 from anti-influenza_Chain
gacauacaaaugacacaaucaccaucaucacuaucagcaucaguaggagacagaguaacaauaacaugccgagcaucacaaucaauaucaacauaccuaaacugguaccaacaaaaaccaggaauaccaccaaaacuacuaauaaacguagcaucaucacuacaaucaggaguaccaucaagauucucaggaucaggaucaggaacagacuucacacuaacaauauccucacuacaaccagaagacuucgcaucauacuacugccaacaaacauacucaucaccaccaacauucggacaaggaacaaaaguagaaauaaaa

SEQ ID NO: 50538 - RNA, 321 nt, Artificial Sequence
  derived and/or modified sequence opt6 from anti-influenza_Chain
gauauacaaaugacacaaucaccaucaacauuaagcggaagcguaggagauagaguaacaauaacauguagagcaagccaaaacauaggaccaugguuagcaugguaccaacaagaaagcggaaaagcaccaaaacuauuaauaucaagagcaagcauacuagaaaguggaguaccaagcagauucucaggaacaggaacaggaacagaauuuacauuaacaauaagcucacuacaaccagaugacuuugcaacauacuauugccaacacuauaacgcauacuggggaacauucggacaaggaacaaaaguagaaauaaau

SEQ ID NO: 50539 - RNA, 321 nt, Artificial Sequence
  derived and/or modified sequence opt6 from anti-influenza_Chain
guaauauggaugacacaaucaccaucacuacuaucagcaucaacaggagacagaguaacaauaucaugcagaaugucacaaggaauaucaucauaccuagcaugguaccaacaaaaaccaggaaaagcaccagaacuacuaauacacacagcauacacacuaaaaucaggagucccaucaagauucucaggaucaggaucaggaaaagacuucacacuaacaauaucaggacuacaaucagaagacuucgcaacauacuacugccaacaauacuacucauucccauacacauucggacaaggaacaaaaguagaaauaaaa

SEQ ID NO: 50540 - RNA, 321 nt, Artificial Sequence
  derived and/or modified sequence opt6 from anti-influenza_Chain
gacauacaaaugacacaaucaccaucaucagucucagcaucaguaggagacagaguaacaauaacaugcagagcaucacaagacguaucaacauggcuagcaugguaccaacuaaaaccaggaaaagcaccaaaacuacuaauauacgcagcaucaucacuacaaucaggaguaccaucaagauucucaggaucaggaucaggaacagacuucacacuaacaguaucaucacuacaaccagaagacuucgcaacauacuacugccaacaagcaaacucauucccauucacauucggaccaggaacaaaaguagacauaaaa

SEQ ID NO: 50541 - RNA, 321 nt, Artificial Sequence
  derived and/or modified sequence opt6 from anti-influenza_Chain
gacauacaauuaacacaaucaccaucauuccuaucagcaucaguaggagacggaguaacaauaacaugcagagcaucacaagacauauacauauaccuagcaugguaccaacaaaaaccaggaaaagcaccaaaacuacuaauauacgcagcaucaacacuacaaggaggaguaccaagcagauucucaggaucaggaucaggaacagaauucacacuaacaauaaacaaccuacaaccagaagacuucgcaacauacuucugccaacaacuaaacggauacccacuaacauucggaggaggaacaaaaguagaaauaaaa

SEQ ID NO: 50542 - RNA, 321 nt, Artificial Sequence
  derived and/or modified sequence opt6 from anti-influenza_Chain
gauauacaacuaacacaaucaccaucaagccuaagcgcaagcguaggagauagaguaacauuaacaugucaagcaagccaagacauaagaaaauucuuaaacugguaccaacaaaaaccaggaaaaggaccaaaacuauuaauauaugacgcaagcaaucuacaaagaggaguaccaagcagauucucaggaggaggaucaggaacagacuuuacauuaauaauaagcucacuacaaccagaagacguaggaacauacuauugccaacaauaugacgggcuaccauucacauucggaggaggaacaaaacuagaaauaaaa

SEQ ID NO: 50543 - RNA, 321 nt, Artificial Sequence
  derived and/or modified sequence opt6 from anti-influenza_Chain
gacauacaacuaacacaaucaccaucaucacuaucagcaucaauaggagacagaguaacaauaacaugccaagcaucacaagacauaagaaacucacuaaacugguacgaacacaaaccaggaaaagcaccaaaacuacuaauacacgacgcaucaaaccuagaaacaggaguaccaagcagauucucaggaggaggaucaggaacagacuucacacuaacaauaucaucacuacaaccagaagacuucgcaacauacuacugccaacaagcaaacucauucccacuaacauucggaggaggaacaaaaguagaaauaaaa

SEQ ID NO: 50544 - RNA, 321 nt, Artificial Sequence
  derived and/or modified sequence opt6 from anti-influenza_Chain
gacauacaacuaacacaaucaccaucaagcuuaucagcaucaguaggagacagaguaacaauaacaugcagagcaucacaaggaauaagaaacgaccuaggaugguaccaacaaaaaccaggaaacgcaccaaaaagauuaauauucggagcaucaucacuacaaucaggaguaccaagcagauucucaggaucaggaucaggaacagaauucacacuaacaauaucaucacuacaaccagaagacuucgcaacauacuacugccuacaacacaacucauacccauacacauucggacaaggaacaaaacuagaaauaaaa

SEQ ID NO: 50545 - RNA, 321 nt, Artificial Sequence
  derived and/or modified sequence opt6 from anti-influenza_Chain
gacauacaacuaacacaaucaccaucaucacuaucagcaucaguaggagacagaguaacaauaacaugcagagcaucacaaucaauaucaagauaccuaaacugguaccaacaaaaaccaggaaaagcaccaaaacuacuacuauucgcagcaucaacacuacuagacggaguaccaucaagauucucaggaucaggaucaggaacagacuucacacuaacaauaucaucacuacaaccagaagacuucgcaacauacuacugccaaagaaaccacucaccaucauggacauucggacaaggaacaagaguagaaauaaaa

SEQ ID NO: 50546 - RNA, 321 nt, Artificial Sequence
  derived and/or modified sequence opt6 from anti-influenza_Chain
gacauacaaaugacacaaucaccaucaucacuaucagcaucaguaggagacagaguaacaaugacaugcagagcaagccaaaacauaagaucauaccuaaacugguaccaacaaagaccaggaacagcaccaaaacuacuaauauacgcagcaucaacacuccacucaggaguaccaucaagauucucaggaggaggaucaggaacagacuucacacuaacaauaaacaaccuacaaccagaagacuucgcaucauacuacugccaacaaucauacgacaacccacaaacauucggacaaggaacaaaaguagaaauaaaa

SEQ ID NO: 50547 - RNA, 321 nt, Artificial Sequence
  derived and/or modified sequence opt6 from anti-influenza_Chain
gacauacaaaugacacaaucaccaucaucacuaucagcaucaguaggagacagaguaacaauaacaugcagagcaaaccaagacauaggaauauaccuaaacugguaccaacaaaacccaggaaaaguaccaaaacuacuacuacacggagcaucaucacuacaaggaggaguaccaucaagauucucagcaucaggaucaggaacagacuucacacuaacaauacauucacuacaaccagaagaccuagcaacauacuacugccaacaaucacgaagacuaccauacacauucggacaaggaacaagaguagaacuaaaa

SEQ ID NO: 50548 - RNA, 321 nt, Artificial Sequence
  derived and/or modified sequence opt6 from anti-influenza_Chain
gacauacaaaugacacaaucaccaucaacacuaucagcaucaauaggagacagaguaacaauaacaugcagagcaucacaaucaauagcaucauggcuagcaugguaccaacaaaaaccaggaaaagcaccaaaacuacuaauauacgaagcaguaaaccuagaaucaggaguaccaucaagauucucaggaucaggaucaggaacagacuucacacuaacaauaucaucacuacaaccagacgacuucgcaacauacuucugccaacacuacggaacaauaucacaaacauucggaggaggaacaaaagucgaaauaaaa

SEQ ID NO: 50549 - RNA, 321 nt, Artificial Sequence
  derived and/or modified sequence opt6 from anti-influenza_Chain
gacauacaaaugacacaaucaccaucaucacuaucagcaucaguaggagacagaguaacaauaacaugcagagcaucacaaucaauaucaucauaccuaaacugguaccaacacaaaccaggaaaagcaccaaaaguacuaauguacgcaguaucaauacuacaauccggaguaccaucaagauucucaggaucaggaucaggagcagacuucacacuaacaauaucaucacuacaaccagaagacuucgcaacauacuacugccaacaaucauacucaucaccacuaacauucggaggaggaacaaaaguagaaauaaaa

SEQ ID NO: 50550 - RNA, 321 nt, Artificial Sequence
  derived and/or modified sequence opt6 from anti-influenza_Chain
gacauacaaaugacacaaucaccaucaucacuaucagcaucaguaggagacagaguaacaauaacaugcagagcaucacaaaacauaaaaagauacuucaacugguaccaacaaaaaccaggaaaagcaccaaaacuacuaauauacgcagcaucaaaccuagaaaacggaguaccaucaagauucucaggaucaggaucaggaacagacuucacccuaacaauaucaucacuacaaccagaagacuucgcaacauacuacugccaacaaucauucucaaaaucauggacauucggacaaggaacaaacguagacauaaaa

SEQ ID NO: 50551 - RNA, 321 nt, Artificial Sequence
  derived and/or modified sequence opt6 from anti-influenza_Chain
gacauacaaaugacacaaucaccaucaucacuaucagcaucaguaggagacagaguaacaauaacaugcagagcaucacaaaacauauacaaauaccuaaacugguaccaacaaagaccaggaaaagcaccaaaaggacuaauaucagcagcaucaggacuacaaucaggaguaccaucaagauucucaggaucaggaucaggaacagacuucacacuaacaauaacaucacuacaaccagaagacuucgcaacauacuacugccaacaaucauacucaccaccacuaacauucggaggaggaacaagaguagaaauaaaa

SEQ ID NO: 50552 - RNA, 321 nt, Artificial Sequence
  derived and/or modified sequence opt6 from anti-influenza_Chain
gacauacaaaugacacaaucaccaucaucacuaucaucaucaguaggagacagaguaacaauaacaugcagagcaucacaaucaauaggagcauacguaaacugguaccaacaaaaagcaggaaaagcaccacaaguacuaauauucggagcaucaaaccuacaaucaggaguaccaucaagauucucaggaucaggaucaggaacagacuucacauuaacaauaucaucacuacaaccagaagacuucgcaacauacuucugccaacaaacauacucaacaccaauaacauucggacaaggaacaagacuagaaauaaaa

SEQ ID NO: 50553 - RNA, 321 nt, Artificial Sequence
  derived and/or modified sequence opt6 from anti-influenza_Chain
gacauacaaaugacacaaucaccaucaucacuaucagcaucaguaggagacagaguaacaauaucaugcagagcaucacaaucaauaucaacauaccuaaacugguaccaacaacaaccaggaaaagcaccaaaaguacuaauauucggagcaacaaaccuacaaucaggaguaccaucaagauucucaggaucaggaucaggaacagacuucacacuaacaauaucaucacuacaaccagaagacuucgcaacauacuacugccaacaaucauacaacacaccacuaauauucggacaaggaacaaaacuagaaauaaaa

SEQ ID NO: 50554 - RNA, 321 nt, Artificial Sequence
  derived and/or modified sequence opt6 from anti-influenza_Chain
gacauacaaaugacacaaucaccaucaucacuaucagcaucaguaggagaccgaguaacaauaucaugcagagcaucacaaucaauaucaacauaccuaaacugguaccaacaacaaccaggaaaagcaccaaaaguacuaauaucaggagcaacaaaccuacaaucaggaguaccaucaagauucucaggaucaggaucaggaacagacuucacauuaacaauaucaucacuacaaccagaagacuucgcaacauacuacugccaacaaucauacaacacaccacuaauauucggacaaggaacaaaacuagaaauaaaa

SEQ ID NO: 50555 - RNA, 321 nt, Artificial Sequence
  derived and/or modified sequence opt6 from anti-influenza_Chain
gacauacaaaugacacaaucaccaucaucacuaucagcaucaguaggagacagacuaacaauaacaugccgagcaucacaaucaauaucaacauaccuacacugguaccaacaaaaaccaggaaaagcaccaaaacuacuaauauacgcagcaucaucacuacaaucaggaguaccaucaagauucucaggaucacgaucaggaacagacuucacacuaacaauaucaucacuacaaccagacgacuucgcaacauacuacugccaacaaucauacucaccaccacuaacauucggaccaggaacaaaaguagacaugaaa

SEQ ID NO: 50556 - RNA, 321 nt, Artificial Sequence
  derived and/or modified sequence opt6 from anti-influenza_Chain
gacauacaaaugacacaaucaccaucaucacuaucagcaucaguaggagacagaguaacaauaacaugcagagcaucacaaucaauaucaaacuaccuaaacugguaccaacacaaaccaggagaagcaccaaaacuacuaaacuacgcagcaucaucacuacaaucaggaguaccaucaagauucucagcaucaggaucaggaacagacuucacacuaacaauaucaucacuacaaccagaagacuucgcaacauacuacugccaacaaucauacaacacaccaauaacauucggacaaggaacaagacuagaaauaaaa

SEQ ID NO: 50557 - RNA, 321 nt, Artificial Sequence
  derived and/or modified sequence opt6 from anti-influenza_Chain
gacauacaaaugacacaaucaccaucaucacuaucagcaucaguaggagacagaguaacaauaacaugcagagcaucacaaucaauaucaaacuaccuaaacugguaccaacacaaaccaggagaagcaccaaaacuacuaaacuacgcagcauccucacuacaaucaggaguaccaucaagauuuucagcaucaggaucaggaacagacuucacacuaucaauaucaggacuacaaccagaagacuucgcaacauacuacugccaacaaucauacaacacaccaauaacauucggaccaggaacaagacuagaaauaaaa

SEQ ID NO: 50558 - RNA, 321 nt, Artificial Sequence
  derived and/or modified sequence opt6 from anti-influenza_Chain
gacauacaaaugacacaaucaccaucaucacuaucagcaucaguaggagacagaguaacaauaacaugcagagcaucacaaucaauaucaacauaccuaaacugguaccaacaaaaaccaggaaaagcaccaaaacuacuaauauacgcagcaucaucacuacacucaggaguaccaucacgauucucaggaucaggaucaggaacagacuucgcacuaacaauaucaucacuacaaccagaagacuucgcaaccuacuacugccaacaaucauacucaccaccaauaacauucggacaaggaacaagacuagaaauaaaa

SEQ ID NO: 50559 - RNA, 321 nt, Artificial Sequence
  derived and/or modified sequence opt6 from anti-influenza_Chain
gacauacaaaugacacaaucaccaucaucacuaucagcaucaguaggagacagaguaacaauaacaugcagagcaucacaaacaauaucaacauaccuaaacugguaccaacaaaaaucaggaaaagcaccaaaacuacuaauauacgcagcaucaggacuacaaucaggaguaccaucaagauucucaggaucaggaucaggcacagacuucacacuaacaauaucaucacuacaaccagaagacuucgcaacauacuucugccaacaaucauacaacacaccacuaacauucggacaaggaacaaaaguagaaauaaaa

SEQ ID NO: 50560 - RNA, 321 nt, Artificial Sequence
  derived and/or modified sequence opt6 from anti-influenza_Chain
gacauacaaaugacacaaucaccaucaucacuaucagcaucaguaggagacagaguaacaauaucaugcagagcaucacaaucaauaucaacauaccuaaacugguaccaacaacaaccaggaaaagcaccaaaaguacuaauaucaggagcaacagaccuacaaucaggaguaccaucaagauucucaggaucaggaucaggaacagacuucacacuaacaauaucaucacuccaaccagaagacuucgcaacauacuacugccaacaaucauacaacacaccacuaauauucggacaaggaacaaaacuagaaauaaaa

SEQ ID NO: 50561 - RNA, 321 nt, Artificial Sequence
  derived and/or modified sequence opt6 from anti-influenza_Chain
gacauacaaguaacacaaucaccaucaucacuaucagcaucaguaggagacagaguaacaauaacaugcagagcaucacaaaacauauacaaauacuuaaacugguaccaacaaagaccaggaaaagcaccaaaaggacuaauaucagcagcaucaggacuacaaucaggaguaccaucaagauucucaggaucaggaucaggaacagacuucacacuaacaauaacaucacuacaaccagaagacuucgcaacauacuacugccaacaaucauacucaccaccauuaacauucggaggaggaacaagaguagacauaaaa

SEQ ID NO: 50562 - RNA, 321 nt, Artificial Sequence
  derived and/or modified sequence opt6 from anti-influenza_Chain
caaucaguacuaacacaaccaccaucagaaucaguaucaccaggacaaacagcaucaguaacaugcucaggacacaaacuaggagacaaauacguaucaugguaccaacaaaaaccaggacaaucaccaguauuacuaauauaccaagacaacagaagaccaucaggaauaccagaaagauucauaggaucaaacucaggaaacacagcaacacuaacaauaucaggaacacaagcacuagacgaagcagacuacuacugccaagcaugggacucaucaacagcaguauucggaggaggaacaaaacuaacaguacuagga

SEQ ID NO: 50563 - RNA, 321 nt, Artificial Sequence
  derived and/or modified sequence opt6 from anti-influenza_Chain
gacauacaacuaacacaaucaccaucaucacuaucagcaucaguaggagacagaguaacaauaacaugcagagcaucacaaggaauaucaacauaccuagcaugguaccaacaaaaaccaggaaaaguaccaaaacuacuaauauacgcagcaucaacacuacaaucaggaguaccaucaagauucucaggaucaggaucaggaacagacuucacacuaacaauaucaucacuacaaccagaagacguagcaacauacuacugccaaaaauacaacucagcaccaucauucggaccaggaacaaaaguagacauaaaaaga

SEQ ID NO: 50564 - RNA, 321 nt, Artificial Sequence
  derived and/or modified sequence opt6 from anti-influenza_Chain
ucaguacuaacacaaccaccaucagcaucaggaucaagaggacaaucaauaacaauaucaugcacaggaucaacaucagacauaggaucauacaacuacguaucaugguaccaacaacacccaggaacagcaccaaaaguaauacuauacgaaguaucacaaagaccaucaggaguaccagacagauucucaggaucaaaaucaggaaacacagcauuccuaacaguaucaggacuacaagcagaagacgaagcagacuacuacugcgcaucauacgcaggaaacaacauauacguauucggaucaggaacaaaaguaaca

SEQ ID NO: 50565 - RNA, 321 nt, Artificial Sequence
  derived and/or modified sequence opt6 from anti-influenza_Chain
ucagcacuaacacaaccaccaucagcaucaggaucaagaggacaaucaauaacaauaucaugcacaggaucaacaucagacauaggaucauacaacuacguaucaugguaccaacaacacccaggaacagcaccaaaaguaauacuauacgaaguaucacaaagaccaucaggaguaccagacagauucucaggaucaaaaucaggaaacacagcauuccuaacaguaucaggacuacaagcagaagacgaagcagacuacuacugcgcaucauacgcaggaaacaacauauacguauucggaucaggaacaaaaguaaca

SEQ ID NO: 50566 - RNA, 321 nt, Artificial Sequence
  derived and/or modified sequence opt6 from anti-influenza_Chain
gaaauaguacuaacacaaucaccagcaacacuaucacuaagcccaggagaaagagcaacacuaucaugcagagcaucacaaucaguaucaacauuccuagcaugguaccaacaaaaaccaggacaagcaccaagacuacuaauguacgacgcaucaaacagagcaacaggaauaccagcaagauucucaggaucaggaucaggaacagacuucacacuaacaauaucaucacuagaaccagaagacuucgcaauauacuacugccaacaaagaucacacuggccaccaauauucggacaaggaacaagacuagaaauaaaa

SEQ ID NO: 50567 - RNA, 321 nt, Artificial Sequence
  derived and/or modified sequence opt6 from anti-influenza_Chain
gacauacaaaugacacaaucaccagcaucacuaucaguaucaguaggagaaacaguaacaauaacaugcagagcaucagaaaaaauauacucaaaccuagcaugguaccaacaaaaagaaggaaaaucaccacaacuacuaguauacgcagcaauaagacuagcagacggaguaccaucaagauucucaggaucaggaucaggaacacaauucucacuaaaaauaaacucacuacaaucagaagacuucggaacauacuacugccaacacuucuggggaacaccacuaacauucggagcaggaacaaaacuagaacuaaaa

SEQ ID NO: 50568 - RNA, 321 nt, Artificial Sequence
  derived and/or modified sequence opt6 from anti-influenza_Chain
gacauacaaaugacacaaucaccaucaucaguaucagcaucaguaggagacagaguaacaauaacaugcagagcaucacaagacauaucaacauggcuagcaugguaccaacaaaaaccaggaaaagcaccaaaauuacuaaucuacgcagcaucaucacuacaaucaggaguaccaagcagauucucaggaucaggaucaggaacagacuucacacuaacaauaucaucacuacaaccagaagacuucgcaacauacuucugccaacaagcaaacucauucccaccaacauucggacaaggaacaaaacuagaaauaaaa

SEQ ID NO: 50569 - RNA, 321 nt, Artificial Sequence
  derived and/or modified sequence opt6 from anti-influenza_Chain
gacauacaaaugacacaaucaccaucaucaguaucagcaucaguaggcgacagaguaacaauaacaugcagagcaucacaagacauaucaacauggcuagcaugguaccaacaaaaaccaggaaaagcaccaaaacuacuaauauacgcagcauccucacuacaaucaggaguaccaucaagauucucaggaucaggaucaggaacagacuucacacuaacaauaucaucacuacaaccagaagacuucgcaacauacuucugccaacaagcaaacucauucccaccaacauucggaugcggaacaaaacuagaaauaaaa

SEQ ID NO: 50570 - RNA, 321 nt, Artificial Sequence
  derived and/or modified sequence opt6 from anti-influenza_Chain
gacauacaaaugacacaaucaccaucaucaguaucagcaucaguaggagacagaguaacaauaacaugcagagcaucacaagacauaucaacauggcuagcaugguaccaacaaaaaccaggaaaaugcccaaaacuacuaauauacgcagcaucaucacuacaaucaggaguaccaucaagauucucaggaucaggaucaggaacagacuucacacuaacaauaucaucacuacaaccagaagacuucgcaacauacuucugccaacaagcaaacucauucccaccaacauucggacaaggaacaaaacuagaaauaaaa

SEQ ID NO: 50571 - RNA, 321 nt, Artificial Sequence
  derived and/or modified sequence opt6 from anti-influenza_Chain
gacauacaaaugacacaaucaccaucaucaguaucagcauccguaggagacagaguaacaauaacaugcagagcaucacaagacauaucaacauggcuagcaugguaccaacaaaaaccaggaaaagcaccaaaauuacuaauauacgcagcaucaucacuacaauccggaguaccaucaagauucucaggaucaggaucaggaacagacuucacacuaacaauaucaucacuacaaccagaagacuucgcaacauacuacugccaacaagcaaacucauucccaccaacauucggacaaggaacaaaacuagaaauaaaa

SEQ ID NO: 50572 - RNA, 321 nt, Artificial Sequence
  derived and/or modified sequence opt6 from anti-influenza_Chain
gacauacaaaugacacaaucaccaucaucaguaucagcaucaguaggagacagaguaacaauaacaugcagagcaucacaagacauaucaacauggcuagcaugguaccaacaaaaaccaggaaaagcaccaaaacuacuaauauacgcagcaucaucacuacaaucaggaguaccaucaagauucucaggaucaggaucaggaacagacuucacacuaacaauaucaucacuacaaccagaagacuucgcaacauacuacugccaacaagcaaacucauucccaccaacauucggaugcggaacaaaacuagaaauaaaa

SEQ ID NO: 50573 - RNA, 321 nt, Artificial Sequence
  derived and/or modified sequence opt6 from anti-influenza_Chain
gacauacaaaugacacaaucaccaucaucaguaucagcaucaguaggagacagaguaacaauaacaugcagagcaucacaagacauaucaacauggcuagcaugguaccaacaaaaaccaggaaaaugcccaaaacuacuaauauacgcagcaucaucauuacaaucaggaguaccaucaagauucucaggaucaggaucaggaacagacuucacacuaacaauaucaucacuacaaccagaagacuucgcaacauacuacugccaacaagcaaacucauucccaccaacauucggacaaggaacaaaacuagaaauaaaa

SEQ ID NO: 50574 - RNA, 321 nt, Artificial Sequence
  derived and/or modified sequence opt6 from anti-influenza_Chain
gaaauaguacuaacacaaucaccagcaacacuaucacuaucaccaggagaaagagcaacacuaucaugcagagcaucaagaucaauaacaacauuccuagcaugguaccaacaaaaaccaggacaagcaccaagacuacuaauauacgacgcaucaaacagagcaacaggaguaccagcaagauucucaggaucaggaucaggaacagacuucacacuaacaauaaacucacuagaaccagacgacuucgcaauauacuacugccaacaaagagaccacuggccaccaauauucggacaaggaacaagacuagaaauaaaa

SEQ ID NO: 50575 - RNA, 321 nt, Artificial Sequence
  derived and/or modified sequence opt6 from anti-influenza_Chain
gaaauaguacuaacacaaucaccagcaacacuaucacuaucaccaggagaaagagcaacacuaucaugcagagcaucaagaucaauaacaacauuccuagcaugguaccaacaaaaaccaggacaagcaccaagacuacuaauauacgacgcaucaaacagagcaacaggaguaccagcaagauucucaggaucaggaucaggaacagacuucacacuaacaauaaacucacuagaaccagacgacuucgcaauauacuacugccaacaaagagaccacuggccaccaauauucggaugcggaacaagacuagaaauaaaa

SEQ ID NO: 50576 - RNA, 324 nt, Artificial Sequence
  derived and/or modified sequence opt6 from anti-influenza_Chain
gaaauaguacuaacacaaucaccaggaacauuaagccuaagcccaggagaaagagcaacauuaagcuguagagcaagccaaacaguaaguucaagcuaucuagcaugguaucaacaaaaaccaggacaagcaccaagauuacuaauauacggagcaucaagcagagcaacaggaauaccagauagauuuagcggaagcggaagcggaacagauuucacacuaacaauaucaagauuagaaccagaagauuucgcaguauauuacugucaacaauacggaaacucaccauauacauuuggacaaggaacaaaauuagaaauaaaa

SEQ ID NO: 50577 - RNA, 324 nt, Artificial Sequence
  derived and/or modified sequence opt6 from anti-influenza_Chain
gaaauaguacuaacacaaucaccaggaacauuaucaguaucaccaggagaaagagcaacauuaucaugcagagcaucacaaucaauaucaucaggauaccuagcaugguaccaacaaaaaccaggacaagcaccaagacuacuaauauacggagcaucaucaagagcaacaggaauaccagacagauucucaggaucaggaucaggaacagacuucacauuaacaauaucaagauuagaaccagaagacuucgcaguauacuacugccaacaauacggaacaucaccacaaacauucggacaaggaacaaaaguagaaauaaaa

SEQ ID NO: 50578 - RNA, 324 nt, Artificial Sequence
  derived and/or modified sequence opt6 from anti-influenza_Chain
gaaguaguacuaacacaaucaccaggaacauuaucauuaagcccaggacaaagagcaacauuaagcuguagagcaagccaaagcguaaguucaagcuaucuagcaugguaucaacaaaaaccaggacaagcaccaagauuacuaauauacgaugcaucaaacagagcaacaggaauaccagauagauuuagcggaagcggaagcggaacagauuucacacuaacaauaucaagacuagaaccagaagauuucgcaguauauuacugucaacaauacggaagcucaccauauacauuuggacaaggaacaaaauuagaaauaaaa

SEQ ID NO: 50579 - RNA, 324 nt, Artificial Sequence
  derived and/or modified sequence opt6 from anti-influenza_Chain
gacauacaacucacacaaucaccaucaucacuaucagcaucaguaggagacagaguaacaauaacaugcagagcaucacaaggaauaauaacauaccuaaacugguaccaacaaaaaccaggaaaagcaccaaaacuacuaauauacgcaacauacucacuacaaaacggaguaccaucaagauucucaggaucaggaucaggaacagacuucacacuaacaauaucaucacuacaaccagaagacuucgcaacauacuacugccaacaaucauacucaucacuaauguucacauucggacaaggaacaaaacuagacauaaaa

SEQ ID NO: 50580 - RNA, 324 nt, Artificial Sequence
  derived and/or modified sequence opt6 from anti-influenza_Chain
gaaacaguacuaacacaaucaccaggaacauuaagccuaacaccaggagaaagagcaacacuaagcuguagaguaggacaaagcguaagcggaagccaucuagcaugguaucaacaaaaaccaggacaagcaccaagauuacuaauauacggagcaucaagcagagccacaggaauaccagauagauuuggaggaagcguaagcggaacagauuucacacuaacaauaucaagauuagaaccagaagauagugcaguauauuacugucaacaauacggagacucaagauauacauuuggacaaggaacaaaauuagaaauaaaa

SEQ ID NO: 50581 - RNA, 324 nt, Artificial Sequence
  derived and/or modified sequence opt6 from anti-influenza_Chain
gaaauaguacuaacacaaucaccaggaacacuaucacuaucaccaggagaaagagcaacacuaucaugcagagcaucacaaucaguaucaucaucacaacuagcaugguaccaacaaaaaccaggacaagcaccaagauuaauaauauacggagcaucaacaagagcaacaggaauaccagacagauucucaggaucaggaucaggaacagacuucacacuaacaauaggaagacuagaaccagaagacuucgcaguauucuucugccaacaauacucaacaucaccaccaacauucggacaaggaacaaaaguagacuucaaa

SEQ ID NO: 50582 - RNA, 324 nt, Artificial Sequence
  derived and/or modified sequence opt6 from anti-influenza_Chain
gauauaguacuaacacaaucaccaggaacauuaagccuaaguccaggagaaagagcaacauuaagcuguagagcaagccaaagcguaagcucaagcuauuuagcaugguaucaacaaaaaccaggacaagcaccaagauuaguaauguacggagcagcaacaagagcaacaggaauaccagauagauuuagcggaagcggaagcggaccagacuucacacuaacaauaucaagauuagaaccagaagauuucgcaauguauuacugucaacaauacggaaacucaccaauaacauuuggacaaggaacaagauuagaaauaaaa

SEQ ID NO: 50583 - RNA, 324 nt, Artificial Sequence
  derived and/or modified sequence opt6 from anti-influenza_Chain
gaaauaguacuaacacaaucaccagcaacacuaucauuaucaccaggagaaagagcaacacuaucaugcagagcaucacaaucaguaucaucauaccuagcaugguaccaacaaaaaccaggacaagcaccaagacuacuaauauacgacgcaucaaacagagcaacaggaauaccagcaagauucuccggaucaggaucaggaacagacuucacacuaacaauaucaucacuagaaccagaagacuucgcaguauacuacugccaacaaagaucacacuggccaccaauaacauucggacaaggaacaagacuagaaauaaaa

SEQ ID NO: 50584 - RNA, 324 nt, Artificial Sequence
  derived and/or modified sequence opt6 from anti-influenza_Chain
agcuaugaauuaacacaaccaccaagcguaaguguaagcccaggacaaacagcaagaauaacauguaguggagacgcacuaccaaaacaaaacgcauacugguaccaacaaaaaccaggacaagcaccaguacuauuaauauauaaagauagcgaaagaccaagcggaauaccagaaagauucucaggaucaagcucaggaacaacaguaacauuaacaauaaguggaguacaagcagaagacgaagcagauuacuauugccaaagcgcagacucaagcggaacaucauggguauucggaggaggaacaaaacuaacaguauua

SEQ ID NO: 50585 - RNA, 324 nt, Artificial Sequence
  derived and/or modified sequence opt6 from anti-influenza_Chain
ucauauguauuaacacaagcaccaucaguaucaguagcaccaggacaaacagcaagaauaacaugcggaggaaaugcaauaggaucaaaaaaaguacauugguaucaacauaaagcaggacaagcaccaguauuaguaguauaugaugauacagacagaccaucaggaauaccagaaagauuuaguggaaguaauagcuggaguacagcaacauuaacaauaaauagaguagaagcaggagaugaagcagacuauuauugucaaguaugggauuucacaauagaucauguaguauuuggaggaggaacaaaauuaacaguauua

SEQ ID NO: 50586 - RNA, 324 nt, Artificial Sequence
  derived and/or modified sequence opt6 from anti-influenza_Chain
gaaauaguacuaacacaaucaccaggaacauuaagcuuaucaccaggagaaagagcaacauuaagcuguagagcaagucaaagcguaagcucaagcuaucuagcaugguaucaaaaaaaaccaggacaagcaccaagauuacuaauauacggagcaucaacaagagcaacaggaauaccagauagauuuacaggaagcggaagcggaacagauuucacacuaucaauaucaagauuagaaccagaagauuucgcaguauauuacugucaacauuucggaacaucaguauuuacauuuggaggaggaacaaaaguagaaauaaaa

SEQ ID NO: 50587 - RNA, 324 nt, Artificial Sequence
  derived and/or modified sequence opt6 from anti-influenza_Chain
gaaauaguaaugacacaaucaccagcaacacuaucaguaucaccaggagaaagagcaacauuaucaugcagagcaucacaaagcguaggaaauucacuagcaugguaccaacaaagaccaggacaagcaccaagacuauuaauauacggagcaucaacaagagcaacaggaauaccaccaagauucucaggaucaggaucaggaacagaauucacauuaacaauaucaucacuacaaacagaagacuucgcaguauacuacugccaacaauacauaaauuggagaccacuaucauucggaggaggaacaaaaguagaaauaaaa

SEQ ID NO: 50588 - RNA, 324 nt, Artificial Sequence
  derived and/or modified sequence opt6 from anti-influenza_Chain
caagaaagcggagcagaauuaguaagaccaggagcaagcguaaaauuaagcuguaaagauagcggauacacauucacaacauauuggaugaacuggguaaaacaaagaccagaacaaggacuagaauggauaggaagaauagauccauaugacucagaaacacacuauaaccaaaaauuuaaagauaaagcaauauuaacaguagacaaaagcucaaacacagcauauaugcaacuaucaagccuaacaucagaagauagcgcaguauauuacuguguaagaggaggaagcacaguagcguacuuuggaguauggggacaagga

SEQ ID NO: 50589 - RNA, 324 nt, Artificial Sequence
  derived and/or modified sequence opt6 from anti-influenza_Chain
gaaauaguauuaacacaaucaccaggaacauuaaguuuaagcccaggagaaagagcaacauuaagcugucgagcaagccaaagaguaagcucauacuuagcaugguaccaacaaaaaccaggacaagcaccaagacuauuaauauauggagcaaguacaagagcagcaggaauaccagacagauucucaggaucaggaucaggaacagacuuuacauuaacaauaagcagacuagaaccagaagacucagcaguauacuauugccaacaauauggaagaacaccacuaacauucggaggaggaacaaaaguagaaauaaaaaga

SEQ ID NO: 50590 - RNA, 324 nt, Artificial Sequence
  derived and/or modified sequence opt6 from anti-influenza_Chain
gaaauaguaaugacacaaucaccaggaacauuaucauuaucaccaggagaacgagcaacauuaucauguagagcaucacaaucaguaucaucaucauaucuagcaugguaucaacaaaaaccaggacaagcaccaagacuacuaauauucggagcaucaucaagagcaacaggaauaccagacagauuuucaggaucaggaucaggaacagacuucacacuaacaauaucaagacuagaaccagaagacuucgcaguauauuacugucaacaauacggaucaucacuaacauucggaggaggaacaaaacuagaaauaaaaaga

SEQ ID NO: 50591 - RNA, 324 nt, Artificial Sequence
  derived and/or modified sequence opt6 from anti-influenza_Chain
gaaauaguacuauaucaaucaccaggaacauuaaguuuaagcccaggagaaagagcaacacuaagcuguagagcaagccaaagaguaagcucauacuuagcaugguaccaacaaaaaccaggacaagcaccaagacuauuaauauauggagcaagcacaagagcagcaggaauaccagacagauucucaggaucaggaucaggaacagacuuuacauuaacaauaagcagacuagaaccagaagacucagcaguauacuauugccaacaauauggaagaacaccacuaacauucggaggaggaacaaaaguagaaauaaaaaga

SEQ ID NO: 50592 - RNA, 324 nt, Artificial Sequence
  derived and/or modified sequence opt6 from anti-influenza_Chain
gacauaguacuaacacaagcaccaucaguaucaguaucaccaggacaaacagcaucaauaacaugcucaggagacagacuaggagaaaaauucgcaucaugguaccaacaaaaaccaggacaaucaccaguacuaguaauauacgaagacucaaaaagaccaucaggaauaccagacagauucucaggaucaaacucaggaaacacagcaacacuaacaauaucaggaacacaaauaauggacgaaggagacuucuucugccaagcaugggacucaucaacaguaguauucggaggaggaacaaaacuaacaguacuaggacaa

SEQ ID NO: 50593 - RNA, 324 nt, Artificial Sequence
  derived and/or modified sequence opt6 from anti-influenza_Chain
gauauagaacuaacacaaucaccaucaguaucaguaucgccaggacaaacagcaucaauaacaugcucaggagauaaauuaggagauaaauuuguauguugguaucaacaaaaagcaggacaaagcccaauaguaguaauauaccaagacgauaaaagaccaucaggaauaccagaaagauuuagcggaagcaauagcggaaacacagcaacacuaacaauaucaggaacacaagcaauggaugaagcagacuauuucugucaagcaugggauagcacaacaguaguauuuggaggaggaacaaaauuaacaguacuaggacaa

SEQ ID NO: 50594 - RNA, 324 nt, Artificial Sequence
  derived and/or modified sequence opt6 from anti-influenza_Chain
caaucaguacuaacacaaccaccaucagcaucaggaucaagaggacaaucaauaacaauaucaugcacaggaucaacaucagacauaggaucauacaacuacguaucaugguaccaacaacacccaggaacagcaccaaaaguaauacuauacgaaguaucacaaagaccaucaggaguaccagacagauucucaggaucaaaaucaggaaacacagcauuccuaacaguaagcggacuacaaacagacgacgaagcagacuacuacugcgcaucauacgcaggaaacaacauauacguauucggaucaggaacaaaaguaaca

SEQ ID NO: 50595 - RNA, 327 nt, Artificial Sequence
  derived and/or modified sequence opt6 from anti-influenza_Chain
aacuuuauguuaacacaaccacauagcguaagcgaaagcccaggaaaaacaguaacaauaagcuguacaggaagcggaggaaauauagcaagaaauuacguacaaugguaccaacaaagaccaggaagcgcaccaguaacaguaauauuagaagaugacaaaagaccaagcggaauaccagacagauucagcggaucaauagauagaucaagcaauagcgcaucauuaacaauaagcggacuaagaacagaagacgaagcauuauacuauugccaaagcuaugacgauagcgaucuaguaguauuuggaggaggaacaaaauuaaca

SEQ ID NO: 50596 - RNA, 327 nt, Artificial Sequence
  derived and/or modified sequence opt6 from anti-influenza_Chain
augcuagaaccacuacaaauacuaagcauaugcucauucauacuaucagcauuacacuucauggcauggacaauaggacaccuaaaccaaauaaaaagaggaguaaaccuaaaaauacaaauaagaaacccaaacaaagaagcaauaaacagagaaguaucaauacuaagacacaacuaccaaaaagaaauacaagcaaaagaaacaaugaaaaaaauacuaagcgacaacauggaaguacuaggagaccacauaguaguagaaggacuaagcacagacgaaauaauaaaaaugggagaaacaguacuagaaguagaagaacuacaa

SEQ ID NO: 50597 - RNA, 327 nt, Artificial Sequence
  derived and/or modified sequence opt6 from anti-influenza_Chain
gacauaagacuaacacaaucaccagcaacacuaagcguaucaccaggagaaagagcaacacuaucaugcagagcaucacacucaguaucaagaaaccuagcaugguaccaacaaaaaccaggaagagcaccaagacuacuaguauacgacacaucaucaagagcaacaggaauaccagcaagauucucaggaucaggaucaggaacagaauucacacuaacaauaucaucacuacaaucagaagacuucgcaguauacuacugccaacaauacaacaacuggccaagaacauucggacaaggaacaaaaguagacauaaaaagaaca

SEQ ID NO: 50598 - RNA, 327 nt, Artificial Sequence
  derived and/or modified sequence opt6 from anti-influenza_Chain
gaaauaguaaugacacaaucaccaggaacauuaucauuaagcccaggagaaagagcaacauuaagcuguagagcaagccaaagcguaagcagcagcuaucuagcaugguaucaacaaaaaccaggacaagcaccaagauuacuaauauacggagcaucaacaagagcaacaggaguaccagauagauuucacggaggaggaagcggaacagauuucacacuaacaauaucaagauuagaaccagaagauuucgcaguauauuacugucaacaauacgauacaucaagcgggcuaacauucggaggaggaacaaaaguagaaauaaaa

SEQ ID NO: 50599 - RNA, 327 nt, Artificial Sequence
  derived and/or modified sequence opt6 from anti-influenza_Chain
gaaauaguaaugacacaauucccagcaacacuaucaguaucaccaggagaaagaguaacacuaucaugcagagcaucacaaucaguauccaacaaccuagcaugguaccaacaaaaaccaggacaaccaccaagacuacuaauauacgacgcaucaacaagagcaacaggaguaccagcaaaauucucaggaacaggaucaggaacagaauucacacuaucaauaucaucacuacaaucagaagacuucgcaguauacuacugccaacaauaccacaacuggccaccaucauacucauucggacuaggaacaaaacuagaaauaaaa

SEQ ID NO: 50600 - RNA, 327 nt, Artificial Sequence
  derived and/or modified sequence opt6 from anti-influenza_Chain
gaaauaauacuagcacaaucaccaggaacauuaucauuaagcccaggagaaagagcaacauuaagcuguagagcaagccaauucguaagcacaagaagccuagcaugguaucaacaaagaccaggacaagcaccaagauuacuaauauacggagcaucaagcagagcaacaggaauaccagauagauuuagcggaagcggaagcggaacagauuucacacuaacaauaucaagauuagaaccagaagauuucgcaguauauuacugucaacauuacggauacucaccaagauacgcauucggacaaggaaguaaaguagaaauaaaa

SEQ ID NO: 50601 - RNA, 327 nt, Artificial Sequence
  derived and/or modified sequence opt6 from anti-influenza_Chain
gaaauaguacuaacacaaucaccaggaacauuaucauuaagcccaggagaaagagcaacauuaagcuguagagcaagccauuucguaaacuauagaagccuagcaugguaucaacaaacaccaggacaaguaccaagauuacuaauauacggagcaucaacaagagccacaggcauaccagauagauuuagcggaagcggaagcggaacagauuucacacuaacaauaucaagauuagaaccagaagauuucgcaguauauuucugucaacaauacggaggaucaccaagauacacauucggacaaggaacaagacuagaaauaaaa

SEQ ID NO: 50602 - RNA, 327 nt, Artificial Sequence
  derived and/or modified sequence opt6 from anti-influenza_Chain
gaaauaguacuaacacaaucaccaggaacauuaagcuuaagcccaggagaaagagcaacauuaaguuguagagcaagccauuucguaauaggaagagcaguagcaugguaucaacaaaaaccaggacaagcaccaagauuacuaauauacggagcaucaagcagagcaacaggaauaccagauagauuuagcggaagcggaucaggaacagauuucacauuaacaauaucaagauuagaaacagaagauuucgcaguauuuuacugucaacauuacggaagcucaccaagauacgcauucggacaaggaacaaaacuagaaauaaaa

SEQ ID NO: 50603 - RNA, 327 nt, Artificial Sequence
  derived and/or modified sequence opt6 from anti-influenza_Chain
gaaauaguauuaacacaaucaccagcaacacuaucacuaucaccaggagaaagagcaacacuaucaugcagagcaucacaaucaguaggaaacuaccuagcaugguaccaacaaaaaccaggacaagcaccaagacuacuaauauacgacucaucaaacagagcaccaggaauaccagcaagauucucaggaucaggaucaggaacagacuucacacuaacaauaucaucacuagcaccagaagacuucgcaguauacuacugccaacaaagaucaaaauggccaccaauguacucauucggacacggaacaaaacuagaaauaaaa

SEQ ID NO: 50604 - RNA, 327 nt, Artificial Sequence
  derived and/or modified sequence opt6 from anti-influenza_Chain
caagcaguaguaacacaagaaccaucauuaacaguaucaccaggaggaacaguaacauuaacaugcggaucaucaacaggaccaguaacaucaggacacuauccauauugguuucaacaaaaaccaggacaagcaccaagaacacuaauaucagcaacaucaaacacacacucauggacaccagcaagauuuucaggaucauuacuaggaggaagagcagcacuaacacuaucaggagcacaaccagaagaugaagcagacuauuacuguuucuuaagcuauucaggagcauggguauucggaggaggaacaacauuaacaguacua

SEQ ID NO: 50605 - RNA, 327 nt, Artificial Sequence
  derived and/or modified sequence opt6 from anti-influenza_Chain
gcaauacaaaugacacaaucaccaucaagccuaucagcaucaguaggagacagaguaacaauaacaugcagagcaucacaaaacauaagaucauaccuaaacugguaccaacaaaaaccaggaaaagcaccaaaccuacuaauauacggaacaacaucacuagaaucaggaguaccaucaagauucucaggcucaggaucaggaacagacuucacauuaacaauaucaucacuacaaccagaagacuucgcaacauacuacugccaacaaucauaccacacaccacaaacauucggacaaggaacaaaaguagaaauaaaaagaaca

SEQ ID NO: 50606 - RNA, 327 nt, Artificial Sequence
  derived and/or modified sequence opt6 from anti-influenza_Chain
gacauacaaaugacacaaucaccaucaucacuaucagcaucaguaggagacagaauaacaauaacaugcagagcaagccaaggaauagacaacuaccuagcaugguuccaacaaaaaccaggaaaaguaccagaacuauuaauauacgcagcaucaacacuacaaucaggaguaccaucaagauucucaggaucaggaucaggaacaggauucacacuaacaauaucaucacuacaaccagaagacguagcaacauacuacugccaaaaauacgacucagcaccacuaacauucggaggaggaacaaaaguagacauaaaaagaaca

SEQ ID NO: 50607 - RNA, 327 nt, Artificial Sequence
  derived and/or modified sequence opt6 from anti-influenza_Chain
gacauacaacuaacacaaucaccaucaucacuaucagcaucaguaggagaccgaguaacaauaacaugcagagcaucacaaggaauaacagacuaccuagcaugguaccaacaaaaaccaggaacaauaccaaaacuacuaauauacgcagcaucaacacuacaaucaggaguaccaucaagauucucaggaggaggauacggaacagacuucacacuaacaauaucaucauuacaaccagaagacguagcaacauacuacugccaaaaauacaacucagcaccacuaacauucggaggaggaacaaaaguagaaauaaaaagaaca

SEQ ID NO: 50608 - RNA, 327 nt, Artificial Sequence
  derived and/or modified sequence opt6 from anti-influenza_Chain
gauauaguaaugacacaaucaccauuuagcuuaucauuaagcccaggagaaagagcaacauuaagcuguagagcaagccaaagcauaagcaauuacuuagcaugguaccaacaaaaaccaggacaagcaccaagauuauuaauauaugacagcagcaauagagcaacaggaguaccagcaagauucucaggaucaggaucaggaacagacuuuacauuaacaauaagcucacuagaaccagaagacuuugcaguauacuauugccaacaaagaagcaauuggauguacacauucggacaaggaacaaaaguagaaauaaaaagaaca

SEQ ID NO: 50609 - RNA, 327 nt, Artificial Sequence
  derived and/or modified sequence opt6 from anti-influenza_Chain
gacauacaaaugacacaaucaccaucaucauuaucagcaucaguaggagacagaguaacaauaacaugcagagcaucacaaggaauaucaucauaccuagcaugguaccaacaaaaaccaggaaaaguaccaacacuacuaauauacgacgcaucaacacuaagaucaggaguaccaucaagauucucaggaucaggaucagcaacagacuucacacuaacaauaucaucacuacaaccagaagacguagcaacauacuacugccaaagauacaacucagcaccaccaauaacauucggacaaggaacaagacuagaaauaaaaaga

SEQ ID NO: 50610 - RNA, 327 nt, Artificial Sequence
  derived and/or modified sequence opt6 from anti-influenza_Chain
gaaauaguaaugacacaaucaccaggaacacuaucacuaucaccaggagaaagagcaacacuaucaugcagagcaucacaaucaguaucaucaucauacuuagcaugguaccaacaaaaaccaggacaagcaccaagacuauuaauauacgacgcaucaucaagagcaacagacauaccagacagauucucaggaucaggaucaggaacagacuucacacuaacaauaucaagacuagaaccagaagacuucgcaguauacuacugccaacaauacggaucaucacuauggacauucggacaaggaacaaaaguagaaauaaaaaga

SEQ ID NO: 50611 - RNA, 327 nt, Artificial Sequence
  derived and/or modified sequence opt6 from anti-influenza_Chain
ucauauguauuaacacaaccaccaucaguaucaguagcaccaggacaaacagcaagaauaacauguggaggaaauaauauaggaucaaaaucgguacauugguaucaacaaaaaccaggacaagcaccaguauuaguaguauaugaugauucagacagaccaucaggaauaccagaaagauuuaguggaaguaauagugggaauacagcaacauuaacaauaucaagaguagaagcaggagaugaagcagauuauuauugucaaguaugggauaguucaagugaucaugcaguauuuggagggggaacacaauuaacaguauuagga

SEQ ID NO: 50612 - RNA, 327 nt, Artificial Sequence
  derived and/or modified sequence opt6 from anti-influenza_Chain
gaaauaguacuaacacaaucaccaggaacauuaucauuaagcccaggagaaagagcaacauuaagcuguagagcaagccaaagcguaagcagcagcuaucuagcaugguaucaacaaaaaccaggacaagcaccaagauuacuaauauacggagcaucaagcagagcaacaggaauaccagauagauuuagcggaagcggaagcggaacagauuucacacuaacaauaucaagauuagaaccagaagauuucgcaguauauuacugucaacaauacggaagcucaccaagaacauuuggaggaggaacaaaaguagaaauaaaaaga

SEQ ID NO: 50613 - RNA, 327 nt, Artificial Sequence
  derived and/or modified sequence opt6 from anti-influenza_Chain
ucauauguauuaacacaaccaccaucaguaucaguagcaccaggacaaacagcaagaauaacauguggaggaaauaauauaggaucaaaaggaguacauugguaucaacaaaaaccaggacaagcaccaguauuaguaguauaugaugauucagauagaccaucaggaauaccagaaagauuuaguggaaguaauaguggaaauacagcaacauuaacaauaucaagaguagaagcaggagaugaagcagauuauuauugucaaguaugggauaguucaagugaucauguaguauuuggaggaggaacaaaauuaacaguauuagga

SEQ ID NO: 50614 - RNA, 327 nt, Artificial Sequence
  derived and/or modified sequence opt6 from anti-influenza_Chain
gaaauaguacuaacacaaucaccaggaacauuaucauuaagcccaggagaaagagcaacauuaagcuguagagcaagccaaagcguaagcagcaacuaucuaggauggacacaacaaaaaccaggacaagcaccaagauuacuaauauacggagcaucaagcagagcaucaggaauaccagauagauuuaguggaggaggaagcggaacagauuucacacuaacaauaucaagauuagaaccagaagauuucgcaguauauuacugucaacaauacggaagcucaccacuaacauuuggaggaggaacaaaaguagaaauaaaaaga

SEQ ID NO: 50615 - RNA, 327 nt, Artificial Sequence
  derived and/or modified sequence opt6 from anti-influenza_Chain
caaaguguaguaacacaaccaccaucaguaucaguagcaccaggacaaacagcaagaauaacaugcggaggaaauaauauaggaucaaaaucaguacauugguaucaacaaaaaccaggacaagcaccaguauuaguaguauacgaugacucagacagaccaucaggaauaccagaaagauuuaguggaaguaauaguggaaauacagcaacauuaacaauaucaagaguagaagcaggagaugaagcagacuauuacugucaaguaugggauaguucaagugaucauuauguauuuggaacaggaacaaaaguaacaguauuagga

SEQ ID NO: 50616 - RNA, 327 nt, Artificial Sequence
  derived and/or modified sequence opt6 from anti-influenza_Chain
ucauacguauuaacacaaccaccaucagaaucaguagcaccaggacaaacagcaagaauaacauguggaggaaacaauauaggaagaaauucaguacacugguaccaacaaaaaccaggacaagcaccaguauuaguaguauaugacgacucagacagaccaucaggaauaccagaaagauucucaggaucaaaaucaggaaauacagcaacacuaauaauaucaagaguagaaguaggagacgaagcagauuacuauugccaaguauggcacucaucaucagaccauuacguauucggaacaggaacaaaaguaacaguauuagga

SEQ ID NO: 50617 - RNA, 327 nt, Artificial Sequence
  derived and/or modified sequence opt6 from anti-influenza_Chain
gaaauaguaaugacacaaucaccaggaacacuaucacuaucaccaggacaaagagcaacacuaucaugcagagcaucacaaucaguaucaucaucauaccuagcaugguaccaacaaaaaccaggacaagcaccaagacuacuaauguacggagcaucaucaagagcaacaggaauaccagacagauucucaggaucaggaucaggaacagacuucacauuaacaauaucaagacuagaaccagaagacuucgcaguauacuacugccaacaauacggaucaucaucacuaacauucggaggaggaacaaaacuagaaauaaaaaga

SEQ ID NO: 50618 - RNA, 327 nt, Artificial Sequence
  derived and/or modified sequence opt6 from anti-influenza_Chain
caagcaggauuaacacaaccaccaucaguaucaguagcaccaggacaaacagcaagaauaacauguggaggaaacaauauaggaucaaaaucaguacacugguaccaacaaaaaccaggacaagcaccaguauuaguaguauaugacgauucagauagaccaucaggaauaccagaaagauucucaggaucaaacucaggaaauacagcaacacuaacaauaucaagaguagaagcaggagacgaagcagauuacuauugccaaguaugggacucaucaucagaccauguaguauucggaggaggaacaaaacuaacaguauuagga

SEQ ID NO: 50619 - RNA, 327 nt, Artificial Sequence
  derived and/or modified sequence opt6 from anti-influenza_Chain
caaaguguaguaacacaaccaccaucagaaucaguagcaccaggacaaacagcaagaauaacaugcggaggacauaauauaggaucaaauucaguacauugguaucaacaaaaaccaggacaagcaccaguauuaguaguauaugauaauucagacagaccaucaggaauaccagaaagauuuagcggaaguaauaguggaaauacagcaacauuaacaauaucaagaguagaagcaggagaugaagcagacuauuauugucaaguauggggaaguucaagugaucauuauguauuuggaacaggaacaaaaguaacaguauuagga

SEQ ID NO: 50620 - RNA, 327 nt, Artificial Sequence
  derived and/or modified sequence opt6 from anti-influenza_Chain
gaaauaguacuaacacaaucaccaggaacauuaaguuuaagcccaggagaaagagcaacauuaagcuguagagcaagccaaagcguaagcucaaacuaucuaggaugguaucaacaaaaaccaggacaagcaccaagauuacuaauauacggagcaucaagcagagcaucaggaauaccagauagauuuaguggaggaggaagcggaacagauuucacacuaacaauaucaagauuagaaccagaagauuucgcaguauauuacugucaacaauacggaagcucaccauuaacauuuggaggaggaacaaaaguagaaauaaaaaga

SEQ ID NO: 50621 - RNA, 327 nt, Artificial Sequence
  derived and/or modified sequence opt6 from anti-influenza_Chain
gaaauaguacuaacacaaucaccagcaacacuaucaguaagcccaggagaaagagcaacacuaucaugcagagcaucacaaucaguagacucaaacuuagcaugguaccaacaaaaaccaggacaagcaccaagacuacuaguauacucagcaucaacaagagcaacaggaauaccagcaagauucucaggaucaggaucaggaacagaauucacacuagcaauaucaucacuacaaucagaagacuucgcaguauacuacugccaacacuacacaaacuggccaccaagacuaacauucggaggaggaucaaaaguagaaauaaaa

SEQ ID NO: 50622 - RNA, 327 nt, Artificial Sequence
  derived and/or modified sequence opt6 from anti-influenza_Chain
gaaauaguacuaacacaaucaccagcaacacuaucaguaucaccaggagaaagagcaacacuaucaugcagagcaucacaaucaguaucacacaaccuagcaugguaccaacaaaaaccaggacaagcaccaagacuacuaguauacucagcaucaacaagagcaacaggaauaccagcaagauucucaggaucaggaucaggaacagaauucacacuagcaauaucaucacuacaaucagaagacuucgcaguauacuacugccaacacuacacaaacuacccaccaagacuaacauucggaggaggaucaaaaguagaaauaaaa

SEQ ID NO: 50623 - RNA, 327 nt, Artificial Sequence
  derived and/or modified sequence opt6 from anti-influenza_Chain
gaaauaguaaugacacaaucaccagcaacacuaucaguaucaccaggagaaagagcaacacuaucaugcagagcaucacaaucaguagacucaaaccuagcaugguaccaacaaaaaccaggacaagcaccaagauuacuaguauacucagcaucaacaagagcaacaggaauaccagcaagauucucaggaucaggaucaggaacagaauucacauuagcaauaucaucacuacaaucagaagacuucgcaguauacuacugccaacacuacacaaacuggccaccaagacuaacauucggaggaggaucaaaaguagaaauaaaa

SEQ ID NO: 50624 - RNA, 327 nt, Artificial Sequence
  derived and/or modified sequence opt6 from anti-influenza_Chain
gaaauaguacuaacacaaucaccagcaacacuaucaguaucaccaggagaaagagcaacacuaucaugcagagcaucacaaucaguaucaucaaaccuagcaugguaccaacaaaaaccaggacaagcaccaagacuacuaguauacucagcaucaacaagagcaacaggaauaccagcaagauucucaggaucaggaucaggaacagaauucacacuagcaauaucaucacuacaaucagaagacuucgcaguauacuacugccaacacuacacaaacuggccaccaagauuaacauucggaggaggaucaaaaguagaaauaaaa

SEQ ID NO: 50625 - RNA, 327 nt, Artificial Sequence
  derived and/or modified sequence opt6 from anti-influenza_Chain
gaaauaguacuaacacaaucaccagcaacacuaucaguaucaccaggagaaagagcaacacuaucaugcagagcaucacaaucaguagaccacaaccuagcaugguaccaacaaaaaccaggacaagcaccaagacuacuaguauacucagcaucaacaagagcaacaggaauaccagcaagauucucaggaucaggaucaggaacagaauucacacuagcaauaucaucacuacaaucagaagacuucgcaguauacuacugccaacacuacacaaacuggccaccaagacuaacauucggaggaggaucaaaaguagaaauaaaa

SEQ ID NO: 50626 - RNA, 327 nt, Artificial Sequence
  derived and/or modified sequence opt6 from anti-influenza_Chain
gaaauaguacuaacacaaucaccagcaacacuaucaguaucaccaggagaaagagcaacacuaucaugcagagcaucacaaucaguaucacacaaccuagcaugguaucaacaaaaaccaggacaagcaccaagacuacuaguauacucagcaucaacaagagcaacaggaauaccagcaagauucucaggaucaggaucaggaacagaauucacacuagcaauaucaucacuacaaucagaagacuucgcaguauacuacugccaacacuacacaaacuggccaccaagacuaacauucggaggaggaucaaaaguagaaauaaaa

SEQ ID NO: 50627 - RNA, 327 nt, Artificial Sequence
  derived and/or modified sequence opt6 from anti-influenza_Chain
gaaauaguacuaacacaaucaccagcaacacuaucaguaucaccaggagaaagagcaacacuaucaugcagagcaucacaaucaguaucacacaaccuagcaugguaccaacaaaaaccaggacaagcaccaagauuacuaguauacucagcaucaacaagagcaacaggaauaccagcaagauucucaggaucaggaucaggaacagaauucacauuagcaauaucaucacuacaaucagaagacuucgccguauacuacugccaacacuacacaaacuucccaccaagacuaacauucggaggaggaucaaaaguagaaauaaaa

SEQ ID NO: 50628 - RNA, 327 nt, Artificial Sequence
  derived and/or modified sequence opt6 from anti-influenza_Chain
gaaauaguacuaacacaaucaccagcaacauuaucaguaucaccaggagaaagagcaacacuaucaugcagagcaucacaaucaguagacucaaaccuagcaugguaccaacaaaaaccaggacaagcaccaagacuacuaguauacucagcaucaacaagagcaacaggaauaccagcaagauucucaggaucaggaucaggaacagaauucacacuagcaauaucaucacuacaaucagaagacuucgcaguauacuacugccaacacuacacaaacuucccaccaagacuaacauucggaggaggaucaaaaguagaaauaaaa

SEQ ID NO: 50629 - RNA, 327 nt, Artificial Sequence
  derived and/or modified sequence opt6 from anti-influenza_Chain
gaaauaguacuaacacaaucaccagcaacauuaagcguaagcccaggagaaagagcaacauuaagcuguagagcaagccaaagcguagacucaaacuuagcaugguaccaacaaaaaccaggacaagcaccaagauuauuaguauauagcgcaagcacaagagcaacaggaauaccagcaagauucucaggaucaggaucaggaacagaauuuacauuagcaauaagcucauuacaaagcgaagacuuugcaguauacuauugccaacacuauacaaauuacccaccaagacuaacauucggaggaggaagcaaaguagaaauaaaa

SEQ ID NO: 50630 - RNA, 327 nt, Artificial Sequence
  derived and/or modified sequence opt6 from anti-influenza_Chain
gaaacaacacuaacacaaucaccagcaacacuaucaguaagcccaggagaaagagcaacacuaucaugcagagcaucacaaguaauaucacacaaccuagcaugguaccaacaaaaaccaggacaagcaccaagacuacuaauauacggagcaucaacaagagcaucaggaauaccagcaagauucucaggaucaggaucaggaacagacuacacacuaacaauaacaucacuacaaucagaagacuucgcaguauacuacugccaacacuacucaaauuggccaccaagacuaacauucggaggaggaacaaaaguagaaauaaaa

SEQ ID NO: 50631 - RNA, 327 nt, Artificial Sequence
  derived and/or modified sequence opt6 from anti-influenza_Chain
gaaauaguacuaacacaaucaccagcaacacuaucaguaucaccaggagaaagagcaacauuaucaugcagagcaucacaaguaauaucacacaaccuagcaugguaccaacaaaaaccaggacaagcaccaagacuauuaauauacggagcaucaacaagagcaucaggaauaccagcaagauucucaggaucaggaucaggaacagacuacacacuaacaauaacaucauuacaaagcgaagacuucgcaguauacuacugccaacacuacagcaacuggccaccaagacuaacauucggaggaggaacaaaaguagaaauaaaa

SEQ ID NO: 50632 - RNA, 327 nt, Artificial Sequence
  derived and/or modified sequence opt6 from anti-influenza_Chain
gaaauaguauuaacacaaucaccagcaacacuaucaguaucaccaggagaaagagcaacacuaucaugcagagcaagccaaguaauaagccacaaccuagcaugguaccaacaaaaaccaggacaagcaccaagacuacuaauauacggagcaucaacaagagcaucaggaauaccagcaagauucucaggaucaggaucaggaacagacuacacacuaacaauaacaucacuacaaccagaagacuucgcaguauacuacugccaacacuacucaaacuggccaccaagacuaacauucggaggaggaacaaaaguagaaauaaaa

SEQ ID NO: 50633 - RNA, 327 nt, Artificial Sequence
  derived and/or modified sequence opt6 from anti-influenza_Chain
gaaauaguaaugacacaaucaccagcaacacuaucaguaucaccaggagaaagagcaacacuaucaugcagagcaucacaaguaauaucacacaacuuagcaugguaccaacaaaaaccaggacaagcaccaagacuacuaauauacggagcaucaacaagagcaucaggaauaccagcaagauucucaggaucaggaucaggaacagacuacacacuaacaauaacaucacuacaaucagaagacuucgcaguauacuacugccaacacuacucaaacuggccaccaagacuaacauucggaggaggaacaaaaguagaaauaaaa

SEQ ID NO: 50634 - RNA, 327 nt, Artificial Sequence
  derived and/or modified sequence opt6 from anti-influenza_Chain
gaaauaguacuaacacaaucaccagcaacacuaucaguaucaccaggagaaagagcaacauuaucaugcagagcaucacaaguaauaucacacaaccuagcaugguaccaacaaaaaccaggacaagcaccaagacuacuaauauacggagcaucaacaagagcaucaggaauaccagcaagauucucaggaucaggaucaggaacagacuacacacuaacaauaacaucacuacaaucagaagacuucgcaguauacuacugccaacacuacucaaacuucccaccaagacuaacauucggaggaggaacaaaaguagaaauaaaa

SEQ ID NO: 50635 - RNA, 327 nt, Artificial Sequence
  derived and/or modified sequence opt6 from anti-influenza_Chain
gaaauaguacuaacacaaucaccagcaacccuaucaguaucaccaggagaaagagcaacacuaucaugcagagcaucacaaguaauaucacacaaccuagcaugguaccaacaaaaaccaggacaagcaccaagacuacuaauauacggagcaucaacaagagcaucaggaauaccagcaagauucucaggaucaggaucaggaacagacuacacacuaacaauaacaucacuacaaucagaagacuucgcaguauacuacugccaacacuacucaaacuacccaccaagacuaacauucggaggaggaacaaaaguagaaauaaaa

SEQ ID NO: 50636 - RNA, 327 nt, Artificial Sequence
  derived and/or modified sequence opt6 from anti-influenza_Chain
gaaauaguacuaacacaaucaccagcaacacuaucaguaucaccaggagaaagaguaacacuaucaugcagagcaucacaaucaguagcaaacaaccuagcaugguaccaacaaaaaccaggacaaucaccaagacuacuaauauacggagcaucaacacgagacacaggaauaccagcaagauucucaggaucaggaucaggaacagaauucacacuaacaauaucaucacuacaauccgaagacuucgcaguauacuacugccaacaauacaacaacuggccaccaauguacacauucggacaaggaacaaaacuagaaauaaaa

SEQ ID NO: 50637 - RNA, 327 nt, Artificial Sequence
  derived and/or modified sequence opt6 from anti-influenza_Chain
gacauaguaaugacacaaucaccaucaacacuaucagcaucaguaggagacagaguaacaauaacaugcagagcaucacaaucaauaggaaacugguuagcaugguaccaacaaaaaccaggaaaagcaccaaaauuacuaauauacaaaguaucaacacuagaaucaggaguaccaucaagauucucaggaucaggaucaggaacagaauucacacuaacaauaaacucacuacaaccagacgacuucgcaacauacuacugccaaagauacacaucaaacucacaaggauucacauucggacaaggaacaaaacuagaaauaaaa

SEQ ID NO: 50638 - RNA, 327 nt, Artificial Sequence
  derived and/or modified sequence opt6 from anti-influenza_Chain
gacauaguaaugacacaaucaccagcaacacuaucaguaucaccaggagaaagagcaacauuaucaugcagagcaucacaaguaguaggaacaaaccuagcaugguaccaacaaaaaccaggacaagcaccaagacuacuaauauacgcagcaucaacaagagcaacaggaauaccagcaagauucucaggaucaggauuuggaacagacuucacauuaacaauaucaucacuacaaucagaagacuucgcaguauacuacugccaacaauauaacaacuggccacuaucauucggaggaggaacaaaaguagaaauaagaagaaca

SEQ ID NO: 50639 - RNA, 327 nt, Artificial Sequence
  derived and/or modified sequence opt6 from anti-influenza_Chain
gacauacaaaugacacaaucaccaucaucacuaucagcaucaguaggagacagaguaacaauaguaugcagagcaucacaaggaauaaacacccaccuacacugguaccaacaaaaaccaggaaaagcaccaaaacuauuaauauacucagcaucaacacuacacacaggaguaccaucaagacuaucaggaucaggaucaggaacagacuucacacuaucaauaucaucacuacaaccagaagacuucgcaacauacuacugccaacaaucauacaacuacccaagaacauucggacaaggaacaaacgucgacauaaaaagaaca

SEQ ID NO: 50640 - RNA, 327 nt, Artificial Sequence
  derived and/or modified sequence opt6 from anti-influenza_Chain
gacauacuaaugacacaaucaccaucaucacuaucagcaucaguaggagacagaguaacaauaacaugcagagcaucacaagacauaagaaacagauuagcaugguaccaacaaaaaccaggaaaagcaccaaaaagacuaauauacgcagcaucaucacuacaaucaggaguaccaucaagauucucaggaucaggaucaggaacagaauucacacuaacaauaaacucacuacaaccagaagacuucgcaacauacuacugcuuacaacacaacucauacccauggacauucggaccaggaacaaaaguagaaauaaaaagaaca

SEQ ID NO: 50641 - RNA, 327 nt, Artificial Sequence
  derived and/or modified sequence opt6 from anti-influenza_Chain
gacauaguaaugacacaaucaccagcaacacuaucaguaucaccaggagaaggagcaacacuaucaugcagagcaucacaaggaauaggaucaaaccuagcaugguaccaacacaaaccaggacaagcaccaagacuacuaauauacgcagcaucaacaagagcaacaggaguaccagcaagauucucaggaucaggaucaggaacagaauucacacuaacaauaucaucauuacaaucagaagaccuagcaguauacuucugccaacaauacaacacauggccacuaacauucggaggaggaacaaaaguagaaauaauaagaaca

SEQ ID NO: 50642 - RNA, 327 nt, Artificial Sequence
  derived and/or modified sequence opt6 from anti-influenza_Chain
gacauaguaaugacacaaucaccaucaacacuaucagcaucaguaggagacagaguaacaauaacaugcagagcaucacaaacaauauacagauggcuagcaugguaccaacaaaaaccaggaaaagcaccaaaaguacuaauauacaaagcaucaacacuagaaucaggaguaccaucaagauucucaggaucaggaucaggaacagaauucacacuagcaauaucaucacuacaaccagacgacuucgcaacauacuacugccaacaauacaacucauucccauacagauucggacaaggaacaaaaguagaaauaaaaagaaca

SEQ ID NO: 50643 - RNA, 327 nt, Artificial Sequence
  derived and/or modified sequence opt6 from anti-influenza_Chain
gacauaguaaugacacaaucaccaucaucacuaucagcaucaguaggagacagaguaucaauaacaugcagagcaucacaaacaauaacaagauuccuaaacugguaccaacaaaaaccaggaaaaggaccaaaacuacuaauauacgcagcauccacaguacacagaggaguaccaucaagauucucaggaucaggaucaggaacagacuucacacuaacaauaucaucauuacaaccagaagacuucgcaacauacuacugccaacaaucauacucagcaccauucacauucggaccaggaacaacaguagacauaagaagaaca

SEQ ID NO: 50644 - RNA, 327 nt, Artificial Sequence
  derived and/or modified sequence opt6 from anti-influenza_Chain
gacauaguaaugacacaaccaccagcaacacuaucaguaucaccaggagaaagagcaacauuaucaugcggagcaucacaaggacuaggaucaaaccuagcaugguaccaacaaaaaccaggacaagcaccaagacuacuaauauacgcagcaucaacaagagcaacaggaauaacagcaagauucucaggaucaggaucaggaacagaauucacacuaacaauaaacucacuacaaucagaagacuucgcacuauacuacugccaacaauacacauacuggccacuaacauucggaggaggaacaaaaguagaaauaaaaagaaca

SEQ ID NO: 50645 - RNA, 327 nt, Artificial Sequence
  derived and/or modified sequence opt6 from anti-influenza_Chain
gauauaguacuaacacaaucaccagcaacacuaagcguaagcccaggagaaagagcaacauuaagcuguagagcaagccaaaguguaaacagaaacuuagcaugguuccaacaaauaccaggacaagcaccaagacuauuaauauuugacgcaagcacaagagcagcagauauaccagcaagauucucaggaggaggaucaggagcagaauuuacauuaacaguaagcucacuacaaccagaagacuuugcaguauacuauugccaacaauaugacaaauggccaccaggauucggacaaggaacaaaaguagaaauaaaaagaaca

SEQ ID NO: 50646 - RNA, 330 nt, Artificial Sequence
  derived and/or modified sequence opt6 from anti-influenza_Chain
caaucaguauuaacacaaccaccaucagcaucaggagcaccaggacaaagaguaacacuaucaugcucaggaucaggaagcaauauaggaucaaacacaguaucaugguaccaacaauuaccaggaacagcaccaaaacuauuaguauuuacaaauaaccaaagaccaucaggaguaccagacagauucucaggaucaaaaucaggaacaucagcaucacuagcaauaucaggacuacaaucagaagacgaagcagacuacuacugcgcagcaugggacgacucacuaaacggacaacuauucggaggaggaacaaaacuaacaguauua

SEQ ID NO: 50647 - RNA, 330 nt, Artificial Sequence
  derived and/or modified sequence opt6 from anti-influenza_Chain
caaucaguauuaacacaaccaccaucaguaucagcagcaccaggacaaagaguaacaauaucaugcucaggaacaucaucaaacauaggaaaaaacuacguaucaugguaccaacaacuaccaggagcagcaccaaaacuacuaauauacgacaaugacaaaagaccaucaggaauaccagacagauucucaggaucaaaaucaggaacaucagcaacacuaggaauaacaggacuacaaacaggagacgaagcagacuacuacugcggaacaugggacucaucauuaucaguaggaauguucggaggaggaacaagacuaacaguacua

SEQ ID NO: 50648 - RNA, 330 nt, Artificial Sequence
  derived and/or modified sequence opt6 from anti-influenza_Chain
gaaacaacacuaacacaaucaccagcaacauuaagcguaagcccaggagaaagagcaacacuaagcugcagagcaagccaaagcguaagcagaaacuuagcaugguaccaacaaaaaccaggacaagcaccaagacuauuaauauauggagcaagcucaagagcaacaggaauaccagacagauucucaggaucaggaucaggaacagacuuuacauuaacaauaagcagacuagaaccagaagacuuugcaguauacuauugccaacaauauggaucaagcucaauaacauucggacaaggaacaagacuagaaauaaaaagaacagua

SEQ ID NO: 50649 - RNA, 330 nt, Artificial Sequence
  derived and/or modified sequence opt6 from anti-influenza_Chain
caaucaguauuaacacaaccaccaucagcaucaggaacaccaggacaaagaguaacaauaucaugcucaggaucaucaucaaacauaggaucaaacaccguaaacugguacaaacaacuaccaggaacagcaccaagacuacuaauauacucaaacgaccaaagaccaucaggaguaccagacagauucucaggaagcaaaucaggaacaucagcaucacuagcaauaucaggauuacaaucagaagacgaagcaaacuacuacugcgcagcaugggacgacucacuaucaggauggguauucggaggaggaacaaaacuaacaguacua

SEQ ID NO: 50650 - RNA, 330 nt, Artificial Sequence
  derived and/or modified sequence opt6 from anti-influenza_Chain
caaagcgcauuaacacaaccaagaucaguaucaggaucaccaggacaaucaguaacaauaucaugcacaggaucaagcucagacguaggagcaagcaauagcguaagcugguaccaacaacauccaggaaaagcaccaaaauuaguaauauaugacguaacagaaagaccaagcggaguaccacacagauucucaggaucaaaaucaggaaauacagcaagccuaacaguaagcggacuacaaccagaagacgaagcagauuacuuuugcugugcauauggaggaaaauaucuaguaguauuuggaggaggaacaaaaguaacaguacua

SEQ ID NO: 50651 - RNA, 330 nt, Artificial Sequence
  derived and/or modified sequence opt6 from anti-influenza_Chain
caaucagcacuaacacaaccagcaucaguaucaggaucaccaggacaaucaauaacaauaucaugcacaggaacaucaucagacguaggaggauacaacuacguaucaugguaccaacaacacccaggaaaagcaccaaaacuacuaauauacgaaguaacaaacuggccaucaggaguaucaaacagauucucaggaucaaaaucaggaaacacagcaucacuaacaauaucaggacuacaagcagaagacgaagcagacuacuacugcucaucauacgcaggaucaucaacauggguauucggaggaggaacaagaguaacaguacua

SEQ ID NO: 50652 - RNA, 330 nt, Artificial Sequence
  derived and/or modified sequence opt6 from anti-influenza_Chain
caaacaguaguaacacaagaacccucacuaacaguaucaccaggaggaacuguaacacuaacaugcgcaucaucaacaggagcaguaacaucaucauauuucccaaacugguuccaacaaaaaccaggacaagcaccaagaccauuaauauacucaacaacaauaagacacucauggacaccagcaagauucuccggaucacuacuaggaggaaaagcagcauuaacauuaucaggaguacaaccagaagacgaagcagacuacuacugccuacuauauucaggaggagacccaguagcauucggaggaggaacaaaauuaacaguacua

SEQ ID NO: 50653 - RNA, 330 nt, Artificial Sequence
  derived and/or modified sequence opt6 from anti-influenza_Chain
caaucaguauuaacacaaucaccaucaguaucagcagcaccaggacaaaaaguaacaauaucaugcucaggaucagacucaaauauaggagacuacuucguaugcugguaccaacacuuaccaggaaaaccaccacaacuauuaauauaugaaaauaacaaaagaccaucaggaauaccagacagauucucaggaucaaaaucaggaacaucagcaacauuaggaauaacaggaauacaaacaggagacgaagcagacuacuacugcgcaacaugggacggaucacuaagcgcauggguauucggaggaggaacaaaacuaacaguacua

SEQ ID NO: 50654 - RNA, 330 nt, Artificial Sequence
  derived and/or modified sequence opt6 from anti-influenza_Chain
caaagcgcacuaacacaaccaagaucaguaucaggaucaccaggacaaucaauaacaauaucaugcacaggaggaagcucagacauaggagcaagcaauagcguaagcugguaccaacaacauccaggaaaagcaccaaaauuaguaauauuugacguaacagaaagaccaagcggaguaccacacagauucucgggaucaaaaucaggaaauacagcaagccuaacaguaagcggacuacaaccagaugacgaagcagauuacuuuugcugugcauauggaggaaaauaucuaguaguauuuggaggaggaacaaaaguaacaguacua

SEQ ID NO: 50655 - RNA, 330 nt, Artificial Sequence
  derived and/or modified sequence opt6 from anti-influenza_Chain
caagcaguaguaacacaagaaccaucauuagcaguaagcccaggaggaacaguaacauuaacauguggaagcucaacaggagcaguaacaagaggacacuauccauauugguuucaacaaaaaccaggacaagcaccaagagcacuaauauacgauagcgcaggaaauagacauaguuggacaccagcaagauucaguggaucacuauuaggaggaaaagcagcauuaacauuaagcggagcacaaccagaagacgaagcagaauacuauugcuuauuaucauacucaggaguauggguauucggaggaggaacaaaacuaacaguauua

SEQ ID NO: 50656 - RNA, 330 nt, Artificial Sequence
  derived and/or modified sequence opt6 from anti-influenza_Chain
gaaauaguaaugacacaaucaccagcaacacuaucaguaucaccaggagaaagaguaacccuaucaugcagagcaucacaaucaauaacagacggacuagcaugguaccaacaaaaaagcggacaagcaccaagacuacuaauauacggagcaucaacaagagcaacaggaauaccagcaagauucucaggaucaggaucaggaacagaauucacacuaacaauaucaucacuacaaucagaagacuucgcaguauacuacugccaacaauacaacaacuggccaccaguaacauucggacaaggaacaaaaguagaaauaaaaagaaca

SEQ ID NO: 50657 - RNA, 330 nt, Artificial Sequence
  derived and/or modified sequence opt6 from anti-influenza_Chain
ucaucagaauuaacacaaccaccaucagcaucaggaacaccaggacaaagaguaacaauaucauguucaggaucaacaucaaauauaggauacaauccaguaagcugguaccaacaaguaccaggaacagcaccaaaacuauuaauauauucaaauacagaaagaccaucaggaguaccagacagauucucaggaucaaaaucaggaacaucagcaucauuagccauaucaggacuacaaucagaagacgaagcagacuacuauugcgcagcaugggacgacacacuaaacggaccaguauucggaggaggaacaaaaguaacaguauua

SEQ ID NO: 50658 - RNA, 330 nt, Artificial Sequence
  derived and/or modified sequence opt6 from anti-influenza_Chain
caaucagcacuaacacaaccagcaucaguaucaggaucaccaggacaaucaauaacaauaucaugcacaggaacaucaucagacguaggaggauacaacuacguaucaugguaccaacaacacccaggagaagcaccaaaacuaaugauaucagacguaucaaacagaccaucaggaguaucaaacagauucucaggaucaaaaucaggaaacacagcaucacuaacaauaucaggacuacaagcagaagacgaagcagacuacuacugcacaucauacacaucaucaaacacacuaguauucggaggaggaacaaaacuaacaguacua

SEQ ID NO: 50659 - RNA, 330 nt, Artificial Sequence
  derived and/or modified sequence opt6 from anti-influenza_Chain
caaucaguauuaacacaaccaccaucaguaucagcagcaccaggacaaaaaguaacaauaucaugcucaggaucaagcucaaacauaggacacaacuucguaucaugguaccaacaacuaccagcaacagcaccaaaacuacuaauauacgacacagacaaaagaccaucaggaauaccagacagauucucaggaucaaaaucaggaacaucagcaacacuaggaauaacaggacuacaaacaggagacgaagcagacuacuacugcggaacaugggacucaucacuaucaucaguaauauucggaggaggaacaaaacuaacaguacua

SEQ ID NO: 50660 - RNA, 330 nt, Artificial Sequence
  derived and/or modified sequence opt6 from anti-influenza_Chain
gacauacaaaugacacaaucaccaucaacacuaucagcaucaguaggagacagaguaacaauaacaugcagagcaucacaaacaauaaacaacuaccuagcaugguaccaacaaaaaccaggaaaagcaccaaaacuacuaauauacaaagcaucaucacuagaaucaggaguaccaucaagauucucaggaucaggaucaggaacagaauucacacuaacaauaucaucacuacaaccagacgacuucgcaacauacuacugccaagaauacaacaacgacucaccacuaacauucggaggaggaacaaaaguagaaauaaaaagaaca

SEQ ID NO: 50661 - RNA, 330 nt, Artificial Sequence
  derived and/or modified sequence opt6 from anti-influenza_Chain
gauauagaauuaacacaagauccaucaguaucaguagcaccaggacaaacagcaagaauaccaugcguaagauuuaacaugggaccaacaucaguacauugguaucaacaaaaaccaggacaagcaccaguauuaguaguauaugaugacucagacagaccaucaggaauaccagaaagauuuaguggaaguaauagcggagacucagcaacacuaacaauaucaagaguagaagcaggagaugaagcagacuauuacugucaaguaugggauaugucaagcgauagaagaguauuuggaggaggaacaacauuaacaguacuaggacaa

SEQ ID NO: 50662 - RNA, 330 nt, Artificial Sequence
  derived and/or modified sequence opt6 from anti-influenza_Chain
gacauaguaaugacacaaucaccaggaacauuaucauuaucaccaggagaaagagcaacauuauacugcagagcaucacaaucaguaagaucaggauaucuagcaugguaucaacauaaaccaggacaagcaccacuauuacuauuuuacgacgcaucaggaagagcaacaggaauaccagacagauuuucaggaucaggaucaggaacagacuucacacuaacaauaucaagauuagaaccagaagacuucgcaguauauuacugucuacaauacggaucaucaccaagaacauucggacaaggaacaaaaguagaaauaaaaagaaca

SEQ ID NO: 50663 - RNA, 330 nt, Artificial Sequence
  derived and/or modified sequence opt6 from anti-influenza_Chain
gacauaguacuaacacaaucaccaucauuccuaucagcaucaguaggagacagaguaacaauaacaugcagagcaucacaacuaauaucaucauacuucgcaugguaccaacaaaaaccaggaaaaccaccaaaacuacuaauauacgcagcauccacacuacaaucaggaguaccaucaagauucucaggaucaggaucaggaacacaauucucacuaacaauauccucacuacaaccagaagacuucgcaacauacuacugccaacaacuaaacucauacccaccaauaacauucggacaaggaacaagacuagaaauaaaaagaaca

SEQ ID NO: 50664 - RNA, 330 nt, Artificial Sequence
  derived and/or modified sequence opt6 from anti-influenza_Chain
gauauaacacuaacacaaucaccagcaacacuaagcguaagcccaggagaaagagcaacauuaagcuguagagcaagccaaagcguaagcucaaacuuagcaugguaccaacaaaaaccaggacaagcaccaagacuauuaauauauggagcaagcaauagagcaacagauauaccagcaagauucucaggaucaggaucaggaacagaauuuacauuaacaauaagcucacuacaaagcgaagacuuugcaguauacuauugccaacaauuuaacgauuggccauucuuaacauuuggaggaggaacaaaaguagaaauaaaaagaaca

SEQ ID NO: 50665 - RNA, 330 nt, Artificial Sequence
  derived and/or modified sequence opt6 from anti-influenza_Chain
gacauaguaaugacacaaucaccaucauuccuaucagcaucaguaggagacagaguaacaauaacaugcagaacaucacaaguaauaucaucauaccuagcaugguaccaacaaagaccaggaaaagcaccaaaacuacuaauauacgcagcaucaacacuacaaucaggaguaccaucaagauucucaggaucaggaucaggaacaagauucucacuaacaauaucaaaccuacaaccagaagacuucgcaacauacuucugccaacaacuaacaacauacccaccaauaacauucggacaaggaacaagacuagaaauaaaaagaaca

SEQ ID NO: 50666 - RNA, 330 nt, Artificial Sequence
  derived and/or modified sequence opt6 from anti-influenza_Chain
gauauaguauuaacacaaaguccaaguguaaguguagcaccaggacaaacagcaagaauaacauguggaggaaaugauauaggaaguaaaaguguacauugguaucaacaaaaaccaggacaagcaccaguauuaguaguauuugaugauagagauagaccaaguggaauaccagaaagauuuaguggaaguaauaguggaaauacagcaacauuaacaauaaguagaguagaagcaggagaugaagcagauuauuauugucaaguaugggauauaacaagugauuuaguaguauuuggaggaggaacaaaacuaacaguaguaggacaa

SEQ ID NO: 50667 - RNA, 330 nt, Artificial Sequence
  derived and/or modified sequence opt6 from anti-influenza_Chain
gacauaguaaugacacaaccaccaggaacauuaucaguaucaccaggagaaagagcaacacuaucaugcagagcaucacaaucaguaucaacaaaccuagcaugguaccaacaaaaaccaggacaagcaccaagacuacuaauacacggagcaucaacaagagcaacaggaauaccagcaagauucucaggaucaggcucaggagcagaauucacacuaacaauaucaucacuacaaucagaagacguagcaguauacuacugccaacaauacgacaacuggcuaccaauaacauucggaccaggaacaaaaguagacauacaaagaaca

SEQ ID NO: 50668 - RNA, 330 nt, Artificial Sequence
  derived and/or modified sequence opt6 from anti-influenza_Chain
gauccaaugcuaacacaaacagcaucaccaguaagcgcagcaguaggaggaacaguaacaauaaacugucaagcaagccaaagcguauacaauaaaaauaacuuagcaugguaccaacaaaaacuaggacaaccaccaaaacuauuaauauaugcagcaagcacacuaacaagcggaguaccaagcagauucaaaggaucaggaucaggaacacaauuuacauuaacaauaagcgaucuagaaugcgaugacgcagcaacauacuauugcgcaggagauuacucaggaggaauauaugcauuuggaggaggaacaaaaguagaaauaaaa

SEQ ID NO: 50669 - RNA, 330 nt, Artificial Sequence
  derived and/or modified sequence opt6 from anti-influenza_Chain
gaauuaguaaugacacaaacaccagcaagcguaagcgcagccguaggaggaacaguaacaauaagcugucaaucaagcgaaagcguauacaaaaacaauaaccuagcaugguuccaacaaaaacuaggacaaccaccaaaacuauuaauauaugacgcaagcaaacuagcaagcggaguaccaagcagauucucaggaucaggaucaggaacacaauuuacauuaacaauaagcgaucuagaaugcgaugacgcagcaacauacuauugcgcaggagauuacucaggaucaaacuaugcauuuggaggaggaacaaaauuagaaauaaaa

SEQ ID NO: 50670 - RNA, 330 nt, Artificial Sequence
  derived and/or modified sequence opt6 from anti-influenza_Chain
gaaccaaugcuaacacaaacagcaucaagcguaagcgcagcaguaggaggaagcguaacaauaagcugucaaucaagucaaaguguagacucaaacaaucaauuaagcugguaccaacaaaaaccaggacaaccaccaaaacuauuaauauaugcagcaagcacacuaacaucaggaguaccaagcagauucaaaggaucaggaucaggaacacaauuuacauuaacaauaagcgaucuagaaugcgaugacgcagcaacauacuauugcgcaggagauuacucaggaggaauauaugcauuuggagggggaacagaaguaguaguaaaa

SEQ ID NO: 50671 - RNA, 330 nt, Artificial Sequence
  derived and/or modified sequence opt6 from anti-influenza_Chain
gauccaaugcuaacacaaacagcagcaagcguaagcgcagcaguaggaggaacaguaacaauaaguugucaaucaagcgaaagcguauacaaaaacaauaacuuagcaugguuccaacaaaaacuaggacaaccaccaacacuauuaauaugggacgcaaguaaacuagcaagcggaguaccaaguagauucucaggaucaggaucaggaacacaauuuacacuaacaauaagcgaucuagaaugcgaugacgcagcaacauacuauugcgcaggagauuacucaggaguaaacuaugcauuuggaggaggaacagaaguaguaguaaaa

SEQ ID NO: 50672 - RNA, 330 nt, Artificial Sequence
  derived and/or modified sequence opt6 from anti-influenza_Chain
gaauuaguaaugacacaaacaccagcaagcguaagcgcagcaguaggaggaacaguaacaauaagcugucaaucaagcgaaaguguauacaaaaacaauaaccuagcaugguuccaacaaaaacuaggacaaccaccaaaacuauuaauauaugacgcaagcaaacuagcaagcggaguaccaaguagauucucaggaucaggaucaggaacacaauuuacauuaacaauaagcgaucuagaaugcgaugacgcagcaacauacuauugugcaggagauuacucaggaucaaacuaugcauuuggaggaggaacagaaguaguaguaaaa

SEQ ID NO: 50673 - RNA, 330 nt, Artificial Sequence
  derived and/or modified sequence opt6 from anti-influenza_Chain
gacccaaugcuaacacaaacagcaucaucaguaucagcaacaguaggaggaacaguaacaauaucaugccaaucaucacaaucaguagacaacaacaaagaccuagcaugguuccaacaaaaaccaggacacucaccaaaacuacuaauauacuucgcaucaagacuagcaucaggaguaccaaguagauucaaaggaucaggaucaggaacacacuucacacuaacaauaucagaccuagaaugcgacgacgcagcaacauacuacugcgcaggagacuacucaggagcaaacuacgcauucggaggaggaacaaaacuagaaauaaaa

SEQ ID NO: 50674 - RNA, 330 nt, Artificial Sequence
  derived and/or modified sequence opt6 from anti-influenza_Chain
gauccaaugcuaacacaaacagcaucaccaguaagcgcagcaguaggaggaacaguaacaauaaacugucaaucaucacaaaguguauacaauaacaauagauuaagcugguuccaacaaaaaccaggacaaccaccaaaacuauuaauauauagcgcaagcacacuagcaagcggaguaucaagcagauucaaaggaucaggaucaggaacacaauuuacauuaacaauaagcgaucuagaaugcgaugacgcagcaacauacuauugcgcaggagauuacucaggaggaauauaugcauuuggaggaggaacagaauuagaaauacua

SEQ ID NO: 50675 - RNA, 330 nt, Artificial Sequence
  derived and/or modified sequence opt6 from anti-influenza_Chain
gaauuaguacuaacacaaacaccagcaagcguaagcgcagcaguaggaggaacaguaagcauaagcugucaaucaagccaaagcguauacaaaaacaauaaccuagcaugguuccaacaaaaacuaggacaaccaccaacacuauuaauaugggacgcaagcaaacuagcaaguggaguaccaagcagauucucaggaucaggaucaggaacacaauuuacauuaacaauaagcgaucuagaaugcgaugacgcagcaacauacuauugcgcaggagauuacucaggaguaaacuaugcauuuggaggaggaacaaaauuagaaauaaaa

SEQ ID NO: 50676 - RNA, 330 nt, Artificial Sequence
  derived and/or modified sequence opt6 from anti-influenza_Chain
gaacuagaucuaacacaaacaccagcaagcguaagcgcagcaguaggaggaacaguaacaauaaguugucaaucaagcgaaagcguauacaaaaacaauaacuuagcaugguuccaacaaaaacuaggacaaccaccaacacuauuaauaugggacgcaaguaaacuagcaagcggaguaccaagcagauucucaggaucaggaucaggaacacaauuuacauuaacaauaagcgaucuagaaugcgaugacgcagcaacauacuauugcgcaggagauuacucaggaguaaacuaugcauuuggaggaggaacagaaguaguaguaaaa

SEQ ID NO: 50677 - RNA, 330 nt, Artificial Sequence
  derived and/or modified sequence opt6 from anti-influenza_Chain
gauauacaaaugacacaaucaccaagcucauuaagcgcaagcguaggagauagaguaacaauaacaugucaaucaagcgaaagcguauacaaaaacaauaacuuagcaugguaccaacaaaaaccaggaaaaccaccaaaacuauuaauaugggacgcaagcaaauuagcaagcggaguaccaagcagauucucaggaucaggaucaggaacagacuuuacauuaacaauaagcucacuacaaccagaagacguagcaacauacuauugcgcaggagauuacucaggaguaaacuaugcauuuggaggaggaacagaaguaguaguaaaa

SEQ ID NO: 50678 - RNA, 333 nt, Artificial Sequence
  derived and/or modified sequence opt6 from anti-influenza_Chain
gacauaguaaugacacaaucaccagacucacuagcaguaucacuaggagaaagagcaacaauaaacugcaaaucaucacaaucaguaacauucaacaacaaaaacuacuuagcaugguaccaacaaaaaccaggacaaccaccaaaacuacuaauauacugggcaucaacaagagaaucaggaguaccagacagauucucaggaucaggaucaggaacagacuucacauuaacaauaagcucacuacaagcagaagacguagcaguauacuacugccaacaacacuacagaacaccaccaacauucggacaaggaacaaaaguagaaauaaaa

SEQ ID NO: 50679 - RNA, 333 nt, Artificial Sequence
  derived and/or modified sequence opt6 from anti-influenza_Chain
caaucagcauuaacacaaccagcaucaguaucaggaucaccaggacaaucaauaacaauaucaugcacaggaacaggaucagacguaggaucaagcaaccuaguaagcugguaccaacaacacccagcaaaagcaccaaaacuaauaauauacgaaguaacaaaaagaccaucaggaguaucaaacagauucucaggaucaaaaucaggaaacacagcaucacuaacaauaucaggacuacaagcagaagacgaagcagacuacuacugcugcucauacgcaggaucaucaucaucaagaguauucggaacaggaacaaaaguaacaguacua

SEQ ID NO: 50680 - RNA, 333 nt, Artificial Sequence
  derived and/or modified sequence opt6 from anti-influenza_Chain
caaucaguauuaacacaaccaccaucagcaucaggaacaccaggacaaagaguaacaauaucauguucaggaucaacaucaaauauaggaucaaaugcaguaaacugguaccaacaauuaccaggaacagcaccaaaacuauuaauauacucaaauaaccaaagaccaucaggaguaccagacagauucucaggaucaaaaucaggaacaucagcaucauuagcaauaucaggacuacaaucagaagacgaagcagauuacuauugcgcagcaugggacgauucauuaagcggaucauggguauuuggaggaggaacaaaauuaacaguacua

SEQ ID NO: 50681 - RNA, 333 nt, Artificial Sequence
  derived and/or modified sequence opt6 from anti-influenza_Chain
gaaacaacacuaacacaaucaccaggaacacuaucacuaucaccaggagaaagagcaacauuaucaugcagaguaagccaaucaguaucaucaaacuaccuagcaugguaccaacaaaaaccaggacaagcaccaagacuacuaauauacggagcaucaucaagagcaacaggaauaccagacagauucucaggaucaggaucaggaacagacuucacacuaacaauaucaagacuagaaccagaagacuucgcaguauacuacugccaacaauacggaacaucaccaagagcauucggacacggaacaaaaguagaaauaaaaagaaccgua

SEQ ID NO: 50682 - RNA, 333 nt, Artificial Sequence
  derived and/or modified sequence opt6 from anti-influenza_Chain
caaucaguauuaacacaaccaccaagcguaagcggagcaccaggacaaagaguaacaauaagcuguggaggaagcagaagcaauauaggagcaggauacgauguacauugguaucaacaauucccaggaacagcaccaaaaguaguaauauacggaaacaauaacagaccaucaggaguaccagauagauuuagcggaagcaaaagcggaacaucagcaucacuagcaauaacaggauuacaagcagaagaugaagcaaacuauuacugucaaaguuacgauacaaauuuaggaggaucaauauuuggaggaggaacacaaguaacaguauua

SEQ ID NO: 50683 - RNA, 333 nt, Artificial Sequence
  derived and/or modified sequence opt6 from anti-influenza_Chain
aacuuuauguuaacacaaccacauagcguaagcgaaagcccaggaaaaacaguaacaauaagcuguacaggaagcagcggaucaauagcaagcaauuacguacaaugguaccaacaaagaccaggaagcgcaccaacaacaguaauauaugaagauuaccaaagaccaagcggaguaccagacagauucucaggaucaauagauagcucaagcaauagcgcaucauuaacaauaagcggacuaaaaacagaagacgaagcagauuacuauugccaaagcuaugacgauagcgaucacuuaauauuuggaggaggaacaaaauuaacaguacua

SEQ ID NO: 50684 - RNA, 333 nt, Artificial Sequence
  derived and/or modified sequence opt6 from anti-influenza_Chain
caaucaauguuaacacaaccaccaucagcaucaggaacaccaggacaaagaguaacaauaucaugcucaggaucaucaucaaauauaggaucaaacacaguaaacugguucaaacaccuaccaggaacagcaccaaaacuacuaauauacagaaacgaccuaagaccaucaggaguaccagacagauucucaggaucaaaaucaggaacaucagcaucacuagcaauaucaggacuacaaucagaagacgaagcagacuacuacugcgcaacaugggacgacucacuaaacggauucuacguauucggcacaggaacaaaaguaacaguacua

SEQ ID NO: 50685 - RNA, 333 nt, Artificial Sequence
  derived and/or modified sequence opt6 from anti-influenza_Chain
gacauacaacuaacacaaucacccucaucacuaucagcaucagcaggagacagaguaucaaugacaugcagagcaucacaaauaauaucaucaucacuaaacugguaccaacaaaaaccaggaaaagcaccaaaacuacuaauauacgccgcaucaaaccuacaaucaggaguaccaucaagauucucaggaucaggaucaggaacagacuucacacuaacaauaucaucacuacaaccagaagacuucgcaacauacuacugccaacaaucauacucaacaccaccagaacuaacauucggaggaggaacaaaaguagacauaaaaagaaca

SEQ ID NO: 50686 - RNA, 333 nt, Artificial Sequence
  derived and/or modified sequence opt6 from anti-influenza_Chain
ucauacguauuaacacaaccaccaucagcaucaggaacaccaggacaaagaguaacaauaucauguucaggaucaacauucaauauaggaucaaaugcaguagacugguacagacaauuaccaggaacagcaccaaaacuauuaauauacucaaauaaccaaagaccaucaggaguaccagacagauucucaggaucaagaucaggaacaucagcaucacuagcaauaucaggacuacaaucagaagacgaagcagacuacuauugcgcagcaugggacgacauacuaaacguaccaguauucggaggaggaacaaaacuaacaguauuagga

SEQ ID NO: 50687 - RNA, 333 nt, Artificial Sequence
  derived and/or modified sequence opt6 from anti-influenza_Chain
caaagcgcacuaacacaaccagcagcaguaucaggaucaccaggacaaucaauaacaauaucaugcacaggaacaagcucagacguaggaggauacaauuacguaagcugguaccaacaacauccaggaaaagcaccaaaacuaaugauauaugaaguaagcaauagaccaagcggaguaucaaacagauucucaggaucaaaaucaggaaauacagcaucauuaacaauaagcggacuacaagcagaagacgaagcagauuacuauugcagcagcuauacaucaagcucaacauauguauuuggaacaggaacaaaaguaacaguacuagga

SEQ ID NO: 50688 - RNA, 333 nt, Artificial Sequence
  derived and/or modified sequence opt6 from anti-influenza_Chain
ucauacguacuaacacaaccaccaucaguaucaggaacaccaggacaaagaguaacaauaucauguucaggaucaagaucaaauguaggagauaacucaguauauugguaucaacauguaccagaaauggcaccaaaacuauuaguauacaaaaacacacaaagaccaucaggaguaccagcaagauuuaguggaagcaaaagcggaacaucagcaucacuagcaauaauaggacuacaaucaggagaugaagcagacuauuacuguguagcaugggaugacucaguagauggauauguauuuggaucaggaacaaaaguaacaguacuagga

SEQ ID NO: 50689 - RNA, 333 nt, Artificial Sequence
  derived and/or modified sequence opt6 from anti-influenza_Chain
agcguacuaacacaaccaccaucaguaucagcagcaccaggacaaaaaguaacaauaucaugcucaggaucaucaucaaacauaggaaacgacuacguaucaugguaccaacaacuaccaggaacagcaccaaaacuacuaauauacgacaacaacaaaagaccaucaggaauaccagacagauucucaggaucaaaaucaggaacaucagcaacacuaggaauaacaggacuacaaacaggagacgaagcaaacuacuacugcgcaacaugggacagaagaccaacagcauacguaguauucggaggaggaacaaaacuaacaguauuagga

SEQ ID NO: 50690 - RNA, 333 nt, Artificial Sequence
  derived and/or modified sequence opt6 from anti-influenza_Chain
caaagcgcacuaacacaaccaagaucaguaucaggaucaccaggacaaucaguaacaauaucaugcacaggaacaagcucagacguaggaggauacaauuacguaaguugguaccaacaacauccaggaaaagcaccaaaacuaaugauauaugacguaagcaaaagaccaagcggaguaccagacagauuuucaggaucaaaaucaggaaauacagcaucauuaacaauaagcggacuacaagcagaagacgaagcagauuacuauugcagcagcuauacaucaagcucaacacauguauuuggaacaggaacaaaaguaacaguacuagga

SEQ ID NO: 50691 - RNA, 333 nt, Artificial Sequence
  derived and/or modified sequence opt6 from anti-influenza_Chain
agcuauguauuaacacaaccaccaagcgcaagcggaacaccaggacaaagaguaacaauaagcuguagcggaagcucaucaaauauaggaagcaauuacguauacugguaccaacaauuaccaggaacagcaccaaaacuauuaauauauagagauggacaaagaccaagcggaguaccagacagauucucaggaucaaaaucaggaacaagugcaaguuuagcaauaagcggacuaagaagcgaugacgaagcagauuacuauugcgcaacaugggacgauaacuuaagcggaccaguauucggaggaggaacaaaacuaacaguauuagga

SEQ ID NO: 50692 - RNA, 333 nt, Artificial Sequence
  derived and/or modified sequence opt6 from anti-influenza_Chain
caaagugcacuaacacaaccagcaucuguaucaggaucaccaggacaaucaauaacaauaucaugcacaggaacaagcucagacguaggaggauacaauuacguaagcugguaccaacaacauccaggaaaagcaccaaaacuaaugauauaugaaguaagcaauagaccaagcggaguaucaaacagauucuccggaucaaaaucaggaaauacagcaucauuaacaauaagcggacuacaagcagaagacgaagcagauuacuauugcagcagcuauacaucaagcucaacauuaguauuuggaacaggaacaaaaguaacaguauuagga

SEQ ID NO: 50693 - RNA, 333 nt, Artificial Sequence
  derived and/or modified sequence opt6 from anti-influenza_Chain
acaguacuaacacaaccaccaucaguaucaggagcaccaggacaaagaguaacaauaucaugcacaggaucaucaucaaauauaggagcaggauacgacguacacugguaucaacaacuaccaggaacagcaccaaaauuauuaauauacggaaacucaaacagaccaagcggaguaccagacagauucucaggaucaaaaucaggaacaucagcaacacuaggaauaacaggacuacaaacaggagacgaagcagacuacuacugcggaacaugggacucaucacuaucagcauacguauucggaacaggaacaaaaguaacaguauuagga

SEQ ID NO: 50694 - RNA, 333 nt, Artificial Sequence
  derived and/or modified sequence opt6 from anti-influenza_Chain
ggaagcgcacuaacacaaccaagaucaguaucaggaucaccaggacaaucaguaacaauaucaugcacaggaacaagcucagacguaggaggauacaauuacguaagcugguaccaacaacauccaggaaaagcaccaaaauuaaugauauaugacguaagcaaaagaccaagcggaguaccagacagauucucaggaucaaaaucaggaaauacagcaucauuaacaauaagcggacuacaagcagaagacgaagcagauuacuauugcagcagcuauacaucgagcucaacacauguauuuggaacaggaacaaaaguaacaguacuagga

SEQ ID NO: 50695 - RNA, 333 nt, Artificial Sequence
  derived and/or modified sequence opt6 from anti-influenza_Chain
gaaauaguacuaacacaaagcccaggaacauuaaguuuaagcccaggagaaagagcaacauuaagcuguagagcaagccaaagcguaagcucaagcuaucuagcaugguaucaacaaaaaccaggacaagcaccaagauuacuaauauucggagcaucaacaagagcaacaggaauaccagauagauuuagcggaagcggaagcggaacagauuucacacuaacaauaucacgauuagaaccagaagauuucgcaguauuuuacugucaacaauacggaucauuaccauuaacauuuggaggaggaacaaaaguagaaauaaaaggaacagua

SEQ ID NO: 50696 - RNA, 333 nt, Artificial Sequence
  derived and/or modified sequence opt6 from anti-influenza_Chain
gaaauaguacuaacacaaucaccaggaacauuaucauuaagcccgggagaaagagcaacauuaagcuguagagcaagccaaagcguaagaucaaacaaucuagcaugguaucaacauaaaccaggacaagcaccaagauuacuaauauucggagcaucaagcagagcaacaggaauaccagauagauuuagcggaagcggaaguggaacagauuucacacuaacaauaucaagauuagaaccagaagauuucgcaguauauuacugucaacaauacggaagcucaccagcacuaacauucggaggaggaacaaaaguagaaauaaaaagaaca

SEQ ID NO: 50697 - RNA, 333 nt, Artificial Sequence
  derived and/or modified sequence opt6 from anti-influenza_Chain
caaagccuagaagaaaguggaggaggauuaguaaaaccaggaggaagccuaacacuaacauguacaguaagcggacuaucacuauauagcaaugaaauaaacuggguaagacaagcaccaggaaacggacuagaauggauaggagcaauagcaggaucaggaucagcagauuacgcaagcugggcaaaaggaagaagcacaauaacaagaaauacagaucuaaauacaguaacauuaaaaaugacaucacuaacagcagcagacacagcaacauacuuuugcgcaucauuuugggaucuauggggaccaggaacauuaguaacaguaagcagc

SEQ ID NO: 50698 - RNA, 333 nt, Artificial Sequence
  derived and/or modified sequence opt6 from anti-influenza_Chain
caaagcguagaagaaagcggaggaggauuaguaaaaccaggaggaagccuaacauuaacauguacaguaagcggacuaucacuauauagcaaugaaauaaacuggguaagacaagcaccaggaaacggacuagaauggauaggagcaauagcaggaucaggaucagcagauuacgcaaguugggcaaaaagcagaagcacaauaacaagaaauacaaaucuaaauacaguaacauuaaaaaugacaucacuaacagcagcagacacagcaacauacuuuugcgcaucauuuugggauuuauggggaccaggaacauuagugacaguaagcagc

SEQ ID NO: 50699 - RNA, 333 nt, Artificial Sequence
  derived and/or modified sequence opt6 from anti-influenza_Chain
caaagccuagaagaaagcggaggaggauuaguaaaaccaggaggaagccuaacauuaacauguacaguaagcggacuaucacuauauagcaaugaaauaaacuggguaagacaagcaccaggaaacggacuagaauggauaggagcaauagcaggaucaggaucagcagauuacgcaaguugggcaaaaagcagaagcacaauaacaagaaauacaaaucuaaauacaguaacauuaaaaaugacaucacuaacagcagcagacacagcaacauacuuuugcgcaucauuuugggaucuauggggaccaggaacauuaguaacaguaagcagc

SEQ ID NO: 50700 - RNA, 333 nt, Artificial Sequence
  derived and/or modified sequence opt6 from anti-influenza_Chain
aauauaguauuaacacaaucaccagcaucauuagcaguaucauuaggacaaagagcaacaauaagcuguagagcaagcgaaagcguagacauauacggaaacagcuucaugcacugguaccaacaaaaaccaggacaaccaccaaaauuauuaauauaucuagcaagcaaacuagaaugcggaguaugugcaagauucaauggaagcggauguagaacagacuuuacauuagcaauagacccaguagaaggagaugacggagcaacauacuauugccaacaaaauuacgaagacccauggacauucggaggaggaacaaaacuagaaauaaaa

SEQ ID NO: 50701 - RNA, 333 nt, Artificial Sequence
  derived and/or modified sequence opt6 from anti-influenza_Chain
aauauaguauuaacacaaucaccagcaagccuagcaguaagcccaggacaaagagcaacaauaagcugcagagcaagcgaaagcauagacauauacggaaacucauucaugcacugguaccaaaaaaaaccaggacaaccaccaaaacuauuaauauauagagcaagcaaucuagaaagcggaguaccagcaagauucaauggaucaggaucaagaacagacuuuacauuaacaauagacccaguagaaggagaugacggagcaacauacuacugccaacaaaauuacgaagacccauggacauucggaggaggaacaaaacuagaaauaaaa

SEQ ID NO: 50702 - RNA, 333 nt, Artificial Sequence
  derived and/or modified sequence opt6 from anti-influenza_Chain
gaaauaguacuaacacaaucaccagcaacacuaucacuauacccaggagaaagagcaacacuaagcugcagagcaucacaaucaguaagcagauaccuagcaugguaccaacaaaaaccaggacaagcaccaagacuacuaauauacgacgcaucaaacagagcaacaggaauaccagcaagauucucaggaucaggaucaggaacagacuucacauuaacaauaucaucacuagaaccagaagacuucgcaguauacuacugccaacaaagaagcaacuggcuaaaaauaacauucggacaaggaacacgacuagaaauaaaaggaacagua

SEQ ID NO: 50703 - RNA, 336 nt, Artificial Sequence
  derived and/or modified sequence opt6 from anti-influenza_Chain
gacauaguaaugacacaaucaccagacucacuagcaguaucacuaggagaaagagcaacaauaaacugcaaaucaucacaaucaguacuauacucaucaaacaacaaaaacuacuuagcaugguaccaacaaaaaccaggacaaccaccaaaacuacuaauagacugggcaucaacaagagaaucaggaguaccagacagauucucaggaucaggaucaggaacagacuucacacuaacaauaucaaaccuacaaguagaagacguagcaguauacuacugccaacaauacuacagaucaccaucauucggacaaggaacaaaacuagaaauaaaa

SEQ ID NO: 50704 - RNA, 336 nt, Artificial Sequence
  derived and/or modified sequence opt6 from anti-influenza_Chain
gacauaguaaugacacaaacaccacuaucauuaucaguaacaccaggacaaccagcaucaauaucaugcaaaucaucacaaucacuacuacacucagacggaaaaacauaccuauacugguaccuacaaaaaccaggacaaucaccacaacuacuaauauacgaaguaucaaacagauucucaggaguaccagacagauucucaggaucaggaucaggaacagacuucacacuaaaaauaucaagaguagaagcagaagacguaggaguauacuacugcaugcaaaacauacuacuaccauuaacauucggaggaggaacaaaaguagaaauaaaa

SEQ ID NO: 50705 - RNA, 336 nt, Artificial Sequence
  derived and/or modified sequence opt6 from anti-influenza_Chain
gaaauaguaaugacacaaacaccacuaucacuaucaguaacaccaggacaaccagcaucaauaucaugcagaucaucacaaucacuacuacacucagacggaaaaacauacuuauacugguaccuacaaaaaccaggacaaccaccacaauuacuaauaucagaaguauucaacagauucucaggaguaccagacagauucucaggaucaggaucaggaacagacuucacacuaaaaauaucaagaguagaagcagaagacguaggaguauacuacugcaugcaaucacuacaacuaccacuaacauucggaggaggaacaaaaguagaaauaaaa

SEQ ID NO: 50706 - RNA, 336 nt, Artificial Sequence
  derived and/or modified sequence opt6 from anti-influenza_Chain
gacauaguaaugacacaaucaccauuaucauuaccaguaacaccaggagaaccagcaucaauaucauguagagcaucacaaucauuacuacauucaaauggauauaacuauuuagacugguaucuacaaaaaccaggacaaucaccacaauuacuaauacaauuaggaucaacaagagcaucaggaguaccagacagauuuucaggaucaggaucaggaacagauuucacacuagaaauaucaagaguagaagcagaagauguaggaguauauuacuguaugcaagcauuacaauuaccauuagcauuuggacaaggaacaagauuagaaauaaaa

SEQ ID NO: 50707 - RNA, 336 nt, Artificial Sequence
  derived and/or modified sequence opt6 from anti-influenza_Chain
gacauaguaaugacacaaucaccauuaucauuaccaguaucaccaggagaaccagcaucaauaucauguagaucaucacaaucauuacuacacggcaauggauauaacuaucuagauugguaucuacaaaaaccaggacaaucaccaagauuacuaauauacuuaggaucaaacagagcaucaggaguaccagaucgauuuucaggaucagguucaggaacagauuucacacuaaaaauaucaagaguagaagcagaagauguaggaguauauuacuguaugcaagcacuacaaacaccauuaacauuuggaggaggaacaaaaguagaaauaaaa

SEQ ID NO: 50708 - RNA, 336 nt, Artificial Sequence
  derived and/or modified sequence opt6 from anti-influenza_Chain
caaucaguacuaacacaaccaccaucaguaucaggagcaccaggacaaagaguaacaauaucaugcacaggaucaucaucaaacauaggagcaggauacgacguacacugguaccaacaacuaccaggaacagcaccaaaacuacuaauauacgacaacaauaacagaccaucaggaguaccagacagauucucaggaucaaaaucaggagcaucagcaucacuagcaauaacaggacuacaagcagaagacgaagcacacuacuacugccaaucauacgacaacucacuaucaggaucaguauucggaggaggaacacaacuaacaguacuauca

SEQ ID NO: 50709 - RNA, 336 nt, Artificial Sequence
  derived and/or modified sequence opt6 from anti-influenza_Chain
caaucaguacuaacacaaccaccauccguaucaggagcaccaggacaaagaguaacaauaucaugcacaggaucaucaucaaacauaggaucagacuacgacguacacugguacaaacaacuaccaggaacagcaccaaaacuacuaauauucggaaacucaaacagaccaucaggaguaccagacagauucucaggaucaaaaucaggaacaucagcaucauuagcaauaacaggacuacaagcagaagacgaagcagacuacuacugccaaucauacgacucaucacuaucaggauuccacguauucggaucaggaacaaaaguaacaguacua

SEQ ID NO: 50710 - RNA, 336 nt, Artificial Sequence
  derived and/or modified sequence opt6 from anti-influenza_Chain
caaucaguacuaacacaaccaccaucaguaucagcagcaccaggacaaaaaguaacaauaucaugcucaggaucaucaucaaacauaggaaacgacuacguaucaugguaccaacaacuaccaggaacagcaccaaaacuauuaauauacgacaacaacaaaagaccaucaggaauaccagacagauucucaggaucaaaaucaggaacaucagcaacauuaggaauaacaggauuacaaacaggagacgaagcaaacuacuacugcgcaacaugggacagaagaccaacagcauacguaguauucggaggaggaacaaaauuaacaguacuagga

SEQ ID NO: 50711 - RNA, 336 nt, Artificial Sequence
  derived and/or modified sequence opt6 from anti-influenza_Chain
gaaauaguacuaacacaaucaccaggaacacuaucacuaucaccaggagaaagagcaacacuaucaugcagagcaucacaaucaguaucaucaucauaccuagcaugguaccaacaaaaaccaggacaagcaccaagauuacuaauauacggagcaucaacaagagcaacaggaauaccagacagauucucaggacgaggauccggaacagacuucacacuaacaauaucaucacuagaaccagaagacuucgcaguauacuacugccaaaacuacggaucaccauuccuauucacauucggaccaggaacaaaaguagacauaaaaagaacagua

SEQ ID NO: 50712 - RNA, 336 nt, Artificial Sequence
  derived and/or modified sequence opt6 from anti-influenza_Chain
gacauacaacuaacacaaucaccauuaucaccaccaguaacacuaggacaaccagcaucaauaucaugcagaucaucacaaucauuauuauacacagacggauucacauaccuaucaugguaccaccaaagaccaggacaaucaccaagaagacuaauauacaaaauaucaaacagagacucaggaguaccagacagauucucaggaucaggaucaggaacagacuucacacuaaaaauaucaagaguagaagcagaagacguaggaguauacuacugcaugcaagcaacacacuggccacuaacauucggagaaggaacaaaaguagaaauaaaa

SEQ ID NO: 50713 - RNA, 336 nt, Artificial Sequence
  derived and/or modified sequence opt6 from anti-influenza_Chain
gacauagaauuaacacaagaaccaagcgcaagcggaacaccaggacaaagaguaacaauaagcuguagcggagacacaagcaauauaggaagcaauacaguaagcugguuccaacuauuaccaggaacagcaccaaaauuauuaauauuuacagauaaccaaagaccaagcggaguaccaggaagauucagcggaucaaaaucaggaacaagcgcaucauuagcaauaagcggacuacaaagcgaagacgaaacagauuacuacugcgcagcaugggacgauagcuuaaacggauggguauucggaggaggaacaaaacuaacaguauuaggacaa

SEQ ID NO: 50714 - RNA, 336 nt, Artificial Sequence
  derived and/or modified sequence opt6 from anti-influenza_Chain
gauauaguacuaacacaaagcccaucagcaucaggaucaccaggacaaucaguaacaauaucaugcacaggaacaagcucagacguaggaggauacgauuacgugagcugguaccaacaacauccaggaaaagcaccaaaacuaaugauauaugaaguaagaaaaagaccaagcggaguaccagacagauucucaggaucaaaaucaggaaauacagcaucauuaacaguaagcggacuacaagcagaagacgaagcauauuacuauugcgcaagcuaugcaggaacauauauacaucuauuuggaggaggaacaaaauuaacaguacuaggacaa

SEQ ID NO: 50715 - RNA, 336 nt, Artificial Sequence
  derived and/or modified sequence opt6 from anti-influenza_Chain
caagaacaacuaauggaaagcggaggaggauuaguaaaaccaggaggaagccuaacauuaacauguacaguaagcggacuaucacuauauagcaaugaaauaaacuggguaagacaagcaccaggaaacggacuagaauggauaggagcaauagcaggaucaggaucagcagauuacgcaaguugggcaaaaagcagaagcacaauaacaagaaauacaaaucuaaauacaguaacauuaaaaaugacaucacuaacagcagcagacacagcaacauacuuuugcgcaaguuuuugggaucuauggggaccaggaacauuaguaacaguaagcuca

SEQ ID NO: 50716 - RNA, 336 nt, Artificial Sequence
  derived and/or modified sequence opt6 from anti-influenza_Chain
caacaacaacuaauggaaagcggaggaggauuaguaaaaccaggaggaagccuaacauuaacauguacaguaagcggacuaucauuauauagcaaugaaauaaacuggguaagacaagcaccaggaaacggacuagaauggauaggagcaauagcaggaucaggaucagcagauuacgcaagcugggcaaaaagcagaagcacaauaacaagaaauacagaucuaaauacaguaacauuaaaaaugacaucacuaacagcagcagacacagcaacauacuuuugcgcaucauuuugggaucuauggggaccaggaacauuaguaacaguaagcagc

SEQ ID NO: 50717 - RNA, 336 nt, Artificial Sequence
  derived and/or modified sequence opt6 from anti-influenza_Chain
caacaacaauuaguagaaagcggaggaggccuaguaaaaccaggaggaagccuaacauuaacauguagaguaagcggacuaucacuauuuagcaaugaaauaaacuggguaagacaagcaccaggaaacggacuagaauggauaggagcaauaggaggaggaggaucggcagauuacgcaagcugggcaaaaagcagaaguacaauaacaagaaauacaaaucuaaauacaguaacauuaagaaugacaucacuaacagcagcagacacagcagcauacuuuugcgcaucauuuugggauuuauggggaccaggaacauuaguaacaguaagcagc

SEQ ID NO: 50718 - RNA, 336 nt, Artificial Sequence
  derived and/or modified sequence opt6 from anti-influenza_Chain
gaaguacaauuaguagaaaguggaggaggauuaguaaaaccaggaggaaguuuaagauuaaguugugcagcaaguggauuaucauuauuuaguaaugaaauaaauuggguaagacaagcaccaggaaaaggauuagaauggauaggagcaauaggaggaggaggaucagcagauuaugcaaguugggcaaaaaguagauuuacaauaucaagagauaaugcaaaaaauaguuuauauuuacaaaugaauucauuaagagcagaagauacagcaguauauuuuugugcaaguuuuugggauuuauggggaccaggaacauuaguaacaguaaguuca

SEQ ID NO: 50719 - RNA, 336 nt, Artificial Sequence
  derived and/or modified sequence opt6 from anti-influenza_Chain
gacauaguaaugacacaaucaccacuaucacuaccaguaacaccaggagaaccagcaucaauaucaugcagaucaucacaaucacuacuaagaucaaacggauacaacuaccuagacugguaccuacaaaaaccaggacaaucaccacaacuacuaauauaccuaggaucaaacagagcaucaggaguaccagacagauucucaggaucaggauccggaacagacuucacacuaaaaauaucaagaguagaagcagaagacguaggaguauacuacugcaugcaagcacuacaaacaccauacacauucggacaaggaacaaaacuagaaauaaaa

SEQ ID NO: 50720 - RNA, 339 nt, Artificial Sequence
  derived and/or modified sequence opt6 from anti-influenza_Chain
gacauaguaaugacacaaucaccagacuuccuaccaguaagccuaggagaaagagcaacaauaaacugcaaaucaucacaaagaguauuauacagcucaaacaacaaaaacuaccuagcaugguaccaacuaaaaccaggacaaccaccaaaacuaauaauauacugggcaagcacaagagaaagcggaguaccagacagauucucaggaucaggaucaggaacagaauucacacuaacaauaagcucacuacaagcagaagacguagcaguauacuacugccaacaauacuacucaagaccauacacauucggacaaggaacaaaacuagaaauaaaa

SEQ ID NO: 50721 - RNA, 339 nt, Artificial Sequence
  derived and/or modified sequence opt6 from anti-influenza_Chain
gacauaguaaugacacaaucaccagacucacuagcaguaagccuaggagaaagagcaacaauaaacuguaaaucaagccaaagcguacuauacagcucaaacaauaaaaauuacuuagcaugguaccaacaaaaaccaggacaaccaccaaaauuacuaauauacugggcaagcacaagagaaagcggaguaccagacagaauaucaggaucaggaucaggagcagacuuuacauuaacaauaagcucacuacaagcagaagacguagcaguauacuacugccaacaauauuucgcaacaccaagaacauucggacaaggaacaaaaguagaaauaaaa

SEQ ID NO: 50722 - RNA, 339 nt, Artificial Sequence
  derived and/or modified sequence opt6 from anti-influenza_Chain
gacauaguaaugacacaaucaccagacucacuagcaguaucauuaggagaaagagcaacaauaaacugcaaaucaucacaaucaguacuauacucaucaaacaacaaaucacaccuagcaugguaccaacaaaaaccaggacaaccaccaaaacuacuaauauacugggcaucaacaagagaaucaggaguaccagacagauucucaggaucaggaucaggaacagacuucacacuaauaauaucaucacuacaagcagaagacguagcaguauacuacugccaacaauacuacuucucaccacuaacauucggaggaggaacaaaaguagaaauaaaa

SEQ ID NO: 50723 - RNA, 339 nt, Artificial Sequence
  derived and/or modified sequence opt6 from anti-influenza_Chain
gacauaguaaugacacaaucaccagacucacuagcaguaucacuaggagaaagagcaacaauaaacugcagaucaucacaaucaauauuccacaacucaaacaacgaaaacuaccuagcaugguaccaacaaaaaccaggacaaccaccaaaacuacuaauauacugggcaucaacaagagaaucaggaguaccagacagauucucaggaucaggaucaggaacagacuucacacuaacaauaucaucacuacaagcagaagacguagcaguauacuucugccaacaauacuacaacgcaccacuaacauucggaggaggaacaaaaguagaaauaaaa

SEQ ID NO: 50724 - RNA, 339 nt, Artificial Sequence
  derived and/or modified sequence opt6 from anti-influenza_Chain
gaaauaguacuaacacaaucaccacuaucauuaccagucacaccaggagaaccagcaucaauaucaugcagaucaucacaaucacuacuacacucaaacggauacaacuaccuagacugguaccuacaaaaaccaggacaaucaccacaacuacuaauauaccuaggaucaaacagagcaucaggaguaccagacagauucucaggaucaggaucaggaacagacuucacacuaaaaauaucaagaguagaagcagaagacguaggaguauacuacugcaugcaagcacuacaaacaccacuaacauucggaggaggaacaaaaguagaaauaaaaaga

SEQ ID NO: 50725 - RNA, 339 nt, Artificial Sequence
  derived and/or modified sequence opt6 from anti-influenza_Chain
gacauaguauuaacacaaccaccaucaguaucaguagcaccaggacaaacagcaacaauaacauguggaggaaacuauauaggaucaaaaucaguaaacugguaccaacaaagaccaggacacgcaccaguauuaguaguauaugacgauucagauagaccaucaggaauaccagacagauucucaggaucaaacucaagaucaacagcaacaacagcaacacuaacaauaucaagaguagaagcaggagaugaagcagacuauuacugucaaguaugggaaacaucagaagaucuauggguauuuggaggaggaacaaaacuaacaguacuaggacaa

SEQ ID NO: 50726 - RNA, 342 nt, Artificial Sequence
  derived and/or modified sequence opt6 from anti-influenza_Chain
gacguaguaaugacacaaucaccagacucacuagcaguaucacuaggagaaagagcaacaauaaacugcaaaucaucacaaucaguacuauacucaucaaacaacaaaaacuaccuagcaugguaccaacaaaaaccaggacaaccaccaaaacuacuaauauacugggcaucaacaagagaaucaggaguaccagacagauucucaggaucaggaucaggaacagacuucacacuaacaauaucaucauuacaagcagaagacguagcaguauacuacugccaacaauacuacucaacaccacuaacauucggaggaggaacaaaaguagacauaaaaaga

SEQ ID NO: 50727 - RNA, 342 nt, Artificial Sequence
  derived and/or modified sequence opt6 from anti-influenza_Chain
gacauacaaaugacacaaucaccagacucacuagcaguaucacuaggagaaaaagcaacaauaaacugcaaaucaucacaaucaauacuaaacucaucaaacaacaaaaacuaccuagcaugguaccaacaaaaaccaggacaaccaccaaaacuacuaauauacugggcaucaacaagagaaucaggaguaccagacagauucucaggaucaggaucaggaacagacuucacacuaacaauaucaucacuacaagcagaagacguagcaguauacuacugccaacaauacuacucaucaccaccaacauucggacaaggaacaaaaguagaaauaaaaaga

SEQ ID NO: 50728 - RNA, 342 nt, Artificial Sequence
  derived and/or modified sequence opt6 from anti-influenza_Chain
gaaauaguacuaacacaaucaccagcaacauuaagccuauacccaggagaaagagcaacauuaagcuguagagcaagccaaagcguaagcagauacuuagcaugguaccaacaaaaaccaggacaagcaccaagacuauuaauauaugacgcaaguaauagagcaacaggaauaccagcaagauucucaggaucaggaucaggaacagacuuuacauuaacaauaagcucacuagaaccagaagacuuugcaguauacuauugcugugacagacaacaaagaucaaacuggcuaaaaauaacauucggacaaggaacaagacuagaaauaaaaggaacggua

SEQ ID NO: 50729 - RNA, 342 nt, Artificial Sequence
  derived and/or modified sequence opt6 from anti-influenza_Chain
gacauaguaaugacacaaucacaaaaauucguaagcacaucaguaggagacagaguaucaguaacaugcaaagcaucacaaaacguaggaucaaacguagcaugguaccaacacaaaccaggacacucaccaacagcacuaauauacucagcaucacacagauacucaggaguaccagacagauucacaggaucagaaucaggaacagacuucacacuaacaauaucaaacguacaaagcgaagaccuagcagaauacuucugccaacaauacuacucauacccauacacauucggaggaggaacaaaacuagaaauaaaaagagcagacgcagcaccaaca

SEQ ID NO: 50730 - RNA, 342 nt, Artificial Sequence
  derived and/or modified sequence opt6 from anti-influenza_Chain
gacauagaaaugacacaaucaccacuaucacuaccaguaacaccaggagaaucagcaucaauaucaugcagaucaucacaaucauuacuacacucaaacggauacaacuaccuagacugguaccuacaaaaaccaggacaaucaccacaacuacuaauauaccuaggaucaucaagagcaucaggaguaccagacagauucucaggaucaggaucaggaacagacuucacacuaaaaauaucaagaguagaagcagaagacguaggaguauacuacugcaugcaaggauuacaaacaccauacacauucggacaaggaacaaaauuagaaauaaaaagaaca

SEQ ID NO: 50731 - RNA, 342 nt, Artificial Sequence
  derived and/or modified sequence opt6 from anti-influenza_Chain
gacauagaaaugacacaaucaccacuaucacuaccaguaacaccaggagaaccagcaucaauaucaugcagaucaucacaaucacuauuacacucaaacggauacaaccaccuagcaugguauuuacaaaaaccaggaagaucaccacacuuacuaauauaccuagcaucaacaagagcaucaggaguaccagacagauucucaggaucaggaucaggaacagacuucacacuaaaaauaucaagaguagaagcagaagacguaggaauauacuacugcaugcaaucauuacaaacaucaauaacauucggacaaggaacaagacuagaaauaaaaagaaca

SEQ ID NO: 50732 - RNA, 345 nt, Artificial Sequence
  derived and/or modified sequence opt6 from anti-influenza_Chain
caaguacaauuaguacaaaguggagcagaaguaaaaaaaccaggaaguaguguaagaguaaguuguaaaacaaguggaggaacauuuaguaguuaugcaguaacauggguaagacaagcaccaggacaaggauuagaauggaugggaggaauaauaggaauguuuggaacaacaaauuaugcgcaaaaauuucaaggaagauuaacaauaacagcagaugaaaugacaaguacagcauauauggaauuaaguaguuuaagaagugaagauacagcaguauauuauugugcaagaggaaguuauuauuaugaaacaacauuagauuauuggggaagaggaacauua

SEQ ID NO: 50733 - RNA, 345 nt, Artificial Sequence
  derived and/or modified sequence opt6 from anti-influenza_Chain
gaaguacaauuaguacaaagcggagcagaaguaaaaaaaccaggaaguaguguaaaaguaaguuguaaaacaaguggaggaacauuuagcaguuaugcaguaacauggguaagacaagcaccaggacaaggauuagaauggaugggagcaauaauaggaauguuuggaacaacaaauuaugcacaaaaauuucaaggaagaguaacaauaacagcagaugaauuaacaaguacagcauauauggaauuaaguagcuuaagaagugaugauacagcaguauauuacugugcaagaggaaguuauuauuaugaaaguagucuagauuauuggggaaaaggaacauua

SEQ ID NO: 50734 - RNA, 345 nt, Artificial Sequence
  derived and/or modified sequence opt6 from anti-influenza_Chain
caaguacaauuaguacaaagcggagcagaaguaaaaaaaccaggaaguaguguaaaaguaagcuguaaaacaaguggaggaacauuuaguaguuaugcaguaacauggguaagacaagcaccaggacaaggauuagaauggaugggaggaauaauaggaauguuuggaacaacaaauuaugcacaaaaauuucaaggaagaguaacaauaacagcagaugaauuaacaaguacagcauauauggaauuaaguagucuaagaagugaagauacagcaguauauuauugugcaagaggaaguuauuauuaugaaaguaguuuagauuauuggggaagaggaacauua

SEQ ID NO: 50735 - RNA, 345 nt, Artificial Sequence
  derived and/or modified sequence opt6 from anti-influenza_Chain
gaaguacaauuaguacaaaguggagcagaaguaaaaaaaccaggagcaaguguaaaaguaaguuguaaagcaaguggauauacauuuacaggauauuauguauauuggguaagacaagcaccaggacaaggauuagaauggaugggauggauaagugcauauaauggaaauacaaauuaugcacaaaaauuucaaggaagaguaacaauaacagcagauaaaaguacaaguacagcauauauggaauuaaguaguuuaagaagugaagauacagcaguauauuauugugcaagaaguagaaguuuagauguauggggacaaggaacaacaguaacaguaaguagu

SEQ ID NO: 50736 - RNA, 345 nt, Artificial Sequence
  derived and/or modified sequence opt6 from anti-influenza_Chain
gacauaguaaugacacaaucaccacuaucacuaccaguaacaccaggagaaccagcaucaauaucaugcagaucaucacaaucacuacuacacucaaacggacacauauacuucgacugguaccuacaaaaaccaggacaaucaccacaacuacuaauauaccuaguaucaaaaagagcaucaggaguaccagacagauucucaggaucaggaucaggaacagacuucacacuaaaaauaucaagaguagaagcagaagacguaggaguauacuacugcaugcaagcacuagaaacaccauucacauucggaccaggaacaaaaguacacauaaaaagaacagua

SEQ ID NO: 50737 - RNA, 345 nt, Artificial Sequence
  derived and/or modified sequence opt6 from anti-influenza_Chain
caaucagcacuaacacaaccagcaucaguaucaggaucaccaggacaaucaauaacaauaucaugcacaggaacaucaucagacguaggagcauacaacuacguaucaugguaucaacaccacccaggaaaagcaccaaaacuaaugauauacgacguaacauacagaccaucaggaguauccacaagauucucaggaucaaaaucaggaaacacagcaucacuaacaauaucaggacuacaagcagaagacgaagcagacuacuacugcucaucacaaucaagaucaucaacacuaguaauauucggaggaggaacaaaacuaacaguacuaggacaaccaaaa

SEQ ID NO: 50738 - RNA, 345 nt, Artificial Sequence
  derived and/or modified sequence opt6 from anti-influenza_Chain
gacauaguacuaacacaaucaccaguaucacuagcaguaucacuaggagaaucagcaacaguaaacugcaaaucaucacaaucaguacuaucaaacuccaaaaaccuaaacuaccuagcaugguaccaacacaaaccaggacaaccaccaaaacuacuaauauacugggcaucaacaagagaaucaggaguaccagacagauucucaggaucaggaucaggaacagacuucacacuaacaauaucaucacuacaagcagaagacguagcaguauacuacugccaacaacacuacucaauaccacuaacauucggaccaggaacaaaaguagacauaaaaagaaca

SEQ ID NO: 50739 - RNA, 348 nt, Artificial Sequence
  derived and/or modified sequence opt6 from anti-influenza_Chain
gacauaguacuaacacaaucaccauuaucacuaccaguaacaccaggagaaccagcaucaauaucaugcagaucaucacaaucacuacuagacucaaacggauacaacuaccuagacugguaccuacaaaaaccaggacaaucaccacaacuacuaauauaccuagcaucauacagagcaccaggaguaccagacagauucucaggaucaggaucaggaacagacuucacacuaaaaauaucaagaguagaagcagaagacguaggacuauacuacugcaugcaagcacuacaaaccccaccaauguacacauucggacaaggaacaaaacuagaaauaaaaagaaca

SEQ ID NO: 50740 - RNA, 351 nt, Artificial Sequence
  derived and/or modified sequence opt6 from anti-influenza_Chain
cuagaaagcggaggaggauuaguacaaccaggaggaagccuaagacuaagcugugcagcaaguggaauaacauucucaagcuaugcaaugaguuggguaagacaagcaccaggaaaaggacuagaauggguaagcacaguaaauagcggaggaggaagcacauacuauggagauaguguaagaggaagauuuacaauaagcagagacaauagcaaaagcacacuauaucuacaacuaaauagcuuaagagcagaagauacagcaauauauuacugugcaaaagacaaaggaagaccaauauucggauuaguaacaccaagcuauuacauggacguauggggaaacggaaca

SEQ ID NO: 50741 - RNA, 351 nt, Artificial Sequence
  derived and/or modified sequence opt6 from anti-influenza_Chain
caagaacaauuaguacaaagcggagcagaaguaaaaaaaccaggagcaagcguaaaaguaagcuguaaagcaagcagaaaaucauucauaggauauuacguacacuggguaagacaagcaccaggacaaggacuagaauggaugggauggauaucaccagauagcgaugcaacaaaauaugcacaaaaauuucaaggaagcguaauaaugacaagagacacaagcguaagcacaguauauauggaacuaucaagauuaacaucagacgauacagcacuauauuacugucuauuauucagaggaggaaacucacuaucauggggacaaggaacauuaguaacaguaucaagc

SEQ ID NO: 50742 - RNA, 351 nt, Artificial Sequence
  derived and/or modified sequence opt6 from anti-influenza_Chain
caaguacaauuacaagaaagcggaccaggauuaguaaaaccaagcgaaacauuaagccuaacauguacaguaagcggaagcucaauaucaaacuauuacuggagcuggauaagacaaucaccaggaaaaggacuagaauggauaggauuuauauauuacggaggaaauacaaaauacaauccaucacuaaaaagcagaguaacaauaucacaagauacaucaaaaucacaaguaagccuaacaaugagcucaguaacagcagcagaaucagcaguauacuuuugcgcaagagcaagcuguagcggaggauauugcauauuagauuacuggggacaaggaacauuaguaaca

SEQ ID NO: 50743 - RNA, 351 nt, Artificial Sequence
  derived and/or modified sequence opt6 from anti-influenza_Chain
gaaguacaauuaguagaaaguggaggaggauuaguacaaccaggagggaguuuaagauuaaguugugcagcaaguggauuuacauuuaguauauaugcaaugaguuggguaagacaagcaccaggaaaaggauuagaauggguaagugcaauaaguaguaguggagauaguacauauuaugcagauagugugaaaggaagauuuacaauaaguagagauaaugcaagaaauacauuauauuuacaaaugaauaguuuaagagcagaagauacagcaguauauuauugugcaagagcauauggauauacauuugauccauggggacaaggaacauuaguaacaguaaguagu

SEQ ID NO: 50744 - RNA, 354 nt, Artificial Sequence
  derived and/or modified sequence opt6 from anti-influenza_Chain
caaguacaacuacaagaaucaggaccaggauuaguaaaaccaucagaaacacuaucacuaacaugcacaguaucaggauacucauucgacucaggauacuacuggggauggcuaagacaaccaccaggaaaaggacuagaauggauaggaucaauauaccacucaagaaacacauacuacaacccaucacuaaaaucaagaguaacaauaucaguagacacaucaaaaaaccaauucucacuacaacuaucaucaguaacagcagcagacacagcaguauacuacugcgcaagaggaacaugguacucaucaaaccuaagauacugguucgacccauggggaaaaggaacacua

SEQ ID NO: 50745 - RNA, 354 nt, Artificial Sequence
  derived and/or modified sequence opt6 from anti-influenza_Chain
caaccaguauuaacacaaccaccaagcgcaagugcaagcuuaggagcaagcguaacauuaacauguacauuaagcucagcauauagcaauuacaaaguagauugguaucaacaaagaccaggaaaaggaccaagauuuguaaugagaguaggaacaggaggaauaguaggaucaaaaggagacggaauaccagacagauucagcguauuaggaucaggauuaaacagauacuuaacaauaaaaaauauacaagaagaagacgaaagcgauuaccauugcggagcagaucacggaagcggaagcaauuucguaagcccauacguauucggaggaggaacaaaacuaacaguauua

SEQ ID NO: 50746 - RNA, 354 nt, Artificial Sequence
  derived and/or modified sequence opt6 from anti-influenza_Chain
caaguacaauuaguacaaagcggagcagauguaaaaaaaccaggaucaagcguaacaguaagcuguaaagcaagcggaggaucauucucaaacuauggaauaaacuggguaagacaagcaccaggacaaggacuagaauggaugggaggaauaauaccauuaauaaaugcaccaaacuaugcaccaaaauuucaaggaagaguaacaauaacagcagacauguucucaaacauaguaucacuacaacuaacaagcuuaagaacagacgauacagcaguauauuacugugcaagaagaaaaaugacaacagcaauagauuacuggggacaaggaacacuaguaacaguaagcuca

SEQ ID NO: 50747 - RNA, 354 nt, Artificial Sequence
  derived and/or modified sequence opt6 from anti-influenza_Chain
caaguacaauuaguacaaagcggagcagaaguaaaaaaaccaggaaguagcguaaaaguaagcuguagagaaagcggaggaacauucaauggauauacaauaacauggguaagacaagcaccaggacaaggacuagaauggaugggaggaauaauaccaaugaugggaacaguaaacuaugcacaaaaauuacaaggaagaguaacaauaacaacagacuauuucacaaaaacagcauauauggauuuaaauaacuuaagaucagaagauacagcaauguauuacuguguaaaaauaagauacacaggacaacaacuacuauggggacaaggaacacuaguaacaguaagcuca

SEQ ID NO: 50748 - RNA, 354 nt, Artificial Sequence
  derived and/or modified sequence opt6 from anti-influenza_Chain
caaguacaauuaguacaaagcggagcagaaguaaaaaaaccaggagcaagcguaaaaguaagcuguaaagcaagcggacacacauucacaggauauuacauacacuggguaagacaagcaccaggacaaggacuagaauggaugggauggauaaauccagauagcggagcaacaagcucagcacaaaacuuucaaggaagaguaacaaugacaggagacacaaguucaagcacagcauauauggaauuaucaagauuaagcuuugacgauacagcaguauauuacugugcaagaguauuauucacaagcccauucgauuucuggggagaaggaacacuaguaacaguaagcuca

SEQ ID NO: 50749 - RNA, 354 nt, Artificial Sequence
  derived and/or modified sequence opt6 from anti-influenza_Chain
caaccaguauuaagucaaccaccaagcgcaagcgcaagucuaggagcaagcguaacauuaacauguacauuaagcucaggauuugacaauuaccaaguagcaugguaucaacaaagaccaggaaaaggaccaagauuuguaaugagaguaggaaauggaggaaacguagcaucaaaaggagacggaauaccagacagauucucaguaucaggaucaggacuaaacagauacuuaacaauaaaaaauauacaagaagaugacgaaagcgauuacuauugcggagcagaucacggaagcggaaacaauuucguaagcccauacguauucggaggaggaacaaaacuaacaguauua

SEQ ID NO: 50750 - RNA, 354 nt, Artificial Sequence
  derived and/or modified sequence opt6 from anti-influenza_Chain
gaaguacaauuaguagaaaguggagcagaaguaaaaaaaccaggagcaaguguaaaaguaaguuguaaagcaaguggauauacauuuagcagauauuauauacauuggguaagacaagcaccaggacaagaauuagaauggaugggauggauaaauccagauaguggagauacaaauuaugcacaaaaauuuagaggaagaguaacaauggcaagagauacaaguauaaguacaguauauauggaauuaaauaguuuaagauaugaugauacagcaguauauuuuugugcaagaauaauauggaguaguaguggaauggauguauggggacaaggaacaacaguaacaguaagu

SEQ ID NO: 50751 - RNA, 354 nt, Artificial Sequence
  derived and/or modified sequence opt6 from anti-influenza_Chain
gaaguacaauuauuagaaaguggaggaggaguaguacaaccaggaagaaguuuaagauuaaguugugcagcaaguggauuuacauuuagaacauauggaaugcauuggguuagacaagcaccaggaaaaggauuagaauggguagcaguaauaagucaugauggaaauuuaaaauauuauggaggaaguguaaaaggaagauuuacaauaaguagagauaauaguaaaaaugcauuauaucuacaaaugaauaguuuaagaguagaugauacagcauuauauuauugugcaagaggaauaggaauaacagaugcauuugauauaagaggacaaggaacaaugguaguaguaagu

SEQ ID NO: 50752 - RNA, 354 nt, Artificial Sequence
  derived and/or modified sequence opt6 from anti-influenza_Chain
gaaguacaauuaguagaaagcggaggaggauuaguacaaccaggaggaucauuaagauuaaguuguacagcaagcggacuaucaguaucaaguacauacaugaacuggguaagacaagcaccaggaaaaggauuagaauggguaagcguauucuauagcgaaacaagaacauauuacgcagacucaguaaaaggaagauucacaguaucaagacauaauucaaauaauacauuauauuuacaaaugaauagcuuaagaguagaagacacagcaguauauuauugugcaagaguacaaagauuaucauacggaauggauguauggggacaaggaacaacaguaacaguaaguuca

SEQ ID NO: 50753 - RNA, 354 nt, Artificial Sequence
  derived and/or modified sequence opt6 from anti-influenza_Chain
gaaguacaauuaguagaaagcggaggaggauuaguacaaccaggaggaaguuuaagauuaagcuguacagcaagcggacuaucaguaucaaguacauacaugaacuggguaagacaagcaccaggaaaaggacuagaauggguaagcguauucuauagcgaaacaagaacauauuacgcagacucaguaaaaggaagauucacaguaucaagacauaauucaaauaauacauuauauuuacaaaugaacucauuaagagcagaagacacagcaguauauuauugugcaagaguacaaagacuaucauacggaauggauguauggggacaaggaacaacaguaacaguaaguuca

SEQ ID NO: 50754 - RNA, 354 nt, Artificial Sequence
  derived and/or modified sequence opt6 from anti-influenza_Chain
gauaugcaauuaguagaaaguggaggaggauuaguaccaccaggaggaaguuuaagauuaaguugugcagcaaguggauucucaguaucagauaauuauauaaauuggguaagacaagcaccaggaaaaggauuagauuggguaaguguauuuuauagugcagauagaacaucauaugcagauucaguaaaaggaagauuuacaguaucaagucaugauaguaaaaauacaguauauuuacaaaugaauaguuuaagagcagaagauacagcaguauauuauugugcaagaguacaaaaaucauauuauggaauggauguauggggacaaggaacaacaguaacaguaucauca

SEQ ID NO: 50755 - RNA, 357 nt, Artificial Sequence
  derived and/or modified sequence opt6 from anti-influenza_Chain
gaaguacaauuaguagaaagcggaccaguauuaguaaaaccaacagaaacacuaacaguaacauguacaguaagcggauucucaguagauaacgauagaaugggaguaagcuggauaagacaaccaccaggaaaagcacuagaaugguuagcacauauauuuagcaaugacgaaaaaucauacucaacaagucuaagaagcagacuaacaauaucaaaagauacaucaaaaagacaaguaguauuaagcaugacagauauggauccaguagacacagcaacauacuauugcgcaagagcaccaucagaauaugcagcaauggauguauggggacaaggaacaaugguaacaguaagc

SEQ ID NO: 50756 - RNA, 357 nt, Artificial Sequence
  derived and/or modified sequence opt6 from anti-influenza_Chain
caaguacaaguaguacaaagcggaacagaaguaaaaaaaccaggaaguagcguaaaaguaaguugucaaacaaguggaggaagauuuaugagcuaugcaauaacauggguaaggcaagcaccaggacaaggauuagaauggaugggaggaauaguaccaguauuuggaacagcaaauuaugcacaaaaauuucaaggaagaguaacaauaacaacggaugauaguacaagaacagcauauauggaauuaaguagcuuaagaagugaagauacagcaguauauuauuguggauuuagauauggaaguggauauggauuugauaguuggggacaaggaacauuaguaacaguaaguagu

SEQ ID NO: 50757 - RNA, 357 nt, Artificial Sequence
  derived and/or modified sequence opt6 from anti-influenza_Chain
gaaguacaauuaguagaaucaggagcaggaguaaaaaaaccaggaaguucaguaaaaguaucauguaaagcaucaggaaauacauuuaguucaaaugcaauaaguuggguaagacaagcaccaggacaaggauuagaauggaugggaggaauauuaggaaugcuaagaacaacaaauuaugcacaaaaauuucaaggaagaguaacaauaacagcagaugaauuuaugaauacagcauauauggaacuaaguucacuaacaagugaagacacagcaguauauuauugugcaagaucaagcggauauuauccagauuauuuucauuuauggggacaaggaacauuaguaacaguauca

SEQ ID NO: 50758 - RNA, 357 nt, Artificial Sequence
  derived and/or modified sequence opt6 from anti-influenza_Chain
caaguacaauuacaagaaagcggaccaggauuaguaaaaccaagcgaaacauuaagccuaacauguacaguaagcggaagcucaauaucaaacuauuacuggagcuggauaagacaaucaccaggaaaaggacuagaauggauaggauuuauauauuacgggggaaauacaaaauacaauccaucacuaaaaagcagaguaacaauaucacaagauacaucaaaaucacaaguaagccuaacaaugagcucaguaacagcagcagaaucagcaguauacuuuugcgcgagagcaagcuguaguggaggauauugcauacuagauuacuggggacaaggaacauuaguaacaguaagc

SEQ ID NO: 50759 - RNA, 357 nt, Artificial Sequence
  derived and/or modified sequence opt6 from anti-influenza_Chain
gaaguacaauuaguagaaucaggaggaggauuaguacaaccaggaggaaguuuaagaauaaguugugcagcaaguggauucacaguaucgaguaauuauaugaguuggguaagacaagcaccaggaaaaggacuagaauggguaaguguaauauauaguggaggaucaacauauuaugcagacucaguaaaaggaagauucucauucucacgagauaauaguaaaaauacaguauucuuacaaaugaauaguuuaagagcagaagacacagcaguauauuauugcgcaagaugucuaucaagaaugagaggauacggacuagauguauggggacaaggaacaacaguaacaguauca

SEQ ID NO: 50760 - RNA, 357 nt, Artificial Sequence
  derived and/or modified sequence opt6 from anti-influenza_Chain
caaguacaauuacaagaaucaggaccaggacuaguaaaaccaucagaaacacuaucacuaacaugcacaguaucaggagcaucaauaucaucagacuacuggucauggauaagacuaccaccaggaaaaggacuagaauggauaggauacauauacaacagaggaucaacaaaauacacaccaucacuaaaaucaagaguaacaauaucacuagacacagcagaaaaccaauucucacuaagacuaagaucaguaacagcagcagacacagcaauauacuacugcgcaagacacguaggaggacacacauacggaauagacuacuggggacaaggaacacuaguaacaguaucauca

SEQ ID NO: 50761 - RNA, 357 nt, Artificial Sequence
  derived and/or modified sequence opt6 from anti-influenza_Chain
caaguacaacuacaagaaucaggaccaggauuaguaaaaccaucagaaacacuaucacuaacaugcacaguaucaggagcaucaauaucaucagacuacuggucauggauaagacuaccaccaggaaaaggacuagaauggauaggauacauauacaacagaggaucaacaaaauacacaccaucacuaaaaucacgaguaacaauaucacuagacacagcagaaaaccaauucucacuaagacuaagaucaguaacagcagcagacacagcaguauacuacugcgcaagacacguaggaggacacacauacggaauagacuacuggggacaaggaacauuaguaacaguaucauca

SEQ ID NO: 50762 - RNA, 357 nt, Artificial Sequence
  derived and/or modified sequence opt6 from anti-influenza_Chain
caaguacaauuacaagaaagcggaccaagauuaguaaaaccaagcgaaagccuaucauuaacauguacaguaagcggaggaagcauaucaaacucauucuggggauggauaagacaaccaccaggagaaggauuagaauggauaggauauguauauaacucaggaaauacaaaauacaauccaucacuaaaaagcagaguaacaauaucaagagauacaucaaaaucacaauuauacaugaaauuaagaucaguaacagcagcagacacagcaguauacuauugcgcaagacaugacgacgcaucacacggauacucaauaucauggggacacggaacauuaguaacaguaucaagc

SEQ ID NO: 50763 - RNA, 357 nt, Artificial Sequence
  derived and/or modified sequence opt6 from anti-influenza_Chain
gaaguacaucuacaacaaucaggaccagaauuaguaaaaccaggagcaucaguaaaaaugucaugcgaagcaucaggauauacauuuacagauuacuauguagcauggguaaaacaaagcccaggagaaucauuugaauggauaggaagaguaaacccauacagcggaggaacaucauacaaucaaaaauucaaaggaaaagcaacacuaauaguagauaaaucaagcucaacagcauacauggaauuaagcucacuaacaagcgaagacagugcaguauacuauugcgcaagaugggacuauggaguauacgaaggauauauagauuacuggggacaaggaucagcauuaacagua

SEQ ID NO: 50764 - RNA, 360 nt, Artificial Sequence
  derived and/or modified sequence opt6 from anti-influenza_Chain
caaguacaauuaguacaaccaggagcagaaguaaaaaaaccaggaucaagcguaaaaguaagcuguaaagcaagcggaggaauauucucaccauaugcaauaagcuggguaagacaagcaccaggacaaggacuagaauggaugggaggaauaauagcaauauucggaacaacaaacuaugcacaaaaauuucaaggaagaguaacaauaacagcagacaaaagcacaacaacagcauaucuagaacuaaauagcuuacgauuugaagauacagcaguauauuacugugcaagaggaggaagauauuacguagacuauuucgauuacuggggacaaggaacacuaguaagcguaagcuca

SEQ ID NO: 50765 - RNA, 360 nt, Artificial Sequence
  derived and/or modified sequence opt6 from anti-influenza_Chain
caaguacaauuacaagaaagcggaccagaucuaguaaaaccaggagcaaguguaaaaaugagcuguaaagcaagcggauacucauucacauacuaucacaugcacuggguaaaacaaacacacggaaaaucacuagaauggauaggaagaauaccauacaauggaggaacaaauuacucacaaagauucaaaggaaaagcaguauucacaguagauaugucaagcucaacagcauacauggaauuaagaucacuaacaagcgaagacucagcaguauacuauugcgcaagagaugcaaauuacgaaggagauugguauuucgauguauggggacaaggaacaacaguaacaguaaguuca

SEQ ID NO: 50766 - RNA, 360 nt, Artificial Sequence
  derived and/or modified sequence opt6 from anti-influenza_Chain
caaguacaauuaguacaaagcggagcagaaguaaaagaaccaggaucagcaaugaaaguaagcuguaaagcaagcggaggaacauucucaagugaugcauuuugcuggguaagacaagcaccaggaagaggacuagaauggaugggaggaauaauaccaguauuccaaacagcaaacuauggaccaaauuuucaaggaagaguaacaauaagugcagacguauacacaacaacacuauaucuagaacuaucaggauuaacaucagaagauacagcaguauauuucugugcaagaaguggagauggauacaauuacuauuucccacuauggggacaaggaacauuaguaacaguaaguuca

SEQ ID NO: 50767 - RNA, 360 nt, Artificial Sequence
  derived and/or modified sequence opt6 from anti-influenza_Chain
caaauaacacuaagagaaucaggaccaacacuaguaaaaccaacacaaacacuaacacuaacaugcacauucucaggauucucacuaucaacaaacggaguaaacguaggauggauaagacaaccaccaggaaaagcacuagaauggcuagcacuaauauacugggacgacgacaaaagauacucaccaucacuaaaaagaagacuaacaauaacaaaagacacaucaaaaaaccaaguaguacuaacacuaacaaacauggacccaguagacacagcaacauacuacugcgcacacagaccagacuucuacggagacuucgaauacuggggaccaggaacacuaguaacaguaucauca

SEQ ID NO: 50768 - RNA, 360 nt, Artificial Sequence
  derived and/or modified sequence opt6 from anti-influenza_Chain
caaguacaauuaguacaaagcggaagcgaaguaaaaaaaccaggaacaagcguaaaaguaagcuguacagcaagcggaagcguauucacaaacuauggaauaaguuggguaagacaagcaccaggacaaggacuagaauggaugggcggaauaauaccauuauucggagcagcaaaauaugcacaaaaauuucaaggaagaguaacaauaacagcagacgaaagcacaaaaacaguauauauggaacuaucaagauuaacaucaaaagauacagcaauauauuucugugcaaaagcaccaagaguauacgaauacuauuucgaucaauggggacaaggaacaccaguaacaguaagcuca

SEQ ID NO: 50769 - RNA, 360 nt, Artificial Sequence
  derived and/or modified sequence opt6 from anti-influenza_Chain
caaguacaauuaguacaaagcggagcagauuuaaaaaaaccaggagcaagcguaaaaguaagcuguaaagcaagcggauacacauucacagacuauuacauacacuggguaagacaagcaccaggacaaggacuagaauggaugggauggauaaauccagaaagcggagacacaaaauaugcacaaaaauuucaaggacgaguaacaaugacaagagacacaaguauaacaacagcauauauggaacuaggaagauuaagaucagacgacacagcaguauauuacugugcaagagacguaaguacaacauggagcugguucgcaccauggggacaaggaacauuaguaacaguaaguuca

SEQ ID NO: 50770 - RNA, 360 nt, Artificial Sequence
  derived and/or modified sequence opt6 from anti-influenza_Chain
caaguacaacuacaagaaucaggaccaggacuaguaaaaccaucagaaacacuaucauuaacaugcucaguaucaggaggaucaauaaacuacuacuacuggagcuggauaagacaaccaccaggaaaaggacuagaaugcauaggauacauaucagacacaggaagaacauacuacaacccaucacuaagaucaagaguaacaauaucaguagacacaucaaaaaaccaauucucacuaaaccuaacaucaaugacagcagcagacacagcaguauacuacugcgcaagagacccaacaggaucaagacaaaaaaacgcauucgacauguggggacaaggaacaaugguaacaguauca

SEQ ID NO: 50771 - RNA, 360 nt, Artificial Sequence
  derived and/or modified sequence opt6 from anti-influenza_Chain
caaguacaauuacaagaaucaggaccaagaguaguaagaccaagcgaaacauuaucauuaacauguacaguaagcgguggaucaauaucaagcuauaacuggauauggauaagacaaccaccaggaaaaggacuagaauggauaggacauauauaugacuauggaagaacauuuuacaauagcucacuacaaagcagaccaacaauaucaguagaugcaagcaaaaaucaauuaucauuaagauuaacaagcguaacagcaucagacacagcaguauacuauugcgcaagaccacuaggaauauuacacuauuacgcaauggaucuauggggacaaggaacaacaguaacaguaagcuca

SEQ ID NO: 50772 - RNA, 360 nt, Artificial Sequence
  derived and/or modified sequence opt6 from anti-influenza_Chain
caaguacaacuacaagaaaguggaccaggauuaguaaaaccaagcgaaacauuaagcuuaacauguagcguaagcggaggaucaauaucaagcgauuucuggagcuggauaagacaaccaccaggaaaaggacuagaauggauaggauauguauauaacagaggaucaacaaaauacucaccaucacuaaaaagcagaguaacaauaucagcagauaugucaaaaaaucaauuuagcuuaaacaugagcucaguaacagcagcagacacagcaguauacuauugcgcaaaaaauggaagaagcucaacaucauggggaauagauguauggggaaaaggaacaacaguaacaguaagcuca

SEQ ID NO: 50773 - RNA, 360 nt, Artificial Sequence
  derived and/or modified sequence opt6 from anti-influenza_Chain
caaguacaacuacaagaaucaggaccaggacuaguaaaaccaucagaaacacuaucacuaacaugcacaguaucaggaggaucaauaucagcauaccacuggucauggauaagacaaccaccaggaaaaggacuagaauggauaggacacauauucgacucaggaagcacauacuacaacccaucacuaaaaucaagaguaacaauaucacuagacgcaucaaaaaaccaacuaucacuaagacuaacaucaguaacagcaucagacacagcaauauacuacugcgcaagaccacuaggaucaagauacuacuacggaauggacguauggggacaaggaacaacaguaacaguaucauca

SEQ ID NO: 50774 - RNA, 360 nt, Artificial Sequence
  derived and/or modified sequence opt6 from anti-influenza_Chain
gaaguacaauuaguagaaucaggaggaggauuaguacaaccaggaggaaguuuaagaauaaguugugcagcaaguggauuuacaguaucaaguaauuauaugaguuggguaagacaagcaccaggaaaaggauuagaaugggugaguguaauauauagcggaggaucaacauauuaugcagauucaguaaaaggaagauuuaguuuuucaagagauaauaguaaaaauacaguauuuuuacaaaugaauaguuuaagagcagaagacacagcaguauauuauugugcaagauguuuaucaagaaugagaggauauggacuagauguauggggacaaggaacaacaguaacaguaucauca

SEQ ID NO: 50775 - RNA, 360 nt, Artificial Sequence
  derived and/or modified sequence opt6 from anti-influenza_Chain
caaguacaauuacaagaaagcggaccaggauuaguaaaaccaagcgaaacacuaagccuaacauguacaguaagcggaagcucaauaucaaacuauuacuggagcuggauaagacaaucaccaggaaaaggacuagaauggauaggauuuauauauuacggaggaaauacaaaauacaauccaucacuaaaaaguagaguaacaauaucacaagauacaucaaaaucacaaguaagccuaacaaugagcucaguaacagcagcagaaucagcaguauacuuuugcgcaagagcaagcuguaguggaggauauugcauacuagauuacuggggacaaggaacauuaguaacaguaagcuca

SEQ ID NO: 50776 - RNA, 360 nt, Artificial Sequence
  derived and/or modified sequence opt6 from anti-influenza_Chain
caaguacaauuacaacaaucaggagcagaaguaaaaaaaccaggaaguucaguaaaaguaucauguaaaguaucaggaguaauauucaguggaagugcaauaucauggguaagacaagcaccaggacaaggacuagaauggaugggaggaauaaguccacuauucggaacaacaaauuacgcacaaaaauuccaaggaagaguaacaauaacagcagaccaaucaacaaauacaacauacauggaaguaaauucacuaagauaugaagacacagcaguauauuucugugcaagaggaccaaaauacuacagcgaauacauggacguauggggaaaaggaacaacaguaacaguaucaagc

SEQ ID NO: 50777 - RNA, 360 nt, Artificial Sequence
  derived and/or modified sequence opt6 from anti-influenza_Chain
caaguacaauuaguacaaagcggagcagaaguaaaaaaaccaggaucaagcguaaaaguaagcuguaaagcaagcggaggaacauucucaaguuaugcaauaagcuggguaagacaagcaccaggacaaggacuagaauggaugggaggaauaaugggaauguucggaacaacaaacuaugcacaaaaauuucaaggaagaguaacaauaacagcagacgaauucacaagcgcagcauauauggaauuaagaaguuuaagaucagaagauacagcaguauauuacugugcaagaagcucaggauauuacccagaauauuuccaagacuggggacaaggaacacuaguaacaguaagcuca

SEQ ID NO: 50778 - RNA, 360 nt, Artificial Sequence
  derived and/or modified sequence opt6 from anti-influenza_Chain
caaaugcaauuaguacaaagcggagcagaaguaaaaaaaccaggaucaagcguaaaaguaagcuguaaagcaagcggaggaacauucucaagcuaugcaauaacauggguaagacaagcaccaggacaaggauuagaauggaugggaggaauaauaggaauguucggaagcacaaacuaugcacaaaacuuucaaggaagaguaacaauaacagcagacgaaagcacaagcacagcauauauggaacuaucaagcuuaagaagugaagauacagcaguauauuacugugcaagaagcacaggauauuacccagcauaucuacaucacuggggacaaggaacacuaguaacaguaagcuca

SEQ ID NO: 50779 - RNA, 360 nt, Artificial Sequence
  derived and/or modified sequence opt6 from anti-influenza_Chain
gaaguacaacuaguagaaagcggagcagaaguaaaaaaaccaggaaguagcguaaaaguaagcuguaaagcaagcggaggaacauucucaagcuauggaauaagcuggguaagacaagcaccaggacaaggacuagaauggaugggagauauaauaggaauguucggaagcacaaacuaugcacaaaacuuucaaggaagauuaacaauaacagcagacgaaagcacaaguacagcauauauggaacuaucaagcuuaagaucagaagauacagcaguauauuacugugcaagaagcucaggauauuacccagcauaucuaccacacuggggacaaggaacacuaguaacagugagcuca

SEQ ID NO: 50780 - RNA, 360 nt, Artificial Sequence
  derived and/or modified sequence opt6 from anti-influenza_Chain
gaaguacaauuaguagaaagcggagcagaaguaaaaaaaccaggaucaagcguaaaaguaagcuguaaagcaagcggaggaacauucucaagcuaugcaauaagcuggguaagacaagcaccaggacaaggacuagaauggaugggaggaauaauaggaauguucggaacagcaaacuaugcacaaaaauuucaaggaagaguaacaauaacagcagacgaauucacaagcacagcauauauggaauuaucaagcuuaagaucagaagauacagcaguauauuacugugcaagaggaaauuacuauuacgaaagcagucuagauuacuggggacaaggaacauuaguaacaguaagcuca

SEQ ID NO: 50781 - RNA, 360 nt, Artificial Sequence
  derived and/or modified sequence opt6 from anti-influenza_Chain
caaguacaauuaguacaaagcggagcagaaguaaaaaaaccaggaaguaguguaaaaguaaguuguaaagcaaguggaggaccauuuagaaauuuugcaauaaauuggguaagacaagcaccaggacaaggacuagaauggaugggaggaauaauagcaguauuuggaacaacaaaauaugcacauaaauuucaaggaagaguaacaauaacagcagacgauaguacaaauacagcauauauggaauuaggaaguuuaaaaagugaagauacagcaguauauuauugugcaagaggaccacauuauuauaguaguuauauggauguauggggagaaggaacaacaguaacaguaaguagu

SEQ ID NO: 50782 - RNA, 360 nt, Artificial Sequence
  derived and/or modified sequence opt6 from anti-influenza_Chain
gaaguagcauuaguagaaacaggagcagaaguaaaaaaaccaggaaguaguguaaaaguaccauguaaaaguaguggaagcccauuuagaaguaaugcaguaaguuggguaagacaagcaccaggacaaggacuagaauggguaggaggaauauuaggaguauuuggaaguccaaguuaugcacaaaaauuucaaggaagaguaacaauaacagcagaugaaucaacaaauacaguacauauggaauuaagaggauuaagaagugaagauacagcaguauauuauugugcgagaggaccaacauauuauuauaguuauauggauguauggggaaaaggaacaacaguaacaguaaguagu

SEQ ID NO: 50783 - RNA, 360 nt, Artificial Sequence
  derived and/or modified sequence opt6 from anti-influenza_Chain
caaaugcaauuaguacaaagcggagcagaaguaaaaaaaccaggaucaagcguaaaaguaagcuguaaagcaagcggaggaacauucaguaguuaugcaauaaguuggguaagacaagcaccaggacaaggacuagaauggaugggaggaauauuuggaauguucggaacagcaaacuaugcacaaaaauuucaaggaagaguaacaauaacagcagacgaauucacaagugcagcauauauggaacuaucaagcuuaggaucagaagauacagcaauguauuacugugcaagaagcucaggauauuacccacaauauuuccaagacuggggacaaggaacacuaguaacaguaaguuca

SEQ ID NO: 50784 - RNA, 360 nt, Artificial Sequence
  derived and/or modified sequence opt6 from anti-influenza_Chain
caaguacaauuaguacaaagcggagcagaaguaaaaaaaccaggaucaucaguaaaaguaagcuguaaagcaagcggaguaacauucucauacuaugcaaugagcuggguaagacaagcaccaggacaaggauuagaauggaugggaggaauaucaccaauguucggaacaacaacauaugcacaaaaauuucaaggaagaguaacaauaacagcagacgauagcacaagcacagcauauauggaaguaagaagcuuaagaucagaagauacagcaguauauuacugugcaagaagcucaaacuauuacgauagcguauacgauuacuggggacaaggaacacuaguaacaguaagcuca

SEQ ID NO: 50785 - RNA, 360 nt, Artificial Sequence
  derived and/or modified sequence opt6 from anti-influenza_Chain
gaaguacaauuaguagaaacaggagcagaaguaaaaaaaccaggaaguaguguaaaagugccauguaaaaguaguggaaguccauuuagaucaaaugcaguaaguuggguaagacaagcaccaggacaaggauuagaauggguaggaggaauauuaggaguauuuggaaguccaaguuaugcacaaaaauuucaaggaagaguaacaauaacagcagaugaaagcacaaauacaguacauauggaauuaagaggauuaagaagugaagauacagcaguauauuauugugcaagaggaccaacauauuauuauaguuauauggauguauggggaaaaggaacaacaguaacaguaaguagu

SEQ ID NO: 50786 - RNA, 360 nt, Artificial Sequence
  derived and/or modified sequence opt6 from anti-influenza_Chain
caaguacauuuaguacaaagcggagcagaaguaagaaaaccaggagcaagcguaaaaguaagcuguaaaguaagcggauacacacuaaaugaauuaagcauacacugguuaagacaagcaccaggaagaggacuagaauggaugggaucauucgauccagaagacggagaaacaauauaugcacaaaaauuucaaggaagaguaacaaugacaggagacacaaguacagacacagcauaucuagaacuaaccagcuuaagaucagaagauacagcacuauauuacugugcaagaggauggggagcaguaacaaguccauucgauuucuggggacaaggaacauuaguaacaguaaguuca

SEQ ID NO: 50787 - RNA, 360 nt, Artificial Sequence
  derived and/or modified sequence opt6 from anti-influenza_Chain
gaaguacaauuaguacaaagcggagcagaaguaaaaaaaccaggaucaagcaugaaaguaagcuguaaagcaagcggaagcauauucucaaacuauggaauaaguuggguaagacaagcaccaggacaaggacuagaauggaugggaggaauaauaccaauauucggagcagcaaacuaugcacaaaaauuucaaggaagaguaacaauaacagcagacgaaagcacaagcacaguauauauggaaguaagaagccuaagaucagaagauacagcaguauauuacugugcaagaagacaacaauuauacaaaggauauuaccaucacuggggacaaggaacauuaguaacaguaagcuca

SEQ ID NO: 50788 - RNA, 360 nt, Artificial Sequence
  derived and/or modified sequence opt6 from anti-influenza_Chain
caaguacaauuaguacaaaguggagcaggaguaaaaaaaccaggaaguagcaugaaaguaaguuguaaagcaaguggaaguauauuuaguaauuauggaauaaguuggguaagacaagcaccaggacaaggauuagaauggaugggaggaauaauaccaauauuuggagcagcaaauuaugcacaaaaauuucaaggaagaguaacaauaacagcagaugaaaguacaagcacaguauauauggaaguaagaagucuaagaagugaagauacagcaguauauuauugugcaagaagacaacaacuauauaaaggauauuaucaucacuggggucaaggaacauuaguaacaguaaguagu

SEQ ID NO: 50789 - RNA, 360 nt, Artificial Sequence
  derived and/or modified sequence opt6 from anti-influenza_Chain
caaguacaacuacaagaaucaggaccaggauuaguaaaaccaucagaaacacuaucacuaacaugcacaguaucaggaggauuaauaggaacaggaucauauuacuggggauggauaagacaaacaccaggaaaaggaauggaauggauaggaucaauaucauacucaggaucaacauacuaccacccaucauuaaaaucaagaguaacaauaucagacgacacaucaaaaaaucaacuauuccuaaaacuaagaucaguaacagcagcagacacagcacaauacuacugcgcaagauacaacuggggaauaagauacuucgacuucuggggaagaggaacacuaguaacaguaucauca

SEQ ID NO: 50790 - RNA, 360 nt, Artificial Sequence
  derived and/or modified sequence opt6 from anti-influenza_Chain
caaguacaauuaguacaaagcggagcagaaguaagaaaaccaggaaguaguguaaaaguaagcuguaaaguaaguggaggaauaauaaggaaauaugcaauaaacuggguaagacaagcaccaggacaaggauuagaauggaugggaggaauaauagcaauauuuaauacagcaaauuaugcacaaaaauuucaaggaagaguaacaauaacagcagaugaaaguacaaguacaguauauauggaauuaaguagucuaagaagugaagauacagcauuauauuauugugcaagaggaaugaauuauuacagugacuauuucgauuacuggggacaaggaaguuuaguaacaguaagccca

SEQ ID NO: 50791 - RNA, 360 nt, Artificial Sequence
  derived and/or modified sequence opt6 from anti-influenza_Chain
caaguacaauuaguacaaagcggaggaggaguaguacaaccaggaagaaguuuaagauuaagcugugcagcaagcggauuuacauuuagaagucaugcaaugcacuggguaagacaagcaccaggaaaaggaccagaauggguagcauuaauaucauaugaugaaguaaauaaauucuaugcagauaguguaaaaggaagauuuacaauaagcagagauguaaguaaaaauacaguauuuuuacaaaugaauaguuuaagugcagacgauacagcaguauauuauugugcaagaggacauaguggaaguuauagauuauuugauuuuuggggacaaggaacauuaguaacaguaaguuca

SEQ ID NO: 50792 - RNA, 360 nt, Artificial Sequence
  derived and/or modified sequence opt6 from anti-influenza_Chain
caaguacaauuaguagaaaguggaggaggauuaguacaaccaggaggaaguuuaagauuaaguugugcagcaaguggauuuauauuuggagauuuugcaauacauuggguaaggcaagcaaguggaaaaggauuagaauggguagcaagaauaagaaguggauuaaauagauuugaaacagcauaugcagcaaguguagaaggaagauuaacaauaaguagagaugauaguaaaaguauggcauauuuacaaaugaauaauguaaaagcagaagauacagcaguauauuuauguacauauuuaguaggagcaguaggauuucaacauuggggacaaggaacauuaguaacaguaaguagu

SEQ ID NO: 50793 - RNA, 360 nt, Artificial Sequence
  derived and/or modified sequence opt6 from anti-influenza_Chain
caaguacaauuaguagaaaguggaggaggaguaguacaaccaggaagaaguuuaagauuaagcugugcagcaagcggauucacauucucaagcuauggaauauacuggguaagacaagcaccaggaaaaggacuagaauggguagcauuuauaucauacgaugaaauaaacaaauucuaugcagauagcguaaaaggaagauuuacaauaagcagagacaauagcaaaaacacaguauuucuacaaaugaauagcuuaagagaugaagauacagcaguauauuacugugcaaaaccauuaagaggaagcuauagauauuucgaucuauggggaagaggaacaguaguaacaguaagcuca

SEQ ID NO: 50794 - RNA, 363 nt, Artificial Sequence
  derived and/or modified sequence opt6 from anti-influenza_Chain
caaguacaacuacaagaaagcggaccagauuuaguaaaaccaggagcaaguguaaugauaagcuguaaagcaagcggauacucauuuacauacuauuauaugcacuggguaaaacaaucacacggaaaaacacuagaauggauaggaagaauauauccauauaacggagacacaaacuauaacagaagauuuaaagauaaagcaauauuaacaguagacgaaagcucaagcacagcauauauggaacuaagaaguuuaacaucagaagacagcgcaguauauuucugugcaagagacgcaaacuaugaaggagacugguauuuugacguauggggacaaggaacaacaguaacaguaucaagc

SEQ ID NO: 50795 - RNA, 363 nt, Artificial Sequence
  derived and/or modified sequence opt6 from anti-influenza_Chain
caaguacaauuaguacaaucaggaggaggaguaguacaaccaggaagaucacuaagacuaucaugcgcagcaucaggauucacauuuagcucauacgcaaugcauuggguaagacaagcaccaggaaaaggacuagaauggguagcaauaauaagcuaugacggaaacgaucaauauuacacagacucaguaaaaggaagauucacaauaucaagagauagcucaaaaguauacuuacaaaugcacagacuaagaccagaagacacagcaguauacuauugcgcaaaagaauuugaaacaucaggauauuuccauggaucauucgauuacuggggacaaggaauauuaguaacaguaaguuca

SEQ ID NO: 50796 - RNA, 363 nt, Artificial Sequence
  derived and/or modified sequence opt6 from anti-influenza_Chain
caaguacaaguaguacaaagcggagcagaaguaaaaaaaccaggaucaagcguaagaguaagcugucaagcaagcggaggaacauucaugaauuaugcaauaauauggguaagaagagcaccaggacaaggacuagaauggaugggaggaauaauaccaguauucccaacaccaaacuaugcacaaauguuucaaggaagaguaacaauaaguacagacgaaagcagaaguacaaguuuucuagaacuaacaaauuuaagauaugaagauacagcaguauauuacugugcaagaagaauauaccauggaggaaacucaggauuugacuuuuggggacaaggaacauuaguaacaguaucaagc

SEQ ID NO: 50797 - RNA, 363 nt, Artificial Sequence
  derived and/or modified sequence opt6 from anti-influenza_Chain
caaguacaauuacaagaaucaggaccaggauuacuaaaaccaucagacacacuagcauuaacaugcacaguaucaggaggaucaauaacaucagacuacuggucauggauaagacaaccaccaggaagaggacuagacuggauaggauucuucuacaacggaggaucaacaaaauacaacccaucacuaaaaucaagaguaacaauaucagcagacacaucaaaaaaccaacuaucacuaaaacuaacaucaguaacagcagcagacacaggaguauacuacugcgcaagacacgacgcaaaauucucaggaucauacuacguagcaucauggggacaaggaacaagaguaacaguaucauca

SEQ ID NO: 50798 - RNA, 363 nt, Artificial Sequence
  derived and/or modified sequence opt6 from anti-influenza_Chain
caaguacaacuacaagaaucaggaccaggacuacuaaaaccaucagacacacuagcacuaacaugcacaguaucaggaggaucaauaacaucagacuacuggucauggauaagacaaccaccaggaagaggacuagacuggauaggauucuucuacaacggaggaucaacaaaauacaacccaucacuaaaaucaagaguaacaauaucagcagacacaagcaaaaaccaacuaucauuaaaauuaacaucaguaacagcagcagacacaggaguauacuacugcgcaagacaugacguaaaauucucaggaucauacuacguagcaucauggggacaaggaacaagaguaacaguaucaagc

SEQ ID NO: 50799 - RNA, 363 nt, Artificial Sequence
  derived and/or modified sequence opt6 from anti-influenza_Chain
caaguacaacuacaagaaucaggaccaggauuaguaaaaccaucagaaacacuaucaguaacaugcaaaguaucaggagacucaauaucaucauacucauggucauggauaagacaaccaccaggaaaaggacuagaauggguaggauaccuauacuacucaggaucaacaaaauacaacccaucacuaaaaucaagaacaacaauaucaguagacacaucaacaaaccaacuaucacucaaacuaucauucguaacagcagcagacacagcaguauacuucugcgcaagaacaggaucagaaucaacaacaggauacggaauggacguauggggacaaggaacaacaguaacaguaucauca

SEQ ID NO: 50800 - RNA, 363 nt, Artificial Sequence
  derived and/or modified sequence opt6 from anti-influenza_Chain
gaaguacaauuaguagaaaguggagcagaaguaaaaaaaccaggaaguaguguaaaaguaaguuguaaagcaaguggaggaccauuuagaaguuaugcaauaaguuggguaagacaagcaccaggacaaggaccagaauggaugggaggaauaauaccaauauuuggaacaacaaaauaugcaccaaaauuucaaggaagaguaacaauaacagcagaugauuuugcaggaacaguauauauggaauuaaguaguuuaagaagugaagauacagcaauguauuauugugcaaaacauaugggauaucaaguaagagaaacaauggauguauggggaaaaggaacaacaguaacaguaaguagu

SEQ ID NO: 50801 - RNA, 363 nt, Artificial Sequence
  derived and/or modified sequence opt6 from anti-influenza_Chain
caaguacaauuaguacaaagcggagcagaaguaaaaaaaccaggaucaagcguaaaaguaagcuguaaagcaagcggaggaccauucagaagcuaugcaauaagcuggguaagacaagcaccaggacaaggaccagaauggaugggaggaauaauaccaauauucggaacaacaaaauaugcaccaaaauuucaaggaagaguaacaauaacagcagacgauuucgcaggaacaguauauauggaauuaucaagcuuaagaagugaagauacagcaauguauuacugugcaaaacacaugggauaucaaguaagagaaacaauggacguauggggaaaaggaacaacaguaacaguaucaagc

SEQ ID NO: 50802 - RNA, 363 nt, Artificial Sequence
  derived and/or modified sequence opt6 from anti-influenza_Chain
gaaguacaauuaguagaaacaggagcagaaguaaaaaaaccaggagcaaguguaaaaguaaguuguaaagcaaguggauauacauuuacaaguuauuauaugcauuggguaagacaagcaccaggacaaggauuagaauggaugggauggauaaauccaaauaguggaggaacaaauuaugcacaaaaauuucaaggaagaguaacaaugacaagagauacaaguauaaguacagcauauauggaacuaaguagauuaagaagugaugauacagcaguauauuauugugcaagagaaggaaaauggggaccacaagcagcauuugauauauggggacaaggaacaaugguaacaguaaguagu

SEQ ID NO: 50803 - RNA, 363 nt, Artificial Sequence
  derived and/or modified sequence opt6 from anti-influenza_Chain
gaaguacaauuaguagaaaguggagcagaaguaaaaaaaccaggaaguaguguaaaaguaaguuguaaagcaaguggaggaacauuuaguuuuuauaguaugaguuggguaagacaagcaccaggacaaggauuagaauggaugggaggaauaauaccaauguuuggaacaacaaauuaugcgcaaaaauuucaaggaagaguaacaauaacagcaguagaaaguacaaguacagcauauauggaaguaaguaguuuaagaagugaagauacagcaguauauuauugugcaagaggagauaaaggaauauauuauuauuauauggauguauggggaaaaggaacaacaguaacaguaaguagu

SEQ ID NO: 50804 - RNA, 363 nt, Artificial Sequence
  derived and/or modified sequence opt6 from anti-influenza_Chain
gaaguacaauuaguagaaacaggagcagaaguaaaaaaaccaggaaguaguguaaaaguaaguuguaaagcaagcggaggaacauuuagaacacaugcaauaaguuggguaagacaagcaccaggacaaggauuagaauggaugggaggaauaauagcaauauuuggaacagcaaauuaugcacaaaaauuucaaggaagaauaacaauaacagcagaugaaaguacaaguacagcauauauggaauuaaguaguuuaagaagugaagauacagcaguauauuuuugugcaagaggaaguggauaucauauaaguacaccauuugauaauuggggacaaggaacauuaguaacaguaaguagu

SEQ ID NO: 50805 - RNA, 363 nt, Artificial Sequence
  derived and/or modified sequence opt6 from anti-influenza_Chain
gaaguacaacuaguacaaucaggagcagaaguaaaaaaaccaggaaguucaguaaaagucaguugcaaagcaucaggaggaauauuuagaucaaauucaauaucauggguaagacaagcaccaggacaaggauuagaauggaugggaggaauauucgcacuauuuggaacaacagauuacgcacaaaaauuccaaggaagaguaacaauaacagcagaugaaucgaguacaacaguauacuuagaauuaagcucacuaacaagcgaagacacagcaguauacuauugcgcaagaggaagcggauacacaacaagaaauuauuucgauuacuggggacaaggaacacuaguaacaguaaguuca

SEQ ID NO: 50806 - RNA, 363 nt, Artificial Sequence
  derived and/or modified sequence opt6 from anti-influenza_Chain
gaaguacaacuaguagaaucaggagcagaaguaaaaaaaccaggaaguucaguaaaaguaucaugcaaagcaucaggaggaauauuuaacucauacgcaauaucauggguaagacaagcaccaggacaaggauuagaauggaugggaggaauaauagcaauauuucacacaccaaaauacgcacaaaaauuccaaggaagaguaacaauaacagcagaugaaucaacaaauacagcauacauggaauuaagaucacuaaaaagcgaagacacagcauuauacuauugcgcaagaggaagcacauacgauuucucaagcggacuagauuacuggggacaaggaacacuaguaacaguaagcuca

SEQ ID NO: 50807 - RNA, 363 nt, Artificial Sequence
  derived and/or modified sequence opt6 from anti-influenza_Chain
caaguacaacuaguacaaucaggagcagaaguaaaaaaaccaggaagcucaguaaaaguaucaugcaaaagcucaggaggaaacuuuaacaauuacgcaguaucauggguaagacaagcaccaggacaaggauuagaauggaugggaggaauaagcccaauauuuggaucaacaaaucacgcacaaaaauuccaaggaagaguaacaauaucagcagauauauuuacaaauacagcauacauggaauuaagcucacuaagaagugaugacacggcaauauacuauugcgcaagaggaagaggauacuauuucuaucacgcaauggauguauggggacaaggaucaacaguaacaguaagcuca

SEQ ID NO: 50808 - RNA, 363 nt, Artificial Sequence
  derived and/or modified sequence opt6 from anti-influenza_Chain
caaguacaauuaguacaaaguggagcagaaguaaaaaaaccaggaaguaguguaaaaguaaguuguaaagcaaguggaggaacauuuaauaauuaugcaauaaauuggguaagacaagcaccaggacaaggauuagaauggaugggaggaauaaguccaauauuuggaaguguaaauuaugcacaaaaauuacaaggaagaguaacaauaacagcagauguauuuacaaguacagcauauauggaauuaaguaguuuaagaagugaagauacagcaguauauuauugugcaaaaggaaguggauauuauuauuauuauggauuagauguauggggauuaggaacaacaguaacaguaaguagu

SEQ ID NO: 50809 - RNA, 363 nt, Artificial Sequence
  derived and/or modified sequence opt6 from anti-influenza_Chain
caaguacaauuaguagaaagcggaggaggaguaguacaaccaggaaggaguuuaagauuaaguugugcagcaaguggauuuacauuuacaaauuaugcaaugcauuggguaagacaagcaccaggaaaaggauuagaauggguagcaguaauaaguuuugaugaagauaauaaaaguuaugcagauuauguaaaaggaagauuuacaauaaguagagauaauaguaauaauagauuauaucuacaaaugaauaguuuaagagcagaagauacagcaguauauuauugugcaaggggaccagaaggaguauggggaagaaguauagauaguuggggacaaggaacauuaguaacaguaaguagu

SEQ ID NO: 50810 - RNA, 363 nt, Artificial Sequence
  derived and/or modified sequence opt6 from anti-influenza_Chain
caaguccaauuaguacaaucaggaggagaccuaguacaaccaggaggaucacuaagacuaucaugcgcagcaucaggauuuacauuuagcagauacucaaugaauuggguaagacaagcaccaggaaugggauuagaauggguagcauacauaagcgauacaucaagaacaauauauuacgcagacucaguaaaaggaagauucacaauaucaagagauaacgccaaaaauagcuuauacuuacaaaugaaaucacuaagagacgaagacacagcaguauacuauugcgcaagagauccagauacaccauucguaagagcauucgauagcuggggacaaggaacauuaguaacaguaagcuca

SEQ ID NO: 50811 - RNA, 363 nt, Artificial Sequence
  derived and/or modified sequence opt6 from anti-influenza_Chain
caaguacaauuaguagaaaguggaggaggauuaguacaaccaggaggaaguuuaagauuaaguuguguagcaaguggauuuacauuuaguagauuuaguaugaauuggguaagacaagcaccaggaaugggauuagaauggguaaguuauauaagugauacaggaagaacaauauauuaugcagauaguguaaaaggaagauuuacaauaaguagagauaaugauaaaaauacauuauauuuacaaaugaaaaguuuaagagaugaagauagugcauuuuauuauugugcaagagauccagauacaccauuuguaagagcauuugauaguuggggacaaggaguauuaguaacaguaaguagu

SEQ ID NO: 50812 - RNA, 363 nt, Artificial Sequence
  derived and/or modified sequence opt6 from anti-influenza_Chain
caaguacaauuacaagaaagcggaccagaucuaguaaaaccaggagcaaguguaaaaaugagcuguaaagcaagcggauacucauuuacauacuaucauaugcacuggguaaaacaaacacacggaaaaucacuagaauggauaggaagaauauauccauauaacggaggaacaaacuauagucaaagauuuaaaggaaaagcaguauuuacaguagauaugagcucaagcacagcauauauggaacuaagaaguuuaacaucagaagauagcgcaguauauuacugugcaagagacgcaaacuaugaaggagacugguauuuugacguauggggacaaggaacaacaguaacaguaucaagc

SEQ ID NO: 50813 - RNA, 366 nt, Artificial Sequence
  derived and/or modified sequence opt6 from anti-influenza_Chain
caaggacaacuagugcaaucaggagcagaaguaaaaaaaagcggaagcucaguaaaaguaucaugcaaaacaucaggaggaacauuuaacucacacgcaauaucauggguaagacaagcaccaggacaaggauuagaauggauaggaggaauaauaccaauguuuggaacaacaaauuacgcacaaaaacuaaaaggaagaauagcaauaacagcagaucaauuaccaacaacagcauacuuagaauuaagcucacuaagaagcgaagacacagcaguauacuauugcgcaagaggacaaagauacuauuacgauagagauggaauggacguauggggacaaggaacaaugguaacaguaucaagu

SEQ ID NO: 50814 - RNA, 366 nt, Artificial Sequence
  derived and/or modified sequence opt6 from anti-influenza_Chain
caaguacacuuaguacaaagcggagcagaaguaaaaaaaccaggaucaagcguaagauuaagcuguagcgcaagcggaggaccauucucaggauuugcaauaagcuggcuaagacaagcaccaggucaaggacuagaaugguuaggaggaauaucggcaguauucggaacagcaacauaugcacaaaaauuucaaggaagaguaacaauaacagcagaccaauucacaagcacaagccauauggauuuaucaagauuaacauaugacgauacagcaguauauuacugugcaagaagcggaggauaucuaccacaaaauaacuggauagauccauggggacaaggaacacuaguaauaguaagcuca

SEQ ID NO: 50815 - RNA, 366 nt, Artificial Sequence
  derived and/or modified sequence opt6 from anti-influenza_Chain
caaguacaauuaguacaaucaggagcagaaguaaaaaaagcaggaaguucaguaaaaguaaguugucaaaguaguggaguaacauuuaguauguaugcaguaaguuggguaagacaagcaccaggacaaggauuagaauggaugggaggaauaauaccauuauuuggaacaacaacauaugcacaaaaauuugaaggaagauuaacaauaacagcagauacaaguacaaauauggcauauuuagaauuaagaaguuuaagaagugaagauacagcaguauauuuuugugcaagagcaggaacaacaguaacaagauuuaauugguuugauccauggggacaagggacauuaguaacaguaucaagu

SEQ ID NO: 50816 - RNA, 366 nt, Artificial Sequence
  derived and/or modified sequence opt6 from anti-influenza_Chain
caaguacaauuaguacaaagcggagcagaaguaaaaaaaccaggaucaagcuuaaaaguaagcuguaaagcaagcggaguaacauucucaauguauacaauaagcuggguaagacaagcaccaggacaaggacuagaauggaugggaggaauaauaccauuauucggaacagcaaauuaugaacaaaaauuucaaggaagaguaacaauaacagcagacacaagcacaaacacagcauauauggaauuaucaagcuuaagaucagaagauacagcaguauauuacugugcaagagcagggacaacauuaacaagauuuaacugguucgauccauggggacaaggaacacuaguaacaguaaguuca

SEQ ID NO: 50817 - RNA, 366 nt, Artificial Sequence
  derived and/or modified sequence opt6 from anti-influenza_Chain
auggcagacaacaugacaacaacacaaauagaauggagaaugaaaaaaauggcaauaggaucaagcacacacucaagcucgguauuaaugaaagacauacaaucacaauucgaacaacuaaaacuaagaugggaaagcuacccaaacuuaguaaaaucaacagacuaccaccaaaaaagagaaacaauaagacuagcaacagaagaacuauaccuacuaagcaaaagaauagacgacagcauacuauuccacaaaacaguaauagcaaacucaucaauaauagcagacaugauaguaagccuaagccuacuagaaacacuauacgaaaugaaagacguaguagaaguauacagcagacaaugccua

SEQ ID NO: 50818 - RNA, 366 nt, Artificial Sequence
  derived and/or modified sequence opt6 from anti-influenza_Chain
gaaguacaauuaguacaaaguggaggaggacuaguacaaccaggaggaaguuuaagauuagcauguguaguaagcggauuuacaguaacaaguaauuauauaacauggguaagacaagcaccaggaaaaggauuagaauggguaaguguaauauauagucauggaagagcauauuauagugcaaguguaaauggaagauuuacaauaaguagacauacaaguaaaaauacaguauauuuagaaaugaauaguuuaagaccagaagauacagcaguauauuauugugcaggaggaggauuaguaggaggauaugaugaauauuuuuuugauuauuggggacaaggaacauuagcaacaguaaguagu

SEQ ID NO: 50819 - RNA, 366 nt, Artificial Sequence
  derived and/or modified sequence opt6 from anti-influenza_Chain
caaguacaauuaguacaaucaggagcagaaguaaaaaaaccaggagcaucaguaaaaguaucauguaaagcaucaggauacacauucacaggauauuacaugcacuggguaagacaagcaccaggacaaggacuagaauggaugggauggauaaauccaaauucaggagacacaaacuacgcacaaaaauuucaaggaagaguaacaaugacaagagacacaucaauaacaacagcauauauggaacuaucaucacuaagaucagacgacacagcaguauauuacugugcaagagacucaccauauucaucaucauggucauuuuucgacuacuggggacaaggaccauuaguaacaguaucauca

SEQ ID NO: 50820 - RNA, 366 nt, Artificial Sequence
  derived and/or modified sequence opt6 from anti-influenza_Chain
gaaguacaauuaguagaaaguggaggaggauuaguacaaccaggaggaaguuuaagauuaaguugugcagcaaguggauuuauauuuagaaauuauuggaugaguuggguaagacaagcaccaggaaaaggauuagaauggguagcaaauauaaaacaagauggaagagaaaaauauuauguagauaguuuaagaggaagaguaaauauaaguagagauaaugcagaaaauaguuuauauuuacauaugaauaguuuaagaguagaagauacagcaguauauuuuugugcaagagcaagaaugguaguaguaacaggagauggauuugauguauggggacauggaacaaugguaacaguaaguagu

SEQ ID NO: 50821 - RNA, 366 nt, Artificial Sequence
  derived and/or modified sequence opt6 from anti-influenza_Chain
gaaguacaauuauuagaaaguggaggaggauuaguacaaccaggaggaagucuaagauuaagcugugcagcaagcggauucgcauucucaagcuauggaaugaguuggguaagacaagcaccaggaaaaggacuagaauggguaagcgcauucucaggaucaggaacaaguacauauuaugcagauaguguaaaaggaagauuuacaauaaguagagauaaaaguaaaaauacacuauauuuacaaaugaauaguuuaagagcagaagauacagcaauauauuacugugcaaaaccaccaggaccauacauaguaguagcaggacuauuugaaaauuggggaagaggaacauuaguaacaguauca

SEQ ID NO: 50822 - RNA, 366 nt, Artificial Sequence
  derived and/or modified sequence opt6 from anti-influenza_Chain
gaaguacaauuaguagaaaguggaggaggaguaguacaaccaggaagaaguuuaagauuaaguugugcagcaucaggauuuaguuuuagcaauuaugcaaugcauuggguaagacaagcaccaggaaaaggauuagaauggguagcauuaauaaguuuugauggaagugauaaauauuaugcagauaguguaaaaggaagauuuacaaugaguagagauaauaguaaaaauacauuauauuuacaaaugaauaguuuaagagcagaagauacagcaguauauuauugugcaagagaugaaccauauuguggaggagauuguuuugcauuugauguauggggacaaggaacaaugguaacaguaagu

SEQ ID NO: 50823 - RNA, 366 nt, Artificial Sequence
  derived and/or modified sequence opt6 from anti-influenza_Chain
caaguacaacuacaacaaagcggaccaggauuaguaaaaccaagccaaacauuaagccuaacauguacaguaagcggaggaccgguaucaggaggaggauauagcuggaacuggauaagacaaagaccaggacaaggacuagaauggguaggauuuauguuucacucaggaucaccaagauacaauccaacacuaaaaaguagaauaacaauaucaguagauacaagcaaaaaucuaguaucauuaaaauuaagcaguguaacagcagcagacacagcaguauacuuuugcgcaagaguaggacaaauggauaaauauuacgcaauggauguauggggacaaggaacaacaguaacaguaagcuca

SEQ ID NO: 50824 - RNA, 366 nt, Artificial Sequence
  derived and/or modified sequence opt6 from anti-influenza_Chain
caaguacaauuaguacaaagcggaggaggauuaguaaaaccaggaggaaguuuaagauuaaguugugcagcaaguggauuuacauuuaguaguuauaguaugaauuggguaagacaagcaccaggaaaaggacuagaauggguaaguaguauaaguaguaguaguaguuauauauauuauguagauaguguaaaaggaagauuuacaauaaguagagacaaugcaaaaaauagcuuauauuuacaaaugaauaguuuaagagcagaagauacagcaguauauuauugugcaagaggaggaggaaguuauggagcauaugaaggauuugauuauuggggacaaggaacauuaguaacaguaaguagu

SEQ ID NO: 50825 - RNA, 366 nt, Artificial Sequence
  derived and/or modified sequence opt6 from anti-influenza_Chain
caaguacaauuaguacaaagcggaggaggaguaguacaaccaggaagaagccuaagauuaagcugugcagcaagcggauucaauuucucaagcuauggaaugcacuggguaagacaagcaccaggaaaaggacuagaaugguuaagcguaauauggagcggaggaucaaacaaauacuaugcagauagcguaaaaggaagauuuacaauaagcagagacgauagcaaaaacacaguauaucuacaaaugaauagcuuaagagaugaagauacagcaguauauuacugugcaagagcacauacagcacuaacaagauuuagauggcuagauccauggggacaaggaauauuaguaacaguaagcuca

SEQ ID NO: 50826 - RNA, 366 nt, Artificial Sequence
  derived and/or modified sequence opt6 from anti-influenza_Chain
caaguacaauuaguacaaagcggaggaggaguaguacaaagaggaagaaguuuaagauuaaguugugcagcaaguggauuuacauuuagaacauauggaaugcauuggguaagacaagcaccaggaaaaggauuagaauguguagcauuaauaaguuaugauggaacaaauaaauauuaugcagauaguguaaaaggaagauuuacuauaaguagagauaauaguaaagauacauuauauuuacaaaugaauaguuuaagagcagaagauacgggaguauauuauugugcaaguuuagauuaugauuuuaguuauuauuaucauagagauguaugggggccaggaacaacaguaacaguaaguagu

SEQ ID NO: 50827 - RNA, 366 nt, Artificial Sequence
  derived and/or modified sequence opt6 from anti-influenza_Chain
caaguacaauuaguagaaaguggaggaggguuaguacaaccaggaggaaguuuaagauuaaguugugcagcaaguggauuuacauuuagugauuauuggaugguauggguaagacaagcaccaggaaaaggauuaguauggguaaguagaauaaguagugauggaucaacaacaaguuaugcagauaguguaaaaggaccauuuacaauaagcagagauaaugcaaaaaauacauuauauuuacaaaugaauaguuuaagagcagaagauacagcaguauauuauugugcaagaguagcaacaccauauuauuaugaaagcggauuugauuauuggggacaaggagcauuaguaacaguaaguagu

SEQ ID NO: 50828 - RNA, 369 nt, Artificial Sequence
  derived and/or modified sequence opt6 from anti-influenza_Chain
caauuccaacuaguacaaucaggaccagaaguaaaaaaaccaggaacaucaguaaaaguaucaugcaaagcaucaggauacacaucaacaacauacggaauaucauggguaagacaaguaccaggacaaggccuagaauggaugggauggauaaacccauacaacggaaacccacacuacggacaaaaauuccaaggaagaguaacacuaacaagagacacaucaacaaacacagcauaccuagaaauacuaucacuaagaucagacgacacagcaguauacuacugcgcaagagacggauggggacaacaacuaguaccauacuacuucgacuacuggggacaaggaacacuaguaacaguaucauca

SEQ ID NO: 50829 - RNA, 369 nt, Artificial Sequence
  derived and/or modified sequence opt6 from anti-influenza_Chain
caaguacaauuagcacaaagcggagcagaaguaaaaagaccaggaaguaguguaaaaguaaguuguacagcaagcggaggaauauuuagaaaaaaugcaauaaguuggguaagacaagcaccaggacaaggauuagaauggaugggaggaauaauagcaguauuuaauacagcaaauuaugcacaaaaauuucaaggaagaguaaaaauaacagcagaugaaagcggaaauacagcauauauggaauuaaguaguuuaagaagugaugauacagcaguauauuauugugcaagucauccaaaauauuuuuauggaaguggaaguuauccagauuuuuggggacaaggaacauuaguaacaguaaguagu

SEQ ID NO: 50830 - RNA, 369 nt, Artificial Sequence
  derived and/or modified sequence opt6 from anti-influenza_Chain
caaguacaauuacaagaaagcggaccaggauuaguaaaaccaagcgaaacacuaagccuaacaugcacaguaagcagaggaucaauaggacacuacuucuggagcuggauaagacaaccaccaggaaaaggacuagaauggauaggauacauaucauacucaggaucaacaaaauacaacccaucacuaagaagcagaguaacaauaucaguagacacaagcaaaaaccaauucucacuaaaccuaaacucaguaacagcaacagacacagcacuauacuacugcgcaagagaagacuacgacauacuaacaggagcaggaccaggaauggaaguauggggacaaggaacaacaguaacaguaucaagc

SEQ ID NO: 50831 - RNA, 369 nt, Artificial Sequence
  derived and/or modified sequence opt6 from anti-influenza_Chain
caaguacaacuacaagaaucaggaccaggacuaguaaaaccaucagaaacacuaucauuaacaugcacaguaucaggagcaucaauaaacucacacuacuggucauggauaagacaaccaccaggaaaaggacuagaauggauaggauacguauacuacagcggaagcacaacauacaacccaucacuaaaaucacgaguaacacuaucaguagacacaucaaaaaaccaauucucacuaaaccuaucaucaguaacagcagcagacacagcauucuacuacugcgcaagacacccauacgacguacuaacaggaucaggagacugguucgacccauggggacaaggaacacuaguaacaguaucauca

SEQ ID NO: 50832 - RNA, 369 nt, Artificial Sequence
  derived and/or modified sequence opt6 from anti-influenza_Chain
caaguacaacuaguacaaucaggagcagaaguaaaaagaccaggaagcucaguaaaaguaucaugcacagcaucaggaggaauauuuagaaaaaacgcaauaucauggguaagacaagcaccaggacaaggauuagaauggaugggaggaauaauagcaguauuuaacacagcaaauuacgcacaaaaauuccaaaacagaguaaaaauaacagcagaugaaucaggaaauacagcauacauggaauuaagcucacuaacaagugaugacacagcaguauacuauugcgcaagucauccaaaauacuuuuacggaagcggaagcuauccagauuucuggggacaaggaacauuaguaacaguaagcagu

SEQ ID NO: 50833 - RNA, 369 nt, Artificial Sequence
  derived and/or modified sequence opt6 from anti-influenza_Chain
gaaguacaauuaguagaaaguggagcagaaguaaaaaaaccaggaaguagcguaaaaguaaguuguaaagcaaguggaggaacauuuagaaguuaugcaguaaguuggguaagacaagcaccaggacaaggauuagaauggaugggaggaauaauagcaauauuuggaacaacaaauuaugcacaaaaauuucaagauagaguaacaauaacagcagaugaucuaccaaguacagcauauauggaauuaacaaguuuaagaagugaagauacagcaguauauuuuuguguaagaggaagaggauauuauuuaggaggagauuauggaaguuuagauaguuggggacaaggaacauuaguaacaguaagu

SEQ ID NO: 50834 - RNA, 369 nt, Artificial Sequence
  derived and/or modified sequence opt6 from anti-influenza_Chain
gaaguacaauuaguagaaaguggaggaggacuaguacaaccaggaagaaguuuaagauuaaguuguguaggaaguggauuuaauuuugauggauaugcaaugcaauggguaagacaaguaccaggaaaaggauuagaauggguaaguggaauaaguuggcauagugauaguacaggauaugcagauagugugagaggaagauuuacaauaaguagagauaaugcaaaaaauagucuauauuuacaaauggauaguuuaagaccagaagauacagcauuuuauuauuguggaaaaaguauaggacauguaggaggaaguuauagacauccaauagauuauugggggcaaggaacauuaguaacaguaagu

SEQ ID NO: 50835 - RNA, 369 nt, Artificial Sequence
  derived and/or modified sequence opt6 from anti-influenza_Chain
caaguacaauuacaagcaucaggaccaggauuaguaaaaccaucagaaacacuaucacuaacaugcacaguaucaggagacucaauaacaucaggagcauacuacuggacauggauaagacaacacccaggaaaaggacuagaauggauaggauacauauacuacucaggaaacacauacuauaacccaucacuaaaaucaagaguaacaauaucacuagacacaagcaaaaaccaauucucacuaaaaguaaacucaguaacagcagcagacacagcaguauacuacugcgcaagagcagcaucaacaucaguacuaggauacggaauggacguauggggacaaggaacaacaguaacaguaucauca

SEQ ID NO: 50836 - RNA, 369 nt, Artificial Sequence
  derived and/or modified sequence opt6 from anti-influenza_Chain
caaguacaauuaguacaaaguggagcagaaguaaaaaaaccaggaaguaguguaagaguaaguuguaaagcaaguggaaguauauuuagaaauuaugcaaugaguuggguaagacaagcaccaggacaaggauuagaauggaugggaggaauaauagcaauauuuggaacaccaaaauaugcacaaaaauuucaaggaagaguaacaauaacagcagaugaaaguacaaguacaguauauauggaacuaaguggauuaagaagugaagauacagcaauguauuauugugcaagaauaccacauuauaauuuuggaaguggaaguuauuuugauuauuggggacaaggaacauuaguaacaguaaguagu

SEQ ID NO: 50837 - RNA, 369 nt, Artificial Sequence
  derived and/or modified sequence opt6 from anti-influenza_Chain
caacuacaauuacaagaaucaggaccaagacuaguaaaaccauccgaaacacuaucacuaacaugcucaguaucaggaguaucaauaucaucaucaaacuacuacuggggauggauaagacaaccaccaggaaaaggacuagaauggauaggaacaauauaccacucaggaucaacauacuacaacccaucacuaaaaucaagacuaauaauaucaguagacacaucaaaaaaccaauucuaccuacaacuaacaucacuaacagcagcagacucagcaguauacuacugcgcaacaggaggaggauucggauggucacaaacauacuucggauacuggggacaaggaacacuaguaacagcaucauca

SEQ ID NO: 50838 - RNA, 369 nt, Artificial Sequence
  derived and/or modified sequence opt6 from anti-influenza_Chain
gaaguacaauuacaacaaagcggaccagaauuaguaaaaccaggagcaagcguaaaaaugagcuguaaagcaaguggauacacauucacaucauuuauaauguacuggguaaaacaaaaaccaggacaaggacuagaauggcuaggauauauagauccauauaacgauggaacgaaauauaacgaaaaauuugaaggaaaagcaacacuaacaucagacaaaaguucaaguacagcauauauggaacuaagcagcuuaacaucagaagauagcgcaguauauuacugugcaaaaagaggaaacuauggaaauggauuugcauauuggggacaaggaacauuaguaacaguaucagcagcaaaaacaagc

SEQ ID NO: 50839 - RNA, 369 nt, Artificial Sequence
  derived and/or modified sequence opt6 from anti-influenza_Chain
caaguacaauuauuagaaaguggaggagauguaguacaaccaggaacaaguuuaagauuaagcugugcagcaaguggauuuaguuuauggacaaguggaaugcauuggguaagacaagcaccaggaaaaggauuagaauggguagcaguaaugaguuaugaugaaacaaaaaaauauuaugcagauaguguaagaggaagauuuaguauaaguagagauaauaguagaaauacauuauauuuacaaaugaauagccuaagaguagaagauacagcaguauauuucugugcaaaaccaagauuagauuauuuagauuauuuucaugcagcagauucauggggacaaggaacauuaguaaguguaaguagu

SEQ ID NO: 50840 - RNA, 369 nt, Artificial Sequence
  derived and/or modified sequence opt6 from anti-influenza_Chain
caaguacaauuaguagaaucaggagcagaaguaagaaaaccaggagaaucacuaagaauaucaugcaaagcacauggagauagcuuuacaucauacuggauaggauggguaagacaacuaccaggaaaaggacuagaauggauggcaguaauauacccaagagauagcgaaacaaaauucucaccagcauuccauggacaaguaucaauaucaguagauaaaucaacaucaacaguacacuuacaauggaacucacuaaaagcaucugacacagcaguauacuauugcgcaagaucaccaggauacucaggauaucuauauggaugguucgauccauggggacaaggaacaccaguaacaguaagcuca

SEQ ID NO: 50841 - RNA, 369 nt, Artificial Sequence
  derived and/or modified sequence opt6 from anti-influenza_Chain
caaguacaauuaguagaaucaggaccaggauuaguaaaaccaucagaaacacuaucacuaacaugcacaguaucaggagauagcguaauaaauagcgcauacuauugggauuggauaagacaaccaccaggaaaaggauuagaauggguaggaagcguauacuauaguggaauaacauacuauaacccaaguuuaaaaagcagaguaacaauaagcguagauacaagcaaaaaccaauucucacuaagacuaucauacguaacagcagcagauacagcacuauauuacugugcaagaagaggaggaggauggcaauacuauuacggaauggauguauggggacaaggaacaacaguaacaguaagcuca

SEQ ID NO: 50842 - RNA, 369 nt, Artificial Sequence
  derived and/or modified sequence opt6 from anti-influenza_Chain
caaguacaauuaguacaaagcggagcagaaguaaaaaaaccaggagcaagcguaaaaguaaguuguaaagcaagcggauacauauucacaggauauuacauacacuggguaagacaagcaccaggacaaggacuagaauggaugggaagaauagauccaaauggaucaggaacaacauaugcacaaaaauuucaaggaagaguaacauuaacaauggacacaaguauaacaacagcauauauggaacuaucaagauuaagauuugacgauacagcaauauauuacugugcaagaugggauuggaauuucgauuuauaucuaggaugguuugacccauggggacaaggaacaccaguaacaguagcaagc

SEQ ID NO: 50843 - RNA, 369 nt, Artificial Sequence
  derived and/or modified sequence opt6 from anti-influenza_Chain
gaaguacaauuaguacaaagcggagcagaaguaaaaaaaccaggagcaaguguaaaaguaagcuguaaagcaagcggauauauauucacaggauauuacauacacuggguaagacaagcaccaggacaaggacuagaauggaugggaagaauagauccaaauggagcaggaacaacauaugcacaaaaauuucaaggaagaguaacauuaacaauggacacaaguauaacaacagcauauauggaauuaucaagauuaagauuugacgauacagcaauauauuacugugcaagaugggauuggaauuucgauuuauaucuaggaugguuugacccauggggacaaggaacaccaguaacaguagcaagu

SEQ ID NO: 50844 - RNA, 369 nt, Artificial Sequence
  derived and/or modified sequence opt6 from anti-influenza_Chain
caaguacaauuaguacaaagcggagcagaaguaaaaaaaccaggagcaaguguaaaaguaaguuguaaagcaaguggauauacauuuaaugcacaucauaugcauuggguaagacaagcaccaggacaaggacuaggauggaugggauggauagauccaaauaaugauggaacaauauaugcacaaaaauuucaaggaagaguaacauuaacaauggauacaaguauacauacagcauauauggaauuaucaggauuaagauaugaugauacagcaauauauuauuguguaagaugggcauggaauuuugauuuuuuuuuaggaugguuugauccauggggacaaggaacauuaguaacaguagcaagu

SEQ ID NO: 50845 - RNA, 369 nt, Artificial Sequence
  derived and/or modified sequence opt6 from anti-influenza_Chain
gaaguacaacuaguacaaucaggagcagaaguaaaaaaaccaggagaaucauuaaaaauaucaugcaaaguaucaggauauagcuuuacaucacaauggauaggauggguaagacaaaugccaggaaaaggauuagaauggauaggaaugauguacccaggagauagcgauacaauauacucaccaucauuccaaggacaaguaacaauaucagcagauaacucaauaucaacagcauacuuacaauggagcucacuaaaagcaucagacacagcaauauacuauugcgcaagcggaccaggauacucaggauaucacuauggaugguucgauacauggggacaaggaacauuaguaacaguaagcuca

SEQ ID NO: 50846 - RNA, 369 nt, Artificial Sequence
  derived and/or modified sequence opt6 from anti-influenza_Chain
gaaguacaauuaguacaaaguggagcagaaguaaaaaaaccgggagaaaguuuaaaaauaaguuguaaaguaaguggauauaguuuuacaagucaauggauaggauggguaagacaaaugccaggaaaaggauuagaauggauaggaaugauguauccaggagaugcagaugcaauauauaguccaaguuuucaaggacaaguaacaauaagugcagauaauaguauaaguacagcauauuuacaauggucaaguuuaaaagcaagugauacagcaauauauuauugugcaaguggaccaggauauaguggauaucauuauggaugguuugauacauggggacaaggaacauuaguaacaguaaguagu

SEQ ID NO: 50847 - RNA, 369 nt, Artificial Sequence
  derived and/or modified sequence opt6 from anti-influenza_Chain
gaaguacaacuaguacaaucaggagcagaaguaaaaaaaccaggagaaucacuaaaaauaucaugcaaaguaucaggauauagcuuuacaucacaauggauaggauggguaagacaaaugccaggaaaaggauuagaauggauaggaaugauguacccaggagaaagcgaaacaauauacucaccaucauuccaaggacaaguaacaauaucagcagauaacucaauaucaacagcauacuuacaauggagcucacuaaaagcaucagacacagcaauauacuauugcgcaagcggaccaggauacucaggauaucacuauggaugguucgauacauggggacaaggaacacuaguaacaguaagcuca

SEQ ID NO: 50848 - RNA, 369 nt, Artificial Sequence
  derived and/or modified sequence opt6 from anti-influenza_Chain
gaagugcaauuaguacaaaguggagcagaaguaaaaaaaccaggagaaaguuuaaaaauaaguuguaaaguaaguggauauaguuuuacaagucaauggauaggauggguaagacaaaugccaggaaaaggguuagaauggauaggaaugauguauccaggagaugcagauacaauauauagcccaagcuuucaaggacaaguaacaauaagugcagauaauaguauaaguacagcauauuuacaauggaguaguuuaaaagcaagugauacagcaauauauuauugugcaaguggaccaggauauagcggauaucauuauggaugguuugauacauggggacaaggaacauuaguaacaguaaguagc

SEQ ID NO: 50849 - RNA, 369 nt, Artificial Sequence
  derived and/or modified sequence opt6 from anti-influenza_Chain
gaaguacaauuaguacaaucaggagcagaaguaaaaaaaccaggagaaucacuaaaaauaucaugcaaaguaucaggauauagcuuuacaucacaauggauaggauggguaagacaaaugccaggaaaaggauuagaauggauaggaaugauguacccaggaucaagcgauacaauauacucaccaucauuccaaggacaaguaacaauaucagcagauaacucaauaucaacagcauaccuacaauggagcucacuaaaagcaucagacacagcaauauacuauugcgcaagcggaccaggauacucaggauaucacuauggaugguucgauacauggggacaaggaacacuaguaacaguaagcuca

SEQ ID NO: 50850 - RNA, 369 nt, Artificial Sequence
  derived and/or modified sequence opt6 from anti-influenza_Chain
gaaguacaauuaguacaaaguggagcagaaguaaaaaaaccaggagaaaguuuaaaaauaagcuguaaaguaaguggauauagcuuuacaagucaauggauaggauggguaagacaaaugccaggaaaaggauuagaauggauaggaaugauguauccaggagauagugaugcaauauauaguccaaguuuucaaggacaaguaacaauaagugcagauaauaguauaaguacagcauauuuacaauggaguaguuuaaaagcaagugauacagcaauauauuauugugcaaguggaccaggauauaguggauaucauuauggaugguuugauacauggggacaaggaacauuaguaacaguaaguagu

SEQ ID NO: 50851 - RNA, 369 nt, Artificial Sequence
  derived and/or modified sequence opt6 from anti-influenza_Chain
gaaguacaauuaguacaaaguggagcagaaguaaaaaaaccaggagaaagucuaaaaauaaguuguaaaguaaguggauauaguuuuacaagucaauggauaggauggguaagacaaaugccaggaaaaggauuagaauggauaggaaugauguauccaggagauacagauacaauauauaguccaaguuuucaaggacaaguaacaauaagugcagauaauagcauaaguacagcauauuuacaauggaguaguuuaaaagcaagugauacagcaauauauuauugugcaaguggaccaggauauaguggauaucauuauggaugguuugauacauggggacaaggaacauuaguaacaguaaguagu

SEQ ID NO: 50852 - RNA, 369 nt, Artificial Sequence
  derived and/or modified sequence opt6 from anti-influenza_Chain
gaaguacaacuaguacaaucaggagcagaaguaaaaaaaccaggagaaucauuaaaaauaucaugcaaaguaucaggauauagcuuuacaucacaauggauaggauggguaagacaaaugccaggaaaaggauuagaauggauaggaaugauguacccaggagaaagugauacaauauacucaccaucauuccaaggacaaguaacaauaucagcagauaacucaauaucaacagcauaccuacaauggagcucacuaaaagcaagugacacagcaauauacuauugcgcaagcggaccaggauacucaggauaucacuauggaugguucgauacauggggacaaggaacacuaguaacaguaagcuca

SEQ ID NO: 50853 - RNA, 372 nt, Artificial Sequence
  derived and/or modified sequence opt6 from anti-influenza_Chain
caaguacaauuaguacaaagcggagcagaaguaaaaaaaccaggaucaagcguaaaaguaagcuguaaagcaagcggaggaauauucauaagucaagcaauaaguuggguaagacaagcaccaggacaaggacuagaauggaugggaggaauaauaccaauguucggagcaacaaacuaugcacaaaaauuucaaggaagaguaacaauaacagcagacaaaagcacaaacacaguauauauggaacuaucaagccuaacaucagaagauacagcaguauauuacugugcaagacuaggaagcggaaguuaucacaauggaccaaacugguucgauccauggggacaaggaacacuaguaacaguaaguuca

SEQ ID NO: 50854 - RNA, 372 nt, Artificial Sequence
  derived and/or modified sequence opt6 from anti-influenza_Chain
caaguacaauuacaagaaagcggaccaggauuaguaaaaccaagcgaaacauuaagccuaaacugugcaguaaguggaggaucaauaucaaacuauuacuggagcuggauaagacaaccaccaggaaaaggacuagaauggauaggauauauaucauacaauggaagaccaaaauacaauccaucacuaacaagcagaguaacaauaucaguagauacaucaaaagaucaauuuagcuuagaauuaagaucaguaacagcagcagacacagcacuauacuauugcgcaagagaaacaagauucggagaauuacuaucaccauaugacgcauucgaaauauggggacaaggaacaaugguaacaguaaguuca

SEQ ID NO: 50855 - RNA, 372 nt, Artificial Sequence
  derived and/or modified sequence opt6 from anti-influenza_Chain
caaguacaauuacaagaaagcggaccaggauuaguaaaaccaagcgaaacacuaucauuaacauguacaguaaguggaggaucaguaucaagcgaaacauauuacuggagcuggauaagacaaccaccaggaaaaggacuagaauggauaggauauauauauuacauaggaaauacagauuacagaccaucacuaaaaaguagaguaacaauaucacuagauacaagcaaaaaucaauuuagcuuaaaauuaagcucaguaacagcagcagacacagcaguauacuauugcgcaagaggagcauauuacgauagcucaggauauccagcauucuauauauggggacaaggaacaaugguaacaguaagcuca

SEQ ID NO: 50856 - RNA, 372 nt, Artificial Sequence
  derived and/or modified sequence opt6 from anti-influenza_Chain
caaguacaauuacaagaaucaggaccaggacuaguaaaaccaucagaaacacuaucacuaacaugcgcaguaucaggaguaucaauaucaaacauagacuucuacuggggauggauaagacaaccaccaggaaaaggacuagaauggauaggaaacauauacuacacaggaauaacauucuacaacccaucacuaucaucaagaguagcaauaucaauagacacaucaaaaaaccaauucucacuaacacuaacaucaguaacagcagcagacacagcaauguacuacugcgcaagacacuacggagacucagaagcaauaaacgacgcauucgacauauggggacaaggaacaauguuaacaguaucauca

SEQ ID NO: 50857 - RNA, 372 nt, Artificial Sequence
  derived and/or modified sequence opt6 from anti-influenza_Chain
caaguacaauuaguagaaagcggagcagaaguaaaaaaauuuggagcaagcguaaaaguaagcuguaaagcaaguggauacacacuaauagacuauuacaugcacuggguaagaguagcaccaggacaaggacuagaauggaugggauggauaaauccaauaaacggaggaacaaauuaugcacaaaaauuucaaggaagaguaacaaugacaagagacacaagcauaaacacagcauauauggaucuaucaaguuuaagaucagacgauacagcaauguauuacuguacaagaggaagaccaauaggaagaaacugggaaccaagagauaaagauuacuggggacaaggaacaccaguaacaguaaguuca

SEQ ID NO: 50858 - RNA, 372 nt, Artificial Sequence
  derived and/or modified sequence opt6 from anti-influenza_Chain
caaguacaacuaguacaaagcggagcagaaguaaaaaaaccaggaucaagcguaacaguaaguuguaaaacaagcggacacacauucauaagcuaugcaauaagcuggcuaagacaagcaccaggacaaggacuagaauggaugggaggaauaguaccaauauucggaacaguaaacuauacacaaaaauuucaaggaagauuaacaauaacagcagacgaaaguacaagcacagcauauauggaucuaucaagauuaacauuugaagauacagcaauauauuucugugcaagagaagcaggauaucacucaagcuuuagcggaguauauuucgauuacuggggacaaggaacacuauuaacaguaagcuca

SEQ ID NO: 50859 - RNA, 372 nt, Artificial Sequence
  derived and/or modified sequence opt6 from anti-influenza_Chain
gaaguacaauuacaacaaagcggaccagaauuaguaaaaccaggagcaagcguaaaaauaagcuguaaagcaagcggauacacauucacagacuauaacaugcacuggguaaaacaaucacuaggaaaaucacuagaauggauaggauauauauauccaaauaacggaggaacaggauauaaccaaaaauuugaaucaaaagcaacacuaacaguagacaauagcucaagcacagcauauauggaacuaagaacacuaacaucagaagacagcgcaguauauuacuguguaagaagcggagcauauuacuuuaacuaucuaguaccauauuucgauuacuggggacaaggaacaacauuaacaguaagcuca

SEQ ID NO: 50860 - RNA, 372 nt, Artificial Sequence
  derived and/or modified sequence opt6 from anti-influenza_Chain
gaaguacaauuacaacaaagcggaccagaauuaguaaaaccaggagcaagcguaaaaauaagcuguaaagcaagcggauacacauucacaggauauaacaugcacuggguaaaacaaucacacggaaaaucacuagaauggauaggaaaaauauauccaaauaacggaguaacaggauauaaccaagaauuuagaucaaaagcaacacuaacaguagacaauagcucaagcacagcauauauggaacuaagaaguuuaacaucagaagauagcgcaauauauuucuguguaagaagcggagcauauuacguaaacuaucuaguaccauauuucgauuacuggggacaaggaacaacauuaacaguaagcuca

SEQ ID NO: 50861 - RNA, 375 nt, Artificial Sequence
  derived and/or modified sequence opt6 from anti-influenza_Chain
caaguacaauuaguacaaucaggagcagaaguaaaaaaaccaggaagcucaguaaaaguaucauguaaagcaucaggaguaacaucaaguaauuacccaauaacauggguaagacaagcaccaggacaaggauuagaauggaugggaggaguauuaccacuauuuggaguaacaaauuaugcacaaaaauuccaaggaagaguaacaauaucagcagauaaaucaacaaacacagcauacauggaauuaaguucacuaagaagcgaagacacagcaguauauuauugcgcaagaggaaaaagaccaggauacuguaguggaggaguaugcucaagcgauuacuggggacaaggaacauuaguaacaguaaguuca

SEQ ID NO: 50862 - RNA, 375 nt, Artificial Sequence
  derived and/or modified sequence opt6 from anti-influenza_Chain
caaguacaacuacaagaaucaggaccaggacuaguaaaacccucacaaacacuaucacuaacaugcacaguaucaggaggaucaauaucaucaggaacauacuacuggucauggauaagacaccacccaggaaaaggacuagaauggauaggauacauauaccacucaggaucagcauacuacaacccaucacuagaaucaagaguaacaaugucaguagacacaucaaaaaaccaauucucauuaaaacuaucaucaguaacagcagcagacacagcaauauacuacugcgcaagagcagaaaaccuacuaucaccauaccuagcagaaggauucgacccauggggacaaggaacauuaguaacaguaucauca

SEQ ID NO: 50863 - RNA, 375 nt, Artificial Sequence
  derived and/or modified sequence opt6 from anti-influenza_Chain
gaaguacaauuaguacaaaguggagcagaaguaaaaaaaccaggagaaaguuuaaaaauaaguugucaagcaaguggauauaguuuuacaaguagauggauaggauggguaagacaaaugccaggaaaaggauuagaauggguaggauuuauauauccaagugauagugauguaagauauagcccaaguuuuagaggacaaguaacaauaagugcagauaaaaguauaaguacagcauauuuacaauggaguaguuuaaaagcaagugauacagcaauguauuuuugugcaagauuaggaggaaauaaagauuauggagauuauuuaugguauuuugauuuauggggaagaggagcauuaguaacaguaaguagu

SEQ ID NO: 50864 - RNA, 375 nt, Artificial Sequence
  derived and/or modified sequence opt6 from anti-influenza_Chain
caaguacaauugguagaaaguggaggaggaguaguacaaccaggaagaaguuuaagauuaaguugugcagcaaguggauuuacauuuaguaguuauggaaugcauuggguaagacaagcaccaggaaaaggauuagaauggguagcaguaauaugguaugauggagauaauaaauauuauggagauagcguaaaaggaagauuuacaauaaguagagauaauagcaaaaauacauuauuuuuacaaaugaauaguuuaagagcagaagauacagcaguauauuauugugcaaaagauacagcagaucauggagauuauguagauuuaggauuuuuugaugcauggggacaaggaacauuaguaacaguaaguagu

SEQ ID NO: 50865 - RNA, 375 nt, Artificial Sequence
  derived and/or modified sequence opt6 from anti-influenza_Chain
gaaguacaauuaguacaaucaggagcagaacuaaaaaugccaggagaaucacuaaaaauaucaugcaaagcaucaggauauacauuuacaaauuacuggauaggauggguaagacaaacaccaggaaaaggacuagaauggaugggaauaauauucccaccagauagccaaacaucauacucaccaucauuccaaggacaaguaacauucucaguagauaacucgauaucaguagcauacauacaauggagcucacuaaaagcaucagacacagcaauauacuauugcgcaagaucaggaauauucgauuggucagcaccauuaguagaagcauucgauauauggggacaaggaacaguaguaacaguaagcuca

SEQ ID NO: 50866 - RNA, 375 nt, Artificial Sequence
  derived and/or modified sequence opt6 from anti-influenza_Chain
gaaguacaauuaguacaaaguggagcagaaguaaaaaaaccaggagaaaguuuaaaaauaaguuguaaaggaaguggauauaguuuuagugauuauuggauaggauggguaagacaaaugccaggagaaggauuagaauggaugggaauaauauauccagcaaguucagaaauaagauauaguccaaguuuucaaggauuaguaacaauaagugcagauaaaaguauaaauacagcaucauuacaauggucaaguuuaaaagcaagugauacagcaauauauuauugugcaagacaugcaaguuguagugcaagaucauguuauuggggaccaguagauuauuggggacaaggaacauuaguaacaguaucaagu

SEQ ID NO: 50867 - RNA, 375 nt, Artificial Sequence
  derived and/or modified sequence opt6 from anti-influenza_Chain
caaguacaauuaguagaaucaggaggaggaguaguacaaccaggaagaucacuaagauuaucaugugcagcaucagaaauaacauuuauaacauaugcaaugcacuggguaagacaagcaccaggaaaaggauuagaauggguagcauuaauaucagaugacggaaguaauaaauuuuaugcagauucaguaaaaggaagauuuacaauaucaagagauaauaguaaaaauacauuauauuuacaaaugaauaguuuaagagcagaagacacagcagcauauuacugugcaagagaaggaguauauuuugacucaggaacauacagaggauauuuugauuauuggggacaagaaacauuaguaacaguaucauca

SEQ ID NO: 50868 - RNA, 375 nt, Artificial Sequence
  derived and/or modified sequence opt6 from anti-influenza_Chain
caaguacaacuacaagaaucaggaccaggauuaguaaaaccaucacaaacacuaucacuaacaugcacaguaucaggaggaucaauaucaucaggaaacuacuacuggaacuggguaagacaacacccaggaaaaggacuagaauggauaggauacauauacuacagaggaucaacauucuacaacccaucacuaaaaagcagaguaacaauaucaauagacacaagcaaaaaccaauucucacuaagacuaucaucaguaacagcagcagacacagcaguauacuacugcgcaaaagacacaagaucaucacuagacaacuaccaauacggaauggacguauggggacaaggaacaacaguaacaguaucauca

SEQ ID NO: 50869 - RNA, 375 nt, Artificial Sequence
  derived and/or modified sequence opt6 from anti-influenza_Chain
gaaguacaauuauuagaaagcggaggaggauuaguacaaccaggaggaaguuuaagauuaaguugugcagcaaguggauuuucauuuaguacauaugcaaugaguuggguaagacaagcaccaggaaaaggauuagaauggguaaguggaauaaguggaaguggagaaaguacauauuaugcagauaguguaaaaggaagauuuacaguaaguagagauaauaguaaaaauacauuauauuuacaaaugaauaguuuaagagcagaagauacagcaguauauuauugugcaaaacaaggagaucauauagcaugguuauuaagaggaauaaauuuugauuauuggggacaaggaguauuaguaacaguaaguagu

SEQ ID NO: 50870 - RNA, 375 nt, Artificial Sequence
  derived and/or modified sequence opt6 from anti-influenza_Chain
caaguacaauuaguagaaucaggaggaggaguaguacaaccaggaagaucacuaagacuaucaugugcagcaucaggauuugcauuucauaauagagcaaugcauuggguaagacaagcaccaggaaaaggacuagaauggguagcacuaauauacuuugacggaaguaaacaauauuaugcagacucaguaaaaggaagauucacaauaucaagagauaauaguaaaaauacaguauuucuacaaaugaauagucuaagaccagaagacacagcaguauacuauugcgcaguaccaggaccaauauuuggaauauucccaccauggucauauuuugaucacuggggacaaggaauauuaguaacaguaucauca

SEQ ID NO: 50871 - RNA, 375 nt, Artificial Sequence
  derived and/or modified sequence opt6 from anti-influenza_Chain
gaaguacaauuaguagaaucaggaggaggaguaguacaaccaggaagaucacuaagacuaucaugugcagcaucaggauuugcauuucauaauagagcaaugcauuggguaagacaagcaccaggaaaaggacuagaauggguagcauuaauauacuuugacggaaguaaacaauauuaugcagauucaguaaaaggcagauuuacaauaucaagagauaauaguaaaaauacaguauuuuuacaaaugaauaguuuaagaccagaagacacagcaguauauuauugugcaguaccaggaccaauauuuggaauauuuccaccauggucauauuuugaucauuggggacaaggaauauuaguaacaguaucauca

SEQ ID NO: 50872 - RNA, 375 nt, Artificial Sequence
  derived and/or modified sequence opt6 from anti-influenza_Chain
gaaguacaauuaguacaaagcggaggaggaguaguacaaccaggaaaaaguuuaagauuaaguugugcagcaaguggacuaacauuuucaaguuaugcaguacacuggguaagacaagcaccaggaaaaggacuagaauggguaacacuaauaucauaugauggagcaaaucaauacuaugcagauagcguaaaaggaagauuuacaauaaguagagauaauaguaaaaauacaguauauuuacaaaugaauaguuuaagaccagaagauacagcaguauauuacugugcaguaccaggaccaguauuuggaauauuuccaccauggucauauuuugauaauuggggacaaggaauauuaguaacaguaucaagu

SEQ ID NO: 50873 - RNA, 375 nt, Artificial Sequence
  derived and/or modified sequence opt6 from anti-influenza_Chain
caaguacaauuaguagaaagcggaggagggguaguacaaccaggaaaaaguuuaagauuaagcugugcagcaagcggacuaacauucucaaguuaugcaguacacuggguaagacaagcaccaggaaaaggacuagaauggguaacauuaauaucauaugauggagcaaaccaauacuaugcagauagcguaaaaggaagauuuacaauaaguagagacaauagcaaaaacacaguauaucuacaaaugaauagcuuaagaccagaagauacagcaguauauuacugugcaguaccaggaccaguauucggaauauuuccaccauggucauacuuugacaauuggggacaaggaauauuaguaacaguaucaagc

SEQ ID NO: 50874 - RNA, 375 nt, Artificial Sequence
  derived and/or modified sequence opt6 from anti-influenza_Chain
caaguacaauuaguagaaagcggaggaggaguaguacaaccaggaaaaagcccaagauuaaguugugcagcaagcggaccaacauucucaagcuaugcaguacacuggguaagacaagcaccaggaaaaggacuagaauggguaacauuaauaucauaugauggagcaaaccaauacuaugcagauucaguaaaaggaagauuuacaauaagcagagacaauagcaaaaacacaguauaucuacaaaugaauagccuaagaccagaagauacagcaguauauuacugugcaguaccaggaccaguauucgguauauuuccaccauggucauacuuugacaauuggggacaaggaauauuaguaacaguaucaagc

SEQ ID NO: 50875 - RNA, 375 nt, Artificial Sequence
  derived and/or modified sequence opt6 from anti-influenza_Chain
gaaguacaauuaguagaaucaggaggaggaguaguacaaccaggaaaaucauuaagauuaucaugugcagcaucaggauuaacauuuaguucauaugcaguacauuggguaagacaagcaccaggaaaaggauuagaauggguaacauuaauaaguuaugacggagcaaaucaauauuaugcagauucaguaaaaggaagauuuacaauaucaagagauaauaguaaaaauacaguauauuuacaaaugaauaguuuaagaccagaagauacagcaguauauuauugugcaguaccaggaccaguauuuggaauauuuccaccuuggucauauuuugauaauuggggacaaggaauauuaguaacaguaucauca

SEQ ID NO: 50876 - RNA, 375 nt, Artificial Sequence
  derived and/or modified sequence opt6 from anti-influenza_Chain
caaguacaauuaguacaaaguggagcagaauuaaaaagaccaggagcaaguguaaaaguaaguuguaaaacaaguggauauaguuuuaauaauuauggaauaaauuggguaagacaagcaccaggacaaggauuagaauggaugggauggauaagugcauauacaggaaauacacauuaugcaaaaaauuuugaaggaagaguaacauuaacaacagauacaaguacaaguacagcauauauggaaguaagaagcuuaagaagugaugauagugcaguauauuuuugugcaagagcaaugauacaaggaguaguaacauuauauuuaagaccaggagauuauuggggacaaggaacauuaguaacaguaaguagc

SEQ ID NO: 50877 - RNA, 375 nt, Artificial Sequence
  derived and/or modified sequence opt6 from anti-influenza_Chain
caaguacaauuaguacaaaguggagcagaaguaaaacaaccaggagcaaguguaaaaguaaguuguaaagcaaguggauauacauuuaaugcauauuauauacauuggguaagacaagcaccaggacaaggacuagaauggaugggauggauaaauccaaauuuuggaggaacacauuaugcaagaaaauuucaaggaagaguaacaaugacaagagaugcaaguauaaauacagcauauauggaauuagauagauuaauaagugaugauacagcaguauauuauuguguaagauggagagcagcagcaguaauaauggaucaauuuuauaaaauggauguauggggacaaggaacauuaguaacaguaaguagu

SEQ ID NO: 50878 - RNA, 375 nt, Artificial Sequence
  derived and/or modified sequence opt6 from anti-influenza_Chain
caaguacaauuaguacaaucaggaccagaauuaaaaaaaccaggaucaucaguaaaauuaucauguauggcaacaggaggaacauuuauaaauuacgcauuuucauggguaagacaagcaccaggacaaggauuagaaugguuaggaggaauaauaccaguauacggaacaucaaaccauguagaaaaauuacaaggaagaguaacaauaacagcagacgcaucaacaaauacagcauauauggaauuaucaggacuaagauuugaugacacagcaguauacuucugcgcagcaucaacagcaacaagcggaacauacuacgcaaugagaccauucgacuucuggggacaaggaacacuaguaucaguaucauca

SEQ ID NO: 50879 - RNA, 378 nt, Artificial Sequence
  derived and/or modified sequence opt6 from anti-influenza_Chain
gaaguacaauuaguagaaaguggaggaggaguaguacaaccaggaggaagucuaagauuaaguuguauagcaagugcauuuaauuuaggaauauuuggaaugcauuggguaagacaagcaccaggaaaaggauuagaauggguagcauuuauaagauaugauggaggaaaaacauuuuaugcagauaguguaaaaggaagauuuacaauaaguagagauaauaguaaaaauacauuauauuuacaaaugaauaguuuaagaacagaagauacagcauuauauuauugugcaagagaugcaacagcagauuauuauggaccaggaaguuauccaaauugguuagauccauggggacaaggaacauuaguaacaguaagu

SEQ ID NO: 50880 - RNA, 378 nt, Artificial Sequence
  derived and/or modified sequence opt6 from anti-influenza_Chain
gaaguacaacuaguagaaucaggaccagcacuaguaaaaccaacacaaacacuaacacuaacaugcucauucucaggauucagccuaagcacaagcggaaugucaguaucauggauaagacaaccaccaggaaaagcacuagaauggcuagcacuaauagacugggacgacgacacauacuacauaacauacucaucaucacuaaaaacaagacuaacaauaucaaaagacacauccaaaucacaaguaguacuaacaaugacaaacauggacccaguagacacagcaacauacuacugcgcaagaacacuaagaguaucaggagacuacguaagagacuucgaccuauggggaagaggaacacuaguaacaguauca

SEQ ID NO: 50881 - RNA, 378 nt, Artificial Sequence
  derived and/or modified sequence opt6 from anti-influenza_Chain
caaguacaauuacaagaaagcggaccaggccuaguaaaaccaagcgaaacauuaucauuaacauguacaguaaguggaggaucaauaaauagcuauuacuggaacuggauaagacaaccacccggaaaaggauuagaauggauaggauauauauaucacucaggaucaacaaauuacaauccaucacuaaaaagcagaguaacaauaucaguagauacaagcaaaaaucaauuuagcuuacaauuaagcucaguaacagcagcagacacagcaguauacuauugcgcaagauuaagaacagacuauggagauccagauagcguauacuauuacggaauggauguauggggacaaggaacaacaguaacaguaagcuca

SEQ ID NO: 50882 - RNA, 378 nt, Artificial Sequence
  derived and/or modified sequence opt6 from anti-influenza_Chain
caaguacaucuaguacaaucaggagcagaaguaagaaaaccaggagacucaguaaaaguaucaugcaaaacaucaggauauacauuuagcacauacccaguagcauggguaagacaaguaccaggacaaggauuagaauggaugggauggauaagcacauacaauggaaauacaaauuucgcacaaaauuuccaaggaagaguaacacuaacaacagauacaacaacaaauacagcauacauggaagugagaucgcuaaaauucgaugacacagcaguauacuauugcgcaagaguagaaggaagcuauagagauuucuggaacaaucaaaauagauuugacccauggggacaaggaacauuaguaacaguaucaagc

SEQ ID NO: 50883 - RNA, 378 nt, Artificial Sequence
  derived and/or modified sequence opt6 from anti-influenza_Chain
gaaguacaauuaguagaaagcggagcagaaguaaaaaaaccaggagcaaguguaaaaguaaguuguaaagcaaguggauauacauuuacaaguuuugauauaaauuggguaagacaagcaccaggacaaggauuagaauggaugggauggaugacaccaacaaguggaaaaacaggauaugcacaaaaauuucaaggaagaauaacaaugacaagaaauacaaguauaaauacagcauauauggaauuaaguaguuuaagaagugaagauacagcaguauauuuuugugcaagaggaccagaaagaagaacaacaauauuugauguaauauuagauugguuugauccauggggacaaggaacauuaguaacaguaagu

SEQ ID NO: 50884 - RNA, 378 nt, Artificial Sequence
  derived and/or modified sequence opt6 from anti-influenza_Chain
caaguacaauuaguacaaagcggagcagaaguaaaaaaaccaggaucaaguguaaaaguaagcuguaaagcaaguggaggauuuuucucaagcuaugcaauaagcuggguaagacaagcaccaggacaaggacuagaauggaugggaggaguaauaccaauauucagaacagcaaauuaugcacaaaacuuucaaggaagaguaacaauaacagcagacgaauucacaagcuauauggaacuaucaagcuuaagaucagacgauacagcaguauauuacugugcaagacuaaauuaccaugacucaggaacauacuauaacgcaccaagaggaugguucgauccauggggacaaggaacacuaguaacaguaagcuca

SEQ ID NO: 50885 - RNA, 378 nt, Artificial Sequence
  derived and/or modified sequence opt6 from anti-influenza_Chain
caaguacaauuaguacaaaguggagcagaaguaaaaaaaccaggaaguaguguaaaaguaaguuguaaagcaaguggaggagcauuuaguaauuaugcaauaaguuggguaagacaagcaccaggacaaggauuagaauggaugggaggaauaauaccaauauuuggaacaacaaauuaugcacaaaaauuucaaggaagaguaacaauaacagcagauaaauuuacaacaauagcauauauggaauuaagaaguuuaaggagugaagauacagcaguauauuauugugcaaggcauggaggaguauauuauuauggaagugcaaguaguggaugguuugauccauggggacaaggaacauuaguaacaguaaguagu

SEQ ID NO: 50886 - RNA, 378 nt, Artificial Sequence
  derived and/or modified sequence opt6 from anti-influenza_Chain
caaguacaauuauuagaaucaggaggaggaguaguaagaccaggaagaucauuaagauuagcaugugcaggaucaggauuuacauuuucagcauaugcaaugcauuggguaagacaagcaccaggaaaaggauuagaauggguagcacauacaaguuaugauggaagagauaguuauuauguagauucaguuaaaggaagauuuacaauaucaagagaugauaguaaaaauacauuauauuuacaaaugaauaguuuaagaccagaagauacagcaguauauuauugugcaaaaguaggaccauauacaggauaugaugauuauaauuauuauggaauggauguauggggacauggaacaacaguaacaguaucauca

SEQ ID NO: 50887 - RNA, 378 nt, Artificial Sequence
  derived and/or modified sequence opt6 from anti-influenza_Chain
caaguacaauuaguagaaaguggaggaggaguaguacaaccaggaggaagcuuaagauuaaguugugcagcaaguggauuuaauuuugaugaauauguaauguauuggguaagacaaucaccaggaaaaggauuagaauggguaaguuuaauaggagcagauggaagaggaacauauaauagugauaguguaaaaggaagauuuacaauaaguagagauaauagaaaaaauaguuuauauuuacaaaugaauaguuuaagaagugaugauacagcauuauauuauugugcaaaaguagaaagaaguuuuuaugauggaaguggauauggagaugcauuagaaauauggggacaaggaacaaugguaacaguaaguagu

SEQ ID NO: 50888 - RNA, 381 nt, Artificial Sequence
  derived and/or modified sequence opt6 from anti-influenza_Chain
gaaguacaacuauuagaaaguggaggaggauuaguacauccaggaggaaguuuaagauuaaguugugcagcaaguggauuuacauuuaguaauuaugcaaugaguuggguaagacaagcaccaggaaaaggauuagaauggguaaguaguauaaauaguggaggaggagcaacauauuaugcagauucaguaaaaggaagauuuacaauaaguagagauaauaguaaaaauacauuaaguuuacaaaugaauaguuuaagagcagaagauacagcaguauauuauugugcaaaagaaggaggaaauacaauauuuggauuaguaacaauggcauauuauuuugauaguuggggacaaggaacauuaguaacaguaaguagc

SEQ ID NO: 50889 - RNA, 381 nt, Artificial Sequence
  derived and/or modified sequence opt6 from anti-influenza_Chain
caaccacaacuacaagaaucaggaccaggacuaguaagaccaucagaaacacuaucacuaacaugcacaguaucaggagacucaguaacaagaggaggauucuacuggggauggauaagacaaccaccaggaaaaggacuagaauggauaggaucaauauacuacaacuacaacauauaccacucaccaucacuaaaaucaagaguaucacuaucaguagacacaucaaaaaaccaaguaucacuaaaauuagcaucaguaacagcagcagacacagcaguauacuacugcgcaagacacuacccauacuacgaccuaccaacaggauucuacucacaauucgacuucuggggacaaggaacaccaguaacaguaucauca

SEQ ID NO: 50890 - RNA, 381 nt, Artificial Sequence
  derived and/or modified sequence opt6 from anti-influenza_Chain
ugguggcaauuaguacaaaguggagcagaaguaaaaaaaccaggaaguaguguaaaaguaaguuguaaagcaaguggaggaacauuuaguaguuaugauauaaguuggguaagacaagcaccaggacaaggauuagaauggaugggaggaauaauaccaauauauggaacagcaaauuaugcacaaaaauuucaaggaagaguaacaauaacagcagaugaaaguacaaguacagcauauauggaauuaaguaguuuaagaagugaagauacagcaguauauuauugugcaagagcaggaggagauaguaguggauauuauggagcauuaggaagauuuuuucaacacuggggacaaggaacauuaguaacaguaaguagu

SEQ ID NO: 50891 - RNA, 381 nt, Artificial Sequence
  derived and/or modified sequence opt6 from anti-influenza_Chain
gaaguacaauuaguacaaagcggaggagcaguaguacaaccaggaagaagccuaagauuaaguugugcagcaagcggauucacauucucaauauaugcaaugcacuggguaaggcaaacaccaggaaaaggacuagaauggguagcauuaauaucauacgauggaaauaacaaauacuaugcagauagcguaaaaggaagauuuacaauaagcagagacaauuacaaaaacacacuauaucuacaaaugaaaggauuaagagcagaagauacagcacuauauuacugugcaagaagaauaacagaaaaaggauacuauaacgauagcggaagaccaaacugguucgauccauggggacaaggaacauuaguaacaguaagc

SEQ ID NO: 50892 - RNA, 381 nt, Artificial Sequence
  derived and/or modified sequence opt6 from anti-influenza_Chain
caaguacaacuacaacaaucaggaccaagauuaguaaaaccaucacaaacacuaucacuaacaugcgcaauaucaggagauaguguaagcggagacucaggaacauggaauuggauaagacaaagcccaagcagaggacuagaauggcuaggaagaacauacuauagaucaaaaugguacaaugacuaugcagaaagcguaaaaucacgaauaguaauaaaagcagacacaaguaaaaacgaauuuucacuacaacuaaauagcguaacaccagaagauacagcaauauauuacugugcaagagcaggaguaaaaauauucggacuaauaguaggagcacuagauaacuggggaagaggaacauuaguaacaguaagcucg

SEQ ID NO: 50893 - RNA, 381 nt, Artificial Sequence
  derived and/or modified sequence opt6 from anti-influenza_Chain
caaguacaacuacaacaauggggagcaggauuauuaaaaccaucagaaacauuaucauuaacauguacaguaucaggaggaaguuuaacagauuauucauggaauuggauaagacaaccaccaggaaaaggauuagaauggauaggagauacauuacauaauggauauacaaauuauaauccaaguuuaagaggaagaguaaguauaaguauagacacaagcaaaaaucaaguaucauuaagauuaacaaguguaacagcagcagauacagcauuauauuacugugcaagaggaaguggcggauauggaggauuugauuauuucggaaaauuaagaacaugggauuucuggggacaaggaacauuaguaacaguaaguuca

SEQ ID NO: 50894 - RNA, 381 nt, Artificial Sequence
  derived and/or modified sequence opt6 from anti-influenza_Chain
caaguacaauuaguacaaagcggagcagaaguaagaaaaccaggagaaaguuuaagaauaagcuguagaggaagcggauauaauuuuccaaaauauuggauaggauggguaagacaaaugccaggaaaaggauuagaauggaugggaaugauauauccaggagauucagacguaagauauaauccaaguuuucaaggacaaguaacaauaagugcagaugaaaguauaaauacagcauauuuacaauggucaaguuuaagaacaagugauacagcaagauauuacugugcaagacauuuaggacaacaauuaguaucaaauacauauuauuauuauggaauggacguauggggacaaggaacaacaguaacaguaucaagu

SEQ ID NO: 50895 - RNA, 384 nt, Artificial Sequence
  derived and/or modified sequence opt6 from anti-influenza_Chain
caaauacaacuacaagaaucaggaccaggauuaguaaaaccaucacaaacacuaucacuaacaugcgcaauaucaggagacucaguaucaucaaacaacgcaguauggaacuggauaagacaaucaccaucaagaggacuagaauggcuaggaagaacauacuacagaucaaaaugguacaacgacuacgcagaaucaguaaaaucaagaauaacaguaaacccagacacaagcaaaaaccaauucucacuacaccuaaaaucaguaacaccagaagacacagcaguauucuacugcguaagaucaggacacauaacaguauucggaguaaacguagacgcauucgacauguggggacaaggaacaaugguaacaguaucauca

SEQ ID NO: 50896 - RNA, 384 nt, Artificial Sequence
  derived and/or modified sequence opt6 from anti-influenza_Chain
caaguacaauuacaagaaagcggaccaggauuaguaaaaccaagccaaacacuaagccuaacaugugcaauaaguggagacucaguaucaagcaauaacgcaguauggaacuggauaagacaaucaccaucaagaggacuagaaugguuaggaagaacauauuacagaagcaaaugguauaacgauuacgcagaaucaguaaaaagcagaauaacaguaaauccagauacaagcaaaaaucaauuuucauuacacuuaaaaucaguaacaccagaagacacagcaguauucuauugcguaagaucaggacauauaacaguauuuggaguaaacguagacgcauucgauauguggggacaaggaacaaugguaacaguaagcuca

SEQ ID NO: 50897 - RNA, 384 nt, Artificial Sequence
  derived and/or modified sequence opt6 from anti-influenza_Chain
caaguacaacuacaacaaucaggaccaggccuaguaaaaccaucacaaacacuaucacuaacaugcgcaauaucaggagacagaguaucaucaaacucagcaguauggaacuggauaagacaaucaccaucaagaggacuagaauggcuaggaagaacauacuacagaucaaaaugguacuacgacuacgcagaaucaguaaaaucaagaauaguaauagacccagacacaagcaaaaaccaaguaucacuacaauuaaacucaguaacacccgaagacucagcaauauacuacugcgcaagaggaggacacauaacaguauucggacuaaacauagacgcauacgacauauggggacaaggagcaaaaguaacaguaagcagc

SEQ ID NO: 50898 - RNA, 384 nt, Artificial Sequence
  derived and/or modified sequence opt6 from anti-influenza_Chain
caaguacaacuacaacaaucaggaccaggacuaguaaaaccaucacaaacacuaucacuaacaugcgcaauaucaggagacagaguaagcagcaacucagcaguauggaacuggauaagacaaucaccaucaagaggacuagaauggcuaggaagaacauacuacagaucaaaaugguacuacgacuacgcagaaucaguaaaaucaagaauaguaauagacccagacacaucaaaaaaccaaguaucacuacaacuaaacucaguaacaccagaagauucagcaauauauuacugcgcaagaggaggacacauaacaguauucggacuaaacauagacgcauacgacauauggggacaaggagcaaugguaacaguaucauca

SEQ ID NO: 50899 - RNA, 384 nt, Artificial Sequence
  derived and/or modified sequence opt6 from anti-influenza_Chain
caaguacaacuacaacaaucaggaccaggacuaguaaaaccaagucaaacauuaucacuaacaugcgcaauaucaggagacagaguaucaucaaacucagcaguauggaacuggauaagacaaucaccaucaagaggacuagaauggcuaggaagaacauacuacagaucaaaaugguacuacgacuacgcagaaucaguaaaaucaagaauaguaauagacccagacacaaguaaaaaccaaguaucacuacaauuaaacucaguaacaccagaagacucagcaauauacuacugcgcaagaggaggacacauaacagaauucggacuaaacauagacgcauacgacauauggggacaaggagcaaugguaacaguaucauca

SEQ ID NO: 50900 - RNA, 384 nt, Artificial Sequence
  derived and/or modified sequence opt6 from anti-influenza_Chain
caaguacaauuacaacaaagcggaccaggauuaguaaaaccaagccaaacauuaagccuaacauguguaauaaguggagacacaguaucaagcaauagagcaacauggaacuggaugagacaaucaccauuaagaggacuagaaugguuaggaagaacauauuacagaagcaaaugguauaacgauuacgcaguaucaguaaaaagcagaguaguaauaaauccagauacaagcaaaaaucaaguaucauuacaauuaaacacaguaacaccagaugacucaggaguauacuuuugcgcaagaggaggacauauaacaguauuuggaguaaacauagacgcauucgauauauggggacuaggaacgaaaguaacaguaagcuca

SEQ ID NO: 50901 - RNA, 384 nt, Artificial Sequence
  derived and/or modified sequence opt6 from anti-influenza_Chain
caaguagaauuacaacaaagcggaccaggauuaguaaaaccaagucaaacauuaagccuaacaugugcaauaaguggagacucaguaucaagcaauagugcaacauggaacuggauaagacaaucaccaucaagaggacuagaauggcuaggaagaacauauuacagaagcaaaugguauaacgauuacgcagacuuucuaaaaagaagaauaacaauaaauccagauacaucaaacaaugaaguaucauuaagauuaacaagcguaacaccagaugacacagcauuauacuauugcgcaagaggaggacauauaacaguauuuggaguaaacauagacgcauucgauguauggggacaaggaacaauggcaacaguaagcuca

SEQ ID NO: 50902 - RNA, 384 nt, Artificial Sequence
  derived and/or modified sequence opt6 from anti-influenza_Chain
caaguacaacuacaacaaucaggaccaggauuaguaaaaccaucacaaacacuaucacuaacaugcgcaauaucaggagacucaguaucaucaaacucagcaacauggaacuggauaagacaaucaccaucaagaggacuagaauggcuaggaagaacauacuacagaucaaaaugguacaacgacuacgcagacuuccuaaaaagaagaauaaccauaaacccagacacaucaaacaacgaaguaucacuaagacuaacaucaguaacaccagacgacacagcacuauacuacugcgcaagaggaggacacauaacaguauucggaguaaacauagacgcauucgacguauggggacaaggaacaaugguaacaguaucauca

SEQ ID NO: 50903 - RNA, 384 nt, Artificial Sequence
  derived and/or modified sequence opt6 from anti-influenza_Chain
caaguacaacuacaacaaucaggaccaggauuaguaaaaccaucacaaacacuaucacuaacaugcgcaauaucaggagacucaguaucaucauacaacgcaguauggaacuggauaagacaaucaccaucaagaggacuagaauggcuaggaagaacauacuacagaucaggaugguacaacgacuacgcagaaucaguaaaaucaagaauaacaauaaacccagacacaagcaaaaaccaauucucacuacaauuaaacucaguaacaccagaagacacagcaguauacuacugcgcaagaucaggacacauaacaguauucggaguaaacguagacgcauucgacauguggggacaaggaacaaugguaacaguaucauca

SEQ ID NO: 50904 - RNA, 384 nt, Artificial Sequence
  derived and/or modified sequence opt6 from anti-influenza_Chain
caaguacaacuacaacaaucaggaccaggacuaguaaaaccaucacaaacacuaucacuaacaugcgcaauaucaggagacucaguaucaucaaacaacgcaguauggaacuggauaagacaaucaccaucaagaggacuagaauggcuaggaagaacauacuacagaucaaaaugguacaacgacuacgcagaaucaguaaaaucaagaauaacaauaaacccagacacaucaaaaaaccaauucucacuacaacuaaacucaguaacaccagaagacacagcaguauacuacugcgcaagaucaggacacauaacaguauucggaguaaacguagacgcauucgacauguggggacaaggaacaacaguaacaguaucauca

SEQ ID NO: 50905 - RNA, 384 nt, Artificial Sequence
  derived and/or modified sequence opt6 from anti-influenza_Chain
agaggacaauuaguacaaaguggaggaggaguaguacaaccaggaagaaguuuaagauuaaguugugcagcaaguggauuuguauuuaauguauuuggaauacauuggguaaggcaagcaccaggaaaaggauuagaaugguuagcaacaauaaguuaugauggauuaaauaaauauuaugcagauaguguaaaaggaagaauaacaauaagcagagauaauaguaaaaauacauuauauuuacaaaugaauaguuuaagagcagaagauacagcaguauauuauuguguaagagauagcgaagaaaguacauauuauggagauuauauguggguauauaauugguuugauuuauggggacaaggaacauuaguaacaguaagu

SEQ ID NO: 50906 - RNA, 384 nt, Artificial Sequence
  derived and/or modified sequence opt6 from anti-influenza_Chain
caaguacaacuacaacaauggggaucaggacuacuaaaaccaucagaaacacuaucacuaacaugcgcaguauacggaggaucauucagagacgacuacuggacauggauaagacaaccaccaggaaaaggacuagaauggauaggagaaauaaaccacucaggaagaacaaacuacaacccaucacuaaaaucaagaguaacaauaucaguagacacaucauuaaaacaauucucacuaaaaguaauaucaguaacagcagcagacacagcaguauacuacugcgcaagaggaacaucacacguaucaagauacuucgacuggcuaccaccaacaaacugguucgacccauggggacaaggaacacaaguaacaguaucauca

SEQ ID NO: 50907 - RNA, 384 nt, Artificial Sequence
  derived and/or modified sequence opt6 from anti-influenza_Chain
caaguacaacuacaacaauggggagcaggacuauuaaaaccaagcgaaacauuaucauuaagcugugcaguuuucggaggaucauucucagacuauuacuggacauggauaagacaaccaccaggaaaaggacuagaauggauaggagaaauaaaacacucaggaagaacaaauuacaauccaucacuagaaagcagaguaacaauaucaguagauacaagcaaaaaucaauuuagcuuaaaauuaagcucaguaacagcagcagacacagcaauauacuauugcgcaagaggaacagauccagauacagaaggauauugcagaagcggaagcuguagcgcauucgauuucuggggacaaggaacauuaguaacaguaagcuca

SEQ ID NO: 50908 - RNA, 384 nt, Artificial Sequence
  derived and/or modified sequence opt6 from anti-influenza_Chain
caaguacaauuacaacaauggggagcaggacuauuaaaaccaagugaaacauuaagcuuaacauguggaguauacggaggaucauuaucagacuauuacuggagcuggauaagacaaccaccaggaaaaggacuagaauggauaggagaaauaaaucacucaggaggaacaaauuacaauccaucacuaaaaagaagagucacaauaucaguagauacaucaaaaaaacaauuuagcuuaaaaaugaacaguguaacagcagcagacacagcaguauacuauugcgcaagaggaacagauccagauacagaaguauauugcagagcaggaaacugugcagcauucgauuucuggggacaaggaacacuaguaacaguaaguuca

SEQ ID NO: 50909 - RNA, 384 nt, Artificial Sequence
  derived and/or modified sequence opt6 from anti-influenza_Chain
caaguacaacuacaagaaucaggaccaggauuaguaaaaccaucacaaacacuaucacuaacaugcacaguaucaggagacucaauaucaucaguagaccacuacuggucauggauaagacaacacccaguaaaaggacuagaauggauaggauucauguacuacucagcaucaacauacuacaacccaucacuaaaaucaagaguaacaauaucaacagacacaagcaaaaaccaauucucacuaagacuaucaucaguaacagcagcagacacagcaguauacuacugcgcaagaggaacaugcgcaggagacugcucacuacacuacuacuacuacggacuagacguauggggacaaggaagaacaguaacaguaucauca

SEQ ID NO: 50910 - RNA, 384 nt, Artificial Sequence
  derived and/or modified sequence opt6 from anti-influenza_Chain
gaaguagcauuaguagaaagcggagcagaaguaaaaaaaccaggaaguaguguaaaaguaaguuguaaagcaaguggacauauauuuaguggauaugcaauaagcuggguaagacaagcaccaggacaaggauuagaauggaugggaggaauaauaccaauauuuggaacaacaaauuaugcacaaaaauuucaaggaagaguaacaauaacagcagaucaaaguacaaguacagcauauauggauuuaaguaauuuaagaagugaagauacagcaguauauuauugugcaagaguaaaagauggauauuguacauuaacaaguuguccaguaggaugguauuuugacuuauggggaagaggaacauuaguaacaguaaguagu

SEQ ID NO: 50911 - RNA, 384 nt, Artificial Sequence
  derived and/or modified sequence opt6 from anti-influenza_Chain
gaaguacaauuaguagaaaguggagcagaaguaaaaaaaccaggaaguaguguaaaaguaaguuguaaagcaagcggacauauauuuaguggauaugcaauaaguuggguaagacaagcaccaggacaaggauuagaauggaugggaggaauaauaccaauauuuggaacaacaaauuacgcacaaaaauuucaaggaagaguaacaauaacagcagaucaaaguacaaguacagcauauauggauuuaaguaauuuaagaagugaagauacagcaguauauuauugugcaagaguaaaagauggauauuguacauuaacaaguuguccaguaggaugguauuuugauuuauggggaagaggaacauuaguaacaguaaguagu

SEQ ID NO: 50912 - RNA, 384 nt, Artificial Sequence
  derived and/or modified sequence opt6 from anti-influenza_Chain
caaguacaauuaguacaaagcggagcagaaguaagaaaaccaggagcaaguguaaaaguaaguuguaaagcaaguggauauacauuuacaagacaugggauaaguuggguaagacaagcaccaggacaaggauuagaauggaugggauggauaagugcauauacaggagauacagauuaugcacaaaaauuucaaggaagaguaacaaugacaacagauacaaguacaaauacagcauauauggaauuaagaaguuuaagaagugaugaugcagcaguauauuauugugcaagauuaagauuacaaggagaaguaguaguaccaccaagucaaaguaauugguuugauccauggggacaaggaacauuaguaacaguaaguagu

SEQ ID NO: 50913 - RNA, 384 nt, Artificial Sequence
  derived and/or modified sequence opt6 from anti-influenza_Chain
caaguacaauuaguagaaagcggaccaggacuaaugaaaccaagcgaaacauuaagccuaacauguacaguaagcggaggaucaguaucaaacuauuacuggagcuggauaagacaaccaccaggaaaaggauuagaauggauaggauauguauuuuacucaggaucaagcaauuacaauccaucacuaaauaacccaucauuaaaaagcagaguaacaauaucaauagacacaagcaauaaccaauucucacuaaaauuaucaagcguaacagcagcagauacagcaguauauuacugugcaagaggaagaguaaauagcggauacgauuggggaccaaauuucgauagcuggggacaaggagcauuaguaacaguaagcuca

SEQ ID NO: 50914 - RNA, 384 nt, Artificial Sequence
  derived and/or modified sequence opt6 from anti-influenza_Chain
caaguacaauuaguacaaagcggagcagaaguaaaaaaaccaggaucaagcguaaaaguaagcuguaaagcaagcggaggaacauucucauacuaugcaauaagcuggguaagacaagcaccaggacaaggacuagaauggaugggaggaauaauaccaauaguaggaacagcacacuauacacaaaaauuucaaggaagaguaacaauaacagcagacgaaagcacaagcacagcauauauggaacuaucaagcuuaagaucagaagauacagcaguauauuucugugcaagagcagcagacgaaagcguagaaucacuaacaauaaaagcauuuagaacaaacuaucacuggggacaaggaacacuaguaacaguaagcuca

SEQ ID NO: 50915 - RNA, 387 nt, Artificial Sequence
  derived and/or modified sequence opt6 from anti-influenza_Chain
gaaguacaauuaguagaaaguggaggaggagcaguacaaccaggagaaaguuuaaaauuaccaugugcagcaaguggauuuacauuuaguaauuauggaaugcauuggguaagacaagcaccaggaaaaggauuagaauggguagcaguaauaaguuaugauggaaguaauaaauauuaugcagauaguguaaaaggaagauuuacaauaaguagagauaauaguaaagauacauuauauuuacaaaugaauaguuuaagagcggaagauacagcauuauuuuauugugcaaaagaaagaccauuaagauuauuaagauauuuugauuggcuaaguggaggagcaaaugauuauuggggacaaggaacauuaguaacaguaucaagu

SEQ ID NO: 50916 - RNA, 387 nt, Artificial Sequence
  derived and/or modified sequence opt6 from anti-influenza_Chain
gaaguacaauuaguagaaaguggaggaggagcaguacaaccaggagaaagucuaaaauuaaguugugcagcaagcggauuuacauuuagcaauuauggaaugcauuggguaagacaagcaccaggaaaaggacuagaauggguagcaguaauaaguuaugauggaaguaauaaauauuaugcagauagcguaaaaggaagauuuacaauaaguagagauaauaguaaagauacauuauauuuacaaaugaauaguuuaagagcagaagauacagcauuauuuuauugugcaaaagaaagaccauuaagauuauuaagauauuucgauugguuaaguggaggagcaaaugauuauuggggacaaggaacauuaguaacaguaaguagu

SEQ ID NO: 50917 - RNA, 387 nt, Artificial Sequence
  derived and/or modified sequence opt6 from anti-influenza_Chain
caaguacaacuaguagaaucaggaggaggaguaguucaaccaggaagaucacuaagauuaucaugugcaguaucaggauucacauucucaucauacgcaaugcacuggguaagacaagcaccaggaaaaggacuagaauggguagcaguaauaucauacgacggaucaaaccaauacuacgcagacucaguaaaaggaagauucacaauaucaagagacaacucaaaaaacacacuauaccuacaaaugaacucauuaagagcagaagacacagcacuauacuacugcgcaaaagacccaagacuaagacaccuauuauacuucccauucacaucaaugauauacuucgacuacuggggacaaggaacacuaguaacaguaucauca

SEQ ID NO: 50918 - RNA, 387 nt, Artificial Sequence
  derived and/or modified sequence opt6 from anti-influenza_Chain
caaguacaauuaguacaaucaggaggaggaguaguacaaccaggaagaucacuaagacuaucaugcguagcaucaggauucacauucucaacauacgcaaugcacuggguaagacaagcaccaggaagaggacuagaauggguagcaguaauaucauacgacgcaaacuauaaauacuacgcagacucaguaaaaggaagauucucaauaucaagagacaacucacaaaacacacuacacuuagaaaugaacacacuaagaacagaagacacagcacuauacuacugcgcaaaagacucacaacuaagaucacuacuauauuucgaauggcuaucacaaggauauuucgaaccauggggacaaggaacauuaguaacaguaacauca

SEQ ID NO: 50919 - RNA, 387 nt, Artificial Sequence
  derived and/or modified sequence opt6 from anti-influenza_Chain
caaguacaauuaguacaaaguggaggaggaguaguacaaccaggaagaucacuaagacuaucaugcguagcaucaggauuuacauuuagcacauacgcaaugcauuggguaagacaagcaccaggaagaggauuagaauggguagcaguaauaagcuaugacggaaacuauaaauauuacgcagacucaguaaaaggaagauucucaauaucaagagauaacucaaacucaacauuacacuuagaaaugaacacacuaagaacagaagacacagcauuauacuauugcgcaaaagauagccaacuaagaagccuacuauauuucgaauggcuaagccaaggauauuucgauccauggggacaaggaacauuaguaacaguaacauca

SEQ ID NO: 50920 - RNA, 387 nt, Artificial Sequence
  derived and/or modified sequence opt6 from anti-influenza_Chain
caaguacaauuaguacaaagcggagcagaaguaaaaaaaccaggaucaagcguaacaguaaguuguaaagcaagcggaggaacauucucaaacuauggaauaagcuggguaagacaagcaccaggacaaggacuagauuggaugggaggaauaauaccauuauucggaacagcaaacuaugcacaaaaauuucaaggaagaguaacaauaacagcagacgaaagcacaaguucaagcaauauggaauuaucaaguuuaagaucagaagauacagcagucuauuacugugcaagagacguacacaauuaugauuucuuaacaggauacccauuacaucuauauggaauggacguauggggacaaggaacaacaguaacaguaucaagc

SEQ ID NO: 50921 - RNA, 387 nt, Artificial Sequence
  derived and/or modified sequence opt6 from anti-influenza_Chain
caaguacaacuacaagaaucaggaccaggauuaguaaaaccaucagaaacacuaucacuaauaugcgcaguaucaggagcaucaauaucaucaucauacuggucauggauaagacaaccaccaggaaaaggacuagaauggauaggauacauauacuacucaggaguaacaaaauacaacccaucacuaaaaucaagaguaacacuaucaguagacacaagcaaaaaccacuucucauuaaaacuaucauacguaacagcagcagacacagcaguauacuacugcgcaagaaaccuaccagacauagcaguaguaacagcaguacaagacgcaacaccaguaugguucgacccauggggaccaggaacccuaguaucaguaucauca

SEQ ID NO: 50922 - RNA, 387 nt, Artificial Sequence
  derived and/or modified sequence opt6 from anti-influenza_Chain
gaaguacaauuaguagaaaguggaggaggauuaguacaaccaggaagaucauuaagauuaaguugugcagcaaguggauuuacauuuagcgauuuuuggaugaguuggguaagacaggcaccaggaaaaggauuagaauggguagcaaauauagaucaagauggaaaugaaagauuuuaugcagauaguguaaaaggaagauuuacaauaagcagagauaaugcaaaaaauaguuuauauuuacaaaugacaaguuuaagagcagaugauacagcaguauauuauugugcaagagauggaagagaaggauauuuuuauggaaguggaaguuuuuauaauuuaaaaggauuaaauuggggacaaggaacauuauuaacaguaaguagu

SEQ ID NO: 50923 - RNA, 387 nt, Artificial Sequence
  derived and/or modified sequence opt6 from anti-influenza_Chain
gaaguauuaaugguagaaagcggaggaggauuaguacaaccagggggaaguguaagauuaaguuguguagcaagcggauuuaguuuuaguagucauuggaugacauggguaagacaagcaccaggaaaaggauuagaauggguagcaaauauagaagacgauggaggagauaaauauuauguagauaguguaaaaggaagauuuauaauaaguagagauaaugcgaaaaauaguguauauuuacaaaugaauaguuuaagagcagaagauacagcaguauauuuuugugcaagaggaaguggaaguagugauagaagugauuaugauccacauuauuauuauuauuuagauguauggggaaaaggagcaacaguaacaguaaguagu

SEQ ID NO: 50924 - RNA, 387 nt, Artificial Sequence
  derived and/or modified sequence opt6 from anti-influenza_Chain
gaaguacaauuaguagaaaguggaggagaucuaguacaaccaggaagaaguuuaaaauuaaguuguacaggaaguggauuuacauuuggagauuauggaguaacauggguaagacaagcaccaggaaaaggauuagaauggguaggauuuauaaggacaagaccauggggaggaacagcagauacagcagcaaguguaaaaggaagauuuacaauaaguagagaugauaguaaaaguuuagcauauuuacaaaugaacaguuuaaaaacagaagauacagcaguauauuauuguuguagagaugcaccaccaaauguagaaguagcaaguaugacaaauugguauuuugauuuauggggaagaggaacauuaguaacaguaaguagu

SEQ ID NO: 50925 - RNA, 387 nt, Artificial Sequence
  derived and/or modified sequence opt6 from anti-influenza_Chain
gaaguacaauuaguacaaaguggaagugaaguaaaaaaaccaggagaaaguuuaaaaauaaguuguaaaggaagcggauauaguuuuaguaauuauuggauaggauggguaagacauaugccaggaaaaggauuagaauggaugggaauaauauauccaggagauagugauacaagauauaguccaaguuuucaaggacaaguaacaaugagugcagauaaaaguaguaguacaguauauuuacaauggaguaguuuaaaagcaagugauacagcaauauauuauugugcaagaagaggaggacauaguuuuggauauggaaguggaggagauacacauagugaauuugauaguuggggacaaggaacauuaguaacaguaaguagc

SEQ ID NO: 50926 - RNA, 387 nt, Artificial Sequence
  derived and/or modified sequence opt6 from anti-influenza_Chain
caaguacaacuacuagaaacaggaggaggauuaguaaaaccaggacaaaguuuaaaauuaagcugugcagcaagcggauucacauucacaagcuaugcaaugcacuggguaagacaaccaccaggaaaaggauuagaauggguagcaguaguaucauacgauggaaauuacaaauacuaugcagauagcguacaaggaagauuuacaauaagcagagacaauagcaaaaacacauuauaucuacaaaugaauagcuuaagagcagaagauacagcaguauauuacugugcaaaagacucacgacuaagaucacuauuauacuuugaauggcuaucacaaggauacuuuaacccauggggacaaggaacaacauuaacaguaucaagc

SEQ ID NO: 50927 - RNA, 387 nt, Artificial Sequence
  derived and/or modified sequence opt6 from anti-influenza_Chain
caaguacaauuaguagaaagcggagcagaaguaaaaaaaccaggagcaagcguaaaauuaaguuguacagcaaguggauacaauuucgcagcauauuacauacacuggguaagacaagcaccaggacaaggacuagaauggaugggauggagcaauccaaauacaggaggagcaaacuaugcacaagacuuucaaggaagaguaacaaugacagcgguaacaaguacaagcacagcauauauggaacuaucaagauuaacaucagacgauacagcacuauauuucugugcaagaguaccaagagauagauuacuaacacuauauuacgaaagcucaacauauggauuugacuauuggggacaaggaacauuaguaacaguaucaagc

SEQ ID NO: 50928 - RNA, 387 nt, Artificial Sequence
  derived and/or modified sequence opt6 from anti-influenza_Chain
caaguacaauuaguagaaaguggaggagggcuaguacaaccaggaggaaguuuaagauuaaguuguacaguaaguggauuuacauuuaauaguuaugcaaugaauuggguaagacaagcaccaggaaaaggauuagaauggguaaguggaauaagaggaaguggagaaaauacauauuaugcagaaacaguaaaaggaagauuuacaauaagcagagauaauaguaaaaauacauuauaucuagaaaugaauaguuuaagagcagaagauacagcaguauauuauugugcaagaaaauggggaagaaugacaguauuuggaguagcaacagaucaauuauauuauuuugauuauuggggacaaggaacauuaguaacaguaaguagu

SEQ ID NO: 50929 - RNA, 387 nt, Artificial Sequence
  derived and/or modified sequence opt6 from anti-influenza_Chain
caaguacaauuaguagaaucaggaccaggauuaguaaaaccaucacaaacacuaucacuaacaugcacaguaucaggaggaucaauaucaaacggaggauaccacuggucauggauaagacaacacccaggaaaaggacuagaauggauaggaaacauauacuacagaggaucaacauucuacgacccaucacuaaaaucaagaguaacaauaucaguagacacaucaaaaucacaauucucacuaaaauuaacaucaguaacagcagcagacacagcaguauacuacugcgcaagaaugccacuagcaaacuacgaccuacuaacaggacuauacauaggagcauucgacuuauggggacaaggaacaaugguaacaguaucauca

SEQ ID NO: 50930 - RNA, 387 nt, Artificial Sequence
  derived and/or modified sequence opt6 from anti-influenza_Chain
caaguacaauuaguagaaaguggagcagaaguaaaaaaaccaggagcaaguguaagaguaaguuguaaaggaaguggauauacauuuacagcauaucauaugcauuggguaagacaagcaccaggacaaggauuugaauggguaggauggauaaauccaaauaguggagcaacauauuauacaaguacauuugaaggaagaguaacaaugacaagagauacaaguauaacaacagcauauauggaauuaaguaguuuaagaagugaugauacagcaguauauuauugugcaacagauauaguaguagaaagagaugcaaguuuaggaggauuuaauaguuauggaauggauguauggggacaaggaacaacaguaacaguaaguagu

SEQ ID NO: 50931 - RNA, 390 nt, Artificial Sequence
  derived and/or modified sequence opt6 from anti-influenza_Chain
caaguacaauuacaacaauggggagcaggauuauuaaaaccaagugaaacauuaaguuuaacaugugcaguauacggaggaucauucaguguaucaggauauuacuggaguuggauaagacaaccaccaggaagaggacuagaauggauaggagaaauaucacacggaggaaguacaaauuacaauccaucacuaaaaaguagaguaacaauaucaguagauacaacaaaaaaucaauuuagcuuaagauuaaguaguguaacagcagcagacacagcaguauauuauugcgcaagaggaacagauccagauacagaaguauauugcagaguaggaaacugugcagcauuugauuacuggggacaaggaagucuaguaacaguaaguuca

SEQ ID NO: 50932 - RNA, 390 nt, Artificial Sequence
  derived and/or modified sequence opt6 from anti-influenza_Chain
caaguacaacuacuagaaagcggaccaggauuaguaaaaccaagccaaacauuacuacuaacauguacaguaagcggagcaucaauaucaacaggaggaaauuacuggucauggauaagacaacauccaggaaaagaucuagaauggauaggauauauauuuuacucaggaacaacaaaauacaauccaucaguagauaacccaagccuaaaaucaagaguaacaaugucaguagacacaagcgaaaaccaauucucacuaaaacuaucaagcguaacagcagcagauacagcaguauauuucugugcaagaggaucaccaaauaguggauacgauuggggaccacauuucgauuacuggggacaaggaacauuaguaacaguaucauca

SEQ ID NO: 50933 - RNA, 390 nt, Artificial Sequence
  derived and/or modified sequence opt6 from anti-influenza_Chain
gaaguacaauuaguagaaagcggaggacauuuaguacaaccaggaagaagcuuaagacuaagcugugcagcaagcggauucacauucgaagacuaugcaaugaauuggguaagacaagcaccaggaaaaggacuagaauggguaaguguaauaucaugggauagcggaagaauaggauaugcagauagcguaaaaggaagauuuacaauaagcagagacaaugcaaaaaacucaagcuaucuacaaaugaauagcuuaagaccagaagauacagcauuauauuacuguguaagagacaugcuagcauacuauagcgauaacucaggaaaaaaauauaacguauacggaauggauguauggggacaaggaacaacaguaacaguaagcuca

SEQ ID NO: 50934 - RNA, 390 nt, Artificial Sequence
  derived and/or modified sequence opt6 from anti-influenza_Chain
gaaguacaauuaguagaaaguggaggaggauuaguacaaccaggaagaaguuuaagauuaagcugugcaguaaguggauuuauauuugaagauuaugcaauaaauugggugagacaagcaccaggaaaaggauuagaauggguaaguauaauaaguugggauaguggaagaauaggauaugcagauagugugagaggaagauuuacaauaaguagagauaaugcaaaaaauaguaguuuuuuacaaaugaauaguuuaagaccagaagauacagcaguauauuauuguguaaaagauauguuagcauauuauuaugauggaaguggaauaagguauaauuuauauggaauggauguauggggacaaggaacaacagugacaguaaguagu

SEQ ID NO: 50935 - RNA, 390 nt, Artificial Sequence
  derived and/or modified sequence opt6 from anti-influenza_Chain
gaaguacaauuaguagaaaguggaggaggauuaguacaaccaggaagaaguuuaagauuaagcugugcaguaaguggauuuauauuugaagauuaugcaauaaauuggguaagacaagcaccaggaaaauguuuagaauggguaaguauaauaaguugggauagugggagaauaggauaugcagauaguguaagaggaagauuuacaauaaguagagauaaugcaaaaaauaguaguuuuuuacaaaugaauaguuuaagaccagaagauacagcaguauauuauuguguaaaagauauguuagcauauuauuaugauggaaguggaauaagauauaauuuauauggaauggauguauggggacaaggaacaacaguaacaguaaguagu

SEQ ID NO: 50936 - RNA, 396 nt, Artificial Sequence
  derived and/or modified sequence opt6 from anti-influenza_Chain
caaauaacauuaaaagaaagcggaccaacauuaguaaaaccgacacaaacauuaacauuaacauguguauuuagcggauucucacuaucaauaacaggaguaagaguaggauggauaagacaaccaccaggaaaagcacuagaaugguuagcauuaauaucaugggaugacgaaaaacauuacucaccaucacuacaaagcagacuaacaauaacaaaagauacaagcaaaaaucaaguaguauuaacaaugacaaauuuagauccaguagacacagcaacauacuauugcgcaagaucaacagauagaggacacguacuaagauacuuuggauggauguuaccaggagacgcauucgauguauggggacaaggaacaaugguaacaguaucauca

SEQ ID NO: 50937 - RNA, 396 nt, Artificial Sequence
  derived and/or modified sequence opt6 from anti-influenza_Chain
caaguacaacuacaagaaagcggaccaggauuaguaaaaccaagcgaaacacuaucauuaacauguacaguaagcucaggaccaaugucagacuauuacuggagcuggauaagacaaccaccaggaaaaggacuagaauggauaggacauguaucaguaucacacggaggaagaacaaaaagcaauccaucaguaaugaguagaguaacaauaucaguagaaacaagcaaaaaucaauuuagcuuaaaauuaacaucaguaacagcagcagacacagcaguguacuauugcgcaagauuaaacuauuacgauagaucaggauaucacucaccagauggaccaagcaauaacugguucgauccauggggacaaggaacauuaguaacaguaagcuca

SEQ ID NO: 50938 - RNA, 396 nt, Artificial Sequence
  derived and/or modified sequence opt6 from anti-influenza_Chain
caaguacaauuaguacaaucaggagcagaaguaaaaaaaccaggagcaagcguaaaaguaucaugcaaaacaucaggauacacauucacagcauacacaauacacuggguaagacaagcaccaggacaaagacuagaauggaugggauggauaaacgcaggaaacggacacacaaaauacucacaaagauucaaaggaagaguaacaauaacaagagacacaagcgcaagaacaacauacauggaacuaagaagccuaacaucagaagacacagcauuauacuucugcgcaagaggaccagaaacauacuacuacgacaaaacaaacuggcuaaauucacacccagacgaauacuuccaacacuggggacacggaacacaaguaacaguaucauca

SEQ ID NO: 50939 - RNA, 399 nt, Artificial Sequence
  derived and/or modified sequence opt6 from anti-influenza_Chain
caaguacaauuaguacaaagcggaagugaaguaaaaaaaccaggagcaagcguaaaaguaagcuguaaagcaaguggauacacauucacaaacuaugacauaaacuggauaagacaagcaccaggacaaggacuagaauggaugggauggauaaauccaaauagcggaacaacaggaucagcacaaagauuucaaggaagaguaacaauaacaguagacacaagcauaacaacaguauauauggaacuaucaaguuuaagaucggacgauacagcaauauauuacugugcaagaggaagagaauuauuaagacuacaacacuuucuaacagacucacaaucagaaagaagagauugcuuugacccauggggacaaggaacacuaguaacaguaucaagc

SEQ ID NO: 50940 - RNA, 402 nt, Artificial Sequence
  derived and/or modified sequence opt6 from anti-influenza_Chain
gaaguacaauuaguagaaagcggaggcggauuaguaaaaccaggaggaagccuaagauuaaguugugcagcaaguggacuaucauuuuuaaaugcauggaugagcuggguaagacaagcaccaggaaaaggacuagaauggguaggaagaauaaaaaguaauacagauggaggaacaacagacuaugcagcaccaguaaaaggaagauuuacaauaaguagagacgauaguaaaaauacacuauauuuacaaaugaguaguuuaaaaacagaagauacagcaguauauuacuguacaacagacggaccauauagcgaugacuuuagaaguggauaugcagcaagauauagauauuucggaauggauguauggggacaaggaacaacaguaacaguaaguagu

SEQ ID NO: 50941 - RNA, 402 nt, Artificial Sequence
  derived and/or modified sequence opt6 from anti-influenza_Chain
gaaguacaauuaguagaaagcggaggaggauuaguaaaaccaggaggaaguuuaagauuaaguugugcagcaagcggauucagcuuuuuaaaugcauggaugaguuggguaagacaagcaccaggaaaaggacuagaauggguaggaagaauaaaaaguaauacagauggaggaacaacagauuaugcagcaccaguaaaaggaagauuuacaauaagcagagacgauaguaaaaauacauuauauuuacaaaugaguaguuuaaaaacagaagauacagcaguauauuacuguacaacggacggaccauauagugaugacuuuagaaguggauaugcagcaagauauagauauuuuggaauggauguauggggacaaggaacaacaguaacaguaaguagu

SEQ ID NO: 50942 - RNA, 402 nt, Artificial Sequence
  derived and/or modified sequence opt6 from anti-influenza_Chain
gaaguacaauuaguagaaagcggaggaggauuaguaaaaccaggaggaagccuaagacuaagcugugcagcaagcggacuaacauucuuaaacgcauggaugagcuggguaagacaagcaccaggaaaaggacuagaauggguaggaagaauaaaaaguaauacagauggaggaacaacagacuaugcagcaccaguaaaaggaagauuuacaauaagcagagacgauagcaaaaacacacuauaucuacaaaugaguagcuuaaaaacagaagauacagcaguauauuacuguacaacagacggaccauauagcgaugacuuuagaucaggauaugcagcaagauauagauauuucggaauggauguauggggacaaggaacaacaguaacaguaagcuca

SEQ ID NO: 50943 - RNA, 402 nt, Artificial Sequence
  derived and/or modified sequence opt6 from anti-influenza_Chain
gaaguacaauuaguagaaagcggaggaggauuaguaaaaccaggaggaaguuuaagauuaaguugugcagcaaguggauuuaguuuuaguaaugcauggaugaguuggguaagacaagcaccaggaaaaggauuagaauggguaggaagaauaaaaaguaauacagauggaggaacaacagauuaugcagcaccaguaaaaggaagauuuacaauaaguagagaugauaguaaaaauacauuauauuuacaaaugaguaguuuaaaaacagaagauacagcaguauauuacuguacaacagacggaccauauagugaugacuuuagaaguggauaugcagcaagauauagauauuuuggaauggauguauggggacaaggaacaacaguaacaguaaguagu

SEQ ID NO: 50944 - RNA, 402 nt, Artificial Sequence
  derived and/or modified sequence opt6 from anti-influenza_Chain
gaaguacaauuaguagaaaguggaggaggauuaguaaaaccaggaggaaguuuaagacuaaguugugcagcaaguggauuaacauuuaguaaugcauggaugaguuggguaagacaagcaccaggaaaaggauuagaauggguaggaagaauaaaaaguaauacagauggaggaacaacagauuaugcagcaccaguaaaaggaagauuuacaauaaguagagacgauaguaaaaauacauuauauuuacaaaugaguaguuuaaaaacagaagauacagcaguauauuacuguacgacagacggaccauauagugaugacuuuagaaguggauaugcagcaagauauagauauuuuggaauggauguauggggacaaggaacaacaguaacagugaguagu

SEQ ID NO: 50945 - RNA, 402 nt, Artificial Sequence
  derived and/or modified sequence opt6 from anti-influenza_Chain
gaaguacaauuaguagaaagcggaggaggauuaguaaaaccaggaggaaguuuaagauuaagcugugcagcgucaggauuuacauuuaguaaugcauggaugagcuggguaagacaagcaccaggaaaaggauuagaauggguaggaagaauaaaaaguaauacagauggaggaacaacagacuaugcagcaccaguaaaaggaagauuuacaauaaguagagacgauaguaaaaauacacuauauuuacaaaugaguagucuaaaaacagaagauacagcaguauauuauuguacaacagacggaccauauagugaugacuuuagaaguggauaugcagcaagauauagauauuuuggaauggauguauggggacaaggaacaacaguaacaguaaguagu

SEQ ID NO: 50946 - RNA, 402 nt, Artificial Sequence
  derived and/or modified sequence opt6 from anti-influenza_Chain
gaaguacaauuaguaguaaguggaggaggauuaguaaaaccaggaggaaguuuaagauuaaguugugcagcaaguggauuaaguuuucuaaaugcauggaugaguuggguaagacaagcaccaggaaaaggauuagaauggguaggaagaauaaaaaguaauacagauggaggaacaacagauuaugcagcaccaguaaaaggaagauuuaguauaaguagagaugauaguaaaaauauguuauuuuuacauaugaguaguuuaagaacagaagauacagcaguauauuauugugcaacagauggaccauauagugaugauuuuagaaguggauaugcagcaagauauagauauuuuggaauggauguauggggacaaggaacaacaguaacaguaaguagu

SEQ ID NO: 50947 - RNA, 402 nt, Artificial Sequence
  derived and/or modified sequence opt6 from anti-influenza_Chain
gaagugcaauuaguaguaaguggaggaggauuaguaaaaccaggaggaaguuuaagauuaaguugugcagcaaguggauuaucauuuuuaaaugcauggaugagcuggguaagacaagcaccaggaaaauguuuagaauggguaggaagaauaaaaaguaauacagauggaggaacaacagauuaugcagcaccaguaaaaggaagauuuaguauaaguagagaugauaguaaaaauauguuauuuuuacauaugaguaguuuaagaacagaagauacagcaguauauuauugugcaacagauggaccauauagugaugauuuuagaaguggauaugcagcaagauauagguauuuuggaauggauguauggggacaaggaacaacaguaacaguaaguagu

SEQ ID NO: 50948 - RNA, 402 nt, Artificial Sequence
  derived and/or modified sequence opt6 from anti-influenza_Chain
gaaguacaauuaguaguaaguggaggaggauuaguaaaaccaggaggaaguuuaagauuaaguugugcagcaaguggauuaaguuuucuaaaugcauggaugaguuggguaagacaagcaccaggaaaaggauuagaauggguaggaagaauaaaaaguaauacagauggaggaacaacagauuaugcagcaccaguaaaaggaagauuuaguauaaguagagaugauaguaaaaauauguuauuuuuacauaugaguaguuuaagaacagaagauacagcaguauauuauugugcaacagaugggccauauagugaugauuuuagaaguggauaugcagcaagauauagauauuuuggaauggauguauggggauguggaacaacaguaacaguaaguagu

SEQ ID NO: 50949 - RNA, 402 nt, Artificial Sequence
  derived and/or modified sequence opt6 from anti-influenza_Chain
gaaguacaauuaguagaaagcggaggaggauuaguaaaaccaggaggaagccuaagauuaagcugugcagcaagcggauucacauuuuuaaacgcauggaugagcuggguaagacaagcaccaggaaaaggauuagaauggguaggaagaauaaaaagcaauacagauggaggaacaacagacuaugcagcaccaguaaaagggagauuuacaauaagcagagacgauaguaaaaauacacuauaucuacaaaugaguaguuuaaaaacagaagauacagcaguauauuacuguacaacagacggaccauauagugaugacuuuagaaguggauaugcagcaagauauagauauuucggaauggauguauggggacaaggaacaacaguaacaguaaguagu

SEQ ID NO: 50950 - RNA, 402 nt, Artificial Sequence
  derived and/or modified sequence opt6 from anti-influenza_Chain
gaaguacaauuaguagaaaguggaggaggauuaguaaaaccaggaggaaguuuaagauuaagcugugcagcaagcggauucacauucuuaaacgcauggaugagcuggguaagacaagcaccaggaaaaugucuagaaugggugggaaggauaaaaagcaauacagauggaggaacaacagacuaugcagcaccaguaaaaggaagauuuacaauaagcagagacgauaguaaaaacacacuauaucuacaaaugucaagccuaaaaacagaagauacagcaguauauuacuguacaacagacggaccauauagugaugacuuuagaaguggauaugcagcaagauauagauauuucggaauggauguauggggacaaggaacgacaguaacaguaagcuca

SEQ ID NO: 50951 - RNA, 402 nt, Artificial Sequence
  derived and/or modified sequence opt6 from anti-influenza_Chain
gaaguacaauuaguagaaagcggaggaggauuaguaaaaccaggaggaucauuaagauuaagcugugcagcaagcggauucacauucuuaaacgcauggaugagcuggguaagacaagcaccaggaaaaggauuagaauggguaggaagaauaaaaaguaauacagauggaggaacaacagacuaugcagcgccaguaaaaggaagauuuacaauaagcagagacgauagcaaaaacacacuauaucuacaaaugagcagcuuaaaaacagaagauacagcaguauauuacuguacaacagacggaccauauagcgaugacuuuagaucaggauaugcagcaagauauagauauuucggaauggauguauggggauguggaacaacaguaacaguaagcuca

SEQ ID NO: 50952 - RNA, 414 nt, Artificial Sequence
  derived and/or modified sequence opt6 from anti-influenza_Chain
caaguacaauuacaagaaaguggaggaggauuaguacaaccaggagaaaguuuaagauuaagcuguguaggaaguggaaguaguuuuggagaaaguacauuaaguuauuaugcaguaaguuggguaagacaagcaccaggaaaaggauuagaaugguuaaguauaauaaaugcaggaggaggagauauagauuaugcagauaguguagaaggaagauuuacaauaaguagagauaauaguaaagaaacauuauauuuacaaaugacaaauuuaagaguagaagauacaggaguauauuauugugcaaaacauaugaguaugcaacaaguaguaagcgcaggaugggaaagagcagauuuaguaggagacgcauuugauguauggggacaaggaacaaugguaacaguaagcagu

SEQ ID NO: 50953 - RNA, 465 nt, Artificial Sequence
  derived and/or modified sequence opt6 from anti-influenza_Chain
cuaucaagaauaaaccacuucgaaaaaauacaaauaaucccaaaaucaucauggucagaccacgaagcaucaucaggaguauccucagcaugcccauaccaaggaacaccaucauucuucagaaacguaguauggcuaauaaaaaaaaacaacacauacccaacaauaaaaagaucauacaacaacacaaaccaagaagaccuacuaauacuauggggaauacaccacuccaacgacgcagcagaacaaacaaaacuauaccaaaacccaaccacauacauaucaguaggcacaucaacacuaaaccaaagacuaguaccaaaaauagcaacaagaucaaaaguaaacggacaaaacggacgaauggacuucuucuggacaauacuaaaaccaaacgacgcaauaaacuucgaaucaaacggaaacuucauagcaccagaauacgcauacaaaauaguaaaaaaa

SEQ ID NO: 50954 - RNA, 564 nt, Artificial Sequence
  derived and/or modified sequence opt6 from anti-influenza_Chain
aacguaccagaauggagcuacauaguagaaaaagcaaacccagcaaacgaccuaugcuaccccggaaacuucaacgacuacgaagaacuaaaacaccuauuaucaagaauaaaccacuucgaaaaaauacaaauaauaccaaaaucaucauggucagaccacgaagcaucaucaggagucucaucagcaugcccauaccaaggaacaccaucauucuuuagaaacguaguauggcuaauaaaaaaaaacaauacauacccaacaauaaaaagaucauacaacaacacaaaccaagaagaccuacuaauacuauggggaauccaccacucaaacgacgcagcagaacaaacaaaacuauaccaaaacccaacaacauacauaucaguaggaacaucaacacuaaaccaaagacuaguaccaaaaauagcaacaagaucaaaaguaaacggacaaaacggcagaauggacuucuucuggacaauacuaaaaccaaacgacgccauaaacuucgaauccaacggaaacuucauagcaccagaauacgcauacaaaauaguaaaaaaa

SEQ ID NO: 50955 - RNA, 609 nt, Artificial Sequence
  derived and/or modified sequence opt6 from anti-influenza_Chain
augcuuagaucacuaguccuaaacgaaaaacuaagagcaagaguacuagaaagagcagaagaauuccuccuaaacaacaaagcagacgaagaaguaugguucagagaacuaguacuaugcauacuaacaucaaacagcucauucauauccgcauacaaaagcaugaacuacauacuagacaaaauacuauacauggacgaaaaagaaauaucaaucuuauuacaagaaucaggcuacagauucuacaaccuaaaagcaaaauaccuauacagagcaaaaaaccuauacggaaaaguaaaaaaaacaauaaaagaaauagcagauaaagaccaaaugcaagccagagaauucauagcaacacauauauacggaauaggauacaaagaagcaucacacuuccuaagaaauguaggauaccuagaccuagcaauaauagacagacacauauuaagauucauaaacaaccuuggaauaccaauaaaacuaaaaucaaaaagagaauaccuacuagcagaaucacuacuaagaucaauagcaaacaaccuaaacguacaaguaggacuacuagaccuauucauauucuucaaacaaacaaacacaauaguaaaa

SEQ ID NO: 50956 - RNA, 615 nt, Artificial Sequence
  derived and/or modified sequence opt6 from anti-influenza_Chain
ggauuauucggagcaauagcaggauucauagaaggaggauggacaggaaugguagacggaugguacggauaccaccaccaaaacgaacaaggaaguggauacgcagcagaccucaaaaguacacaaaacgcaauagacgaaauaacaaacaaaguaaacagcguaauagaaaaaaugaacacacaauucacagcaguaggaaaagaauucaaccaccuagaaaaaagaauagaaaacuuaaacaaaaaaauagacgacggauuccuagacauauggacauacaacgcagaacuacuaguauuacuagaaaacgaaagaacacuagacuaccacgacaguaacguaaaaaaccuauacgaaaaaguaagaagccaacuaaaaaacaaugcaaaagaaauaggaaacggaugcuucgaauucuaccacaaaugcgacaacacaugcauggaaucaguaaaaaacggaacauacgacuacccaaaauacucagaagaagcaaaacuaaacagagaagaaauagacggaguaaaacuagaaaguacacgaauauaccaaauccuagcaauauauucaacaguagcaucaaguuuaguauuaguaguaagccuaggagcg

SEQ ID NO: 50957 - RNA, 639 nt, Artificial Sequence
  derived and/or modified sequence opt6 from anti-influenza_Chain
gaaauaguucuaacacaaucaccaggaacacuaucacuaucaccaggcgaaagagcaacauuaucaugcagagcaucacaacgagucucaucauacuuagcaugguaccaacaaaaaccaggacaagcaccaagacucuuaauauacggagcaucaacaagagcagcaggaauaccagaccguuucucaggauccggaucaggcacagacuucacauuaacaauaucaagauuagaaccagaagacucagcaguauacuacugccaacaauacggaagaacaccauuaacauucggaggcggaacaaaaguagaaauaaaaagagcagcagcaccaucaguauuuauauucccaccaucagacgaacaacuaaaaucaggaaccgcaucaguaguaugcuuacuaaacaacuucuacccaagagaagcaaaaguacaauggaaaguagacaacgcacuacaaucaggaaacucacaagaaucaguaacagaacaagacucaaaagacucaacauacucacuauccuccacauuaacccuaucaaaagcagacuacgaaaaacacaaaguauacgcaugcgaaguaacacaccaaggacucucaucaccaguaacaaaaucauucaacagaggagaaugc

SEQ ID NO: 50958 - RNA, 639 nt, Artificial Sequence
  derived and/or modified sequence opt6 from anti-influenza_Chain
gacauacaaaugacacaauccccauccucuuuaucagcaucacuaggaggaaacgucacaauaacaugcaaagcaucacaagacauaaauaaauauauagcaugguaccaacacaaaccaggaaaaggaccaagauuaguaauacacuacacauccacacuacaaccaggcauaccaucaagauucuccggaucaggaucaggaacagacuacucauucucaauaucaaaccuagaaccagaagacauagccacauacuacugucuccaauaugacauauuauacaccuucggaggaggaaccaaacuagaaauaaaaagagcagacgcagcaccaacaguaucaauauucccaccaucaucagaacaauuaacaucaggaggagccucaguaguaugcuucuuaaacaacuuuuacccaaaagacauaaacguaaaauggaaaauagacggaucagaacgacaaaauggaguacuaaauucauggacagaccaagacucaaaagacucaacauacucaaugucaucaacacucacacuaacaaaagacgaauacgaaagacacaacuccuacacaugcgaagcaacacacaaaaccucaacaucaccaauaguaaaauccuucaacagaaacgaaugc

SEQ ID NO: 50959 - RNA, 642 nt, Artificial Sequence
  derived and/or modified sequence opt6 from anti-influenza_Chain
gacauacaaaugacacaaucaccaucuucacuaucagcaucagucggagacagaguaacaauaacaugcagagcaucacaaggcauauccucauaccuagcaugguaccaacaaaaaccaggaaaaguaccaacacuauuaaucuacgaugcaucaacacuucgaucaggaguaccauccagauucucaggcucaggaucagcaacagacuucacacuaacaauauccucacuccaaccagaagacguagccacauacuacugccaaagauacaacucagcaccacccauaacauucggccaagguacacgacuagaaauaaaaagagcagcagcaccauccguauucauauucccacccucagaugaacaacuaaaaucaggcacagcaucaguaguaugccuauuaaacaacuucuacccccgcgaagcaaaaguacaauggaaaguagauaacgcacuccaaucaggaaacucacaagaaucaguaacagaacaagacucaaaagacucaacauacucauuaucaucaacacuaacauuaucaaaagccgacuacgaaaaacacaaaguauacgcaugcgaaguaacacaccaaggauuauccucaccaguaacuaaaucauucaacagaggagaaugc

SEQ ID NO: 50960 - RNA, 642 nt, Artificial Sequence
  derived and/or modified sequence opt6 from anti-influenza_Chain
gaaauaguauuaacacaaucacccggaacauuaagccuaagcccaggagaaagagcaacauuaagcuguagagcaagucaaagcguaaguucaagcuaucuagcaugguaucaacaaaaaccaggacaagcaccaagacuacuaauauacggagcaucuagcagagcaacaggaauaccagauagauuuagcggaagcggaucaggaacagauuucacauuaacaauaucaagauuagaaccagaagauuucgcaguauauuacugccaacaauacggaagcucuccaagaacauuuggaggaggaacaaaaguagaaauaaaaagagcagcagcaccaagcguauuuauauucccacccucagacgaacaauuaaaaucaggcacagcaucaguaguaugcuuacucaacaacuuuuacccaagagaagcaaaaguacaauggaaaguagauaacgcacuacaaagcggaaacucacaagaaucaguaacagaacaagauagcaaagacucaacauauucauuaagcucaacauuaacauuaucaaaagcagacuacgaaaaacauaaaguauacgcaugcgaaguaacacaccaaggauuaagcucaccaguaacaaaaucauuuaacagaggcgaaugc

SEQ ID NO: 50961 - RNA, 642 nt, Artificial Sequence
  derived and/or modified sequence opt6 from anti-influenza_Chain
uccuacguauuaacacaaccaccaucaguaucaguagccccaggagaaacagcaacaguaacaugcggaggaaacaacauaggcucaaaaucaguacacugguaccaacaaaaacccggucaagcaccaguaguaguaaucuacuacgacggagacagaccaucaggaauaccagaaagauucucaggaucaaacucaggagacacagcaacacuaacaauauccagaguagaagcaggagacgaagcagacuacuacuguuuaguaugggacuacacaagcguacauuacguauuuggaacaggaacaaaaguaacaguacuaggacaaccaaaagcaaacccaacaguaacauuauucccaccaagcucagaagaacuacaagcaaauaaagcaacacuaguaugccuaauaucagacuucuauccaggagcaguaacaguagcauggaaagcagacggaucaccaguaaaagcaggaguagaaacuacaaaaccaucaaaacaaucaaacaauaaauacgcagcaucaucauaccuaucauuaacaccagaacaauggaaaucacacagaaguuacucaugucaaguaacacacgaaggaucaacaguagaaaaaacaguagcaccaacagaaugcuca

SEQ ID NO: 50962 - RNA, 642 nt, Artificial Sequence
  derived and/or modified sequence opt6 from anti-influenza_Chain
gacauacaaaugacacaaacaucaucaagccuaucagcaucauuaggcgaccgaguaacaauauccugccgagcaucacaagacauaagaaacuaccuaaacugguaccaacaaaaacccgacggaacaguaaaacuucuaauauacuacacaucaagauuacauucaggaguaccaucaagauucucagacucaggaucaggaacagacuacucccuaacaauaucaaaccuagaacaagaagaccuagcaacauacuucugccaacaaacauacacauuaccauggacauucggaggaggaacaaaacuagaaauaaaaagagcagaugcagcaccaacaguaucaauauucccaccaucaucagaacaacuaacaucaggaggagcaucaguagucugcuuccuaaacaacuucuacccaaaagacauaaacguaaaauggaaaauagacggaucagaaagacaaaacggaguacucaauuccuggacagaccaagacucaaaagacucaacauacucaaugucaucaacacuaacacuaacaaaagacgaauacgaaagacacaacucauacacaugcgaagcaacacacaaaacaucuaccucaccaauaguaaaauccuucaauagaaacgaaugc

SEQ ID NO: 50963 - RNA, 645 nt, Artificial Sequence
  derived and/or modified sequence opt6 from anti-influenza_Chain
gacggaguaaaaccacuaauauuaagagacugcucaguagcaggauggcuacuaggaaacccaaugugcgacgaauucauaaacguaccagaauggucauacauaguagaaaaagcaaacccagcaaacgacuuaugcuacccaggaaacuuuaacgacuacgaagaacuaaaacaccuacuaucaagaauaaaccacuucgaaaaaauacaaauaauaccaaaaucaucauggagcgaccacgaagcaucaucaggaguaucaucagcaugcccauaccaaggaacaccaucauucuucagaaacguaguaugguuaauaaaaaaaaacaacacauacccaacaauaaaaagaucauauaacaacacaaaccaagaagaccuacuaauacuauggggaauacaccacagcaacgacgccgcagaacaaacaaaacuauaccaaaacccaacaacauacauaucaguaggaacaagcacacuaaaccaaagacucguaccaaaaauagcaacacgaagcaaaguaaauggacaaaacggaagaauggacuucuucuggacaauauuaaaaccaaacgacgcaauaaacuucgaaucaaacggaaacuucauagcaccagaauacgcauacaaaauaguaaaaaaa

SEQ ID NO: 50964 - RNA, 645 nt, Artificial Sequence
  derived and/or modified sequence opt6 from anti-influenza_Chain
gacauacaaaugacacaaucaccaucaacacuaucagcaucaguaggcgacagaguaaccauaacaugcagagcaucacaaacaauaaacaacuaucuagcaugguaccaacaaaaaccaggaaaagcaccaaaacuacuaauauauaaagcaucaucacuagaaucaggaguaccaucacgauucagcggaucaggaucaggaacagaauuuacacuaaccauaucuucacuacaaccagacgacuucgcaacauacuacugccaagaauacaacaacgacagcccacuaacauucggaggaggaacaaaaguagaaauaaaaagaacaguagcagcaccaucaguauucauauucccaccaucagacgaacaacuaaaaucaggaacagcaucuguaguaugccuacuaaacaacuucuacccaagagaagcaaaaguacaauggaaaguagacaacgcauuacaaaguggaaacucacaagaaucaguaacagaacaagacucaaaagacucaacauacucauuaucaucaacacuaaccuuaucaaaagcagacuacgaaaaacacaaaguauacgcaugcgaaguaacacaccaaggacucucaucaccaguaacaaaaucauucaacagaggagaaugc

SEQ ID NO: 50965 - RNA, 645 nt, Artificial Sequence
  derived and/or modified sequence opt6 from anti-influenza_Chain
ucaguacuaacacaaccaccaucagcaucaggaucaagaggacaaucaauaacaauaucaugcaccggaucaacaucagacauaggcucauacaacuacguaucaugguaccaacaacaccccggaacagcaccaaaaguaauccuauacgaaguaucacaaagaccaucaggcguaccagacagauucucaggauccaaaucaggaaacaccgcauuccuaacaguaucaggacuacaagccgaagacgaagcagacuacuacugcgcaucauacgccggaaacaacauauacguauucggaucaggaacaaaaguaacaguacucggacaaccaaaagcaaacccaacaguaacccuauuucccccaucaucagaagaacuacaagcaaacaaagcaacacuaguaugccuaauaucagacuucuacccaggagcaguaacagucgcauggaaagcagacucaucaccaguaaaagcaggaguagaaacaacaacaccaucaaaacaaagcaacaacaaauacgccgcaucaucauacuuaucacuaacaccagaacaauggaaaucacacaaaucauacucaugccaaguaacacacgaaggaucaacaguagaaaaaacaguagccccaacagaaugcuca

SEQ ID NO: 50966 - RNA, 645 nt, Artificial Sequence
  derived and/or modified sequence opt6 from anti-influenza_Chain
ucagcacuaacacaaccaccaucagcaucaggaucaagaggacaaucaauaacaauaucaugcacaggaucaacaucagacauaggcuccuacaacuacguaucaugguaccaacaacacccaggaacagcaccaaaagucauacuauacgaaguaucacaaagaccaucaggaguaccagacagauucucaggaucaaaaucaggaaacacagcauuuuuaacaguaagcggacuacaagcagaagacgaagcagacuacuacugcgcaucauacgcaggaaacaacauauacguuuucggaucaggaacaaaaguaacaguacuaggacaaccaaaagcaaacccaacaguaacacuauucccaccauccagcgaagaacuacaagcaaacaaagcaacacuaguaugccuaauaucagacuucuacccaggagcaguaacaguagcauggaaagcagacuccucccccguaaaagcaggaguagaaacaacaacaccauccaaacaaaguaacaacaaauacgcagcaucaucauaucuaucacuaacaccagaacaauggaaaucacacaaaucauauagcugccaaguaacacacgaaggaucaaccguagaaaaaacaguagcaccaacagaauguuca

SEQ ID NO: 50967 - RNA, 648 nt, Artificial Sequence
  derived and/or modified sequence opt6 from anti-influenza_Chain
caaucagucuuaacacaaccaccaucagaaucaguaucaccaggacaaacagcauccguaacaugcuccggacacaaauuaggagacaaauacguaucaugguaccaacaaaaaccaggacaaucaccaguauuauuaauauaccaagacaacagacgaccaucaggaauaccagaaagauucaucggcagcaacucaggaaacacagcaacacuaacaauaucaggaacacaagcacuagacgaagcagauuauuacugccaagcaugggacucaucaacagcaguauucggaggaggaacaaaacuaacaguacuaggagcagcagcaggacaaccaaaagcagcaccaucaguaacauuauucccaccaucaucagaagaauuacaagcaaacaaagcaacacuaguaugucuaauaucagacuucuacccaggcgccguaacaguagcauggaaagcagacucaucaccaguaaaagccggaguagaaacaacaacaccaucaaaacaaagcaacaacaaauacgccgcaucaucauaccuaucacuaacaccagaacaauggaaaucacaccgaucauacucaugccaaguaacacacgaaggaucaacagucgaaaaaacaguagcaccaacagaaugcuca

SEQ ID NO: 50968 - RNA, 648 nt, Artificial Sequence
  derived and/or modified sequence opt6 from anti-influenza_Chain
caaucagcauuaacacaaccagcaucaguaucaggaucaccaggacaaucaauaacaauaucaugcacaggaacaucaucagacguaggaucauacaaccucguaagcugguaccaacaacauccaggaaaagccccaaaacuaaugauauacgaaguaagcaaaagaccuuccggaguaucaaacagauucuccggaucaaaaucaggaaauacagcaucauuaacaauaucaggauuacaagcagaagacgaagcagacuacuacugccaccuauacguaggaaguucaaacugggucuucggaggaggaaccaaacuagcaguacuaggacaaccaaaagcagcaccaucaguaacacuauuuccaccaucaucaaaagaacuacaagcaaacaaagcaacacuaguaugcccaauaucagacuucuacccaggcgcaguaacaguagcauggaaagcagacagcucaccaguaaaagcaggagucgaaacuacaacaccaucaaaacaaucaaacaacaaauacgcagcaucaucauaccuaucacuaacaccagaacaauggaaaucacacaaaucauacucaugccaaguaacacaugaaggaucaacaguagaaaaaacaguagcaccaaccgaauguagc

SEQ ID NO: 50969 - RNA, 648 nt, Artificial Sequence
  derived and/or modified sequence opt6 from anti-influenza_Chain
gaaauaguacuaacacaaucaccagcaacacuaucaguaucaccaggagaaagagcaacauuaucauguagagcaucacaauccguagacucaaacuuagcaugguaccaacaaaaaccaggacaagcaccaagacuauuaguauacucagccucaacaagagcaacaggaauaccagcaagauucucaggaucaggaucaggcacagaauuuacacuagcaauaagcucacuacaaucagaagauuucgcaguauacuacugccaacacuacacaaacuggccacccagacuaacauucggaggaggauccaaagucgaaauaaaaagaacaguagcagcaccaucaguauucauauucccaccaucagacgaacaacuaaaaucaggaacagcauccgucguaugccuauuaaacaacuucuacccacgagaagcaaaaguacaauggaaaguagacaacgcauuacaaucaggaaacucacaagaaucaguaacagaacaagacagcaaagacucaacuuauucacuauccucaacauuaacauuauccaaagcagauuacgaaaaacacaaaguauacgcaugcgaaguaacacaccaaggucuauccucaccaguaacaaaauccuucaacagaggugaaugc

SEQ ID NO: 50970 - RNA, 648 nt, Artificial Sequence
  derived and/or modified sequence opt6 from anti-influenza_Chain
gaaauaguacuaacacaauccccagcaacacuaucaguaucaccaggugaaagagcaacacuaucaugccgagcaucacaaucaguaucacacaaccuagccugguaccaacaaaaacccggacaagcaccaagacuauuaguauacucagcauccacaagagcaacaggaauaccagcaagauucucaggaucaggaucaggaacagaauuuacacuagcaauaucaucacuacaaucagaagacuucgcaguauacuacugccaacacuacacaaauuacccaccaagacuaacauucggcggaggaucaaaaguagaaauaaaacgaacaguagcagcaccauccguauucauauucccacccucagacgaacaacuaaaaucaggaacagcaucaguaguaugccuacuaaacaacuucuacccacgagaagcaaaaguacaauggaaaguagauaacgcacuacaauccggaaacucacaagaaucaguaacagaacaagacucaaaagacucaacuuacucauuaucaucaacauuaacccuaucaaaagcugacuacgaaaaacacaaaguauacgcaugcgaaguaacacaccaaggacuaucaucaccuguaacaaaaucauucaacagaggugaaugc

SEQ ID NO: 50971 - RNA, 648 nt, Artificial Sequence
  derived and/or modified sequence opt6 from anti-influenza_Chain
gaaauaguaaugacacaaucacccgccacacuaucaguaucaccaggcgaacgcgcaacauuauccugcagagcaucacaaucaguagacucaaaccuagccugguaccaacaaaaaccaggacaagcaccaagacuauuaguauacuccgcaucaacaagagcaacaggcauuccagcaagauucucaggaucaggaucaggaacagaauuuacauuagcaauaucaucacuacaaucagaagacuucgccgucuacuauugccaacauuacacaaacuggccaccaagauuaacauucggaggaggauccaaaguagaaauaaaaagaacagucgcagcaccaagcguauucauauucccaccaucagacgaacaauuaaaaucaggaacagccucaguaguaugccuacuaaacaacuucuacccaagagaagcaaaaguacaauggaaaguagacaacgcacuccaaucaggaaauucacaagaaucaguaacagaacaagacagcaaagacucaacauacagccuauccucaacacuaacauuaucaaaagcagacuacgaaaaacacaaaguauacgcaugcgaaguaacacaccaaggacuaagcucaccaguaacaaaaaguuucaacagaggagaaugc

SEQ ID NO: 50972 - RNA, 648 nt, Artificial Sequence
  derived and/or modified sequence opt6 from anti-influenza_Chain
gaaaucguacuaacacaaucaccagcaacauuaucaguaucaccaggagaaagagcaacauuauccugcagagcaucccaaucaguauccucaaaccuagcaugguaccaacaaaaacccggacaagcaccaagacuacuaguauacucagcaucaacaagagcaacaggaauaccagcaagauucucaggauccggaucuggaacagaauucacauuagcaauaagcucauuacaaucagaagacuucgcuguauacuacugucaacacuacaccaacuggccaccaagauuaacauucggaggaggaucaaaaguagaaauaaaaagaacaguagcagcacccagcguauucauauucccaccaucagaugaacaacuaaaaucaggcacagcaucagucguaugccuacuaaacaacuucuacccaagagaagcaaaaguacaauggaaaguagacaacgcacuccaaucaggaaacucacaagaauccguaaccgaacaagacucaaaagacucaacauacucauuauccucaacauuaaccuuaucaaaagcagacuacgaaaaacacaaaguauacgcaugcgaaguaacacaucaaggacuaucaucaccaguaacaaaaucauucaacagaggagaaugc

SEQ ID NO: 50973 - RNA, 648 nt, Artificial Sequence
  derived and/or modified sequence opt6 from anti-influenza_Chain
gaaauaguacuaacacaaagcccagcaaccuuaagcguaagcccaggagaaagagcaacauuaaguugucgagcaagccaaagcguagaccauaacuuagcaugguaccaacaaaaaccaggacaagcaccaaggcuauuaguauauagcgcaagcacaagagcaacaggaauaccagccagauucucaggaucaggaucaggaacagaauuuacacuagcaauaagcucacuacaaagugaagacuuugcaguuuacuauugccaacacuauacaaauuggccaccaagacuaacauucggaggaggaagcaaaguagaaauaaaaagaacaguagcagccccauccguauucauauucccaccaucugacgaacaacuaaaaucaggaacagcaucuguaguaugcuuacuaaauaacuuuuacccaagagaagcaaaaguacaauggaaaguagauaacgcacuacaaagcggaaacucacaagaaagcguaacagaacaagacucaaaagacucaacuuauaguuuaucaucaacauuaacauuaagcaaagcagacuacgaaaaacacaaaguauacgcaugcgaaguaacacaccaaggacuaucaucaccaguaacaaaaucauuuaacagaggcgaaugc

SEQ ID NO: 50974 - RNA, 648 nt, Artificial Sequence
  derived and/or modified sequence opt6 from anti-influenza_Chain
gaaauaguacuaacacaaucaccagcaacccuaucaguaucaccaggagaaagagcaacacuaucaugccgagcaucacaaucaguaucacacaaccuagcaugguaccaacaaaaaccaggacaagcacccagacuauuaguauauucagcaucaacacgagcaacaggaauaccagcaagauucucagguucaggaucaggcacagaauuuacacuagcaauaucaucccuacaaucagaagauuucgcagucuacuacugccaacacuauacaaacuggccaccaagacuaacauucggaggcggaagcaaaguagaaauaaaaagaacaguagcagcaccaucaguauucauauucccacccucagacgaacaauuaaaaucaggcacagcaucaguaguauguuuacuaaacaacuucuacccacgagaagcaaaaguccaauggaaaguagacaaugcacuacaaucuggaaacucacaagaaucaguaacagaacaagauucaaaagacucaacauacucacuaucauccacacuaacacuaucaaaagccgacuacgaaaaacacaaaguauacgcaugcgaaguaacacaccaaggacuaucaucaccaguaaccaaaucauucaacagaggagaaugc

SEQ ID NO: 50975 - RNA, 648 nt, Artificial Sequence
  derived and/or modified sequence opt6 from anti-influenza_Chain
gaaauaguacuaacacaaucaccagcaacacuaucaguaucaccaggagaaagagcaacauuaucaugcagagcaagccaaucaguaucccacaacuuagccugguaccaacaaaaaccaggacaagcaccaagacuauuagucuacucagcaucaacacgagcaacaggcauaccagcaagauucucaggaucaggcucaggaacagaauuuacacuagcaauaucuucacuacaaucagaagacuucgcaguauacuacugucaacacuacacaaacuucccaccacgacuaacauucggaggaggaucaaaaguugaaauaaaaagaacaguagcagccccaucaguauucauauucccaccaucagacgaacaacuaaaaucaggcacagcaucaguaguaugccuacuaaacaauuucuacccaagagaagcaaaaguacaauggaaaguagacaacgcacuacaaucaggaaacucacaagaaucaguaacugaacaagacucaaaagacucaacauacucacuauccucaacacuaacccuauccaaagcagacuacgaaaaacacaaagucuacgcaugcgaaguaacacaccaaggacuauccucacccgucacaaaaucauucaacagaggagaaugc

SEQ ID NO: 50976 - RNA, 648 nt, Artificial Sequence
  derived and/or modified sequence opt6 from anti-influenza_Chain
gaaauaguacuaacacaaaguccugcaacauuaucaguuucaccaggagaaagagcaaccuuaucauguagagcaagccaaaguguagacucaaaccuagcaugguaccaacaaaaaccaggacaagcccccagacucuuaguauauagcgcaagcacacgagcaacaggaauaccagcaagauucucaggauccggcucaggaacagaauuuacauuagccauaagcucacuacaaagcgaagacuuugcaguauacuauugccaacacuauacaaauuuuccaccaagacuaacauucggaggagggucaaaaguagaaauaaaaagaacagucgcagcaccaagcguauucauauucccaccaucagacgaacaauuaaaaucaggaacagcaucaguaguaugcuuauuaaauaauuuuuacccaagagaagcaaaaguacaauggaaaguagauaacgcauuacaaucaggaaacucacaagaaucaguaacagaacaagauucaaaagacucaacauauagcuuaagcucaaccuuaacauuaucaaaagcagauuacgaaaaacauaaaguauacgccugcgaaguaacacaccaaggauuaucaucaccaguaacaaaaucauuuaacagaggagaaugc

SEQ ID NO: 50977 - RNA, 648 nt, Artificial Sequence
  derived and/or modified sequence opt6 from anti-influenza_Chain
gaaaucguauuaacacaaucaccagccacacucucaguaucaccaggagaaagagcaacacuaucaugcagagcaucacaaucagucgacucaaacuuagcaugguaccaacaaaaaccaggacaagcaccaagacuucuaguauauucagcauccacaagagcaacaggaauaccagcaagauucucaggaucaggaucaggaacugaauuuacacuagcaauaucaucacuacaaucagaagacuuugcaguauacuacugccaacacuacacaaacuacccaccaagacuaacauucgguggcggaucaaaaguugaaauaaaacgaacaguagcagcaccaagcguauucauauucccaccauccgacgaacaacuaaaaucaggaacugcaucaguaguaugccuacuaaacaacuucuacccaagagaagcaaaaguacaauggaaaguagacaacgcacuacaaucaggaaacucacaagaaucaguaaccgaacaagacuccaaagacucaacauacucacuaucaucaacacuaacacuaucaaaagcagacuacgaaaaacacaaaguauacgcaugcgaaguaacacaccaaggauuaucaucuccaguaacaaaauccuucaacagaggagaaugc

SEQ ID NO: 50978 - RNA, 648 nt, Artificial Sequence
  derived and/or modified sequence opt6 from anti-influenza_Chain
gaaacaacauuaacacaaucaccagcaacacuaucaguaucaccaggagaaagagcaacacuaucaugucgagcaucacaaguaauaagccacaaccuagcaugguaccaacaaaaaccaggacaagcaccaagauuacuaauauacggcgcaucaacaagagcaucaggcauaccagcaagauucucaggaucaggaucaggaacagacuauacacucacaauaacaucacuacaaucagaagacuucgcaguauacuacugucaacacuacucaaacuggccaccaagacuaacauucggaggcggaacaaaaguagaaauaaaaagaacaguagcagcaccaagcguauucauauuuccaccaucagacgaacaauuaaaaucaggaacagcaucaguaguaugcuuacuaaacaacuucuauccacgagaagcaaaaguacaauggaaaguagacaacgcacuacaaucaggaaacucucaagaaagcguaacagaacaagacuccaaagacuccaccuacucccuaagcucaacacuaacacuaagcaaagcagacuacgaaaaacauaaaguauacgcaugcgaaguaacacaccaaggauuaucaucaccaguaacaaaaucauucaacagaggagaaugc

SEQ ID NO: 50979 - RNA, 648 nt, Artificial Sequence
  derived and/or modified sequence opt6 from anti-influenza_Chain
gaaauaguacuaacacaaagcccagcaaccuuaagcguaagcccaggagaaagagcaacauuaaguuguagagccucacaaguaauaucacauaacuuagcaugguaccaacaaaaaccaggacaagcaccaagacuauuaauauauggagcaagcacaagagcaucaggcauaccagcaagauucucaggaucaggaucaggaacagacuauacacuaacaauaacaucacuccaaucagaagacuuugcaguuuacuauugccaacacuauucaaauuggccaccaagacucacauucggaggaggaacuaaagucgaaauaaaaagaacagucgcagcaccaucaguauucauauuuccaccaucagacgaacaacuaaaaucaggaacagcaucaguaguaugcuuacuaaauaacuuuuauccaagagaagcaaaaguacaauggaaaguagauaacgcacuacaaucaggaaauucacaagaaucaguaaccgaacaagacagcaaagacucuacauauuccuuaagcucaacccuuacauuaagcaaagcagauuacgaaaaacauaaaguauacgcaugcgaaguaacacaccaaggcuuaagcucaccaguaacaaaaucauuuaacagaggagaaugc

SEQ ID NO: 50980 - RNA, 648 nt, Artificial Sequence
  derived and/or modified sequence opt6 from anti-influenza_Chain
gaaauaguccuaacacaaucacccgcaacacuaucaguaucaccaggagaaagagcaacacuaucaugcagagcaucacaaguaauaucacacaacuuagcaugguaccaacaaaaaccaggccaagcacccagacuacuaauauacggagcaucaacaagagcaucaggaauaccagcuagauucucaggaucaggaucaggcacagacuacacacuaacaauaacaucacuccaaccagaagauuucgcaguauacuacugccaacacuacucaaacuggccacccagauuaacauucggaggcggaacaaaaguugaaauaaaaagaacaguagcagccccauccguauccauauuuccaccaucagacgaacaacuaaaaucaggaacagccucaguaguaugccuacuaaacaacuucuacccacgagaagcaaaaguacaauggaaaguagauaacgcacuacaaucaggaaacucacaagaaucaguaacagaacaagacucaaaagacucaacauacucacuaucaucaacacuaacauuaucaaaagccgacuacgaaaaacacaaaguauacgcaugcgaaguaacacaccaaggauuaucaucaccaguuacaaaaucauuuaacagaggagaaugc

SEQ ID NO: 50981 - RNA, 648 nt, Artificial Sequence
  derived and/or modified sequence opt6 from anti-influenza_Chain
gaaauaguaaugacacaaagcccagcaacauuaagcguuagcccaggagaaagagcaacauuaaguuguagagcaagucaaguaauaagccauaaccuugcaugguaccaacaaaaaccaggucaagcacccagacuauuaauauauggagcaagcacaagagcaucaggaauaccagcaagauucucaggcucaggaucaggcacagacuauacacuaacaauaacaucauuacaaagcgaagacuuugcaguauacuauugccaacacuauagcaauuggccaccaagacuaacauucgguggaggaacaaaaguagaaauaaaaagaacaguagcagccccaucaguauucauauucccaccaucagacgaacaauuaaaaucaggaacagcaucagucguaugcuuacuaaacaacuuuuacccacgagaagcaaaaguacaauggaaaguugauaaugcacuacaaucaggaaacucacaagaaagcguaacagaacaagauucaaaagacucaacauauucauuaagcucaacauuaacauuaaguaaagcagauuacgaaaaacauaaaguauacgcaugcgaaguaacacaccaaggacuaagcucaccaguaacaaaaucauuuaauagaggcgaaugu

SEQ ID NO: 50982 - RNA, 648 nt, Artificial Sequence
  derived and/or modified sequence opt6 from anti-influenza_Chain
gaaauaguacuaacacaaucacccgcaacacuaagcguaagcccaggcgaaagagcaacacuaucaugcagagcaucacaaguaauaucacacaaccuagcaugguaccaacaaaaacccggacaagcaccaagacuacuaauauacggagcaucaacaagagcaagcggaauaccagcaagauucucaggaucaggaucaggaacagacuacacacuaacaauaacaucauuacaaagcgaagacuucgcaguauacuacugccaacacuacucaaacuucccaccaagacuaacauucggagguggaacaaaaguagaaauaaaaagaacaguagcagcaccaucaguauucauauucccaccaucagacgaacaacuaaaaucaggcacagcaucaguaguaugcuuacuaaacaauuucuacccaagagaagcaaaaguccaauggaaaguagauaaugcacuacaaucaggaaacucacaagaaucaguaacagaacaagacucaaaagacucaacauacucacuaagcucaacauuaacacuaaguaaagcagacuaugaaaaacacaaaguauacgcaugugaaguaacacaccaaggacuaaguucaccuguaacaaaaucauucaacagaggcgaaugc

SEQ ID NO: 50983 - RNA, 648 nt, Artificial Sequence
  derived and/or modified sequence opt6 from anti-influenza_Chain
gaaauaguauuaacacaaagcccagcaacauuaucaguaucuccaggagaaagagcaacacuaucaugcagagcaucucaaguaauaucacacaaccuagcaugguaucaacaaaaaccaggacaagcaccaagacuacuaauuuacggagcauccacacgagcaucaggaauaccagcaagauucucaggaucaggcucaggaacagacuacacucuaaccauaaccucacuacaaucagaagauuucgcaguauacuacugccaacacuacucaaacuacccaccacgacuaacauucggaggcggaacaaaagucgaaauaaaaagaacaguagcagcaccaucaguauucauauucccaccaucagacgaacaacuaaaaucaggaacagcauccguaguaugccuauuaaacaacuucuacccaagagaagccaaaguacaauggaaaguagacaacgcacuacaaaguggaaacucacaagaaagcguaacagaacaagauucaaaagacucaacauacucccuaucaucaacacuaacacuaucaaaagcagacuacgaaaaacacaaaguauacgccugcgaaguaacacaccaaggauuaucaucaccaguaaccaaaucauucaacagaggagaaugc

SEQ ID NO: 50984 - RNA, 648 nt, Artificial Sequence
  derived and/or modified sequence opt6 from anti-influenza_Chain
gaaauaguacuaacacaaucaccagcaacauuaucaguaagcccaggagaaagaguaacucuaucaugcagagcaucccaaucaguagccaauaaccuagccugguaccaacaaaaaccaggacaauccccaagacuauuaauauacggagcauccacacgagacacaggcauaccagcaagauucucaggcucaggauccggaacagaauuuacauuaacaauaaguucacuacaaucagaagacuucgcaguauacuacugccaacaauacaacaacuggccaccaauguacacauucggacaaggaacaaaacucgaaauaaaaagaacaguagcagcaccaagcguauucauauucccaccaucagacgaacaauuaaaauccggaacagcaucagucguaugccuacuaaacaauuucuacccaagagaagcaaaaguacaauggaaaguagacaaugcacuacaaucaggaaauucacaagaauccguaacagaacaagacucaaaagacucaaccuauagccuaucaucaacauuaacauuauccaaagcagacuacgaaaaacacaaaguauacgcaugcgaaguaacacaccaaggauuaucaucaccaguaacaaaaucauucaacagaggcgaaugc

SEQ ID NO: 50985 - RNA, 648 nt, Artificial Sequence
  derived and/or modified sequence opt6 from anti-influenza_Chain
gacauaguaaugacacaaucaccaucaacccuauccgcaagcguaggcgacagaguaacaauaacaugcagagcaucacaaucaauaggaaacuggcuagccugguaccaacaaaaaccaggaaaagcaccaaaacuauuaauauacaaaguauccacacuagaaucaggaguaccaucaagauucucaggauccggaucaggcacagaauucacauuaacaauaaacucacuacaaccagacgacuucgcaacauacuacugccaacgauacacaucaaacucacaaggauucaccuucggacaaggaaccaaacuagaaauaaaaagaaccgucgcagccccauccguauucauauucccaccuucagacgaacaauuaaaaucaggaacagcaucugucguaugccuacuaaauaacuucuauccaagagaagcaaaaguacaauggaaagucgacaacgcacuacaauccggaaacucacaagaaucuguaacagaacaagacucaaaagacucaacauacucacuaucaucuacacuaacacuauccaaagcagacuacgaaaaacacaaaguauacgcaugcgaaguaacacaccaaggacuaucaucaccaguaacaaaaucauucaacagaggagaaugc

SEQ ID NO: 50986 - RNA, 648 nt, Artificial Sequence
  derived and/or modified sequence opt6 from anti-influenza_Chain
gacauacaacuaacacaauccccacuaagcccuccaguaacacuaggacaaccagcaucaauauccugcagaucaucacaaagccuacuauacacagacggauucacauaccuaucaugguaccaccaaagaccaggacaaucaccaagaagacuaauauacaaaauaucaaaccgagacucaggaguaccagacagauuuaguggaucaggaucaggaacagacuucacacuaaaaauaucaagaguagaagcagaagauguaggaguauacuacugcaugcaagcaacacacuggccacuaaccuucggagaaggaacaaaaguagaaauaaaaccaaaagcagcaccaagcguaacauuauuuccaccaucaucagaagaauuacaagcaaacaaagcaacacuaguaugccuaauaucagacuucuacccaggagccguaaccguagcauggaaagcagacucaucaccaguaaaagcaggaguagaaacaacaacaccaucaaaacaaagcaacaacaaauacgccgccucaucauaccuauccuuaacaccagaacaauggaaaucacacaaaucauacucaugccaaguaacccacgaaggaagcacaguagaaaaaacaguagcaccaacagaauguuca

SEQ ID NO: 50987 - RNA, 648 nt, Artificial Sequence
  derived and/or modified sequence opt6 from anti-influenza_Chain
gaaauaguacuaacacaaagcccaggaacacuaagccuaagcccuggagaacgagcaacauuaagcugucgagcaagccaaucaguaagaucaaacaauuuagcaugguaucaacauaaaccaggacaagcaccaagauuauuaauauucggagcaucaaguagagcaacaggaauaccagauagauuuagcggaucaggaagugguaccgauuucacacuaacaauaucaagauuagaaccagaagauuucgcaguauauuacugucaacaauacggaaguucacccgcacuaacauucggaggaggaacaaaaguagaaauaaaaagaacagucgcagcaccaagcguauucauauucccaccaucagacgaacaauuaaaaucaggaacagcaucgguuguaugccuacuaaacaacuucuacccaagagaagcaaaaguacaauggaaaguugauaacgcauuacaaagcggaaauucucaagaaagcguaacagaacaagacucaaaagacucaacauauagcuuaagcucaaccuuaaccuuaagcaaagcagauuacgaaaaacauaaaguauacgcaugcgaaguaacacaccaaggauuaucuucaccaguaacaaaaucauuuaacagaggagaaugc

SEQ ID NO: 50988 - RNA, 648 nt, Artificial Sequence
  derived and/or modified sequence opt6 from anti-influenza_Chain
caaucaguccuaacacaacccccaucagcaucaggaucaagaggacaauccauaacaauaucaugcacaggaucaacaucagacauaggaucauacaacuaugucucaugguaccaacaacacccaggaacagcacccaaaguaauacuauacgaaguaucacaaagaccauccggaguaccagacagauuuucaggaucaaaaucaggaaacacagcauuccuaaccguaucaggacuacaaacagacgacgaagcagacuacuacugcgcaagcuacgcaggaaacaacauauauguauucggaucaggaacaaaaguaaccguacuaggacaaccaaaagcaaacccaacaguaacacuauucccaccaucaucagaagaacuacaagcaaauaaagcaacacuaguaugccuaauaucagacuucuacccaggagcaguaacaguagcauggaaagcagacucaucaccaguaaaagccggaguagaaacaacaacaccaucaaaacaauccaacaacaaauacgcagcaucaucauaccuaucacuaaccccagaacaauggaaaucccacaaaucauacucaugucaaguaacacacgaaggaucaacagucgaaaaaacaguagcaccaacagaaugcagc

SEQ ID NO: 50989 - RNA, 651 nt, Artificial Sequence
  derived and/or modified sequence opt6 from anti-influenza_Chain
caaccaguccuaacacaaccuccaucagcaagcggcucaccaggacaaagaguaacaauaucaugcucaggaucaucaucaaacauaggaucauacacaguaaacugguaccaacaacuaccaggaaccgcaccaaaauuauuaaucuacucacuaaaccaaagaccauccggaguaccagacagauucucagguucuaaaucaggaacaucagcaucacuagcaauaucaggacuacaaucagaagacgaagcaguuuauuacugcgcagcaugggacgacucacuaucagcacauguaguauucggaggaggaacaaaauuaacuguacuaggacaaccaaaagcagcaccaucaguaacacuauucccaccaucaucagaagaauuacaagcaaacaaagcaacacuaguaugcuuaauaucagacuucuacccaggagcaguaacaguagcauggaaagcagacucaucacccgucaaagcaggaguagaaacaacaacacccucaaaacaauccaacaacaaauacgcagcaucauccuaccuaucacuaacacccgaacaauggaaaucacacagauccuacucaugccaaguaacacacgaaggaucaacaguagaaaaaacaguagcaccaacagaauguucc

SEQ ID NO: 50990 - RNA, 651 nt, Artificial Sequence
  derived and/or modified sequence opt6 from anti-influenza_Chain
caacccguauuaacacaaccaccaucagcaucaggaacaccaggacaaagaguaacaauaucaugcucaggauccucaucaaacauaggaucaaacacaguaucaugguaccaacaaguaccaggaacagcaccaaaacuacuaaucuauggaaacaacgaaagaccaucagguguaccagacagauucucaggaucaaaaucagcaacaucagcauccuuagcaaucucaggacuccaaucagaagacgaagccgacuacuacugcgcagcaugggacgacucacuaaacggauuuuggguauucggaggaggaacaaaauuaacaguauuaggccaaccaaaagcagcaccaucaguaacucuauucccaccaucauccgaagaacuacaagcaaacaaagcaacauuaguaugccuaauaucagacuucuacccaggagcaguaacagucgccuggaaagcugacucaucaccaguaaaagcaggaguagaaacaacaacaccaucaaaacaaaguaacaauaaauacgcagcaucaucauaccuaucacuaacaccagaacaauggaaaucacacaaaucauacucaugccaaguaacacacgaaggaucaacaguagaaaaaacaguagcaccaacagaaugcucc

SEQ ID NO: 50991 - RNA, 651 nt, Artificial Sequence
  derived and/or modified sequence opt6 from anti-influenza_Chain
ucauacguacuaacacaaccaccaucaguaucaggaacaccaggacaaagaguaauaauauccugcucugguuacucaucaaacaucggaucaaacaccguaaacugguaccaacaauucccuggaacagcaccaagacuacuaaucuacgcaaauaaccaaagaccaccaggaguaccagacagauuuucaggaucaaaauccggaacaucagcaucacucgcaauaucaggacuucaauccgacgacgaaucagacuacuacugcgcagcaugggacgacucacuaaacggccacuggguauucggaggaggcacaaaacuaacaguacuaggacaaccaaaagcugcaccauccguaacacuauucccaccaucaucagaagaacuacaagcaaauaaagcaacacucguaugccuaaucucagacuucuacccaggagcaguuacaguugcauggaaagcugacucaucacccgucaaagcaggaguagaaacaacaacaccaucaaaacaaucaaacaacaaauaugcagcaucaucuuaccuaucauuaacaccagaacaauggaaaucccacagaucauacucaugccaaguaacacaugaaggaucaacagucgaaaaaacaguagcaccaacagaaugcuca

SEQ ID NO: 50992 - RNA, 654 nt, Artificial Sequence
  derived and/or modified sequence opt6 from anti-influenza_Chain
ucauacguacuaacacaaccaccaucaguaucaguagccccaggacaaacagcaagaauaacaugcggaggaaacaacauaggaucaaaaucaguacacugguaccaacaaaaaccaggacaagcaccaguacuaguaguauacgacgacucagacagaccaucaggaauaccagaaagauucucaggaucaaacagcggaaacacagcaacauuaacaaucucaagaguagaagcaggagacgaagcagacuauuacugccaaguaugggacucaucaucagaccacgcaguauucggaggcggaacacaauuaacaguacuaggcgcagcagcaggacaaccaaaagcagcaccaucaguaacacuauucccaccaucaucagaagaacuacaagcaaauaaagcaacacuaguaugccuaauaucagacuuuuacccaggagcaguaacaguagcauggaaagccgacaguucaccaguaaaagcaggaguagaaacaacaacaccaagcaaacaaucaaacaacaaauacgcagcaucaucauacuuaucacuaacaccagaacaauggaaaucacacagaagcuauucaugccaaguaacacacgaaggaaguacaguagaaaaaacaguagcaccaacagaaugcagc

SEQ ID NO: 50993 - RNA, 654 nt, Artificial Sequence
  derived and/or modified sequence opt6 from anti-influenza_Chain
caaucaguaguaacacaaccaccaucaguaucaguagcaccaggacaaaccgcucgaauuacaugcggaggaaacaauauaggaucaaaaucaguacauugguaccaacaaaaaccaggacaagcaccaguauuaguaguauacgacgacucagacagaccaucaggaauaccagaacgauucucuggaagcaacagcggaaacacagcaacacuaacaauaucaagaguugaagcaggagacgaagcagacuacuauugccaaguaugggacagcucaagcgaccacuacguauucggaacaggaacaaaaguaacaguauuaggagcagcagcaggacaaccaaaagcagcaccaucaguaacacuauucccaccaucaucagaagaacuacaagcaaacaaagcaacacucguaugccuaauaucagacuucuaucccggcgcaguaacaguagcauggaaagccgauaguucacccguaaaagcaggaguagaaacaacaacaccaucaaaacaaucaaacaauaaauacgcagcauccucauaccuaucacuaacaccagaacaauggaaaucacauagaaguuacucaugccaaguaacacacgaaggaaguacaguagaaaaaacaguagcaccaacagaaugcagc

SEQ ID NO: 50994 - RNA, 654 nt, Artificial Sequence
  derived and/or modified sequence opt6 from anti-influenza_Chain
cuaucaagaauaaaccacuucgaaaaaauacaaauaauaccaaaaucaucauggucagaccacgaagcaucaucaggaguaucaucagcaugcccauaccaaggaacacccucauuuuucagaaacguagucuggcuaaucaaaaaaaacaacacauacccaacaauaaaaagaucauacaacaacacaaaccaagaagacuuacuaauccuauggggaauacaccacucaaacgacgcagcagaacaaacaaaacucuaccaaaacccaaccacauacauaucaguaggaacaucaacacuaaaccaaagauuaguaccaaaaauagcaacccgcucaaaaguaaacggacaaaacggacgaauggacuuuuucuggacaauacuaaaaccaaacgacgccauaaacuucgaaucaaacggaaacuucauagcaccagaauacgcauacaaaauaguaaaaaaaggagacucagcaauaguaaaaucagaaguagaauacggaaauugcaacacaaaaugccaaacaccaauaggcgcaauaaacuccucaaugccauuccacaacauccacccacuaacaaucggagaaugcccaaaauacgucaaaucaaauaaacuaguauuagccacaggauuacgaaauucaccacuc

SEQ ID NO: 50995 - RNA, 657 nt, Artificial Sequence
  derived and/or modified sequence opt6 from anti-influenza_Chain
uccucagaacuaacacaaccaccaucagcaucaggaaccccaggacaaagaguaacaauaagcugcucuggaucuacaucaaacauaggauacaacccaguaucaugguaccaacaaguacccggcacagcaccaaaacuacuaauauacucaaacacagaaagaccaucaggaguaccagacagauucucaggaucaaaaucaggaaccucagcaucauuagcaauaucaggacuacaauccgaagacgaagcagacuacuacugcgcagccugggacgacacacuaaacggaccaguauuuggaggaggaacuaaaguaacagucuuaggacaaagaacaguagcagcuccauccguauucauauuuccaccaucagacgaacaacuaaaaucaggaacagcaucaguaguaugcuuacucaacaacuucuacccacgagaagcaaaaguacaauggaaaguagauaacgcacuacaauccggaaacucacaagaaucaguaacagaacaagacucaaaagacucaacauacucacuaucaucaacacuaacauuaaguaaagccgacuacgaaaaacacaaaguauacgcaugcgaagucacacaccaaggccuaucaucaccaguaacaaaaucauucaacagaggcgaaugc

SEQ ID NO: 50996 - RNA, 657 nt, Artificial Sequence
  derived and/or modified sequence opt6 from anti-influenza_Chain
gacauaguaaugacacaaagcccacuaucacucccaguaacaccaggagaaccagcaucaauaucuugccgaagcucacaaucauuacuaagaucaaacggauacaacuaccuagacugguaccuacaaaaacccggacaaucaccacaacuacuaauauaccuaggaucaaaccgugcaagcggaguaccagacagauucucaggaucaggaucaggaacagacuucacacuaaaaauaucaagaguagaagccgaagacguagguguauacuacugcaugcaagcauuacaaacaccauacacauuuggacaaggaacaaaacuagaaauaaaaagaacaguagcagcaccauccguauucauauuuccaccaucagacgaacaauuaaaaucaggaacagccucaguaguaugccuacuaaacaacuucuacccaagagaagcaaaaguacaauggaaagucgacaacgcacuacaaagcggaaacucacaagaaagcguaacagaacaagacucaaaagauucaacauacagccuaucaucaacauuaacacuaagcaaagccgacuacgaaaaacacaaaguauacgcaugcgaaguaacacaccaaggccuaucaucaccaguaacaaaaucauucaacagaggcgaaugc

SEQ ID NO: 50997 - RNA, 660 nt, Artificial Sequence
  derived and/or modified sequence opt6 from anti-influenza_Chain
ucauacguacuaacacaaccaccaucagcaagcggaacaccaggacaaagaguuacaauaucaugcucaggauccacauucaacauaggaucaaacgcaguagacugguauagacaacuaccaggaacagcaccaaaacuacuaauauacuccaacaaccaacgaccaucaggaguaccagacagauucuccggcuccagauccggaacaucagcaucacuagcaauaagcggacuacaaucagaagaugaagcagacuacuacugcgcagcaugggacgacauauuaaacguaccaguauucggaggaggcacaaaacuaacagucuuaggagcagcagcuggacaaccaaaagcagcaccaucaguaacacuauucccaccaucaucagaagaacuacaagcaaacaaagcaacacuaguaugccuaauaucagacuucuacccaggagcuguaacagucgccuggaaagcagacucaucaccaguaaaagcaggaguagaaacaacaacaccaucaaaacaaucaaacaacaaauaugcagcaucaucauacuuaucauuaacaccagaacaauggaaaucacacagaucauauucaugccaaguaacacacgaaggaucaacaguagaaaaaacaguagccccaacagaaugcuca

SEQ ID NO: 50998 - RNA, 660 nt, Artificial Sequence
  derived and/or modified sequence opt6 from anti-influenza_Chain
caaucagcacuaacacaaccagcagcaguaucaggaucaccaggacaaucaauaacaauaucaugcacaggaacaucaucagacguaggcggauauaauuacguaucaugguaccaacaacacccaggaaaagcaccaaaauuaaugauauacgaaguaucaaacagaccaucaggagucucaaacagauucucaggaucaaaaucaggaaacacagcaucacuaacaauaucaggacuccaagcagaagaugaagccgacuacuauuguuccucauacacaucaucaucaacauacguauucggcacaggaacaaaaguaacaguacuaggagcagcagcaggacaaccaaaagcagcaccaucaguaacacuauucccaccaucauccgaagaacuacaagcaaacaaagcaacacuaguaugccuaauaucagacuucuacccaggagcugucacaguagcauggaaagcagacucaucaccaguaaaagccggagucgaaacuacaacaccaucaaaacaaucaaacaacaaauacgcagcaucaucauaccuaucauuaacaccagaacaauggaaaucacauagaucauacuccugccaaguaacccacgaaggaucaacaguagaaaaaacagucgcaccaacagaauguuca

SEQ ID NO: 50999 - RNA, 660 nt, Artificial Sequence
  derived and/or modified sequence opt6 from anti-influenza_Chain
uccuacguguuaacacaaccaccaucaguaucaggaacaccaggacaaagagucacaauaucaugcucaggaucaagaucaaacguaggagacaacucaguauacugguaccaacacguaccagaaauggcaccaaaauuacuaguauacaaaaacacacaaagaccaucaggaguaccagcaagauucagcggaucaaaaucaggaacaucugcaucuuuagcaauaauaggacuacaaucuggagaugaagcagacuacuauugcguagcaugggaugacuccguagacggauacguauucggaucuggaacaaaaguaacaguacuaggagcagcagcaggacaaccaaaagcagcaccaucaguaacauuauucccaccaucaagcgaagaauuacaagccaacaaagcaacccuaguaugucuaauaucagacuucuacccaggugcaguaacaguagccuggaaagcagacucaucaccaguaaaagcaggaguagaaacaacaacaccaucaaaacaaagcaacaauaaauacgcagcaucaucauaccuaucacuaacaccagaacaauggaaaucacacagaagcuauucaugccaaguaacacacgaaggaucaacaguagaaaaaacaguagcaccaacagaaugcagu

SEQ ID NO: 51000 - RNA, 660 nt, Artificial Sequence
  derived and/or modified sequence opt6 from anti-influenza_Chain
ucauacguauuaacacaaccaccaucagcaucaggaacaccaggacaacgaguaacaaucucaugcucaggaucaaguucaaauauaggcucaaacuacguauacugguaccaacaauuaccaggaacagcaccaaaauuacuaauauacagagauggacaaagaccaucaggaguaccagacagauucucaggaucaaaauccggaacaucagcaucauuagcaauauccggacuaagauccgacgacgaagcagacuacuacugugcaacaugggacgacaaccuaucaggaccaguauucggaggaggaacaaaauuaacaguacuaggagcagcagccggucaaccaaaagcagcaccaucaguaacacuauucccaccaucaucagaagaauuacaagcaaauaaagcuacauuaguaugccuaauaucagacuucuauccaggagcuguaacaguagcauggaaagcagacucaucaccaguaaaagcaggaguagaaacaaccacaccaucaaaacaaucaaacaacaaauacgcagcaucaucauaccuaucauuaacaccagaacaauggaaaucccacagaucauacucaugccaaguaacacacgaaggcucaacaguagaaaaaacaguagcaccaacagaaugcuca

SEQ ID NO: 51001 - RNA, 660 nt, Artificial Sequence
  derived and/or modified sequence opt6 from anti-influenza_Chain
caaucagcacuaacacaaccagcaucaguauccggaucaccaggacaaucaauaacaauaucuugcacaggaacaucaucagacguaggaggauauaacuacguaucaugguaccaacaacacccaggcaaagcaccaaaauuaaugauauacgaaguaucaaaccgaccaucagguguaucaaacagauucucaggaucaaaaucaggaaacacagcaagccuaacaauauccggauuacaagccgaagacgaagcagacuacuacugcucaucauacacaucaucaucaacacuaguauucgguacaggaacaaaaguaacaguacuaggagcagcagcaggacaaccaaaagcagcaccuucaguaacauuauucccaccaucaucagaagaacuacaagcaaacaaagcaacacuagucugccuaaucucagacuucuacccaggagcaguaacagucgcauggaaagccgacuccucaccaguaaaagcaggagucgaaacaacaacaccaucaaaacaaucaaacaacaaauacgcagcaucaucauaccuaucacuaacaccagaacaauggaaaucacacagaucauacucaugccaaguaacacacgaaggaucaacagucgaaaaaacaguagccccaacagaauguagc

SEQ ID NO: 51002 - RNA, 660 nt, Artificial Sequence
  derived and/or modified sequence opt6 from anti-influenza_Chain
accguacucacacaaccaccaucuguaucaggagcaccaggacaaagaguaacaauauccugcacaggaucaucaucaaacauaggagcaggauaugacguacacugguaccaacaauuacccggaacagcaccaaaauuauuaauauacggaaacuccaacagaccaucaggaguaccagacagauucucaggaagcaaaucaggaacaucagcaacacuaggaauaacaggacuacaaacaggagacgaagcagacuacuacugcggaacaugggacucaucauuaagcgcauacguauucggaacaggaacaaaaguaacagucuuaggagccgcagcuggacaaccaaaagcagcaccaucaguaacauuauucccaccaagcucagaagaacuacaagcaaacaaagcaacacuaguaugccuaauaucagacuucuacccaggugcaguaacaguagcauggaaagccgauucaucaccaguaaaagcaggaguagaaacaacaaccccaucaaaacaaucaaacaauaaauacgcagcaucaucauaccuaucacuaacaccagaacaauggaaaagccauagaucauacucaugccaaguuacacacgaaggaucaacaguagaaaaaacaguagcaccaacagaaugcuca

SEQ ID NO: 51003 - RNA, 663 nt, Artificial Sequence
  derived and/or modified sequence opt6 from anti-influenza_Chain
caaucuguacuaacacaacccccaucagugagcgcagcaccaggacaaaaaguaacaauaucaugcucaggaucaucaagcaauauaggaaacgacuacguaucaugguaccaacaacuaccaggaacagcaccaaaacuacuaauuuacgacaacaacaaaagaccaucaggaauaccagacagauucucaggcucaaaaucagguacaucagcaacacuaggaauaacaggacuacaaacaggagacgaagcaaacuacuacugugcaacaugggacagaagaccaacagcauacguaguauucggaggaggaacaaaacuaacaguacuaggagcagcagcaggacaaccaaaagcagcaccaucaguaacacuauuccccccaucaucagaagaauuacaagcaaacaaagcaacacuaguaugcuuaauaucagacuucuacccaggagcaguaacaguagcauggaaagcagacagcucaccaguaaaagcaggaguagaaacaacaacccccucaaaacaaagcaacaacaaauaugcagcaucaucauaccuaucauuaacaccagaacaauggaaaucacacagaaguuacucaugccaaguaacucaugaaggaucaacaguagaaaaaacaguagcaccaacugaaugcuca

SEQ ID NO: 51004 - RNA, 675 nt, Artificial Sequence
  derived and/or modified sequence opt6 from anti-influenza_Chain
augguaggauuuacaccaguagcauuagcagcauuagcagcaacaggagcauuagcauuuccagcaggaaaugcaacagaauuagaaaaaagacaaacaacaccaaauagugaaggauggcaugauggauauuauuauaguugguggagugauggaggagcacaagcaacauauacaaauuuagaaggaggaacauaugaaauaaguuggggagauggaggaaauuuaguaggaggaaaaggauggaauccaggauuaaaugcaagagcaauacauuuugaaggaguauaucaaccaaauggaaauagcuauuuagcaguauauggauggacuagaaauccauuaguagaauauuacauaguagaaaauuuuggaacauaugauccaagcaguggagcaacagauuuaggaacaguagaaugugauggaaguauauauagacuaggaaaaacaacaagaguaaaugcaccaaguauagauggaacacaaacauucgaucaauauuggagcguaagacaagauaaaagaacaaguggaacuguacaaacgggaugucauuuugaugcaugggcaagagcaggacuaaauguaaacggagaucauuauuaucaaauaguagcaacagaaggauauuuuagcaguggauaugcaagaauaacaguagcagauguagga

SEQ ID NO: 51005 - RNA, 687 nt, Artificial Sequence
  derived and/or modified sequence opt6 from anti-influenza_Chain
agaucagacaaaacacauacaugcccaccuugcccagcaccagaacuauuaggaggccccucaguauucuuauucccaccaaaaccaaaagacacacuaaugauaucuagaacacccgaaguaacaugcguaguagucgacguaucacacgaagacccagaaguaaaauucaacugguacgucgacggaguagaaguacacaacgcaaaaacaaaaccaagagaagaacaauacaauucaacauaccgaguaguaucaguacuaacaguacuacaccaagacuggcuaaacggaaaagaauauaaaugcaaaguaucaaacaaagcacuaccagcaccaauagaaaaaacaauaucaaaagcaaaaggacaaccaagagaaccacaaguauacacacuaccaccaucaagagaagaaaugacaaaaaaccaaguaucacuaaccugccuaguaaaaggauuuuacccaucagacauagcaguagaaugggaaucaaacggacaacccgaaaauaacuacaaaacaacaccaccaguauuagacucagacggcuccuucuuccuauacuccaaacuaacaguagacaaaucaagauggcaacaaggaaauguauucucaugcucuguaaugcacgaagcacuacacaaccacuacacacaaaaaucauuaucauuaucacccggaaaa

SEQ ID NO: 51006 - RNA, 696 nt, Artificial Sequence
  derived and/or modified sequence opt6 from anti-influenza_Chain
cacgcacaagacauacuagaaaaaacacacaacggaaaacuaugcgaccucgacggaguaaaaccauuaauacuaagagacugcucaguagcaggauggcuacuaggaaacccaaugugcgacgaauucauaaacguacccgaauggucauacauaguagaaaaagcaaacccagcaaaugaccuaugcuacccaggaaacuuuaacgacuacgaagaacuaaaacaccuacuaucaagaauaaaccacuucgaaaaaauccaaauaauaccgaaaucaucauggucagaccacgaagcaucauccggaguaucaucagcaugcccauaucaaggaacaccaucauucuucagaaacguaguauggcuaaucaaaaaaaacaacacauacccaacaauaaaaagaucauacaacaacacaaaccaagaagacuuacuaauacuauggggaauacaccacucaaacgacgcagcagaacaaaccaaacuauaccaaaacccaacaacauacauaucagucggcacaucaacacuaaaccaaagacuaguaccaaaaauagcaacaagauccaaaguaaacggacaaaacggaagaauggauuucuucuggacaauauuaaaaccaaacgacgccauaaacuucgaaucaaacggaaacuucauagcaccagaauacgcauacaaaauaguaaaaaaa

SEQ ID NO: 51007 - RNA, 699 nt, Artificial Sequence
  derived and/or modified sequence opt6 from anti-influenza_Chain
augagaccaucaauacaauuccuaggacuauuauuauucuggcuacacggaggacaaugcgacauacaaaugacacaauccccaucaucacuaucagcaucacuaggaggaaacgucaccauaacaugcaaagcaucacaagacauaaauaaauacaucgcaugguaccaacacaaaccaggcaaaggaccaagauuaguaauacacuacacaucaacacuacaaccaggaauaccaucaagauucagcggaucaggaucaggaaccgacuacucauucucaauaucaaacuuagaaccagaagacauagcaacauacuacugccuacaauacgacauacuauacacauucggaggcggaacaaaacuagaaauaaaacgagcagacgcagccccaaccguaucaauauucccaccaucaucagaacaacuaacaucaggcggagccucaguaguaugcuuccuaaacaacuucuacccaaaagacauaaacguaaaauggaaaauagauggcucagaaagacaaaacggaguccuaaauucauggacagaccaagacuccaaagacucaaccuacucaaugucaucaacacuaacacuaacaaaagacgaauacgaaagacacaacuccuacacaugcgaagcaacacacaaaacauccacaucaccaauaguaaaaucauucaacagaaaugaaugc

SEQ ID NO: 51008 - RNA, 702 nt, Artificial Sequence
  derived and/or modified sequence opt6 from anti-influenza_Chain
augaugucaucagcacaauucuuaggacuacuacuacuaugcuuccaaggaacacgaugcgacauacaaaugacacaaacaaguuccucauuaucagcaucacuaggagacagagucacaauaucaugccgagcaucacaagacauaagaaauuaccuaaacugguaccaacaaaaaccagacggaacaguaaaacuacuaauauacuacacaucaagacuacacucaggaguaccaucaagauucucagacuccggaucaggaacagacuauucauuaacaauaucaaaccuagaacaagaagaccuagcaacauacuucugucaacaaacauacacccuaccauggacauucggaggaggaacaaaacuagaaauuaaaagagcagacgcagcaccaacaguaucaauauucccaccaucauccgaacaacuaaccucaggaggagcaucaguaguaugcuuccuaaacaacuuuuacccaaaagacauaaacguaaaauggaaaauagacggaucagaaagacaaaacggcguacuaaacucauggacagaucaagacucaaaagacuccaccuacucaaugucaucaacacuaacccuaacaaaagacgaauacgaaagacauaacucauacacaugcgaagcaacacacaaaaccucaacuucacccauaguaaaaucauucaacagaaacgaaugc

SEQ ID NO: 51009 - RNA, 702 nt, Artificial Sequence
  derived and/or modified sequence opt6 from anti-influenza_Chain
auggaagcacccgcacaacuacuauuccuauuacuauuaugguuaccagacacaacaggagaaauaguacuaacacaaucaccagcaacacuaagccuaagcccaggagaaagagcuacacuaucauguagagcuucagaaaacauauggaacaaucuagcaugguaccaacaaaaacccggacaagcaccaagacuauuaauuucaggagcaucaacaggcgcaacaggaguaccaagcagauuccgaggaucaggaucaagaacagaauuuacacuaacaauaucaucauuacaaagcgaagacuucgcaauauacuucugccaacaauacaacucauggccaagaacauucggaccaggaacaaaagucgaaauaaaacgaacaguagcagcaccaucaguauucauauucccaccaucagaugaacaacuaaaaucaggaacagccucaguagucugccuacuaaacaacuucuacccaagagaagcaaaaguacaauggaaaguagacaacgcacuacaaucaggaaacucacaagaaucaguaacagaacaagacucaaaagauuccacauacucacuaucaucaacacuaacacuaucaaaagcagacuacgaaaaacacaaaguauacgcaugcgaagucacacaccaaggacuaucaucaccaguaaccaaaucauucaacagaggagaaugc

SEQ ID NO: 51010 - RNA, 705 nt, Artificial Sequence
  derived and/or modified sequence opt6 from anti-influenza_Chain
auggaaaccccagcacaacuacuauuccuacuacuacuauggcuaccagacacaacaggagaaauaguucuaacacaaucaccaggaacauuaucacuaucaccaggagaaagagcaacacuaucaugcagagcaucacaaucccuaucaucaucaucccuaguaugguaccaacaaaaacccggccaagcaccaagauuauuaauauacggcgcaucaucaagagcaacaggcauuccagacagauucucaggaucaggaucaggaacagacuucacacuaacaauaucaagacuagaaccagaagacuucgcaguauacuacugucaacaauacggaaacucaccauacaccuuuggacaaggaacacaaguagaaauaaaacgaaccguagcagcaccauccguauucauauuuccaccaucagaugaacaauuaaaaucaggcacagcaucagucguaugcuuacuaaacaacuucuacccaagagaagcaaaaguacaauggaaaguugacaacgcauuacaaucaggaaacucacaagaaucaguaacagaacaagacucaaaagacucaacauauucuuuauccucaacacuaacacuaucaaaagcagacuacgaaaaacacaaaguauacgcaugcgaaguaacacaccaaggauuaagcucacccguaacaaaaucauucaacagaggagaaugu

SEQ ID NO: 51011 - RNA, 705 nt, Artificial Sequence
  derived and/or modified sequence opt6 from anti-influenza_Chain
auggaaacaccagcacaacuauuauucuuacuacuacuauggcuaccagacaccacaggagaaacaguacuaacacaaucaccaggaacccuuucacuaucaccuggagaaagagcaacacuauccugcagagcaucccaaagcgucucaauaucauaccuagcaugguaucaaagaaaaccaggacaagcacccagacuacuaauauacggagcaucaagacgagcuacaggaauaccagauagauucucaggaucaggaucaggaacagacuucacacuaacuauaucaagauuagaaccagaagacuucgcaguauacuacugccaacaauacggaucaucaccauacacauucggucaaggcacaaaacuagaaauaaaaagaacaguagcagcaccaucaguauucaucuuuccaccuucagaugaacaauuaaaaucaggcacagcaucaguaguaugccuacuaaacaauuucuacccaagagaagcaaaaguacaauggaaaguagauaacgcacuacaaucaggaaacucacaagaaagcguaacagaacaagacucaaaagacucaacauacucacuaucaucaacacuaacccuaucaaaagcagacuacgaaaaacacaaaguauacgccugcgaaguaacacaucaaggacuaucaucaccaguaacaaaaucauucaacagaggagaaugc

SEQ ID NO: 51012 - RNA, 705 nt, Artificial Sequence
  derived and/or modified sequence opt6 from anti-influenza_Chain
auggcauggaugaugcuacuauuaacacuacuaauacacuguacaggaucaugggcacaaucaguacuaacucaaccaccaucaguaagcgcagcaccaggucaaaaaguaacaauaucaugcucaggaucaagcucaaacauaggaaaaaacuacguaucuugguaucaacaacuaccaggaacagcaccaaaacuauuaauauacgauaacgauaaaagaccaucaggcauaccagaucgauucucaggauccaaaucaggcacauccgcaacacuaggaauaaccggacuacaaacaggagaugaagcagacuaccacugcggcgcaugggacagcucacuaaacggaggaguauucggaggagguacaaaaguaacaguccuaggacaaccaaaagcagcaccaagcguaacuuuauucccaccauccagcgaagaauuacaagcaaacaaagcaacacuaguaugcuuaauaucagacuucuacccaggagcaguaacaguagcauggaaagcagauagcuccccaguaaaagcaggaguagaaacaacuacaccaucaaaacaaucaaacaacaaauacgcagcaucaagcuaucuaucacucacaccagaacaauggaaaucacaccgaucauacucaugccaaguaacacacgaaggaucaacaguagaaaaaacagucgcaccaacagaaugcagc

SEQ ID NO: 51013 - RNA, 714 nt, Artificial Sequence
  derived and/or modified sequence opt6 from anti-influenza_Chain
augaugaaaaaaaaaucaugguucacacuaaugauaacaggaguaauaucacuauucuucucaguaucagcauucgcuggaaacguauucugggaaccauuaucauauuucaacucaagcacauggcaaaaagcagauggauacucaaauggacaaauguucaacugcacauggagagccaacaacguaaacuucaccaacgacggaaaauuaaaauuaucauuaaccucaccagcaaacaacaaauucgacugcggagaauacagaagcaccaacaacuacggauacggacuauacgaaguaucaaugaaaccagcaaaaaacacaggaauaguaucaucauucuucacauacacaggaccaucacacggaacacaaugggacgaaauagacauagaauuccuaggaaaagacacaacaaaaguacaauucaacuacuacacaaacggaguaggaggacacgaaaaaauaauaaaccuaggauucgacgcaucaacaucauuccacacauacgcauuugacuggcaaccaggauacauaaaaugguacguagacggaguacuaaaacacacagcaacaacaaacauaccaaguacaccaggcaaaauaaugaugaacuuauggaacggaacaggaguagacucauggcuaggaucauacaacggagcaaacccauuauacgcagaauacgacuggguaaaauacacaucaaac

SEQ ID NO: 51014 - RNA, 729 nt, Artificial Sequence
  derived and/or modified sequence opt6 from anti-influenza_Chain
caaguacaauuaguacaaagcggagcagaaguaaaaaaaccaggaaguaguguaaaaguaaguuguaaagcaaguggaggaacauucucaagcuacgcaauuagcuggguaagacaagcaccaggacaaggauuagaguggaugggaggaauaaugggaauguuuggaacaacaaauuacgcacaaaaauuucaaggacgaguaacaauaacagcagaugaauuuacaagugcagcauauauggaauuaagaaguuuaagaucagaagauacagcaguauacuauugugccagaaguucagguuauuacccagaauauuuucaagacuggggacaaggaacauuaguaacuguaagcucaggaacaggaggaagcggaggaacaggaucaggaacaggaggaagcacacaaaguguauuaacacaaccaccaagcgaaucaguaaguccaggacaaacagcaaguguaacaugcaguggacauaaauuaggagauaaauacguaaguugguaucaacaaaaaccaggacaaucaccaguauuauuaauauaucaagauaacagaagaccaaguggaauaccggaaagauuuauaggaucaaauaguggaaauacagcaacauuaacaauaagugggacacaagcacuagaugaagcagauuauuauugccaagcaugggacucaaguacagcaguauuuggaggaggaacaaaauuaacaguauuagga

SEQ ID NO: 51015 - RNA, 729 nt, Artificial Sequence
  derived and/or modified sequence opt6 from anti-influenza_Chain
caaguacaauuaguccaaucaggagcagaaguaaaaaaaccagguucaucaguaaaaguaucaugcaaagcaucaggaggaccauucagaaauuuugcaauaaacuggguaagacaagcaccaggacaaggacuagaauggaugggaggaauaauagcaguauucggaacaacaaaauaugcacauaaauuucaaggaagaguaacaauaacagcagacgauagcacaaauacagcauauauggaacuaggaagucuaaaaucagaagacacagcaguauacuacugcgcaagaggaccacacuacuacucuucauacauggacguauggggagaaggaacaacaguaacaguaucaucaggaaccggaggaucaggaggaacuggaucaggaacaggaggaucaacagauauccaacuaacacaaucuccaagcucauuaucagcaagcguaggugacagaguaacaauaacaugcagagcaucacaaggaauaucaacauacuuagcaugguaucaacaaaaaccaggaaaaguaccgaaauuauuaauauacgcagccucaaccuuacaaucaggaguaccaucaagauucucaggaucaggaucaggaacagacuuuacauuaacaauaucaucacuacaaccagaagacguagcaacauacuacugccaaaaauacaacucagccccaagcuuuggaccaggaacaaaaguagacauaaaaaga

SEQ ID NO: 51016 - RNA, 729 nt, Artificial Sequence
  derived and/or modified sequence opt6 from anti-influenza_Chain
augucauacagaguaaaaagaauguuaaugcuacuaguaacaggacuauuccuaagcuuaagcacauuugcagcaucagcaucagcacaaacaggagggucauucuacgaaccauucaacaacuacaacacaggacuauggcaaaaagcagacggauacucaaacggaaacauguucaacugcacauggagagcaaacaacgugucaaugacaucauuaggagaaaugagacuaucacuaacaucaccaucauacaacaaauucgacuguggcgaaaacagaucaguacaaacauacggauacggacuauacgaaguaaacaugaaaccagcaaaaaacguaggaauaguuucaucauucuucacauacacaggaccaacagacggaacaccaugggacgaaauagacauagaauuccuaggaaaagacacaacaaaaguacaauucaacuacuacacaaacggaguaggaaaccacgaaaaaauaguaaacuuaggauucgacgcagcaaacucauaccacacauaugcauucgacuggcaaccaaacucaauaaaaugguacgucgacggacaacuaaaacacacagccacaacacaaaucccacaaacaccaggaaaaauaaugaugaaccuauggaacggagcaggaguagacgaauggcuaggaucauacaacggaguaacaccacuaucaagaucacuacacuggguaagauacacaaaacga

SEQ ID NO: 51017 - RNA, 735 nt, Artificial Sequence
  derived and/or modified sequence opt6 from anti-influenza_Chain
caaguacaacuacaacaaucaggagcagaaguaaaaaaaccuggaagcucaguaaaaguaucaugcaaaguaucaggaguaauauuuucaggaagugcaauaaguugggucagacaagcaccaggacaaggauuagaauggaugggaggaauaagcccauuauuuggaacaacaaauuacgcacaaaaauuccaaggcagagucacaauaacagcagaucaaucaacaaauacaacauacauggaaguaaauucacucagauacgaagacacagcaguauacuuuugugcaagaggaccaaaauacuauagcgaauacauggacguauggggaaaaggaacaacaguaacaguaucaagcggaacaggaggaucgggcggaacaggaucaggaacaggaggaucaacagauauacaaaugacgcaaaguccaucaagcuuaagugcgaguguaggagauagaguaacaauaacuuguagagcaagccaaggaauaaguucauacuuagcaugguaccaacaaaaaccaggaaaaguaccaacacuauuaaucuaugacgcaagcacauuaaggaguggaguaccaaguagguuuucaggaucaggaucagcaacagacuuuacacuaacaauaaguaguuuacaaccagaagauguagcaacauacuauugccaaagauauaauucagcaccaccaauaacauuuggacaaggaacaagacuagaaauaaaaaga

SEQ ID NO: 51018 - RNA, 735 nt, Artificial Sequence
  derived and/or modified sequence opt6 from anti-influenza_Chain
gaaguacaauuaguagaaaguggagcagaaguaaaaaaaccagguaguucaguaaaaguaaguuguaaagcaucaggaggaacauuuucaaguuacggaauaucauggguaagacaagcuccaggacaaggauuagaauggaugggagauauaauaggaauguuuggaaguacaaauuaugcacaaaauuuucaaggaagacuaacaauaacagcagaugaaaguacuucaacagcauauauggaauuaucaucacuaagaagugaagauacagcaguauauuauugugcaagaaguagcggauauuauccagcauauuuaccacauuggggacaaggaacauuaguuacaguaaguaguggaacaggaggaaguggaggaacaggaucaggaacagggggaucaacagaaauagugcuaacacaaaguccuggaacauuaucauuaucaccaggagaaagagcaacacuaaguugcagggcaucacaaaguguaagcagcaguuauuuagcaugguaucaacaaaaaccaggacaagcaccaagacuauuaauauauggagcaagcaguagagcaacaggaauaccagauagauuuaguggaaguggaaguggaacagauuuuacauuaacaauaaguagacuagaaccagaagauuuugcaguauauuauugucaacaauauggaaguaguccaagaacauuuggaggaggaacgaaaguagaaauaaaaaga

SEQ ID NO: 51019 - RNA, 735 nt, Artificial Sequence
  derived and/or modified sequence opt6 from anti-influenza_Chain
gaaguccaauuaguagaaucaggagcagaaguaaaaaaaccaggaaguucaguaaaaguaucauguaaagcaagugggggaacauucaguaguuaugcgauaaguuggguaagacaagcaccaggacaaggacuagaauggaugggaggaauaauaggaauguuuggaacagcgaauuaugcacaaaaauuucaaggaagaguaacaauaacagcagaugaauuuacaagcacggcauauauggaacuaagcaguuuaagaagugaagauacagcaguauacuauugugcaagaggaaauuauuauuaugaaagcaguuuagauuauuggggacaaggaacauuaguaacaguaaguaguggaacaggaggaagcggaggaacaggaaguggaacagguggaaguacacaaaguguaguaacgcaaccuccaucaguaagcguagcaccaggacaaacagcaaggauaacaugugguggaaauaauauaggaucaaaaaguguacauugguaucaacaaaaaccaggacaagcaccaguauuaguaguauacgaugauucagauagaccaagcggaauaccagaaagauuuaguggaaguaacagcggaaauacagcaacauuaacaauaaguagaguagaagcaggagaugaagcagauuauuauugucaaguaugggauaguaguagugaucauuauguauuuggaacaggaacgaaaguaacaguauuagga

SEQ ID NO: 51020 - RNA, 735 nt, Artificial Sequence
  derived and/or modified sequence opt6 from anti-influenza_Chain
gaaguacaauuaguacaaaguggagcagaaguaaaaaaaccuggagcaucaguaaaaguuucauguaaagcaucaggauauacguuuacaggauauuauguauauuggguaagacaagcaccuggacaaggauuagaauggaugggauggauaagcgcauauaauggaaauacaaauuaugcacaaaaauuucaaggaagaguaacaauaacagcagauaaaucaacaucaacagcauauauggaauuaagcucauuaagaagugaagauacagcaguauauuauugugcaagaucaagaagcuuagauguauggggacaaggaacaacaguaacaguaucaaguggaacagguggaagcggugguacaggaucaggaacaggaggaaguacagacguaguaaugacacaaagcccagacucacuagcgguaucauuaggagaaagagcaacaauaaauugcaaaaguucacaaucaguauuauauaguagcaauaauaaaaacuauuuagcgugguaucaacaaaaaccaggacaaccuccaaaauuauuaauauauugggcaucaacaagagaaucaggaguaccagauagauuuaguggaaguggaucaggaacugacuuuacauuaacaauaucgagucuacaagcagaagacguagcaguauauuauugucaacaauacuauagcacaccacuaacuuuuggaggaggaacaaaaguagauauaaaaaga

SEQ ID NO: 51021 - RNA, 735 nt, Artificial Sequence
  derived and/or modified sequence opt6 from anti-influenza_Chain
gaaguacaauuaguagaaacaggagcagaaguaaagaaaccaggaucaaguguaaaaguaccauguaaaaguagcggaaguccauuuagaaguaaugcgguaaguuggguaagacaagcaccagggcaaggauuagaauggguaggaggaauauuaggaguauuuggaaguccaaguuaugcacaaaaauuucaaggaagaguaacaauaacagcagaugaaaguacaaauacagugcauauggaauugagaggauugaggucagaagauacagcaguauauuauugugcaagaggaccaacauauuauuauaguuauauggauguauggggaaaagggacaacaguaacagugagcucaggaacaggaggaucaggaggaacaggaaguggaacaggaggaaguacaaguuauguauuaacacaaccaccaagugaaaguguagcaccuggacaaacagcaagaauaacauguggaggaaauaacauaggaagaaauaguguacauugguaucaacaaaaaccaggacaagcaccaguguuaguaguauaugaugacagugaucgaccaaguggaauaccagaaagauuuaguggaaguaaaagcggaaauacagcaacacuaauaauaaguagaguagaaguaggagaugaggcagauuacuauugccaaguauggcauucaaguagugaucauuauguauuuggaacaggaacaaaaguaacaguauuagga

SEQ ID NO: 51022 - RNA, 735 nt, Artificial Sequence
  derived and/or modified sequence opt6 from anti-influenza_Chain
caaaugcaauuaguacaaagcggcgcagaaguaaaaaaaccaggaaguucaguaaaaguaucauguaaagcaucaggagggacauuuaguucauaugcaaucucauggguaagacaagcaccaggacaaggauuagaauggaugggaggaauauuuggaauguuuggaaccgcaaauuaugcacaaaaauuucaaggaagaguaacaauaacagcagaugaauuuacaucagcagcuuauauggaauuaaguagucucggaagugaagauacagcaauguauuauugugcaagaucaagcggauauuauccacaauauuuucaagauuggggacaaggaacuuuaguaacaguuaguaguggaacaggaggaaguggaggaacaggaagcggaacaggaggaucaacagaaauaguaaugacccaaucaccaggaacauuaagcuuaaguccaggacaaagagcaacacuaagcuguagagcaagccaaucaguaaguucaagcuauuuagcaugguaucaacaaaaaccaggacaagcuccaagauuauuaauguauggagcaucaagcagagcaacaggaauaccagauagauucaguggaaguggaaguggaacagauuuuacauuaacaauaucgagauuagaaccagaagauuuugcaguauauuauugucaacaauacggaaguagcucauuaacguuuggaggagguacaaaauuagaaauaaaaaga

SEQ ID NO: 51023 - RNA, 735 nt, Artificial Sequence
  derived and/or modified sequence opt6 from anti-influenza_Chain
caaguacaauuaguacaaaguggagcagaaguaaaaaaaccaggaaguaguguaaaaguaagcuguaaagcaagcggaguaacauuuaguuauuaugcaaugagcuggguaaggcaagcaccaggacaaggauuagaauggaugggaggaauaaguccaauguuuggaacaacaacauaugcgcagaaauuucaaggaagaguaacaauaacggcagaugauucaacaaguacagcauauauggaaguaagaaguuuaagaucagaagauacagcaguauauuauugugcaagaucaaguaauuauuaugauaguguauaugauuauuggggacaaggaacauuagugacaguaaguagcggaacaggaggaaguggaggaacagggaguggaacaggaggaaguacacaaaguguaguaacacaaccaccaagugaaucaguagcaccagggcaaacagcgagaauaacauguggaggacauaauauaggaaguaauucaguucauugguaccaacaaaaaccuggacaagcaccaguacuaguaguauaugauaauagugauagaccaaguggaauaccagaaagguuuucaggaaguaauaguggaaauacagcaacauuaacaauaucaagaguagaagcaggugaugaagcagauuacuauugucaaguauggggaaguaguagugaucauuauguauuuggaacaggaacaaaaguaacaguauuagga

SEQ ID NO: 51024 - RNA, 738 nt, Artificial Sequence
  derived and/or modified sequence opt6 from anti-influenza_Chain
caaguacaauuaguacaaaguggaggaggauuaguaaaaccaggaggaucauuaagacuuucaugugcugcuaguggauuuacauuuagcaguuauaguaugaauuggguaagacaagcaccuggaaaaggauuagaauggguaucgaguauaagcucaucaucaucauauauauauuacguggauucaguaaaaggaagauuuacaauaaguagagauaaugcuaaaaauagcuuauauuuacaaaugaauaguuuaagagcagaagauacagcaguauauuauugugcaagaggaggaggaaguuauggagcauacgaaggauucgauuauuggggacaaggaacauuaguaacgguaucaucaggaacaggaggaucaggaggaacaggaaguggaacaggaggaaguacagaaauaguuuuaacacaaagcccaggaacauuaagccuaagcccaggagaaagagcaacauuaaguuguagagcaagccaaagaguaucaaguuaccuagcaugguaccaacaaaaaccgggacaggcaccaagacuauuaauauauggagcaucaacaagagcagcaggaauaccagauagauucaguggaaguggaagcggaacagauuuuacauuaacaauaaguagauuagaaccagaagauagugcaguguauuauugucaacaauauggaagaacaccacuuacauuuggaggaggaacaaaaguagaaauaaaaaga

SEQ ID NO: 51025 - RNA, 738 nt, Artificial Sequence
  derived and/or modified sequence opt6 from anti-influenza_Chain
gaaguacaacuaguagaaaguggagcagaaguaaaaaaaccaggaucaaguguaaaaguaaguuguaaagcaaguggaggaccauuuagaaguuaugcaauaagcuggguacgacaagcaccaggacaaggaccagaauggauggguggaauaauaccaauauuugggacaacgaaauaugcgccaaaauuucaaggaagaguaacaauaacagcagaugauuuugcaggaacgguauauauggaauuaaguaguuuaagaucagaagauacagcaauguauuauugugcaaaacauaugggauaucaaguaagagaaacaauggauguauggggaaaaggaacaacaguaacaguaucuagugggacagggggaaguggaggaacagguaguggaacagggggaaguacaaguuacguauuaacacaaccaccgucgguaaguguagcaccaggacaaacagcaagaauaacauguggaggaaauaauauaggaaguaaaaguguacauugguaucaacaaaaaccaggacaagcaccaguauugguaguauaugaugacucagauagaccaaguggaauaccagaaagauuuaguggaagcaauaguggaaacacagcaacauuaacaauaucaagaguagaagcaggagaugaagcagauuauuauugucaaguaugggauaguaguagugaucaugcaguauuuggaggaggaacacaacuaacaguauuaggg

SEQ ID NO: 51026 - RNA, 738 nt, Artificial Sequence
  derived and/or modified sequence opt6 from anti-influenza_Chain
gaaguacaacuaguagaaacaggagcugaagugaaaaaaccaggagcaagcguaaaaguaaguuguaaagcaaguggauauacauuuacaagcuauuacaugcauuggguaagacaagcaccaggacaaggauuagaauggaugggauggauaaauccaaauagcgggggaacaaauuaugcacaaaaauuucaaggaagaguaacaaugacaagagauacaaguauaagcacagcauauauggaacuaaguagauuaagaagugaugauacagcuguauacuauugugcaagagaaggaaaauggggaccacaagcagcauuugauauauggggacaaggaacaaugguuacaguaagcaguggaacuggaggaucagggggaacagggucaggaacaggaggaagcacagaaauaguaaugacacaaucaccaggaacauuaagccuaaguccuggugaaagagcaacauuaucauguagagcaagucaaagcguaagcucaaguuaucuagcaugguaucaacaaaaaccaggacaagcaccaagauuauuaauauaugaugcaucaaguagagcaacagauauaccagaucgauuuaguggaaguggaaguggaacagauuuuacauuaacaauaucaagacuagaaccggaagauuuugcaguauauuauugucaacaauauggaagcucauuauggacauuuggacaaggaacaaaaguagaaauaaaaaga

SEQ ID NO: 51027 - RNA, 738 nt, Artificial Sequence
  derived and/or modified sequence opt6 from anti-influenza_Chain
gaaguacaauuaguggaaucaggaggaggauuaguacaaccuggaggaucauuaagauuaaguugugcagccucaggauuuacauuuaguauauaugcgaugucauggguaagacaagcaccaggaaaaggcuuagaauggguaucagcaauaagcucaaguggagauucaacauauuaugcagacucaguuaaaggaagauuuacaauaucaagagauaaugcaagaaauacauuauauuuacaaaugaacucauuaagagcugaagauacagcaguauauuauugugcaagagcuuauggauacacauuugauccauggggacaagguacauuaguaacaguaucaucagguacaggaggaucaggggguacaggaucaggaacaggaggaaguacagaaauuguauuaacacaaaguccacuaucacuaccaguaacaccaggagaaccggcaucaauaucauguagaaguucacaaagucuacuacauucgaauggauauaauuauuuagauugguauuuacaaaaaccaggacaaucaccucaauuauuaauauauuuaggaucaaauagagcaaguggaguaccagauagauucucaggaucaggaucaggaacagauuuuacauuaaaaauaaguagaguugaagcagaagauguaggaguauacuauuguaugcaagcacuacaaacaccauuaacauucggaggaggaacaaaaguagaaaucaaaaga

SEQ ID NO: 51028 - RNA, 738 nt, Artificial Sequence
  derived and/or modified sequence opt6 from anti-influenza_Chain
gaaguacaacuaguagaaacaggagcggaaguaaaaaaaccaggaaguucgguaaaagugucuugcaaagcaaguggagggacauuuagaacacaugcaauaaguuggguaagacaagcaccaggacaaggacuagaauggaugggaggaauaauagcaauauuuggaacagcaaauuaugcacaaaaauuucaaggaagaauaacaauaaccgcggaugaaaguacaaguacagcauauauggaacuuaguagucuaagaagcgaagauacggcaguauauuuuugugcaagagggaguggauaucacauaaguacaccauuugauaauuggggacaaggaacauuaguaacaguaaguucaggaacaggaggaaguggaggaacaggaucaggaacaggaggaaguacaaguuauguauuaacucaaccaccaaguguaaguguagcaccaggucaaacagcaagaauaacauguggaggaaauaauauaggaucaaaaggaguacauugguaccaacaaaaaccagggcaagcaccaguacuaguaguauaugaugauagugauagaccaagcggaauaccagaaagauuuucaggaagcaauaguggaaacacagcaacauuaacaauaaguagaguggaagcaggagaugaagcagauuauuauugucaaguaugggauucaaguagugaucauguaguauuuggaggaggaacuaaacuaacaguacuagga

SEQ ID NO: 51029 - RNA, 738 nt, Artificial Sequence
  derived and/or modified sequence opt6 from anti-influenza_Chain
gaaguacaauuaguacaaucaggagcagaaguaaaaaaaccaggaaguucaguaaaaguaucauguaaagcuucaggaggaauauuuagaagcaauucaauaucauggguaagacaagcaccaggacaaggauuagaauggaugggaggaauauuugcauuauuugguacaacagauuaugcacaaaaauuucaaggaagaguaacaauaacagcagaugaaucaagcacaacaguauaucuagaauuaaguucauuaacaagugaagauacagcaguauauuauugugcaagaggaucaggauauacaacaagaaauuauuuugacuacuggggacaaggaacauuaguaacaguaagcucaggaacagguggaaguggaggaacaggaucaggaacagguggaaguacagaaauaguauuaacacaaagcccaggaacauuaucacuaucaccaggagaacgagcaacauuaucauguagagcaucacaaucaguaaguaguaauuacuuaggaugguaucaacaaaaaccaggacaagcaccaagacuauuaauuuauggugcaaguagcagagcaucaggaauaccagauagauuuucaggaggaggaucaggaacagauuuuacauuaacaauaaguagauuagagccagaagauuuugcaguauauuauugucaacaauauggaucaaguccauuaaccuuuggagguggaacaaaaguagaaauaaaaaga

SEQ ID NO: 51030 - RNA, 738 nt, Artificial Sequence
  derived and/or modified sequence opt6 from anti-influenza_Chain
gaaguacaauuaguagaaucaggagcagaaguaaaaaaacccggauccaguguaaaaguaucauguaaagcaagcggaggaauauuuaauucauacgcaauaaguuggguaagacaagcaccaggacaaggauuagaauggaugggaggaauaauagcaauauuucauacaccaaaauacgcacaaaaauuucaaggaagaguaacaauaacagcagaugaaucaacaaauacagcauauauggaauuaagaucauuaaaaagugaagauacugcuuuauauuauugugcaagaggaagcacauaugacuuuucaagcggacuagauuauuggggacaagguacauuaguaacaguaaguucaggaacgggaggaaguggaggaacaggaucagguacaggaggaaguacacaagcaggacuaacacaaccuccaaguguaaguguagcaccaggacaaacagcgagaauaacauguggaggaaacaauauaggaagcaaaagcguacauugguaucaacaaaaaccuggacaagcaccaguauuaguaguauaugaugauagcgauagaccaaguggaauaccagaaagauuuucaggaucaaauucaggaaauacagcaacacuaacaauaaguagaguagaagcaggagaugaagcagauuauuauugucaaguaugggauucaaguagugaucauguaguauuuggaggaggaacaaaacuaacaguacuagga

SEQ ID NO: 51031 - RNA, 741 nt, Artificial Sequence
  derived and/or modified sequence opt6 from anti-influenza_Chain
caaaugcaauuaguucaaaguggagcagaaguaaaaaaaccaggaagcucaguaaaaguaaguuguaaagcaucaggaggaacauuuaguaguuaugcuauaacauggguaagacaagcaccaggacaaggauuagaauggaugggaggaauaauaggaauguuugguagcacaaauuaugcacaaaauuuucaaggaagagugacaauaacagcagaugaaucaacaagcacagcauauauggaacuaucaucacuaagaucagaagauacagcaguauauuauugugcaagaaguacaggauauuauccagcauauuuacaucauuggggacaaggaacauuaguaacaguaaguucaggaacaggaggaaguggagguacaggaucaggaacaggaggaagcacacaaagugcgcuaacacaaccaagaaguguaagcggaaguccaggacaaaguguaacaauaucaugcacaggaacaucaagugauguaggaggauauaauuauguaucaugguaucaacaacauccuggaaaagcaccaaaauuaaugauauaugauguuaguaaaagaccaucaggaguaccagauagauuuaguggaaguaaaaguggaaauacagcaaguuuaacaauaucaggauuacaagcagaagaugaagcagauuauuacuguaguucauauacgagcaguaguacacauguauuuggaacagggacaaaaguaacgguauuagga

SEQ ID NO: 51032 - RNA, 744 nt, Artificial Sequence
  derived and/or modified sequence opt6 from anti-influenza_Chain
gaagugcaauuaguagaaaguggagcagaaguaaaaaaaccaggaucaaguguaaaaguaucauguaaagcgaguggaggaccuuucagaaguuaugcaauaaguugggucagacaagcaccaggacaagggccagaauggaugggaggaauaauaccaauauuuggaacaacaaaauaugcaccaaaauuucaaggaagaguaacaauaacagcagaugauuuugcaggaacaguauauauggaauugucaagucuaagaagugaagauacagcuauguauuauugugcuaaacauaugggauaucaaguaagagaaacaauggauguauggggaaaagggacaacaguaacaguaaguaguggaacaggaggaaguggaggaacagguucaggaacaggaggaucaacaaguuauguuuuaacacaaccaccaagugcaaguggaacaccaggacaacgaguaacaauaucauguucaggaucaacauuuaauauaggaaguaaugcaguugauugguauagacaauuaccaggaacagcaccaaaacuauuaauauauaguaauaaucaaagaccaaguggagugccagauagauuuagcggaagucgaaguggaacaagugcaucauuagcaauaucaggauugcaaucagaagaugaagcagauuauuacugugcagcaugggaugauauauuaaauguaccaguauuuggaggaggaacaaaauuaacaguauuagga

SEQ ID NO: 51033 - RNA, 744 nt, Artificial Sequence
  derived and/or modified sequence opt6 from anti-influenza_Chain
caaguacaauuaguacaaaguggagcagaagucaaaaaaccaggaucaagcguaaaaguaagcuguaaagcaaguggaggaccauucagaagcuaugcaauaagcuggguaagacaagcaccaggacaaggaccagaauggaugggaggaauaauaccgauauucggaacaacaaaauacgcaccaaaauuucaaggaagaguuacaauaacagcagacgauuuugcaggaacaguauauauggaacuaucaagcuuaagaucagaagauacagcaauguauuacugugcaaaacacaugggauaucaagugagagaaacaauggacguauggggaaaaggaacaacaguaacaguaaguaguggaacaggaggaucaggaggaacaggaagcggaacaggaggaucaacacaaagcgcacuaacacaaccagcagcaguaucaggaucaccaggacaaaguauaacaauaaguugcacgggaacaagcagcgacguaggaggauacaauuacgugagcugguaccaacaacauccaggaaaagcaccaaaacuaaugauauaugaaguaagcaauagaccaaguggaguaucaaacagauucucaggaucaaaaucaggaaauacagcaagcuuaacaauaaguggauuacaagcagaagacgaagcagauuauuauugcucaagcuauacaucaagcaguacauauguauuuggaacagguacaaaaguaacaguauuaggg

SEQ ID NO: 51034 - RNA, 744 nt, Artificial Sequence
  derived and/or modified sequence opt6 from anti-influenza_Chain
gaaguacaauuaguggaaaguggagcagaagugaaaaagccaggaaguagcguaaaaguaaguuguaaagcaaguggaggaccauuuagaaguuacgcaauaagcuggguaagacaagcaccaggacaaggaccagaauggaugggaggaauaauaccaauauuugggacaacaaaauaugcaccaaaauuucaaggaagaguaacgauaacagcagaugauuuugcaggaacgguauauauggaauuaaguaguuuaagaucagaagauacagcaauguauuauugcgcaaaacauaugggauaucaaguaagagaaacaauggauguguggggaaaaggaacaacaguaacaguaaguagcggaacagguggaagcggaggaacaggaaguggaacaggaggaaguacaaguuauguauuaacgcaaccaccaaguguaagcggaacaccaggacaaagaguaacaauaaguuguagcggaucgagaaguaauguaggagauaauucaguauauugguaucaacauguaccagaaauggcaccaaaauuauuaguauauaaaaauacacaaagaccaaguggaguaccagcaagauuuagcggaaguaaaaguggaacaucagcaagucuagcgauaauuggauugcaaaguggagaugaagcagauuauuauuguguagcaugggaugauaguguagacggauauguauuuggaaguggaacaaaaguaacaguauuagga

SEQ ID NO: 51035 - RNA, 744 nt, Artificial Sequence
  derived and/or modified sequence opt6 from anti-influenza_Chain
gaaguacaauuaguugaaaguggagcagaaguaaaaaaaccaggaucaaguguaaaaguaagcuguaaagcaaguggaggaccauuuagaaguuaugcaauaucauggguaagacaagcaccuggacaaggaccagaauggaugggaggaauaauaccaauauucggaacaacaaaauacgcaccaaaauuucaaggaaggguaacaauaacagcagaugauuucgcaggaacaguauacauggaauuaaguucauuaagaagugaagauacagcaauguauuauugugcaaaacauaugggauaucaaguaagagaaacaauggauguauggggaaaagggacaacaguaacaguaagcaguggaacaggaggaagcggagggacaggaaguggaacaggaggaucaacaaguuacguauuaacacaaccaccaagugcaaguggaacaccagggcaaagaguaacaauaagcuguaguggaucaaguaguaauauaggaucaaauuauguauauugguaccaacaauuaccgggaacagcaccaaaauuauuaauauauagagauggacaaagaccaaguggaguaccagauagauuuaguggaaguaaaucaggaacaagcgcaaguuuagcaauaagcggacuaagaagcgaugaugaagcggauuauuauugugcaacgugggacgauaauuuaaguggaccaguauuuggaggaggaacaaaauuaacaguacuagga

SEQ ID NO: 51036 - RNA, 744 nt, Artificial Sequence
  derived and/or modified sequence opt6 from anti-influenza_Chain
gaaguacaauuaguagaaucaggagccgaaguaaaaaaaccaggaaguagcguaaaaguaagcuguaaagcaaguggaggaacauuuaguuuuuauaguaugagcuggguaagacaggcaccaggacaaggauuagaauggaugggaggaauaauaccaauguuuggaacaacaaauuaugcacaaaaauuucaaggaagaguaacaauaacagcaguagaaaguacaaguacagcauauauggaaguaucaaguuuaagaagugaagauacagcaguauauuauugugcaagaggagauaaaggaauauauuauuauuauauggauguaugggguaaaggaacaacaguaacaguaaguagcggaacaggaggaucaggaggaacaggaaguggaacaggaggaaguacacaaagugcguugacgcaaccagcaucaguaucaggaucaccaggacaaaguauaacaauaagcuguacaggaacaaguagugauguaggaggauauaauuaugugagcugguaucaacaacauccaggaaaagcaccaaaauuaaugauauaugaaguaaguaauagaccaagcgggguaaguaauagauuuucaggaucaaaaagcgguaauacagcaagucuaacaauaaguggauuacaagcagaagaugaagcagauuauuauuguaguucauauacaaguagcaguacauuaguauucgggacaggaacaaaaguaacaguauuagga

SEQ ID NO: 51037 - RNA, 744 nt, Artificial Sequence
  derived and/or modified sequence opt6 from anti-influenza_Chain
augagucuauuuggagauacaauagcauauuuauuaagcuuaauagaagacggagaaggaaaagcagaauuagcagaaaaauuacacuguugguuuggaggaaaagaauucgaucuagauagcgcacuagaauggauaaaaaauaaaagaugcuuaacagauauacaaaaagcacuaauaggagcaaguauaugcuuuuuaaaaccaaaagaccaagaaagaaaaagaagauuuauaacagaaccauuaucaggaaugggaacaacagcaacaaaaaaaaaaggauugauauuagcagaaagaaaaaugagaagauguguaucauuccaugaagcauucgaaauagcagaaggacacgaaaguagcgcauuacuauauugcuuaaugguaauguauuuaaauccagaaaauuauagcaugcaaguaaaacuaggaacgcuaugugcauuaugcgaaaaacaagccagucacucgcacagagcacauagcagagcagcaagaucaagcguaccaggagucagacgagaaaugcaaaugguaagugcaaugaauaccgcaaaaacgaugaaugguaugggaaaaggagaggacguacaaaaacuagcagaagaacuacaaaauaauauaggaguauuaagaucauuaggggcaucacaaaaaaacggagaaggaauagcaaaagauguaauggaaguacuaaaacaaucaaguaugggaaacagugcacuaguaagaaaauacuua

SEQ ID NO: 51038 - RNA, 747 nt, Artificial Sequence
  derived and/or modified sequence opt6 from anti-influenza_Chain
gaaguacaauuaguagaaaguggagcagaaguaaaaaaaccaggaucaaguguaaaaguaagcuguaaagcaaguggaggaccauuuagaaguuacgcaauaaguuggguaagacaagcaccuggacaagguccagaauggaugggaggaauaauaccaauauuuggaacaacaaaauaugcaccaaaauuucaaggaagaguaacgauaacagcagaugacuuugcaggaacaguauauauggaacuaucaucauuaagaucagaagauacagcaauguauuauugugcaaaacauaugggauaucaaguaagagaaacaauggauguuugggguaaaggaacaacaguaacaguaaguucaggaacaggaggaaguggaggaacaggaucaggaacaggaggaaguacacaaaguguuuuaacacaaccaccaaguguaagugcagcaccaggacaaaaaguaacaauaagcuguagcggaaguucaagcaauauaggaaaugacuauguaaguugguaucagcaacuaccagguacugcaccaaaacuacuaauauaugauaauaauaaaagaccaagcggaauaccagacagguuuaguggaucaaaaagcggaacaagugcaacauuaggaauaacaggacuacaaacaggugaugaagcaaauuauuauugugcgacgugggauagaagaccaacagcauauguaguauuuggaggaggaacaaaacuaacaguuuuagga

SEQ ID NO: 51039 - RNA, 750 nt, Artificial Sequence
  derived and/or modified sequence opt6 from anti-influenza_Chain
caaguacaauuaguacaaucaggagcagaaguaaaaaaaccaggaucaagcguaagaguaucauguaaagcaucaggaaguauauuuagaaauuaugcaaugucauggguacgacaagcaccaggacaaggauuagaauggaugggaggaauaauagcaauuuuugguacaccaaaauaugcacaaaaauuucaaggaagaguaacaauaacagcagaugaaagcacaucaacuguauauauggaauuaaguggauuaagaagugaagauacggcaauguauuauugugcaagaauaccucauuauaacuuuggaagcggaaguuauuuugacuauuggggacaaggaacauuaguaacaguaaguagugguacaggaggaaguggaggaacaggaaguggaacaggaggaaguacaacaguacuaacucaaccaccaucaguaucaggagcaccaggacaaagaguaacaauaucaugcacaggaucaucaucaaacauaggagcaggauaugauguacauugguaucagcaauuaccaggaacagcaccaaaauuauuaauuuauggaaauucaaauagaccaagcggaguaccagauagauuuucaggaagcaaaaguggaacaagugcaacacuaggaauaacaggauuacaaacaggagaugaagcugauuauuauuguggaacaugggauucaaguuuaagugcauauguauuuggaacagggacaaaaguaacaguauuagga

SEQ ID NO: 51040 - RNA, 756 nt, Artificial Sequence
  derived and/or modified sequence opt6 from anti-influenza_Chain
gaaguacaacuaguugaaucaggagcagaaguaaaaaaaccaggaaguaguguaaaaguaucauguaaagcaagcggucauauauucaguggauaugcaauaucauggguacgacaagcaccaggacaaggauuagaauggaugggaggcauaauaccaauuuuugguacaacaaacuacgcacaaaaauuucaaggaagaguaacaaucacagcagaucaaucaacaucaacagcauauauggauuuaaguaaucuuagaagugaagacacagcaguauauuauugugcaagaguaaaagauggcuauuguacauuaacaagcuguccaguaggaugguauuuugauuuauggggaagaggaacuuuaguaacaguaaguaguggaacaggaggaucaggaggaacaggaagcggaacuggaggaucaacugaaauaguaaugacacaaaguccuggaacauuaagccuaaguccaggagaaagagcaacauuaagcuguagagcaucacaaaguguaucaucaaguuauuuagcaugguaucaacaaaaaccgggacaagcaccaagauuacuaauauuuggagcaaguaguagagccacaggcauaccagauagauuuucaggaagcggaagcggaacagauuuuacauuaacaauaucaagauuagaaccagaagauuuugcaguauauuauugucaacaauacggaucaucauuaacauuuggaggaggaacuaaauuagaaauaaaaaga

SEQ ID NO: 51041 - RNA, 768 nt, Artificial Sequence
  derived and/or modified sequence opt6 from anti-influenza_Chain
caaguacaauuaguacaaaguggagcagaaguaaaaaaaccuggaucaucaguaaaaguaaguugcaaagcaucaggaggcuuuuucucaucauacgcaauaucauggguaagacaagcaccaggacaaggauuagaauggaugggaggaguaauaccaauauucagaacagcaaacuaugcacaaaacuuucaaggaagaguaacaauuacagcagacgaauuuacaucauacauggaacuaucuagccuaagaucagacgauacagcaguauacuacugugcuagacuaaauuaccacgacucaggaacauacuauaacgcaccaagaggaugguucgacccauggggacaaggaacacuaguuacaguaucaucaggaacaggaggaagcggaggaacaggaucuggaacaggaggaucaacugacauacaaaugacucaaucaccagauucauuagcaguaucacuaggagaaaaagcaacaauaaacuguaaaaguucacaaagcauauuaaacucaucaaauaauaaaaauuacuuagccugguaucaacaaaaaccaggacaaccacccaaauuauuaauauacugggcaaguacaagagaaaguggaguaccagauagauucucagguucaggaagcggaacagacuucacacuaacaauaucaucauuacaagcagaagacguagcaguauacuacugccaacaauacuauucaucaccaccaacauucggacaaggaacaaaaguagaaauaaaaaga

SEQ ID NO: 51042 - RNA, 768 nt, Artificial Sequence
  derived and/or modified sequence opt6 from anti-influenza_Chain
caaguacaauuaguacaaucaggagccgaaguaaagaaaccuggaucaaguguaaaaguaucauguaaagcaagcggagguuucuuuucaaguuaugcaauaucauggguaagacaagcuccaggacaaggccuagaauggaugggaggaguaauaccaauauuuagaacagcaaauuacgcacaaaauuuucaaggaagaguaacaauaacagcagacgaauuuacaucauacauggaauuaucaucauuaagaucagacgauacagcaguauacuauugugcaagauuaaauuaucaugacucagguacauauuauaaugcaccaagaggaugguuugauccauggggacaaggaacauuaguaacaguaucaucaggaacaggaggaucaggaggaacaggaagcggaacaggaggaucaacagauauacaaaugacacaaaguccagacucauuagcaguaucuuuaggagaaaaagcaacaauaaacugcaaaucaucacaaucaauauuaaacagcaguaauaauaaaaauuauuuagcaugguaucaacaaaaaccuggacaaccaccaaaauuacuaauauacugggcaaguacaagagaaagcggaguaccagacagauucucaggaucaggaagcggaacagauuucacauuaacaauaaguucauuacaagcagaagauguagcaguuuauuauugucaacaauauuacagcucaccaccaacauuuggacaaggaacaaaaguagaaauaaaaaga

SEQ ID NO: 51043 - RNA, 771 nt, Artificial Sequence
  derived and/or modified sequence opt6 from anti-influenza_Chain
auaugcauaggauaccacgcaaacaacagcacagaacaagucgacacaauaauggaaaaaaacguaacaguaacccacgcacaagacauauuagaaaaaacacacaacggaaaacuaugcgaccuagacggaguaaaaccauuaauacuaagagacuguuccguagcaggauggcuacuaggaaauccaaugugcgaugaauucauaaacgucccagaauggucauacauaguagaaaaagcaaacccagcaaacgaccuauguuacccaggaaauuucaacgacuacgaagaauuaaaacacuuacuaucaagaauaaaucacuucgaaaaaauacaaauaauaccaaaaucaucauggucagaccacgaagccucaagcggaguaucaucagcaugcccauaccaaggcacaccaucauuuuucagaaacguaguauggcuaauaaaaaaaaacaacacauacccaacaaucaaacgaucauauaauaacacaaaccaagaagacuuacuaauacuauggggaauacaccacucuaacgacgcagcagaacaaacaaaacuauaccaaaacccaacaacauacauaucaguaggaacaucaacacuaaaccaaagacuaguaccaaaaauagcaacacgaucaaaaguaaacggacaaaacggaagaauggacuucuuuuggacaauauuaaaaccaaacgacgcaauaaacuucgaaucaaacggaaauuucauagcaccagaauacgcauacaaaauagucaaaaaa

SEQ ID NO: 51044 - RNA, 771 nt, Artificial Sequence
  derived and/or modified sequence opt6 from anti-influenza_Chain
auaugcauaggauaccacgcaaacaacuccacagaacaaguagacacaauaauggaaaaaaacguaacaguaacacacgcacaagacauacuagaaaaaacacacaacggaaaacuaugugaucuagacggaguaaaaccacuaauucuaagagauugcucagucgcaggaugguuacuaggaaauccaaugugcgacgaauucauaaacguaccagaauggucauauauaguagaaaaagcaaaccccgcaaacgaccuaugcuacccaggaaacuuuaacgacuaugaagaacuaaaacaccuacuaucacgcauaaaucacuucgaaaaaauacaaauaauaccaaaaucaucauggucagaccacgaagcaucauccggaguaucaucagcaugcccauaccaaggaacaccaucauuuuucagaaacguaguauggcuaauaaaaaaaaacaacacauacccaacaauaaaacgaucauacaacaacacaaaccaagaagauuuacuuauacuauggggaauacaccacagcaacgacgcagcagaacaaacaaaacuauaccaaaacccaacaacauacauaucaguaggaacaucaacauuaaaccaaagacuaguaccaaaaauagcaacaagaucaaaaguaaacggacaaaacggaagaauggacuucuucuggacaauacucaaaccaaaugacgcaauaaacuucgaaucaaacggaaacuucauagcaccagaauacgcauacaaaauaguaaaaaaa

SEQ ID NO: 51045 - RNA, 777 nt, Artificial Sequence
  derived and/or modified sequence opt6 from anti-influenza_Chain
augguaaaaucaaaauauuuaguauuuauaaguguauuuagcuuauuauuuggaguauuuguaguaggauuuagucaucaaggaguaaaagcagaagaagaaagaccaaugggaacagcauuuuaugaaucauuugaugcauuugaugaugaaagauggucaaaagcaggaguauggacaaauggacaaauguuuaaugcaacaugguauccagaacaaguaacagcagauggauuaaugagauuaacaauagcaaaaaaaacaacaucagcaagaaauuauaaagcaggagaauuaagaacaaaugauuucuaucauuauggauuauuugaaguaaguaugaaaccagcaaaaguagaaggaacaguaaguaguuuuuuuacauauacaggugaaugggauugggacggcgacccaugggaugaaauagauauugaauuuuuaggaaaagacacgacaagaauacaauuuaauuauuuuacaaauggaguaggcggaaaugaauuuuauuaugauuuaggauuugacgcaagcgaaaguuuuaauacauaugcauuugaauggagagaagauaguauaacaugguauguaaauggagaagcaguacauacagcaacagaaaauauaccacaaacaccacaaaaaauaaugaugaaucuauggccuggaguaggaguagauggauggacaggaguauuugauggagauaauacaccaguauauucauauuaugauuggguaagauauacaccuuuacaaaauuaucaaauacaucaa

SEQ ID NO: 51046 - RNA, 777 nt, Artificial Sequence
  derived and/or modified sequence opt6 from anti-influenza_Chain
augguaaaaucuaaauauuuaguauucauaagcguauuuucauuauuauuuggaguauuuguaguaggauuuagucaucaaggaguaaaagcagaagaagaaagaccaaugggaacagcauucuaugaaucauuugaugcauuugacgaugaaagauggaguaaagcaggaguauggacaaaugggcaaauguuuaaugcaacaugguauccagaacaaguaacagcagacggacuaaugagauuaacaauagcaaaaaaaacaacaucagcaagaaauuauaaagcaggagaauuaagaacaaacgacuuuuaucauuacggauuauuugaaguaaguaugaaaccagcaaaaguugaaggaacaguaucaaguuuuuuuacauauacaggagaaugggauugggauggagauccaugggaugaaauagauauagaauuuuuaggaaaagacacgaccagaauacaauuuaauuacuuuaccaauggaguaggaggaaaugaauuuuauuaugauuuaggauuugaugcaucagaaucauucaauacauaugcauuugaauggagagaagacucaauaacaugguaugucaauggagaagcaguacacacggcaacagaaaauauaccacaaacaccacaaaaaauaaugaugaauuuauggccaggaguaggaguagacggauggacaggaguauucgauggagauaauacaccaguuuauucauauuaugauuggguaagauauacaccauuacaaaacuaccaaauacaucaa

SEQ ID NO: 51047 - RNA, 783 nt, Artificial Sequence
  derived and/or modified sequence opt6 from anti-influenza_Chain
gauauacaaaugacacaaucaccaucaaguguaagugcaucaguaggagacagaguaacaauaacauguagagcaucacaagacauaaguacaugguuagcaugguaucaacaaaaaccaggaaaagcaccaaaacuauuaauauaugcagcaucaucacuacaaaguggaguaccaaguagguuuucaggaagcggaucagggacagacuuuacauuaacaauaagcucauuacaaccagaagauuuugcaacauauuuuugccaacaagcaaauucauucccaccaacauuuggauguggaacaaaacuagaaauaaaaggaggaggaggaaguggaggaggaggaaguggaggaggcggaagcggaggagguggaucagaaguacaauuaguaguaagcggaggaggauuaguaaaaccaggaggaagucuaagauuaagcugugcagcaagcggauuaaguuuucuuaaugcauggaugaguuggguaagacaggcaccaggaaaaugcuuagaauggguaggaagaauaaaaaguaauacagauggaggaacuacagacuaugcagcaccuguaaaaggaagauuuagcauaagcagggaugauagcaaaaauauguuauuuuuacauaugagcucauuaagaacggaagauacugcaguauauuauugugcaacagacggaccauauagugaugacuuuagaucaggauaugcagcaagauauagauauuuuggaauggauguauggggacaaggaacaaccguaacaguaagcuca

SEQ ID NO: 51048 - RNA, 783 nt, Artificial Sequence
  derived and/or modified sequence opt6 from anti-influenza_Chain
gauauacaaaugacacaaaguccaucaaguguuucagcaucaguaggagauagaguaacaauaacaugucgagcaagucaagauauaaguacaugguuagcaugguaucaacaaaaaccaggaaaagcaccaaaauuacuaauauaugcagcaaguucauuacaaucaggaguaccaagcagauuuaguggaaguggaucuggaacagauuuuacauuaacaauaagcaguuuacaaccagaagacuuugcaacauauuuuugccaacaagcaaauagcuuuccaccaacauuuggaugcggaacaaaauuagaaauaaaaggaggagguggaaguggaggaggaggaucaggaggaggggguucaggaggaggaggaucagaaguacaauuaguaguaagcggaggaggucuaguaaaaccaggaggaagucuaagauuaagcugugcagcaucaggauuaucauuuuuaaacgcauggaugagcuggguaagacaagcaccaggaaaauguuuagaauggguaggaagaauaaaaaguaauacagauggaggaacuacagauuaugcagcuccaguaaaaggaagauuuaguauaucaagagaugauagcaaaaauauguuauuuuuacauaugucaaguuuaagaacagaagauacagcaguauauuauugcgcaacagauggaccauauagugaugacuuuagaucgggauaugcagcaagauauagauauuuuggaauggauguuuggggacaaggaacaacaguaacaguaucauca

SEQ ID NO: 51049 - RNA, 789 nt, Artificial Sequence
  derived and/or modified sequence opt6 from anti-influenza_Chain
augggauucgucuuauuuucacaacuaccaagcuuucuauuaguaucuacacuacuauuauucuuaguaauaagccauagcugucgagcacaaaauggaggaucauauccauauaaaucaggagaauacagaacaaaaucauuuuucggauacggauacuaugaaguaagaaugaaagcagcaaaaaacguaggaauaguaucaucauucuucacauacacaggaccaucagauaacaauccaugggacgaaauugauauagaauucuuaggaaaagacacaacaaaaguucaauuuaauugguauaaaaauggaguaggaggaaaugaauacuuacacaaucuaggauuugacgcaucacaagauuuucauacauauggauuugaauggcgaccagacuauauagauuucuauguagauggaaaaaaaguuuacagaggaacaagaaacauaccaguaacaccaggaaaaauaaugaugaaccuuuggccaggaauaggaguagacgaauggcuaggaagauacgacggaagaacaccauuacaagcagaauacgaauacguaaaauauuacccaaacggaagaucaaaauuagucguaaacacaccauuuguagcaguauuuaguaauuucgauagcucacaaugggaaaaagcagauugggcaaacggauccguauucaauugcguauggaaaccaucacaaguaaccuuuaguaauggaaaaaugauacuaacucuagauagagaauauguagaccaucaccaccaccaucacaaagacgaacua

SEQ ID NO: 51050 - RNA, 789 nt, Artificial Sequence
  derived and/or modified sequence opt6 from anti-influenza_Chain
augggauucguauuauuuagccaauuaccaagcuuuuuauuaguaucaacauuacuacuauucuuaguaauaagucauaguuguagagcacaaaacggaggaagcuacccauauaaaucaggagaauacagaacuaaaagcuuuuucggauacggauacuaugaaguaagaaugaaagcagcaaaaaacguuggaauaguaucaaguuuuuucacauauacaggaccuagcgauaacaauccaugggacgaaaucgauauagaauucuuaggaaaagacacaacaaaaguacaauucaauugguauaaaaacggaguaggaggaaaugaauauuuacacaaucuaggauuugacgcaucacaagauuuucauacauauggauucgaauggagaccagacuauauagauuucuacguagacggaaaaaaaguauacagaggaacacgaaauauaccaguaacaccaggaaaaauaaugaugaaccuauggccuggaauaggaguagacgaauggcuaggaagauacgauggaagaacaccacuacaagcagaauacgaauacguaaaauauuacccaaacggaagaucgaaauuaguuguaaacacaccauuuguagcaguauuuaguaauuucgauaguucacaaugggaaaaagcagauugggcaaacggaagcguguucaauugcguauggaaaccaucacaaguaacauuuucaaauggaaaaaugauacuaacacuagauagagaauacguagaccaucaccaccaccaucacaaagacgaauua

SEQ ID NO: 51051 - RNA, 840 nt, Artificial Sequence
  derived and/or modified sequence opt6 from anti-influenza_Chain
auggcacaaguaggaagaggagcaucaccacuuucaagagcaagaguaccaccauuaccacauccauuagauggugaacauuuaccacaugaccccgcagguggaggacauggaaaagcaucaucucaagaugccccaguaggacaauuaccaggucaccuagcaagaccagcauuuuuucauuauuuaaaaaauucuuuuuuaguauguucauuaacaacaguuuuugcacuagcuguugcaacauuugcaggauaugcacuagcaagauuuagauuuccaggagcagaauuauuuggugguucuguauuaguaacacaaguaauaccaggaauauuauucuuaauaccaauauauauuauguauauauauguacaaaauuggguaagaucagcacuuggauuagaaguacgauuaguaggaucuuaugguggacuaguauuuacuuauacagcauuuuuuguaccauuaucuauauggauauuaagaggauucuuugcauccauaccaaaagaauuagaagaagcagcaaugguagauggagcaacaccauuucaagcauuucauagaguaauucuaccacuagcauuaccaggauuagcagcaacagcaguauauaucuucuuaacagcaugggaugaauuacuauuugcucaaguauuaacaacagaagcaacugcuacaguuccuguaggaauacgaaauuuuguaggaaauuaucaaaacagguaugauuuaguaauggcagcagcaacaguagcaacauuaccaguauuaguauuauuuuuuuuuguacaaagacaauuaauacaaggauuaacagcaggagcaguuaaagga

SEQ ID NO: 51052 - RNA, 840 nt, Artificial Sequence
  derived and/or modified sequence opt6 from anti-influenza_Chain
auggcacaaguaggaagaggagcaucaccauuaucaagagcaagaguaccaccuuuaccucauccauuagauggagaacaucuuccacaugauccagcaggaggaggucauggaaaagcaucaucucaagaugcaccuguaggacaacuaccaggacacuuagcaagaccagcauucuuucauuauuuaaaaaauucuuuuuuaguauguaguuuaacaacaguauuugcauuagcgguagcaacuuuugcaggauaugcauuagcaagauuuagauuuccaggagcagaacucuuuggaggaucaguauuaguaacacaaguuauaccaggaauuuuauuuuuaauaccaauauauauuauguacauauauguucaaaauuggguuagaucagcauuaggacuagaaguacgauuaguaggaucauacgguggauuaguauuuacauauacagcauuuuuuguaccauuaucuauauggauacuaagaggauuuuuugcaucuauaccaaaagaauuagaagaagcagcuaugguagauggagcaacaccauuucaagcauuucauagaguaauauuaccuuuagcauuaccuggacuagcagccacagcaguauacauauucuuaacagcaugggaugaauuacuuuuugcacaaguacuaacaacagaagcaacagcaacaguaccaguagguauucguaauuucgucggaaacuaccaaaauagauaugacuuaguaauggcagcagcaacaguagcaacauuaccuguauuaguauuauuuuuuuuuguacaaagacaauuaauacaagguuuaacagcaggagcaguaaaagga

SEQ ID NO: 51053 - RNA, 843 nt, Artificial Sequence
  derived and/or modified sequence opt6 from anti-influenza_Chain
auggcagacaacaugacaacaacacaaauagaaguaggaccaggagcaaccaacgcaacaauaaacuucgaagcaggaauauuagaaugcuacgaaagauucucauggcaacgagcacuagacuacccaggacaagacagauuacauagacuaaaaagaaaacuagaaucaagaauaaaaacacacaauaaaucagaaccagaaaacaaaagaaugucacucgaagaaagaaaagccauaggaguaaaaaugaugaaaguauuacuauucauggacccaagugcaggaauagaaggauucgaaccauacuguguaaaaaaccccucaacaucaaaaugcccaaauuacgauuggacagauuaccccccaacaccaggaaaauacuuagacgauauagaagaagaaccagaaaacguagaccacccaauagaaguaguacuccgagacaugaacaauaaagacgcaagacaaaaaauaaaagacgaaguaaacacacaaaaagaaggaaaauucagacuaacaauaaaaagagauauaagaaauguauuaagcuuacgaguacuaguaaacggaacauuccuaaaacacccaaauggagacaaaagccuaaguacauuacacagauuaaacgcauacgaccaaaacggaggacuuguagcaaaacuaguagcaacagacgacagaacaguagaagacgaaaaagacggacacagaauacuaaauagccuauucgaaagauucgacgaaggucauagcaaaccaauaagagcagcagaaacagcgguaggaguacuaagccaauucgggcaagagcacagacuaagcccagaagaaggagauaac

SEQ ID NO: 51054 - RNA, 843 nt, Artificial Sequence
  derived and/or modified sequence opt6 from anti-influenza_Chain
auggcagacaacaugacaacaacacaaauagaaguaggaccaggagccacaaacgcaacaauaaacuucgaagcaggaauacuagaaugcuacgaaagauucucauggcaaagagcauuagacuauccaggacaagacagacuacacagauuaaaaagaaaauuagaaucaagaauaaaaacacacaacaaaagcgaaccagaaaacaaaagaaugucacuagaagaaagaaaagcaauaggaguuaaaaugaugaaaguucuacuauuuauggacccaucagcaggaauagaaggauucgaaccauacuguguaaaaaacccaucaacaagcaaaugcccaaacuaugacuggacagacuacccaccaacacccggcaaauacuuagacgauaucgaagaagaaccagaaaacguagaccacccaaucgaaguaguacuaagagacaugaacaacaaagacgcaagacaaaaaauaaaagacgaaguaaacacacaaaaagaaggaaaauucagacuaacaauaaaaagagacauaagaaacgucuuaagccuaagaguauuaguaaacggaacauuccuaaaacacccaaacggagacaaaaguuugaguacacuccacagauuaaaugcauacgaccaaaacggaggccuaguagcaaaauuaguagcaacagaugauagaacaguagaagacgaaaaagacggacacagaauauuaaauucacuauucgaaagauuugacgaaggacacagcaaaccaauaagagcagcagaaaccgcaguaggaguauuaucccaauucggacaagaacacagacuaucaccagaggaaggagacaac

SEQ ID NO: 51055 - RNA, 858 nt, Artificial Sequence
  derived and/or modified sequence opt6 from anti-influenza_Chain
auguguacuaugccauuaaugaaauuaaaaaaaaugaugagaaggacagcauuuuuauuaaguguauuaauaggauguagcaugcuaggaagcgaucgaucagauaaagcaccacauugggaguuaguauggagcgaugaauuugauuauucaggacuaccagauccagaaaaaugggauuaugauguaggaggacauggauggggaaaucaagaacuacaauacuauaccagagcaaggauugaaaaugcaagaguaggaggaggaguauuaauaauagaagcucgacaugaaccauaugaaggaagagaauauacuagugcaagauuaguaacaagaggaaaagcaaguuggacauauggaagauucgaaauaagagcaagguuaccaagugguagaggaacauggccagcaauauggauguuaccagauagacaaacauauggaagugcauauuggccagauaauggagaaauagauauaauggaacauguaggauuuaauccagauguaguacauggaacagugcacacaaaagcauauaaucaucugcuaggaacgcaaagaggaggaaguauaagaguaccaacagcaagaacagauuuucauguauacgcaauagaauggacgccagaagaaauaagaugguuuguggaugauagcuuauacuauagauuuccuaaugaaagacuaacagauccagaagcagauuggagacauuggccuuucgaucaaccauuucauuuaauaaugaauauagcaguaggaggagcaugggguggacaacaaggaguagauccagaagcauuuccagcacaacuaguaguagacuauguaagaguauauagauggguagaa

SEQ ID NO: 51056 - RNA, 858 nt, Artificial Sequence
  derived and/or modified sequence opt6 from anti-influenza_Chain
auguguacaaugccacuaaugaaauuaaaaaaaaugaugagaagaacggcauuucuauuaaguguauuaauaggauguaguauguuagggagcgaucgaagugauaaagcaccacacugggaauuaguauggagugaugaauucgacuauaguggauuaccagauccagaaaaaugggauuaugauguaggaggacauggauggggaaaucaagaauuacaauacuauacaagagcaagaauagaaaaugcuaggguaggaggaggaguauuaauaauagaagcuagacaugaaccauaugaaggaagagaauauacaagcgcaagauuaguaacaagaggaaaagcaaguuggacauauggaagguuugaaauaagggcaagacuaccgagcggaagaggaacauggccagcaauauggaugcuaccagaucgacaaacauaugguucagcauauuggccagauaauggagaaauagauauaauggaacauguaggauuuaauccagauguaguacauggaacaguacacacuaaagcauauaaucauuuauuaggaacacaaagaggaggaagcauaagaguaccaacagcaagaacugacuuucauguguaugcaauagaauggacaccagaagaaauuagaugguuuguagaugauaguuuauauuacagauuucccaaugaaagacuaacagauccagaagcagacuggagacauuggccauucgaccaaccauuucauuuaauaaugaauaucgcaguaggaggagcauggggaggacaacaaggaguagacccagaagcauuuccagcacaauuaguaguagauuauguaagaguauauagauggguagaa

SEQ ID NO: 51057 - RNA, 900 nt, Artificial Sequence
  derived and/or modified sequence opt6 from anti-influenza_Chain
aacguaccagaauggucauacauaguagaaaaagccaacccagcaaacgaccuaugcuacccuggaaauuucaaugacuacgaagaacuaaaacacuuauuaucacgaauaaaccacuuugaaaaaauacaaggauacaucccagaagcaccacgagacggacaagcauacguaagaaaagacggagaauggguauuauuaucuacauuccuaagaucagacaaaacacauacaugcccaccaugcccagcacccgaacuacuaggaggaccaucaguauucuuauucccaccaaaaccaaaagacacccuaaugaucucaagaacaccagaaguaaccugcguaguaguagauguaucacaugaagaccccgaaguaaaauucaacugguacguagacggaguagaaguacacaacgccaaaaccaaacccagagaagaacaauacaacucaacauacagaguuguaucaguauuaacaguauuacaccaagacuggcuaaacggaaaagaauacaaaugcaaaguaucaaacaaagcauuaccagcaccaauagaaaaaacaauaucaaaagcaaaaggacaacccagagaaccacaaguauauacccuacccccaucacgugaagaaaugacaaaaaaccaaguaagccuaacaugccucguaaaaggauucuacccauccgacauagcaguagaaugggaaucaaacggacaaccagaaaacaacuacaaaacaaccccaccaguacuagacuccgacggcuccuucuuuuuauacucaaaauuaacaguagacaaauccagauggcaacaaggaaacguauucucaugcucaguaaugcacgaagcucuacacaaccacuacacacaaaaaagccuaucacuaucaccaggaaaa

SEQ ID NO: 51058 - RNA, 900 nt, Artificial Sequence
  derived and/or modified sequence opt6 from anti-influenza_Chain
aacguaccagaauggucauacaucguagaaaaagcaaacccagcaaaugaccuaugcuacccaggcaacuucaacgacuacgaagaacucaaacacuuacuaucaagaauaaaccacuucgaaaaaauacaaggauacauaccagaagcaccaagagacggacaagcauacguaagaaaagacggagaauggguacuacuaagcacauucuuacgaucugauaaaacacacacauguccaccaugcccagccccagaacuacuaggaggaccaaguguauuccuauuuccaccaaaaccuaaagacacacuaaugauaucacgaacaccagaaguaaccugcguaguaguagauguaucucacgaagauccagaaguaaaauucaacugguacguagacggcguagaaguacacaacgccaaaacaaaaccaagagaagaacaauauaauucaacauauagaguaguaucgguacuuacaguucuacaucaagacugguuaaauggaaaagaauacaaaugcaaaguaucaaacaaagcacuuccagcaccaauugaaaaaacaauaagcaaagcuaaaggacaaccaagagaaccacaaguauacacauuaccaccaucacgagaagaaaugacuaaaaaccaaguaucauuaacaugccucguaaaaggauucuacccauccgauauagccguagaaugggaaagcaauggacaaccagaaaacaacuauaaaacaacaccaccaguacuagauucagauggcucauucuuccuauacucaaaauuaacuguagacaaaucaagauggcaacaaggaaacguauucucaugcucaguaaugcacgaagcauuacauaaucacuacacacaaaaaucauuaucucuaucaccaggaaaa

SEQ ID NO: 51059 - RNA, 927 nt, Artificial Sequence
  derived and/or modified sequence opt6 from anti-influenza_Chain
augguaaauaggagagauuuaauaaaauggagugcaguagcauuaggggcuggggcuggauuagcagggccagcaccagcagcacaugcagcugauuuagaaugggaacaauauccaguaccagcagcccccggaggaaauaggaguuggcaauuauuaccaucacauucagaugauuucaauuauacaggaaaaccacaaacauuuagaggaagaugguuagaucaacauaaagauggauggucaggaccagcaaacucacuauacucagcaagacauaguuggguagcagauggaaauuuaauaguagaaggaagacgagcuccagauggaagaguauauuguggauauguaacaagcagaacaccaguagaauauccauuauauacagaaguauuaaugagaguaagcggauuaaaacuaaguaguaauuuuugguuacuaagcagagaugauguuaaugaaauagauguaauagaauguuauggaaaugaaucauuacauggaaaacauaugaacacagcauaucauauauuucagagaaauccuuucacagaauuagcaagaucacaaaaaggauacuuugcagauggaaguuaugguuauaauggagaaacaggucaaguauuuggagauggagcaggacaaccauuacuaagaaauggauuccauagauaugguguacacuggauaagugcaacagaauuugauuuuuauuuuaauggaagauuaguuagaagauuaaauagaaguaaugaucuaagagauccaagaaguagauucuuugaucaaccaaugcauuuaauauuaaauacagaaucacaucaauggaggguagauagaggaauagaaccaacagaugcagaauuagcugauccaaguauaaauaauauauauuaucgauggguaagaacauaucaagcugua

SEQ ID NO: 51060 - RNA, 927 nt, Artificial Sequence
  derived and/or modified sequence opt6 from anti-influenza_Chain
augguaaauagaagagaccuaauaaaauggagcgcaguagcauuaggagcaggggcaggauuagcaggaccggcaccagcagcacaugcggcagauuuagaaugggaacaauauccagucccagcugcaccagguggaaauagaagcuggcaauuauuaccaagccauucagacgauuuuaacuauacaggaaaaccacaaacauucagaggaagaugguuagaucaacauaaagauggauggucaggaccagcaaauagcuuauauucagcaagacauaguuggguagcagauggaaaucuaauaguagaaggaagacgagcuccagaugguagaguauauugcggauauguaacuucaagaacaccaguagaauauccuuuauauacagaaguuuuaaugagaguuagcggacuuaaauuaucaaguaauuucugguuauuaaguagagaugauguaaaugaaauagauguaauagaaugcuauggaaaugaaucacuacacggaaaacauaugaauacagcauaucauauauuucaaagaaauccauuuacagaacuagcaagaucacaaaaaggauauuuugcagacggaucauauggauauaauggggaaacaggacaaguauuuggagauggagcgggacaaccacuauuaagaaauggauuucauagauacggaguacacuggauaucagcaacagaauuugauuuuuauuuuaauggaagauuaguuagaagauuaaauagaaguaaugauuuacgugacccuagaaguagauucuuugaucaaccaaugcauuuaauucuaaauacagaaucacaccaauggagaguugauagaggaauagaacccacagaugcagaacuagcugauccaucaauaaauaacauauauuaucgauggguaagaacauaucaagcagua

SEQ ID NO: 51061 - RNA, 960 nt, Artificial Sequence
  derived and/or modified sequence opt6 from anti-influenza_Chain
auaugcauaggauaccacgcaaacaacucaacagaacaaguugacacaauaauggaaaaaaauguaacagucacacacgcacaagacauacuagaaaaaacacacaauggaaaauuaugcgacuuagauggaguaaaaccccuaauacucagagacugcucaguagccggauggcuacuaggaaacccaaugugugacgaauucauaaauguaccagaauggucauauaucguagaaaaagcaaacccagccaacgaccuaugcuacccaggaaacuucaacgauuacgaagaacuaaaacacuuauuaucccgaauaaaccacuucgaaaaaauccaaauaauaccaaaaagcucauggucagaccacgaagccucaucaggagucucauccgcaugccccuaccaaggaacaccaagcuucuucaggaacguaguauggcuaauaaaaaaaaacaauacauacccaacaaucaaaagaucauacaacaacacaaaccaagaagaccucuuaauauuauggggaauccaccacucaaaugacgcagcagaacaaacaaaacuauaccaaaaucccacaacauacauaucagucggaacaagcacacuaaaccaaagauuaguaccuaaaauagcaacaagaucuaaagucaacggacaaaacggaagaauggacuucuucuggacaauacuaaaacccaacgacgcaauaaacuucgaaucaaacggaaacuucauagcaccagaauacgcauauaaaauagucaaaaaaggagauucugcuauaguaaaaucagaaguagaauacggaaacugcaacacaaaaugccaaacccccauaggagcaauaaacucaucaaugccauuccacaacauucacccauuaacaauaggagaaugcccaaaauacgucaaauccaacaaacucguacuagcaacaggacuaagaaacucaccacua

SEQ ID NO: 51062 - RNA, 960 nt, Artificial Sequence
  derived and/or modified sequence opt6 from anti-influenza_Chain
auaugcauaggauaccacgcaaauaauucaacagaacaagucgauacaauaauggaaaaaaacguaacaguaacacacgcucaagacaucuuagaaaaaacacacaacggaaaauuaugcgaccucgacggcguaaaaccacuaauacuaagagacugcucaguagcaggauggcuacuaggaaacccaaugugcgacgaauucauaaacguaccagaauggucauacauaguagaaaaagcaaacccagccaaugaccuauguuacccaggaaacuucaacgauuacgaagaacuaaaacauuuacuauccagaauuaaucacuuugaaaaaauacaaaucauacccaaaucaucauggucagaccacgaagcaucaucuggaguaagcucagcaugcccauaucaaggaacaccaucuuucuucagaaacguaguaugguuaauaaaaaaaaacaacacauacccaacaauaaaacgaucuuacaacaacacaaaccaagaagaccuacuaauacuauggggaauacaccacucaaacgacgcagcagaacaaacuaaacuauaccaaaacccaacaacauacauauccguaggaacauccacacuaaaccaaagacuaguaccaaaaauagccacaagaucaaaaguaaacggacaaaacggccgaauggauuucuucuggacaauacuaaaaccaaacgacgcaauaaacuucgaaucaaacggaaacuucauagcaccagaauacgcauacaaaauaguaaaaaaaggcgacucagcaauagucaaaucagaagucgaauauggcaacugcaacacaaaaugccaaacacccauaggcgcaauaaacuccucaaugcccuuucacaacauacauccacuaacaauaggagaaugcccaaaauauguaaaaagcaacaaacuaguacuagcaacaggacuucgaaacucaccacua

SEQ ID NO: 51063 - RNA, 960 nt, Artificial Sequence
  derived and/or modified sequence opt6 from anti-influenza_Chain
auaugcauaggauaccacgcaaacaauucaacagaacaaguagauaccauuauggaaaaaaacguaacaguaacacacgcccaagauauacucgaaaaaacacauaacggaaaacuaugcgaucuagacggaguaaaaccauuaauauuacgagacugcucaguugcaggaugguuacuagguaaccccaugugcgacgaauucauaaacguaccagaauggucauauauaguagaaaaagcaaauccagcaaacgaccuaugcuacccaggaaacuucaacgacuaugaagaacuaaaacaccuacuaucacgaauaaaccacuucgaaaaaauacaaauaauaccaaaaucaucauggucagaccacgaagcaucaucaggaguaucauccgccugcccauaccaaggaacaccaucauucuucagaaacguaguauggcuaauaaaaaaaaacaacacauacccaacaauaaaaagaucauacaauaacacaaaccaagaagaccuccuaauacuauggggaauacaucauagcaacgaugccgcagaacaaacuaaacuauaccaaaacccaacaacauacauaucagucggcacaucaacccuaaaccaacgacuaguaccaaaaauagccacaagaucaaaagucaauggccaaaacgguagaauggacuuuuuuuggacaauacuaaaaccaaaugacgcaauaaacuuugaaucaaacggaaacuucauagcgccagaauacgcauauaaaauaguaaaaaaaggagauucagcaauaguaaaaucagaaguagaauacggaaacugcaacacaaaaugccaaacaccaauaggcgccaucaauucaagcaugccauuccacaacauacacccauuaacaaucggcgaaugcccaaaauacguaaaauccaacaaacuaguacuagcaacuggacuccgcaacuccccacua

SEQ ID NO: 51064 - RNA, 978 nt, Artificial Sequence
  derived and/or modified sequence opt6 from anti-influenza_Chain
accuuaugcauaggauaccaugcaaacaauucaacagacacaguagacacaguauuagaaaaaaacguaacaguaacacacaguguaaaccuacucgaagauaaacacaacggcaaacuaugcaaacuaagaggaguagccccacuacaccuaggaaaaugcaacauagcaggauggauacuaggaaacccagaaugcgaaucacuauccacagcaucaagcuggucuuacaucguagaaacaucaucaucagacaacgguacaugcuacccaggagacuucauagacuacgaagaacuaagagaacaauuaucaucaguaucauccuuugaaagauuugaaauauucccaaaaacaucaucauggccaaaccaugacucaaauaaaggcguaacagcagcaugcccacaugcaggagcaaaaucauucuacaaaaaccuaauauggcuaguaaaaaaaggaaacucauaccccaaauuaucaaaaucauacauuaacgacaaaggaaaagaaguacuaguacucuggggaauacaccacccaucaacaucagcagaccaacaaucacucuaccaaaacgccgaugcauauguauuuguaggaacaucuagauacucaaaaaaauucaaaccagaaauagcaaucagacccaaaguacgagaccaagaaggaagaaugaacuacuauuggacccuaguagaaccaggagauaaaauaacauucgaagcaacaggaaacuuaguaguaccacgauacgcauucgcaauggaacgagacgcaggaucaggcauaauuauuucagacacacccguacacgauuguaauacuacaugccaaacaccaaaaggcgcaauaaacacaagcuuaccauuucaaaauauacacccaauaacaauaggaaaaugcccaaaauacguaaaaucaacaaaguuaagacuagcaacaggacuaagaaauguaccaagcauacagaguaga

SEQ ID NO: 51065 - RNA, 978 nt, Artificial Sequence
  derived and/or modified sequence opt6 from anti-influenza_Chain
acacuaugcauaggauaccacgcaaauaacucaacagacaccguagacacaguauuagaaaaaaaugucacaguaacccacagcguaaacuuacuagaagacaaacacaauggcaaauuauguaaauuaagaggagucgcaccacuacauuuagguaaaugcaauaucgcaggauggauauuaggcaacccagaaugcgaaucacuaucaacagcaucaucauggucauauauaguagaaacauccucauccgauaacggaacaugcuaccccggagacuucauagacuaugaagaauuaagagaacaauuaucaucaguaucaucauucgaaagauuugaaauauucccaaaaacaucaagcuggccaaaccacgacucaaacaaaggaguaacagcagcauguccccaugcaggagcaaaaucauucuauaaaaaccuaauuugguuaguaaaaaaaggaaacucauacccaaaacuaucaaaaucauacauaaacgacaaaggaaaagaaguauuaguauuauggggaauacaccacccaucaacauccgcagaucaacaaucacuauaccaaaacgcugacgcauacguauucguaggaacaagcagauauucaaaaaaauucaaaccagaaauagcaauaagaccaaaaguccgagaccaagaaggaagaaugaacuacuacuggacauuaguagaaccuggugacaaaauaacauucgaagcaacaggaaacuuaguaguaccaagauacgcauucgcuauggaaagagacgccggaucaggaauaauaauauccgacacacccguacaugacugcaacacaacaugccaaacaccaaaaggagcaauaaacacauccuuaccauuccaaaacauacauccaauaacaauaggaaaaugcccaaaauacguaaaaucaacaaaacuaagacuagcaaccggauuacgaaacgucccaucaauccaaagccgu

SEQ ID NO: 51066 - RNA, 960 nt, Artificial Sequence
  derived and/or modified sequence opt6 from anti-influenza_Chain
auaugcauaggcuaccacgcaaacaacucaacagaacaaguagacacuauaauggaaaaaaaugucacagucacacacgcacaagacauacuagaaaaaacacacaacggaaaauuaugcgaccuagacggaguaaaaccacuaauccuacgagacugcucaguagcaggauggcuacucggcaacccaaugugugacgaauucauaaacguuccagaauggucauacaucguagaaaaagcaaacccagcaaacgaucuaugcuacccaggaaacuucaacgauuacgaagaauuaaaacacuuauuauccagaauaaaucacuucgaaaaaauacaaauaauaccaaaaucaucauggucugaccacgaagccucaucaggaguauccagcgcaugcccauaccaaggaacaccuucauucuucagaaacguaguauggcuaauaaaaaaaaacaacacuuacccaacaauaaaaagaucauacaacaacacaaaccaagaagacuuacucauacuauggggcauacaccauucaaaugacgcagccgaacaaacaaaacucuaccaaaacccaacaacauauaucucaguaggaacaucaacacuaaaccaacgacuaguaccaaaaauagcaaccagaucaaaaguaaacggacaaaacggaagaauggauuucuucuggacaauacuaaaaccaaacgacgcaauaaacuucgaaucaaacggaaacuuuauagcaccagaauaugcauacaaaauagucaaaaaaggagacucagcaauaguaaaaucugaaguagaauacggaaauugcaacacaaaaugucaaacaccaauaggagcaauaaacuccucaaugccauuccacaacauacacccacuaacaauaggagaaugcccaaaauacguaaaaucaaacaaacuaguccuagcaacaggacuaagaaacucaccauua

SEQ ID NO: 51067 - RNA, 990 nt, Artificial Sequence
  derived and/or modified sequence opt6 from anti-influenza_Chain
augugcucaagcauaccaucauuaagagaaguauucgcaaacgacuucagaauaggagcagcaguaaauccaguaacacuagaagcacaacaaucauuacuaauacgacacguaaacucccucacagcagaaaaccacaugaaauucgaacaccuccaaccagaagaaggaagauucacauuugacauagcaauaaaaucaucaacaagcccauuuucaucacacggagugagaggacacacacuagucuggcauaaccaaacaccaagcuggguauuccaagacucacaaggacacuuuguaggcagagacguccuacuagaaagaaugaaaucccacauaucaacagucguacaacgauacaaaggaaaaguauacugcugggauguaauaaacgaagcaguagcagaugaaggaucagaauggcuacgaucaucaacauggcgucaaauuauaggagacgacuucauacaacaagcauuuuuauacgcacacgaagcagacccagaagcucuucuauucuacaacgacuacaaugaaugcuucccagaaaaaagagaaaaaauauacacauuaguaaaaucauuaagagacaaaggaauaccaauacacggaauaggaaugcaagcacacuggucauuaaaccgaccaacacuagacgaaaucagagcagcaauagaaagauaugcaucauuaggaguaauauuacacauaaccgaauuagacauaucaauguuugaauucgacgaccauagaaaagacuuagcagcaccaacaaacgaaaugguagaaagacaagcagaaagauaugaacaaauauucagccuuuucaaagaauaccgagacgucauacaaaauguaacauucugggguauugcagaugaccacacaugguuagaccacuucccaguacaaggacgaaaaaacuggccacuacuauucgaugaacaacacaauccaaaaccagcauucuggcgaguaguaaacaua

SEQ ID NO: 51068 - RNA, 990 nt, Artificial Sequence
  derived and/or modified sequence opt6 from anti-influenza_Chain
augugcagcuccauaccaucacuuagagaaguauucgccaaugauuucagaauaggcgcagcaguaaauccaguaacacuagaagcacaacaaucauuacuaauaagacauguaaacucacuaacagcagaaaaccauaugaaauucgaacaccuacaaccagaagaaggaagauucacuuucgacauagcaauaaaaucaucaacauccccauucucaucacacggcguaagaggacauacauuaguauggcacaaccaaacaccauccuggguuuuccaagacucacaaggacacuucguaggaagagauguauuacuagaaagaaugaaaucacacauaucaaccguaguacaaagauauaaaggcaaaguauauuguugggauguaauaaaugaagcaguagcagacgaaggauccgaauggcuaagaucaagcacauggcgacaaauaauaggagacgacuucauacaacaagcauuuuuauacgcucacgaagcagaucccgaagcauuacuauucuacaaugacuauaacgaaugcuucccagaaaaaagagaaaaaauauauacacuaguaaaaucccuaagagacaaaggaauaccaauacacggaauaggaaugcaagcacacuggucacuaaacagaccaacacuagacgaaauaagagcugccauagaaagauacgccucauuaggaguaauauuacacaucacagaacuagacauaucuauguucgaauucgacgaccauagaaaagacuuagcagcaccuacaaacgaaaugguagaacgccaagcagaaagauacgaacaaauauucucacucuucaaagaauacagagauguaauacaaaauguaacauucuggggaauagcagacgaccacacaugguuagaccauuuccccguacaaggaagaaaaaacuggccacuauuauucgacgaacaacacaacccaaaaccagcauucuggagaguaguaaacaua

SEQ ID NO: 51069 - RNA, 1002 nt, Artificial Sequence
  derived and/or modified sequence opt6 from anti-influenza_Chain
augaaaaauagaguaauaucuuuauuaauggcaagucuuuuauuaguacuaaguguaauaguagcaccauucuacaaagcagaagcagcaacuguaguaaacacaccauuugucgcaguauucuccaacuucgauaguucacaaugggaaaaagcagauugggcaaacggaaguguauucaauugcguauggaaaccaagccaaguaacauuuucaaacggaaaaaugauauuaacacuagauagagaauacggaggaucauacccauacaaaucaggagaauaucgaacaaaaucauucuuuggauauggauauuacgaaguuagaaugaaagccgcuaaaaauguaggaauaguaaguucauucuucacauauaccggaccaucagacaauaauccaugggaugaaauagacauagaauuucuaggaaaagauacaacaaaaguacaauuuaacugguauaaaaacgguguaggaggaaaugaauaccuacauaaccuaggauucgaugcaagccaagacuuccacacauauggauucgaauggagaccugauuacauagauuuuuacguagacgguaaaaagguuuacagaggaacgagaaacauuccaguaaccccaggaaaaauaaugaugaaucuauggccaggaauaggaguagaugaauggcuaggacgauaugacggaagaacaccauuacaagcagaauaugaauauguaaaauacuauccaaacggaguaccucaagacaauccaacaccaacaccaaccauagcaccaucaacaccaacaaauccaaauuuaccauuaaaaggagacguaaauggagauggacaugucaauucaucagacuauaguuuauuuaaaagauaccuacuaagaguaauagauagauuuccaguaggagaccaaucgguagcagacguaaaccgagacgguagaauagacucaacagacuuaacaaugcuaaaaagauacuugauacgagcaauaccaucauua

SEQ ID NO: 51070 - RNA, 1002 nt, Artificial Sequence
  derived and/or modified sequence opt6 from anti-influenza_Chain
augaaaaacagaguaauaucauuauuaauggcaagccuauuacuaguauuaucaguaauaguugcaccauucuauaaagcagaagcagcgacaguaguaaauacaccauuuguagcaguauucucaaauuucgauagcagucaaugggaaaaagcagacugggcaaacgguagcguauucaauugcguauggaaaccaucacaaguaacauuuucaaacggaaaaaugauauuaacacuagacagagaauauggaggaucauacccuuauaaaucaggagaauauagaacaaaaaguuucuucggauacggauauuacgaaguaagaaugaaagcagcaaaaaauguagguauaguaagcagcuuuuuuacauauacaggaccuucugacaacaacccaugggaugaaaucgacauagaauuucucggaaaagauacaacaaaaguacaauucaacugguacaaaaacggcguaggaggaaaugaauaucuacauaaucuuggauuugacgcuagucaagacuuccacacauacggauucgaauggagaccagacuacauagacuucuacgucgacggaaaaaaaguauacagaggaacacggaauauaccaguaacaccaggaaaaaucaugaugaaucuauggccaggaauaggaguagaugaauggcuaggaagauaugacggaagaacaccacuacaagcagaauacgaauacgucaaauacuauccaaauggaguaccccaagacaauccaacaccaacaccaacaauagcaccaucaacaccaacaaauccaaauuuaccucuaaaaggagauguaaacggagacggacauguaaauucaucagacuacucauuauucaaaagauaucuacuuagaguaauagauagauuuccaguaggagaucaaucaguagcagacguaaacagagacggaagaauagacucaacagaucuaacaauguuaaaaagauacuuaauaagagcaauaccaucauua

SEQ ID NO: 51071 - RNA, 1041 nt, Artificial Sequence
  derived and/or modified sequence opt6 from anti-influenza_Chain
auaugcauaggauaccacgcaaacaacucaaccgaacaaguagacacaauaauggaaaaaaacguaacaguaacccacgcacaagauauucuagaaaaaacccacaacggaaaacuaugugaccuagacggcguaaaaccacuaauauuacgugauugcucaguagccggauggcuauuaggaaacccaaugugcgacgaauucauaaacguacccgaauggaguuacauaguagaaaaagcaaacccagcaaacgaccuaugcuacccaggaaacuucaaugacuacgaagaacuaaaacaucuacuaucaagaauaaaccacuucgaaaaaauccaaauaauaccaaaaucaucauggucagaccacgaagcaucaucaggaguaucaucagcaugucccuaccaaggcaccccaucauucuuccgaaacgucguaugguuaauaaaaaaaaacaacacauacccaacaauaaaaagauccuacaauaauacaaaccaagaagaccuacuaauauuauggggaauacaccacagcaacgaugcagcagaacaaacaaaacuauaccaaaacccaacaacauacauaucaguagguacauccacacuaaaccaaagauuaguaccaaaaauagcaacacgaucuaaaguaaacggacaaaacggcagaauggacuuuuucuggacuauucuaaaaccaaacgacgcaauaaacuucgaaucaaauggaaacuucauagcaccagaauacgccuacaaaauaguaaaaaaaggagauucagcaauaguuaaaucagaaguagaauacggaaacugcaauacaaaaugccaaacacccauaggagccauaaacuccucaaugcccuuucacaacauacacccucuaacaauaggagaauguccaaaauacguuaaaucaaacaaacuaguacuagcaacaggauuacgaaauuccccauuagguuacauaccagaagcaccaagagacggacaagcauacguucgaaaagauggagaauggguacuacuauccacauucuua

SEQ ID NO: 51072 - RNA, 1041 nt, Artificial Sequence
  derived and/or modified sequence opt6 from anti-influenza_Chain
auauguauaggauaccacgcaaacaacagcacagaacaagucgacacuauaauggaaaaaaacgucacaguaacacacgcacaagacauccuagaaaaaacccacaauggaaaauuaugcgaccuagacggaguaaaaccacucauauuaagagacugcucaguagcaggauggcuauuaggaaacccaaugugcgaugaauucauaaacguacccgaauggucauacauaguagaaaaagcaaacccagccaacgaccuaugcuauccaggaaauuucaacgacuacgaagaacuaaaacaccuacucuccagaauaaaccauuucgaaaaaauacaaauaauaccaaaaucaucauggucagaucaugaagcaucauccggaguaucaucagcaugcccauaccaaggaacaccaucauucuucagaaacguaguaugguuaauaaaaaaaaauaacacauacccaacaaucaaaagaucauacaacaacacaaaccaagaagaccuacuaauacuauggggaauccaccacuccaacgacgcagcagaacaaacaaaacucuaccaaaacccaacaacauacauaucaguaggaacaucaacacucaaccaaagauuaguaccaaaaauagcaacaagaucaaaaguaaacggacaaaauggaagaauggauuucuucuggacaauacuuaaaccaaacgaugcaauaaacuucgaaucuaacggaaacuucaucgcaccagaauacgccuacaaaauaguaaaaaaaggagacucagcaauaguaaaauccgaaguagaauacggaaacugcaauacaaaaugccaaacaccaauaggagcaauaaacucaucaaugccauuccacaacauacacccccuaaccaucggcgaaugcccaaaauauguaaaauccaacaaauuaguacuagcaacaggacuaagaaauucaccauuaggauacauacccgaagcaccaagagauggacaagccuacguaagaaaagacggagaauggguauuacuaucaaccuuuuua

SEQ ID NO: 51073 - RNA, 1047 nt, Artificial Sequence
  derived and/or modified sequence opt6 from anti-influenza_Chain
augaauauuaaaaaaacagcaguaaaaucagcauuagcaguagcugcagcagcugcagcuuuaacuacaaauguaagugcaaaagauuuuagcggagcagaauuauauacacuugaagaaguacaauaugguaaauucgaagcaagaaugaaaauggcagcagcaucaggaacaguaucauccauguuucuauaccaaaaugguagugaaauugcagacggaagaccauggguagaagucgacauagaaguauuaggaaaaaauccagguucauuucaaagcaauauaauaacaggaaaagcaggagcacagaaaacaagcgaaaaacaccacgcuguaaguccagcagcagaucaagcauuucauacuuauggauuagaauggacaccaaauuauguaagauggacaguagauggacaagaaguaagaaaaacagaaggaggacaaguaucaaauuuaacaggaacacaaggguuaagauucaacuuauggaguagcgaaagugcagcuuggguaggacaauuugaugaaucaaaauuaccucuauuucaauucauaaauuggguaaaaguuuauaaauauacuccaggacaaggagaaggaggaucagacuuuacauuagauuggacagauaauuuugacacuuuugacggaaguagauggggaaaaggugauuggacuuucgauggaaauagaguagauuuaacagauaaaaauauauacucaagagaugguauguuaauauuagcauuaacaagaaaaggacaagaaagcuucaacggacaaguaccuagagaugaugaaccagcaccacaaucaucaucaucagcaccagcaaguucaaguagcguaccagcaaguucaaguucaguaccagcaaguagcuccuccgcauuuguaccaccaagcaguucaucagcaacaaaugcaauacaugguaugagaaccaccccagcaguugcaaaagaacauagaaaucuuguaaaugcaaaaggagcaaaaguaaauccaaauggacauaaaagauacagaguaaauuuugaacac

SEQ ID NO: 51074 - RNA, 1047 nt, Artificial Sequence
  derived and/or modified sequence opt6 from anti-influenza_Chain
gaaguacaacuuguagaaucaggcggaggaguuguacaaccuggaagaucacuaagauuaucuugugcugcuuccggauuugcuuuccauaacagagcaaugcacuggguacgacaagcaccaggaaaaggacuagaauggguagcacuaauauauuucgauggaucaaaacaauacuaugcagauucaguaaaaggaagauuuacaauuucaagagacaauucaaaaaacacaguauuucuacaaaugaauucauuaagaccagaagacacagcaguauauuauugugcaguccccggaccaauauucggaauauuuccaccuuggucauacuuugaucauuggggacaaggaauccuagucacaguaucaucagccucaacaaaaggaccuucaguauuuccacucgccccaucaucaaaaucaacauccggagguacagcagcacuagguugucuaguaaaagauuacuuucccgaaccagucacagucucauggaauucaggagcacuaacuucaggaguacacacauuuccagcaguauuacaaucuuccggccuauacucuuuaucaucaguaguaacaguaccaucaucuucccuaggaacacaaacauauauauguaacguaaaccauaaaccaucaaacacaaaagucgauaaaaaaguagaaccaaaaucaugugacaaaacccauacauguccaccauguccagcacccgaauuacuaggaggaccaagcguauucuuauucccaccaaaaccaaaagauacauuaaugauaucacgaacaccagaaguaacaugugucguagucgauguuucacaugaagauccagaaguaaaauucaauugguauguagacggaguagaaguucacaaugcaaaaacaaaaccacgugaagaacaauauaacucaacauacagaguaguaucaguacuaacaguuuuacaccaagauuggcuuaauggaaaagaauacaaaugcaaaguaucuaacaaagccuuaccagcaccaauagaaaaaaccauaucaaaagcaaaagga

SEQ ID NO: 51075 - RNA, 1047 nt, Artificial Sequence
  derived and/or modified sequence opt6 from anti-influenza_Chain
gaaguacaacuaguagaaucaggaggaggaguaguucagccaggacgaucauuaagacucucaugugcagcaucagguuucgcauuccacaauagagcaaugcauuggguacgacaagcuccagguaaaggacuagaauggguagcauuaauauauuucgauggcucaaaacaauauuaugcagauucaguaaaaggacgauuuacaauaucaagagacaauuccaaaaacacaguauuucuacaaaugaauucccuaagaccagaagacacagcuguauauuauugcgcaguaccagguccaauauucggaauauuuccacccuggucauacuucgaccauuggggacaaggaauauuaguaacugucucaucagcaucaacuaaaggaccuucaguauuuccacuugccccauccucuaaaucaacaucaggaggaacagcagcacuaggaugccuaguuaaagacuacuuuccagaaccaguaacaguaucauggaauaguggagcacuaacaucaggaguacauacauuuccugcuguauuacaaucaucaggauuauauuccuuaucaaguguaguaacagucccaucuucaucacuaggaacacaaacauauauauguaacguuaaccauaaacccucaaauacuaaagucgacaaaaaaguugaaccuaaaucaugcgauaaaacacacaccuguccaccaugcccagcuccagaauuacuaggaggaccauccguauucuuauuuccaccaaaaccaaaagacacauuaaugauaaguagaacaccagaaguaacaugcgucguaguagacgucucacaugaagauccagaaguaaaauucaacugguaugucgauggagucgaaguacacaaugcaaaaaccaaaccaagagaagaacaauauaacucaacauacagaguaguaucuguacuuacaguauuacaucaagauuggcuuaauggaaaagaauauaaaugcaaaguaucaaauaaagcacucccagcaccaaucgaaaaaacuauauccaaagcaaaagga

SEQ ID NO: 51076 - RNA, 1047 nt, Artificial Sequence
  derived and/or modified sequence opt6 from anti-influenza_Chain
augaauauaaaaaaaacugcaguaaaaucagcauuagcaguagcagcagcagcagcagcauuaacaacaaauguaucagcaaaagauuuuucaggagcagaauuauauacauuagaagaaguucaauacgggaaauuugaagcaagaaugaaaauggccgcagcaucaggaacaguaucaucaauguuucuauaucagaacggaucagaaauagcagauggaagaccaugggucgaaguagauauagaaguauuaggaaaaaauccaggaagcuuucaauccaauauaauuacaggaaaagcaggagcacaaaaaacaucagaaaaacaucacgcuguaaguccagcagcagaucaagcauuucauacauauggacuagaauggaccccaaauuauguaagauggacaguagauggacaagaagucagaaaaacagaaggaggucaaguaucaaaucuaacaggaacacaaggauuacgauuuaacuuguggucaucagaaagugcagccuggguaggacaauuugaugaaucaaaacuuccacuauuucaauucauaaauuggguaaaaguauauaaauauacuccuggacaaggagaaggaggcucagacuuuacauuagauuggacagacaauuuugauacauucgacggaucaagauggggaaaaggagacuggacuuuugauggaaaucgaguagauuuaacagauaaaaacauauacucaagagauggaauguuaauacuagcacuaacaagaaaaggacaagaaagcuuuaauggacaaguaccuagagaugaugaaccagcaccacaaucaucaaguagcgcaccagcaagcaguagcucagucccagcaucaucaucaucagucccagcuucaagcucaucagcauuuguuccaccuucaucaucaucugcaacaaacgcaauacauggaaugagaaccacaccagcaguagcaaaagaacauagaaaucuagucaacgcaaaaggagcaaaaguaaacccaaauggacauaaaagguauagagucaauuuugaacac

SEQ ID NO: 51077 - RNA, 1161 nt, Artificial Sequence
  derived and/or modified sequence opt6 from anti-influenza_Chain
augaauaaauucuuaaacaaaaaauggucacuaauacuaacaaugggaggcaucuuuuuaauggccacacuaucauuaauauuugcaacaggaaaaaaagccuucaacgaccaaacaagcgccgaggauauaccaagucuagcagaagcauuuagagauuauuucccaaucggagcugcaaucgaaccaggauauacaacaggacaaauagcagaacuauacaaaaaacacguaaauaugcuaguagccgaaaacgccaugaaaccagcaucacuacaaccuacagaaggaaacuuccaaugggcagaugcagacagaauaguacaauucgcaaaagaaaauggaauggaauuaagauuccauacauuaguauggcacaaccaaacaccaacaggcuuuagucuagacaaagaagguaaaccaaugguggaagaaacagauccacaaaaaagagaagaaaacagaaaauuauuacuacaaagauuagaaaacuacauaagagcaguugucuuacgauauaaagaugacauaaaaucaugggauguaguaaacgaaguaauagaaccuaacgacccaggagguaugagaaauucaccaugguaucaaaucacaggaacagaauacauagaaguagcauucagagcaacaagagaagcaggaggcucagauauuaaacuauacaucaaugacuacaacacagacgacccaguaaaacgagacauacuauaugaauuagucaaaaaccuacuagaaaaaggaguaccaauagacggaguuggacaucaaacacacaucgacauauacaauccaccugucgaaagaauaauagaauccauaaaaaaauucgcaggauuaggauuagacaauaucauaacagaacuagacaugucaauauauucauggaacgauagaucagacuauggagauucaaucccagacuacauacuaacacuacaagcaaaaagauaucaagaacuauuugacgcucuaaaagaaaauaaagacauaguuucagcagucguuuucuggggaauaagugauaaauauucuuggcuaaauggcuucccaguaaaaagaacgaaugcaccacuacuauucgacagaaacuucaugccaaaacccgcauucugggcaauagucgauccaucaagacuacgagaa

SEQ ID NO: 51078 - RNA, 1161 nt, Artificial Sequence
  derived and/or modified sequence opt6 from anti-influenza_Chain
augaacaaauucuuaaauaaaaaauggagcuuaaucuuaaccaugggagguaucuuccuaauggcaacacuaucauuaauauuugcgacagguaaaaaagcauucaaugaccaaacaucagcagaagacaucccuucacuagcagaagcauucagagauuauuucccaauaggagcagcaauagaaccaggauacacaacaggacaaauagcggaauuauauaaaaaacacguaaauaugcuuguagcagaaaacgcaaugaaaccagcaucacuccaaccaacagaaggaaauuuccaaugggcagacgcagacagaauaguacaauuugcaaaagaaaacggaauggaacuuagauuucauacacuaguauggcacaaucaaacaccaacaggauuuagcuuagacaaagaaggaaaaccaaugguagaagaaacagauccacaaaaaagagaagaaaacagaaaauuacuauuacaaagacuagaaaacuauauaagagcaguaguauuaagauauaaagaugacauaaaaagcugggacguaguaaacgaaguaauagaaccaaacgauccaggaggaaugcgaaauaguccaugguaccaaauuacaggaacagaauauauagaaguagcauucagagcaacaagagaagcaggaggaucagacauaaaauuguacauaaaugacuacaacacagacgacccaguaaaaagggacauacuauacgaacuagugaaaaaccuauuagaaaaaggcguuccaauagacggaguaggccaucaaacacacauagauauuuacaacccaccuguugaacgcauuauagaaucaauaaaaaaauucgcaggacuaggauuagacaauaucauaacagaacuagacaugucaauauacucauggaacgauagaucagacuauggagacucaauaccagauuacauacucacacuacaagcaaaaagauaccaagaauuauucgacgcauuaaaagaaaauaaagacauagucagcgcuguaguauucuggggcauaagcgauaaauacaguuggcuaaauggauuuccaguaaaaagaacaaacgcaccacuauuauucgacagaaacuucaugccaaaaccagcauucugggcaauaguagacccaucaagauuaagagaa

SEQ ID NO: 51079 - RNA, 1221 nt, Artificial Sequence
  derived and/or modified sequence opt6 from anti-influenza_Chain
augagaaacguaguacgaaaaccacugacaauaggacuagcacuaaccuuauuacuaccaaugggcaugaccgcaaccucagcaaaaaacgcagauagcuacgcaaaaaaaccacacauaucagcacuaaacgcaccacaacuagaccaaagauacaaaaacgaauucacaauaggagcagcaguagaaccauaccaauuacaaaacgaaaaagauguacaaaugcuaaaaagacauuucaacagcauaguugcugaaaacguaaugaaaccaaucaguauucaaccagaagaaggaaaauuuaacuuugaacaagcagacaggauagucaaauuugcaaaagcaaacggaauggauauaagauuccauacacucguauggcacucacaaguaccacaaugguucuuucuagauaaagaaggaaaaccaaugguaaaugaaacagacccaguaaaaagagaacaaaacaaacaacuauuacuaaaaagacuagaaacacacauaaaaacaauaguagaacgauauaaagacgacauaaaauacugggacguaguaaacgaagucguaggcgacgacggcaaacuacgaaacucaccaugguaucaaauagcaggaauagauuacauaaaaguagcauuucaagcagccagaaaauacggaggugacaauauaaaacuauauaugaaugacuauaacacagaaguagaaccgaaaaggacagcacuauacaacuuaguaaaacaauuaaaagaagagggaguaccaauagacggaauaggacaccaaucacauauccaaauaggauggccaucagaagcagaaauugaaaaaaccauaaacauguucgcagcauuaggauuagacaaccaaauaacagaacuagacguaucaauguacggauggccaccaagagcauacccaaccuacgaugcaauaccaaaacaaaaauuuuuagaucaagcagcacgauacgacagacuauucaaacuauaugaaaaauuaucagacaaaauaagcaauguaacauucuggggaauagcagacaaccacacaugguuagacucgcgagcagacgucuacuacgaugcaaacggaaacguuguaguagacccaaaugcacccuacgcaaaagucgaaaaaggaaaaggaaaagaugccccauucguauucggaccagacuacaaaguaaaaccagcauacugggcaauaauagaccacaaa

SEQ ID NO: 51080 - RNA, 1221 nt, Artificial Sequence
  derived and/or modified sequence opt6 from anti-influenza_Chain
augagaaacguagucagaaaaccauuaaccauaggauuagcauuaacacuccuacuaccaaugggaaugacagcaacaagcgcaaaaaacgccgacagcuacgcaaaaaaaccacacauaucagcccuaaacgcaccacaauuagaccaaagauauaaaaacgaauuuacaauaggcgcagcaguagaaccauaccaacuacaaaacgaaaaagauguacaaauguuaaaaagacauuucaacucaauaguagcugaaaacguaaugaaacccauaagcauacaaccagaagaaggaaaauucaacuuugaacaagccgacagaauuguaaaauuugcaaaagcaaacggaauggacauaagauuccauacauuaguauggcacucacaaguuccacaaugguucuuucuagacaaagaaggaaaaccaauggucaacgaaacagacccaguaaaaagagaacaaaauaaacaacuacuauuaaaaagacuugaaacacacauaaaaaccauaguagaaagauacaaagacgacauaaaauacugggauguaguaaacgaagucguaggagaugauggcaaauuaagaaacaguccaugguaucaaauagcagggaucgacuauauaaaaguagcauuucaagcagcaagaaaauauggaggagauaauauaaaacucuauaugaacgacuauaacacagaagucgaaccaaaacgaacagcccuauacaaccuaguaaaacaacuaaaagaagaaggagucccaauagacggaauaggacaccaaagucacauacaaauaggauggccaagcgaagccgaaauagaaaaaacaauaaacauguucgccgcacuaggauuagacaaccaaauuacagaacuagaugucucgauguauggauggcccccacgagcauauccaacauaugacgcaauacccaaacaaaaauuucuagaccaagcagcaagauacgaccgauuauucaaauuauacgaaaaacuaucagacaaaauaaguaauguaacauucuggggaauugcagacaaccacacauggcuagauagcagagcagauguauauuaugacgcaaacgguaacguaguaguggaccccaacgccccauacgcaaaaguagaaaaagguaaaggaaaagaugcaccauucguauucggaccagauuacaaaguaaaaccagcuuauugggccauaauagaccauaaa

SEQ ID NO: 51081 - RNA, 1233 nt, Artificial Sequence
  derived and/or modified sequence opt6 from anti-influenza_Chain
cucucaagaauaaaccacuuugaaaaaauccaaauaauaccaaaaucaucauggagcgaccacgaagcaucaucaggcguaagcucagccuguccauaccaaggaacaccauccuucuuccgaaacguaguaugguuaauaaaaaaaaauaauacauacccaacaaucaaaagaucauauaacaacaccaaccaagaagauuuacuuauacuauggggaauacaccauucaaaugacgccgcagaacaaacaaaacucuaucaaaacccaacaacauauauaucaguaggaacaagcaccuuaaaccaacgauuaguaccaaaaauugcaacaagauccaaaguaaauggacaaaacggacgaauggacuuuuucuggaccauacuuaaaccuaacgacgccauaaacuucgaauccaacggaaauuuuauagccccagaauacgcauacaaaauagucaaaaaaggcuacauaccagaagcaccaagagacggacaagcauacguaagaaaagacggagaauggguacuauuaucaacauuucucagaucagacaaaacccacacauguccaccaugcccagcaccagaauuauuaggaggaccuucuguauucuuauuccccccaaaacccaaagacacauuaaugauaucaagaacucccgaaguaacaugcguaguaguagacguaucccacgaagaccccgaaguaaaauuuaacugguauguagacggaguagaaguacauaacgcaaaaacaaaacccagagaagaacaauacaacucaacauaucgagucguaucaguacuaacaguauuacaccaagacuggcuaaacggaaaagaauacaaaugcaaaguuucaaacaaagcucuaccagcaccaauagaaaaaacaauauccaaagcaaaaggccaaccuagagaaccacaaguauacacacuaccaccaucaagagaagaaaugacaaaaaaccaaguuucauuaacaugccuaguaaaaggauucuacccauccgacauagccguagaaugggaaucaaacggucaacccgaaaacaacuauaaaacaacaccaccaguauuagacucagacggauccuucuuccuauacuccaaacuaacugucgauaaaucuagauggcaacaaggaaacguauucucaugcuccguaaugcacgaagcauuacacaaccauuacacacaaaaaucucuaucacucucaccaggaaaa

SEQ ID NO: 51082 - RNA, 1233 nt, Artificial Sequence
  derived and/or modified sequence opt6 from anti-influenza_Chain
cucagccguauaaaccacuuugaaaaaauacaaauaauacccaaaucaucauggucagaccacgaagcaaguucaggaguaucauccgcauguccauaccaaggaacaccaucuuucuuccgaaacguuguaugguuaauaaaaaaaaacaacacguacccaaccauaaaaagaucauauaacaacacaaaccaagaagacuuacugauacuauggggaauacaccacuccaacgacgcagcagaacaaacaaaacuauaccaaaaucccaccacauacauaucaguaggaacaucaacccuaaaucaaagacuaguuccaaaaauagccacacgaagcaaaguuaauggacaaaacggcagaauggauuucuucuggacaauauuaaaaccaaacgacgcaaucaacuuugaaucaaauggaaauuucaucgcaccagaauacgcauacaaaauaguaaaaaaagguuacauacccgaagcuccacgcgacggacaggcauacguaagaaaagacggagaauggguacuacuaagcacuuucuuaagaucagacaaaacacacacauguccaccauguccagccccagaacucuuaggaggcccaucuguuuuucucuuuccaccaaaaccaaaagacacauuaaugauaucaagaacaccagaagucacauguguagucguagacguuucacacgaagauccagaaguaaaauucaacugguauguagauggaguagaaguacauaacgcaaaaacuaagccaagagaagaacaauacaauucaacauacagaguaguuuccguacuaacaguacuacaccaagauugguuaaacggaaaagaauacaaaugcaaaguaucaaacaaagcauuaccagcaccaauagaaaaaacaauauccaaagcaaaaggacaaccccgagaaccacaaguuuacacauuaccaccauccagagaagaaaugacaaaaaaccaaguaucauuaacaugccuaguaaaaggcuuuuaccccucugacauagcaguagaaugggaaucuaacggacaaccugaaaacaacuauaaaacaacucccccaguacuagacucagauggauccuucuucuuauacagcaaacuaacaguagacaaauccagauggcaacaaggaaacguauucuccugcucaguaaugcaugaagcacuacauaaccauuacacacaaaaaucauuaucacuaucaccaggaaaa

SEQ ID NO: 51083 - RNA, 1293 nt, Artificial Sequence
  derived and/or modified sequence opt6 from anti-influenza_Chain
auggaugaccacgcagaaaaauuuuuauggggaguagccacaucagcauaucaaauagaaggcgcaacacaagaagauggaagagguccaucaauaugggaugcuuuugcaaggagaccaggagcaauaagagaugggucuacaggagaacccgcuugugaccacuauagaagauaugaggaagauauugcuuuaaugcaaucacuagguguaagagcauauagauuuucaguagcauggccaagaauauuaccagaaggaaggggucgaauaaauccaaaaggacuugcauuuuaugauagauuaguagauagauuauuagcuagugggauaacuccauuucuaacauuauaucauugggauuuaccacuugcauuagaagaaagaggaggauggcgaucaagagaaaccgcauuugcauuugcagaauaugcugaagcaguagcaagagcauuagcagauagaguaccauuuuucgcuacauuaaacgaaccauggugcucagcauuuuuaggacacuggacaggagaacaugcaccaggucuaagaaaucuagaagcagcacuuagggcagcacaucauuuacuauuaggucauggacuagcaguagaagcauuaagagcagcaggagcaagaagaguaggaauaguauuaaauuuugcaccagcauauggagaagauccagaagcuguugauguagcagauagauaccacaauagauauuucuuagauccaauauuagguaaaggcuacccggaaaguccauuuagagauccaccaccaguuccaauauugucaagagauuuagaauuaguagcaagaccuuuagauuucuuagggguaaauuacuaugcaccaguaagggucgcaccagguacaggaacuuuaccagugcgauauuuaccaccugaaggaccagcaacagcuaugggaugggaaguuuauccagaaggauuacaucauuuauuaaaaaggcuaggaagagaaguaccauggccauuguauguaacagagaauggagcagcauauccagauuuauggacaggagaagcuguaguagaagauccagaacgcguagcauacuuagaagcacauguggaagcugcacuacgagcaagagaagaaggaguugaucuaagagguuauuuuguguggaguuuaauggauaauuuugaaugggcauuuggauauacgagaagauucggccuauauuacguagauuuccccucacaaagaagaauaccuaaaagaagugcucuaugguaucgagaaagaauagccagagcacaaaca

SEQ ID NO: 51084 - RNA, 1293 nt, Artificial Sequence
  derived and/or modified sequence opt6 from anti-influenza_Chain
augacugaaaaugcagaaaaauuuuuaugggguguagcaacaagugcauaucaaauugaaggagcuacacaagaagauggaagaggaccaucaauaugggaugcauuugcacaaagaccaggagcaauaagagauggaaguacuggugaaccagcaugugaucauuauagaagauaugaagaagauauagcacuaaugcaaaguuuaggaguaagagcauauagauuuucaguagcauggccaagaauacuaccagaagguagaggaagaauaaauccaaaaggauuggcuuuuuacgauagguuaguagauagauuacuagcaucagguauaacuccauuuuuaacguuauaucauugggauuuaccacuggcauuagaagaaagaggaggauggagaucuagagaaacagcauuugcuuuugcagaauacgcagaagcaguagcaagagcauuagcugauagaguuccauucuuugcaacguuaaaugaaccuugguguagugcauuucuuggacauuggaccggagaacaugcaccaggucuuagaaauuuagaggcagcauugagagcagcacaccauuuacuuuuaggccauggacuagcaguagaagcauugagggcugcaggcgcaagaagaguaggaauuguuuuaaauuuugcuccagcauauggagaagauccagaagcaguagacguagcagauagauaccauaaucguuucuuucuagauccaauauuaggaaaaggauauccagaaucaccauuuagagauccaccaccaguacccauauuaucaagagacuuagaauuaguggcaagaccauuagacuuuuuagguguaaauuauuaugcaccgguaagaguagcaccugggacaggaacauuaccaguuagauauuuaccaccagaaggaccugcaacagcuaugggaugggaaguauauccagaagggcuauaucauuuacuuaaaagauugggaagggaagugccuuggccacuauaugucacagaaaacggagcagcauauccagauuuauggacaggugaagccguuguggaagauccagaaagaguagcauauuuagaagcacauguagaagcagcacuaagagcucgagaagaaggaguugauuuaagagguuauuuugucuggaguuuaauggauaacuuugaaugggcauuuggauacacaagacgguucgguuuauauuauguagauuuuccaucacaaaggagaauaccaaaaagaucagcacuaugguauagagaaagaauagcaagagcacaaaca

SEQ ID NO: 51085 - RNA, 1293 nt, Artificial Sequence
  derived and/or modified sequence opt6 from anti-influenza_Chain
auggcagaaaaugcugaaaaauuuuuauggggaguagcaacaagcgcauaccaaauagaaggugcaacacaagaagacgguagaggaccaucaauaugggauacauucgcaagaagacccggagcaauaagagauggaucaacuggugaaccugcaugugaucauuaccauagauaugaagaagauauugcacuaaugcaaucauuaggaguaggaguuuauagauuuucaguugcuuggccaagaauauugccagaaggcagagggagaauaaauccaaagggccuagcauucuacgauagauuaguugauagauuauuagcagccggaauaacacccuuccuaacacuauaucacugggauuuaccucaagcauuagaagacagaggaggguggagaaguagagagacagcuuuugcauuugcagaauaugcugaagcaguagcuagagcauuagcagacagaguuccauuuuucgcaacacuaaaugaaccuugguguagugcauuucuuggacauuggacaggcgaacacgcaccaggacuaagaaaucuagaagcagcacuuagagcugcacaucauuuauuauuaggucauggacuagcuguagaagcacuucgagcagcuggagcaaaaaggguaggaauaguuuuaaauuuugcacccguuuauggagaagacccagaagccguugaugucgcagauagguaucauaauagauauuuucuagacccaauauuaggcagagguuauccagaaucaccauuccaagacccaccuccaacuccuaaucuuucaagagauuuagaauuaguagcuagaccauuagauuuucuaggaguaaauuauuaugcuccaguaagaguagcaccaggaacaggacccuuaccaguaagauaucuaccaccagaaggacccguaacagcaaugggaugggaaguauauccugaaggacuguaucauuuacuaaaaagauuagguagagaaguaccauggccauuauauauaacugaaaauggagcugcuuauccagauuuauggacaggggaagcaguaguagaagauccagaaagaguagcauauuuagaagcacauguagaagcagcguuaagagcaagagaagaagguguugaucuaagagguuauuucguauggucacuuauggacaauuuugaaugggcuuuuggauacacaagaagauuuggcuuauauuauguagacuucccaagucaaagaagaauaccaaaaagaagcgcauuaugguacagagaaagaauagcaagggcacaauua

SEQ ID NO: 51086 - RNA, 1293 nt, Artificial Sequence
  derived and/or modified sequence opt6 from anti-influenza_Chain
auggaugaucacgcagaaaaguucuuauggggaguagcuacaagcgcuuaucaaauugaaggagcaacacaagaagacgguagaggaccuaguauuugggaugcauuugcaagaagaccaggagcaauaagagauggaaguacaggagaaccagcaugugaucauuaucgacgauaugaagaagauauagcacuaaugcagucacuaggaguaagagcuuauagguuuaguguagcauggccaagaauacuaccggaaggaagaggaaggauaaauccaaaaggauuagcauucuacgacagauuaguagaucgauuauuagcaaguggaauaacaccuuuucuaacauuauaucauugggacuugccucuagcuuuagaggaaagaggcggauggagaucaagagaaacugcauuugcauuugcagaauacgcagaagcaguagcaagagcacuagcagaucguguaccauucuuugcaacauuaaacgaaccaugguguucagcauuuuuaggucauuggacaggggaacaugcuccaggauuaaggaaccuagaagcugcauuaagggcagcacaucacuuauuauuaggacauggauuagcuguagaagcauuaagagcagcaggagcaagaaggguugguauuguauuaaauuuugcuccagcauauggagaagacccggaagcaguugauguagccgauagauaucauaaucgauauuuucuagauccaauuuuagggaaaggauauccagagucaccuuuuagagacccuccaccaguaccaauacugucaagagacuuagaauuaguugcaagaccauuagacuuuuuaggaguuaauuauuaugcaccaguaagagucgcaccaggaacagguacauuaccaguaagauaccuaccaccugaaggaccugcuacagcaaugggaugggaaguuuauccagaaggucuacaucauuuacuaaaaaggcuaggaagagaaguaccauggccauuauaugugacagaaaauggugcugcauauccugauuuauggacaggagaagcaguaguagaagauccagaaaggguagcauaucuagaagcacaugucgaagcagcacuaagagcaagagaagaaggaguagauuuaagagguuauuuuguaugguccuuaauggauaauuuugaaugggcauuuggauauacucgaagguuuggauuauauuauguugauuucccaagucaaagaaggauuccaaaaagaagcgcauugugguauagagaaagaauagcuagagcacagacg

SEQ ID NO: 51087 - RNA, 1293 nt, Artificial Sequence
  derived and/or modified sequence opt6 from anti-influenza_Chain
augacagaaaaugcugaaaaauuuuuauggggaguagcaacuucagcauaucaaauagaaggagcaacacaagaagauggaagagguccuucaauaugggaugccuuugcacaaagaccaggagcaauaagagauggaucaaccggagaaccagcaugugaucauuauagaagauaugaagaagauauagcgcuuaugcaaucauuaggaguacgagcauauagauuuucaguagcauggcccagaauacuuccagaaggaagaggaagaauaaauccaaaaggauuagcauuuuaugauagauuaguggauagauugcuugcuaguggaauaacacccuuuuuaacauuauaucauugggaucuaccauuggcauuagaagaaaggggaggauggagaucaagagaaacagcauuugcauucgccgaauaugcagaagcaguagcacgagcacuagcagauagaguaccauucuucgcuacauuaaaugaacccugguguagugcauuuuuaggacauuggacaggagaacaugcuccaggauugagaaaucucgaagcagccuuaagagcagcacaucauuuacuauuaggacacggacuagcagucgaagcauuaagagcugcuggugcaagaagaguaggaaucguacuaaauuucgcaccagcauauggagaagacccagaagcaguagauguugcagauagauaucauaauagauucuuuuuagauccaauucuaggaaaaggcuauccagaauccccauuuagagauccuccaccaguaccaauacuaagcagagaucucgaauuaguagcaagaccucuugauuucuuaggaguaaauuauuaugcuccuguaagaguagcaccaggaacaggaacauuaccaguaagauauuuaccaccagagggaccagcaacagcuaugggaugggaaguauauccagaaggauuauaucaucuauuaaaacgacuuggaagagaaguaccuuggccuuuauauguaacugaaaauggagcggcauauccagauuuauggacaggagaagcuguaguagaagauccagaaagaguagcuuacuuagaagcacauguagaagcugcauuaagagcaagagaagaagggguugaucuacgaggauacuuuguuuggucacuaauggauaauuuugaaugggcauuugguuauacccgaagauuugguuuauauuauguagauuucccaucacaaagaagaauaccuaaaagaucagcuuuaugguaucgagaaagaauagcaagagcucaaacg

SEQ ID NO: 51088 - RNA, 1293 nt, Artificial Sequence
  derived and/or modified sequence opt6 from anti-influenza_Chain
auggcagaaaaugcugaaaaauuuuuauggggaguugcaacaucagcauaucaaauugaaggagcaacacaagaagaugguagaggaccaagcauaugggauacuuuugccagaagaccuggugcaauaagggauggcucaacaggugaaccagcaugugaucauuaucaccgauacgaagaagacauagcauuaaugcagucacuaggcguaggaguauauagauucucagucgcuuggccaagaauauuaccagaaggacgaggaagaauaaauccaaaaggauuagcauuuuacgauagauuaguagauagacuacucgcugcaggaauaacgccauuuuuaacauuauaccacugggauuuaccucaagccuuagaagauagaggugguuggagaucaagagaaacggcuuuugcauuugcagaauaugcagaagcaguagcaagggcacuagcagauagaguaccuuucuuugcaacauuaaaugaaccuugguguucagcauuuuuaggacauuggacuggagaacaugcaccugguuuaagaaaccuagaagcagcauuaagagcagcacaucauuuauuauuaggucacggauuagcaguagaagcacuaagagcugcaggagcuaaacgaguagguauaguacuuaauuuugcaccaguauauggagaagauccugaagcaguagauguagcugacagauaucauaacagauacuuuuuagauccaauauuaggaagagguuauccagaaucacccuuucaagauccuccaccaacacccaauuuaaguagagauuuagaauuaguagcaagaccacuagacuuuuugggaguaaauuacuaugcaccaguaagaguagcaccaggaacaggaccauuaccaguuagauauuuaccaccagaaggaccaguaacagcuauggguugggaaguauauccagaaggucuauaucauuuacuuaaaagauuaggaagagaaguaccauggccauuauacauaacagaaaacggagcagcauauccagauuuauggacaggagaagcaguaguugaagauccagaacgaguagcauauuuagaagcacauguagaagcagcacuaagagcgagagaagaaggaguagaucuacgaggauauuuuguauggagucuaauggauaauuuugaaugggcguuuggauauacacgacgcuuuggauuauauuauguugacuuuccaagucaacgaagaauaccaaaaagaagugcuuuaugguauagagaaagaauagcaagagcacaauua

SEQ ID NO: 51089 - RNA, 1296 nt, Artificial Sequence
  derived and/or modified sequence opt6 from anti-influenza_Chain
auguucaaaccaaauuaucauuucuuuccaauaacaggauggaugaacgauccaaauggauuaauauuuuggaaaggaaaauaccauauguuuuaucaauauaauccuagaaaaccagaauggggaaauauauguuggggccaugcgguaagugaugaucuuguacauuggcgucauuuaccaguagcauuauacccugaugacgaaacacauggaguguuuucagguagugccguagaaaaagacggaaaaauguucuuaguauauacuuauuacagagacccaacacauaauaaaggagagaaagaaacgcaauguguagcuaugagugaaaauggacuagauuucguaaaauaugauggaaauccaguaauaucaaaaccaccagaagaaggaacgcacgcauuuagagauccaaaaguaaacagaagcaauggggaauggaggaugguacuaggaaguggaaaagaugaaaagauaggaagaguauuacuuuacacaagcgaugacuuauuucauuggaaauaugaaggaguaauauuugaagaugagacaacaaaagaaauagaauguccagaucuuguaagaauaggugaaaaagauauacuaauauauucgauaacaucaacaaauagcguauuauuuaguaugggagaguuaaaagaaggaaaauuaaacguagagaaaagaggacuauuagaucaugggacagauuuuuacgcagcacaaacauuuuucggaacagacagaguagucguaauaggaugguuacaaucauggcuaagaacaggacuauauccgacaaaaagagaaggauggaauggaguuaugaguuuaccaagagaauuauacguagaaaauaaugaauugaaaguaaaacccguagaugaauuauuagcacuaagaaaaagaaaaguauuugaaacagccaaaagugggacauucuuauuagauguaaaagaaaacucuuacgaaauaguaugugaauuuaguggagaaauagaauuaagaaugggaaacgaaagugaagaaguugucauaaccaaaaguagagaugaacuaauaguugauacaacaagaucaggaguaaguggaggagaaguaagaaaaaguacaguagaagaugaggcaacaaauagaauaagagcauuuuuagacucauguucgguagaauuuuucuucaaugacucaaucgcauuuucauuuagaauccacccagaaaauguuuauaauauauuaagcguaaaaucaaaucaaguuaaacuugaagucuucgaauuagaaaauaucugguua

SEQ ID NO: 51090 - RNA, 1296 nt, Artificial Sequence
  derived and/or modified sequence opt6 from anti-influenza_Chain
auguuuaaaccaaacuaccacuucuuuccaauaacaggauggaugaaugacccaaauggccuaauauuuuggaaaggaaaauaccauauguuuuaccaauauaauccaagaaaaccagaauggggaaacauauguuggggacacgcaguuucagacgauuuaguacacuggagacauuuaccaguagcacucuauccagacgacgaaacccacggaguauuuucaggaagcgccguagaaaaagauggaaaaauguuuuuagucuauacauacuauagagacccaacacauaacaaaggcgaaaaagaaacacaauguguagcaaugucagaaaaugggcuagacuuuguaaaauaugacggaaacccaguaauuaguaaaccaccagaagaaggaacacacgcauuuagagacccaaaaguaaacagaagcaauggagaauggaggaugguucugggaaguggaaaagaugaaaaaauuggcagaguacuacuauacacaagcgaugaccuauuucauuggaaauacgaagguguaauauuugaagacgaaacaacuaaagaaauagaauguccagacuuaguaagaauaggagaaaaagauauacuaauauacagcauuaccaguacaaacaguguauuauuuagcaugggagaacuaaaagaaggaaaauuaaacguagaaaaaagaggauuauuagaccauggaacagacuuuuaugcagcacaaacauuuuucggaacagauagaguaguaguaauaggauggcuacaaaguuggcuaaggacaggauuauacccgacaaaaagagaaggauggaacggaguaaugagcuuaccaagagaacuauacguugaaaauaaugaacuaaaaguuaaaccaguagacgaacuauuagcccuaagaaaaagaaaaguauuugaaacagcaaaaagcggaacauuuuuauuagacguaaaagaaaauucauaugaaauaguaugcgaauuuucaggagaaauagaacuaagaaugggaaacgaaagugaggaaguaguaauaacuaaaucaagagaugaauuaauaguagacacaacaagaaguggaguuucaggaggagaagucagaaaaagcacaguagaagacgaagcaaccaauagaauaagagcguuucuagacucguguucaguagaauuuuuuuuuaaugacaguauagcauucucauuucgaauacacccugaaaacguauauaauauauuaaguguaaaaucaaaccaaguaaaacuagaaguauucgaauuagaaaauauaugguua

SEQ ID NO: 51091 - RNA, 1323 nt, Artificial Sequence
  derived and/or modified sequence opt6 from anti-influenza_Chain
gaaguaaaacuaguagaaucaggaggaggcuuaguccaacccggaggaagccuaagacuaucaugcgcuacaucaggauucacauuuucagacuacuauaugucauggguacgacaaucacccggaaaagcacuagaauggcuaggauucacaagaucacgaguauuaggauacacaacagacuauucagccucaguaaaaggaagauucaccauaaguagagauaacucacaaucaauccuauaucuacaaaugaauucacuaagaggagaagacuccgcaacuuacuacugcgcaagagacagacccauggauuacuggggccaaggaacaucgguaacagucucaagcgcuaaaacaacaccaccaucaguauaccccuuagcacccggcucagcagcacaaacaaacucaaugguaacauuaggaugccuaguaaaaggauacuucccagaaccaguaacaguaaccuggaauucugggucauuaucaucaggcguacauacauuccccgcaguacuacaaucagaucuuuauacacuauccucuucagucacaguuccaucaaguacauggccaucagaaacaguaacauguaacguagcacauccugcaucuucaaccaaaguagauaaaaaaauuguacccagagauugcggaugcaaacccuguauauguacaguaccagaaguaucaucaguauucauauuuccacccaaaccuaaagauguauuaacaaucacauuaaccccaaaaguaacaugcguugucgucgacaucagcaaagacgacccagaaguacaauuuucaugguucguagacgacgucgaaguacacaccgcucaaacacaacccagagaagaacaauuuaauucaacauuuagaucuguaucagaauuaccaauaaugcaccaagacuggcuuaacggaaaagaauuuaaaugcagaguaaacucagccgcauucccugcaccaauagaaaaaacaauaucaaaaacaaaaggaaggccaaaagccccccaagucuauacaauaccaccacccaaagaacaaauggcuaaagauaaagucucauuaacauguaugauaacagacuuuuucccagaagauaucacagucgaauggcaauggaacggccaaccagccgaaaauuauaaaaacacgcaaccuauaauggacacagacggaucauacuucgucuacucaaaauuaaauguacaaaaaucaaauugggaagcaggaaacacauuuacaugcucuguauuacacgaaggacuacauaaccaucacacugaaaaaucacuuucucacucacccggaaaa

SEQ ID NO: 51092 - RNA, 1323 nt, Artificial Sequence
  derived and/or modified sequence opt6 from anti-influenza_Chain
gaaguaaaacuaguugaaucaggaggaggauuaguccaaccagguggaucccuacgauuaucaugcgcuacaucaggauuuaccuuuucagauuacuauaugucuuggguaagacaaucuccuggaaaagcacucgaauggcuaggauucacaagaucaagaguauuaggcuacacuacagacuacagugcauccguaaaaggacgcuucacuauaucaagagauaacucccaaucaauacuauauuuacaaaugaacagucuaagaggagaagacucagccaccuacuauugugcaagagauagaccaauggacuauugggggcaagguacaucaguaacaguauccucagcaaaaacaacacccccaucaguuuacccuuuagcaccagguuccgccgcacaaacaaacucaaugguaacauuaggaugcuuaguaaaaggcuauuucccagaaccagucacuguaacauggaauuccggaucacuuucuucugguguucauacuuucccagccguccuccaaucagacuuauauacacuaucaucauccguaacaguaccaucuuccacuuggccaagcgaaacaguaaccuguaauguugcacacccagcuucaucaacaaaagucgauaaaaaaauaguaccacgagacugcggauguaaaccaugcauaugcacagucccagaaguaucuucaguuuucauauuuccaccaaaaccgaaagauguacuaacaauaacacuaacaccaaaagucaccugcguagucgucgacauaucaaaagaugacccagaaguacaauuuucaugguucgucgacgauguggaaguacauacagcacaaacccaaccuagagaagaacaauucaauucaacauucagaucaguauccgaacucccaauaaugcaccaagacugguuaaauggaaaagaauuuaaaugccgaguaaacucagccgcuuucccagcaccaauagaaaaaacaaucaguaaaacaaaaggaagaccaaaagcuccacaaguauacacaaucccaccacccaaagaacaaauggcaaaagacaaaguaucauuaacauguaugauaacagacuucuuuccugaagacauaacaguagaauggcaauggaauggccaaccagcugaaaauuauaaaaauacacaaccaauaauggauacagauggauccuacuuugucuacucaaaacuaaauguacaaaaaucuaacugggaagcaggaaauacauuuacauguucaguauuacaugaaggacuccauaaccaucauacagaaaaaucacuaucacauuccccuggaaaa

SEQ ID NO: 51093 - RNA, 1329 nt, Artificial Sequence
  derived and/or modified sequence opt6 from anti-influenza_Chain
gaaguacaacuccaacaauccggacccgaauuaguaaaaccaggcgcaucaguaaaaaugucauguaaagcaucaggcuacacauucacaucuuacguuaugcauuggguaaaacaaaaacccggccaaggacuagaauggauaggauauauaaacccauacaacgacggaacaagauacaacgagaaauucagaguaaaagccacacuaacuucagacaaauccucaucaacagcuuauauggaauuauccucccuaacuucugaagacuccgcaguauauuacugugcaagacgaggauuaauaacaacaccaacacucgacuacuggggacaaggcacaaccuuaaccguaucaucugcaaaaacuacaccacccuccgucuacccacuagccccaggaucagccgcacaaacaaacucuauggucacacuaggaugccuuguaaaaggauacuuuccagaaccaguaacaguaacauggaauuccggaucacuauccucaggaguucacacauuuccagcaguauuacagucagaccuuuauacacuauccucaucaguaacuguaccaucaucaacauggccaucagaaacaguaacauguaauguagcacacccagcuucaucaacaaaaguagauaaaaaaauaguaccaagagacugcggaugcaaaccaugcaucugcacaguacccgaaguauccagugucuuuauauucccaccaaaacccaaagacguauuaacaauaaccuuaaccccaaaaguaacaugcguaguugucgacauaucaaaagacgacccagaaguacaauucaguuggguagaugacguagaaguucacacagcccaaacacaaccuagagaagaacaauucaacuccacauuccgcucaguauccgaauuaccuaucaugcaucaagacugguuaaacggaaaagaauucaaaugcagaguuaacucagcagcauuccccgcacccauagaaaaaacaauaucuaaaacaaaaggaagaccaaaagccccacaaguauauacaauaccaccaccaaaagaacaaauggcaaaagacaaaguaucacuaacaugcaugauaacagacuuuuucccagaagacauaacaguagaauggcaauggaacggccaacccgcagaaaacuacaaaaacacccaaccaauaauggauacagacggaucauacuucguauauuccaaauuaaacguacaaaaaagcaacugggaagcaggaaacacauuuacuuguucagucuuacaugaaggccuacauaaucaccacacagaaaaaucauuaucacacucaccuggaaaa

SEQ ID NO: 51094 - RNA, 1329 nt, Artificial Sequence
  derived and/or modified sequence opt6 from anti-influenza_Chain
gaaguacaacuucaacaaucaggaccugaauuaguaaaaccaggagcaucaguaaaaauguccuguaaagccuccggauacacauucacaucauacgucaugcacuggguuaaacaaaaaccaggacaaggauuagaauggauaggauauauaaacccauacaaugacggcacaagauauaacgaaaaauuuagaguaaaagcaacauuaacaucagauaaaucaucuuccacugcauacauggaauuaucaucccuaacuucagaagacucagcaguauacuauugcgcaagaagaggauuaauaacaacaccaacacuagacuacuggggacaaggcacaacacuuaccguuucaucagcaaaaacaacaccaccauccguauacccauuagcuccaggaucagcugcacaaacaaacucaaugguaacuuuaggcugccuaguuaaaggcuauuucccagaaccaguuacaguuacauggaacucaggaucccucucaucaggaguucacaccuucccagccguccuucaaucagaccuauacacacuaucaucauccguaaccguaccaucuucaaccuggccaagcgaaacaguaacaugcaacguagcucacccagccaguucaacaaaaguagacaaaaaaauaguaccaagagacuguggaugcaaacccugcauaugcacaguaccagaagucucaucaguauucauauuucccccaaaaccaaaagacguacuaaccauaacacuaaccccaaaaguaaccugcguagucguagacauuuccaaagaugacccagaaguacaauucucauggguagacgacgucgaaguccacaccgcacaaacccaaccaagagaagaacaauucaauucuacauuuagaucaguuuccgaacuccccauaaugcaccaagacugguuaaacggaaaagaauuuaaaugcagaguaaauucagcagcauucccagcaccaauagaaaaaacaauauccaaaaccaaaggaagaccaaaagcaccucaagucuacacaauaccaccaccaaaagaacaaauggcaaaagacaaaguaucauuaacauguaugauaacagacuucuuucccgaagacaucacuguagaauggcaauggaacggccaaccagcagaaaacuacaaaaacacacaaccuauaauggacacagacggaagcuacuuuguauauaguaaacucaauguacaaaaaaguaacugggaagcaggaaacacuuuuacaugcucuguccuacacgaaggacuacacaaucaccacaccgaaaaaucauuaucccacucaccaggaaaa

SEQ ID NO: 51095 - RNA, 1332 nt, Artificial Sequence
  derived and/or modified sequence opt6 from anti-influenza_Chain
aacguaccagaaugguccuacauaguagaaaaagcaaacccagccaacgacuuaugcuacccaggcaacuuuaacgauuacgaagaacuaaaacaucuauuaucaagaauaaaucacuucgaaaaaauacaaauaauaccaaaaucaucuuggucagaccaugaagcaucuucaggaguuucauccgcaugcccauaucaaggaacacccucauucuucagaaacguaguaugguuaauaaaaaaaaacaacacauacccaacuauaaaacgaucauacaacaauacaaaccaagaagacuuacuaauacuauggggaauacaccauucaaacgacgcagcagaacaaacuaaacuauaccaaaauccaacaacauauauaagcguuggcacaucaacacuuaaccaaagacucguaccaaaaauagcaacuagaucaaaagucaacggacaaaacggaagaauggacuucuucuggacaauacuaaaaccaaacgaugcaauaaacuucgaaucuaacggcaacuucauagcucccgaauacgcuuacaaaauagucaaaaaaggauacauaccugaagcaccaagagacggacaagccuacguuagaaaagacggagaauggguacuacuauccaccuucuuaagaagugacaaaacccacacaugcccaccauguccagcaccagaauuacuaggaggacccucaguauuccuauucccaccuaaaccaaaagacacccuaaugauaucacgcacaccagaaguuacaugcguugucguagauguuucccacgaagacccagaaguuaaauucaacugguauguagacggcgucgaaguacauaaugcaaaaaccaaaccuagagaagaacaauacaacucuaccuacagagucguaucaguacucacaguacuacaccaagauuggcuuaacggaaaggaauacaaaugcaaaguaucaaacaaagcacuaccagcaccuauugaaaaaacaauauccaaagccaaaggacaacccagagaaccacaaguauacacccuaccaccaucaagagaagaaaugacaaaaaaccaagucucacucacaugccuaguaaaagguuucuauccauccgacaucgccguagaaugggaaucuaacggacaaccagaaaauaacuauaaaacaacuccaccaguauuagacucagacggauccuucuucuuauacagcaaguuaaccguagacaaguccagguggcaacaaggaaauguauuuucauguuccguaaugcaugaagcacuacacaaccauuauacacaaaaaucacuaucccuaucaccaggaaaa

SEQ ID NO: 51096 - RNA, 1332 nt, Artificial Sequence
  derived and/or modified sequence opt6 from anti-influenza_Chain
aacgucccggaauggucauacauaguugaaaaagcaaacccagcaaacgacuuaugcuacccaggaaacuucaaugauuacgaagaauuaaaacaccuacuuucacgaaucaaccacuuugaaaaaauacaaauaaucccaaaaucaucauggucagaccacgaagcaucaucuggaguaucauccgcaugcccauaucaaggaacaccaagcuuuuuccguaacguaguaugguuaaucaaaaaaaacaacacauaucccacaauaaaacgaucauacaacaacaccaaucaagaagaccuucuaauauuauggggaauccaucacucaaacgacgcagcagaacaaacaaaauuauaucaaaacccaacaaccuacauaucaguuggaacaagcacauuaaaucaaagacuaguaccaaaaauagcaacuagaagcaaaguaaacggacaaaacggacgaauggauuucuucuggacaauauuaaaaccaaacgacgcaauaaacuuugaaucaaacggaaauuuuauagcaccugaauaugcauacaaaauaguaaaaaaaggauacauacccgaagcaccaagagauggccaagccuacgucagaaaagacggagaauggguacuccucucaacauuuuuaagaucagacaaaacucacacuugcccaccaugcccggcaccagaacuacuaggcggcccauccguauuccuauucccaccaaaaccaaaagacacacuaaugauaucaagaacaccagaaguaacauguguaguaguagacguaucucacgaagacccagaaguaaaauuuaacugguacguagacggaguugaaguacauaacgcaaaaaccaaaccucgagaagaacaauacaacucuacauauagaguaguaucuguccuaacaguauuacaccaagacuggcuaaacggaaaagaauacaaaugcaaaguaucaaacaaagcacuaccagccccaauagaaaaaaccauaucaaaagccaaaggacaaccucgagaaccacaagucuacacacucccaccauccagagaagaaaugaccaaaaaccaagucucacuaacaugccuaguaaaaggauuuuacccaucagauauagcaguugaaugggaauccaacggacaacccgaaaacaauuacaaaaccacaccaccaguauuagauucagacgguucauucuuccucuacuccaaacuaacaguagacaaaucaagauggcaacaaggaaacgucuucagcugcagugucaugcacgaagcacuacacaaccacuauacacaaaaaucccuaucacuuucaccaggaaaa

SEQ ID NO: 51097 - RNA, 1341 nt, Artificial Sequence
  derived and/or modified sequence opt6 from anti-influenza_Chain
caaguacaacuacaagaaucaggcccaggauuaguaaaaccaucagaaacacuaucucuaacuugcacgguaucaggaggucuaaucggaacuggaucauacuacuggggauggauuagacaaaccccuggaaaaggaauggaauggauaggaucaauauccuacucaggauccacuuacuaccauccaucauuaaaaucaagaguaacaauaucagacgacacauccaaaaaccaauuauucuuaaaauuaagauccguuacagccgcagauacagcacaauacuacugcgcaagauacaacuggggaauaagauauuucgacuuuugggguagagguacacuaguaacuguaucaucugcaaguacaaaaggaccaucaguauuuccucuagcaccaugcucccgaucaacgucagaaucaacagccgcccuaggaugucuagucaaagauuacuuucccgaacccguaaccguaucauggaauuccggagcccuaacaagcggaguacacacauuuccagcuguauuacaauccuccggacuauacucuuuauccuccgucguuacaguaccauccucaucuuuagguacaaaaacauacacaugcaaugucgaccacaaaccauccaacacaaaaguagauaaaacacgagaaucaaaauauggaccacccugcccauccuguccagccccagaauucuuaggaggcccaucuguauuuuuauucccaccaaaaccaaaagacacuuuaaugauaucccgaacaccugaaguaacaugcguagucguggacgucucccaagaagacccagaaguacaauuuaacugguacguagacggaguagaaguacauaacgcuaaaacuaaaccucgagaagaacaauucaacucaacauaccgcguaguauccguccuaaccguacuacaucaagauugguuaaacggaaaagaauauaaauguaaaguuuccaauaaaggauuaccuucaucaauugaaaaaacaauauccaaagccaaaggacaaccacgagaaccacaaguauauacauuaccaccagcacaagaagaaaugacuaaaaaucaaguuucauuaacaugccuaguaaaaggauucuacccaucagauauagcaguagaaugggaaucuaacggacaaccagaaaauaacuauaaaacuacaccaccaguuuuagauucagauggauccuuuuuuuuauauucacgucuaacaguagacaaaucaagauggcaagaagguaacguauuuucauguucaguaaugcaugaagccuuacauaaccauuacacacagaaaucucucuccuuaucccuaggaaaa

SEQ ID NO: 51098 - RNA, 1341 nt, Artificial Sequence
  derived and/or modified sequence opt6 from anti-influenza_Chain
caaguacaauuacaagaaucaggaccagguuuaguaaaaccaucagaaacauuaucccuaacauguacaguauccggaggacuaauuggaacaggaucauacuauuggggauggauacgacaaaccccuggaaaaggaauggaauggauagguucuauaaguuauucagguucuacauauuaccacccaucacucaaaucaagaguaacaauuucagacgacacaagcaaaaaucaauuauucuuaaaacuaagauccguaacagcagcagauacagcacaauauuauugcgcaagauacaacuggggcaucagauauuucgacuucuggggaagaggcacauuaguaaccguaaguagugcauccacuaaaggaccaucuguauuuccauuagccccauguucaagaaguacuucagaaaguacagcagccuuaggaugcuuaguaaaagauuacuuuccagaacccguuacaguaucauggaauucaggcgccuuaacauccggaguacacacauuuccagccguacuucaaucaucuggucuauacucacuaagcucuguagucacaguuccaucaucaucacuaggaaccaaaaccuauacauguaacguagaccacaaacccucaaauacaaaagucgacaaaacaagagaauccaaauacgguccaccuugcccaucauguccagcaccagaauuccuaggcggaccaucuguauucuuauucccaccuaaaccaaaagauacauuaaugaucagucgaacaccagaaguaacauguguagucguagacguaucacaagaagauccagaaguacaauucaacugguacguugacggaguagaaguucacaacgcaaaaacaaaaccaagagaagaacaauucaauucaacauacagaguaguaucaguauuaacaguacuccaccaagauuggcuaaacggaaaagaauacaaauguaaaguuagcaauaaaggacuaccaucauccauagaaaaaacaauaucaaaagcaaaaggacaaccuagagaaccacaagucuacaccuuaccaccagcccaagaagaaaugacaaaaaaccaaguuucauuaacaugucuugucaaaggauuuuacccaucagacauagcaguugaaugggaaucaaauggacaaccagaaaacaacuacaaaacaacaccaccaguacuagacagugacggaucauucuucuuauauagcagacuaacaguagauaaaucacgauggcaagaaggaaacguauucuccuguaguguaaugcacgaagcccuacauaaucacuacacacaaaaaaguuuaucacuaagccuaggaaaa

SEQ ID NO: 51099 - RNA, 1344 nt, Artificial Sequence
  derived and/or modified sequence opt6 from anti-influenza_Chain
gaaguacaacuccaagaaucagguccaggccuaguaaaaccuucccaaacauuaucauuaacauguaacguaucagguggaucaauaacuggugacuacaaauggucauggauacgccaaccaccaggaaaaggauuagaauggauaggacacauacauucaacuggaaccacauacuacaauccaagucuaagaucaagaauaacaauaagcauggacacaucaaaaaacaaccuaucccuaagacuaacaucagucacagcagccgacaccgcugucuacuauugcgccucacacacacuaacaucaggacacuauccaagagacuucgauuucuggggacaaggaacacuagucacaguaucaucugccucuacaaaaggaccaucugucuuuccacuagcccccuguucgagaucaaccucagaaucaaccgcagcacuaggcugccuaguaaaagacuacuucccagaacccguaacaguaucuuggaacucaggagcauuaacaagcggaguacacacauucccagcaguacuacaaucaagcggauuauacucauuaagcucgguaguaacaguaacaucaucaaacuuuggcacacaaacauacacaugcaacguagaccauaaaccuucaaacaccaaaguagauaaaacugucgaaagaaaaugcugugucgaauguccaccaugcccugcaccaccagucgcaggcccuucaguauuccuauucccaccuaaaccuaaagauacauuaaugauauccagaacaccagaaguaacuuguguaguaguagacguuucucacgaagaccccgaaguacaauucaauugguaugucgauggaauggaaguacacaacgcuaaaaccaaaccaagagaagaacaauuuaacucaaccuuucguguaguaucuguccuaacuguaguucaucaagacuggcuaaaugguaaagaauauaaauguaaaguaucuaacaaaggacuaccagcaccaauagaaaaaacaauauccaaaaccaaaggacaaccaagagaaccacaaguauauacacuaccaccaucacgagaagaaaugaccaaaaaccaaguaucucuaaccugccuuguaaaaggauuuuaccccuccgacauagcaguagaaugggaaaguaacggccaaccugaaaacaacuacaaaacaacacccccaaugcuagacucagauggcagcuucuuucuauacucaaaacucaccguagacaaaucuagauggcaacaaggaaacguauucucaugcucagucaugcacgaagcacuacacaaccacuauacacaaaaaucacuaucacuauccggaaaa

SEQ ID NO: 51100 - RNA, 1350 nt, Artificial Sequence
  derived and/or modified sequence opt6 from anti-influenza_Chain
caaguucaacuacaacaaucaggcgcagaaguaaaaaaaccuggauccucaguaaaaguaucuugcaaaguauccggagucauauucucaggaucagcaauauccugggucagacaagcaccaggacaaggacuugaauggaugggcggaaucucaccauuauucggaaccacaaacuacgcccaaaaauuccaaggcagagucacaauaacagccgaccaaucaacaaacacaacauacauggaaguaaacucacuaagauacgaagacacagcaguauacuuuugcgcgagaggaccaaaauacuacuccgaauacauggacguauggggaaaagguacaacaguuaccguaucaucagcuucaacaaaaggaccaucgguauucccacuagcaccuuccucaaaaucaacaucagguggaacagcagcacuaggcuguuuagugaaagacuacuuccccgaacccguaacaguuucauggaacaguggcgcauuaacauccggaguacacaccuucccugcaguauuacaauccucaggacuauacucacuaucaucuguagucacaguaccaucaucaucauuaggaacacaaacauauauauguaacgucaaccacaaacccuccaauaccaaaguagacaaacgaguagaacccaaauccugugacaaaacacacacaugcccaccaugcccagcaccagaacuacuagguggaccaucagucuuccuauuccccccaaaacccaaagacacacucaugauaucaagaacaccagaagucacaugcguuguaguagacguaucccacgaagacccugaaguaaaauucaauugguacgucgaugguguagaaguacacaacgccaaaacaaaacccagagaagaacaauauaacucaacauacagaguuguauccguauuaacuguucuacaccaagauuggcuaaauggaaaagaauacaaaugcaaaguuucaaacaaagcacuacccgcacccauugaaaaaacuaucucaaaagcuaaaggacaacccagagaaccacaaguuuacacauuaccaccaucaagagaagaaaugacaaaaaaucaaguauccuuaacaugccucguaaaaggauuuuaucccucagacauagcaguagaaugggaaucuaauggacagccagaaaauaauuauaaaaccacaccaccaguacuagacuccgacggaucuuucuucuuauauucaaaauuaacaguagauaaaagucgauggcaacaaggaaacguuuucucaugcucaguaaugcacgaagcauuacacaaccauuauacacaaaaaucuuuaucauuaucaccagguaaa

SEQ ID NO: 51101 - RNA, 1350 nt, Artificial Sequence
  derived and/or modified sequence opt6 from anti-influenza_Chain
caaguccaacuuguucaaucaggagccgaaguaaagaaaccaggaaguagugugaaagucucuugcaaagcaucgggaggaacauuuucaucuuacgcaauaucauggguaagacaagcaccaggacaaggacuagaauggaugggaggaauaaugggaauguuuggaacaaccaacuacgcacaaaaauuccaaggaagaguaacaauaacagcagaugaauuuacaucagcagcuuacauggaauuaagaucauuaagaucagaagacacugcaguuuauuacugcgcaagauccucagguuacuaccccgaauauuuccaagauuggggacaaggaacauuaguuaccguaucaucagcuuccaccaaaggcccuucaguauuuccauuagcacccucaagcaaaucuacaucaggcggaacagcagcacuaggaugucuugucaaagauuacuucccagaaccaguaacugucucauggaacucaggagcauuaaccaguggaguacacacauuuccagcaguauuacaaaguucaggacuauacucauuaucaucaguagucaccguuccaucaucauccuuaggaacucaaacauauaucuguaaugucaaucacaaacccucaaacacaaaaguagacaaacgaguagaaccaaaaucaugugauaaaacacauacauguccaccaugcccagccccugaauuacuaggaggacccucuguauucuuauuuccacccaaaccaaaagacacauuaaugauaucaagaacaccugaaguaacaugcguuguuguagaugucucucaugaagacccagaaguaaaauucaacugguauguagauggaguugaaguacauaaugcaaaaacaaaaccaagagaagaacaauauaacucuacauacagaguagugucagucuuaacuguacuacaccaagauugguuaaauggaaaagaauacaaaugcaaaguauccaacaaagcucuaccagcaccaauagagaaaacuauaucaaaagcaaaaggacaaccaagagaaccacagguauauacacuaccucccucacgcgaagaaaugaccaaaaaccaaguaucauuaacaugcuuagucaaaggauucuaccccucugauauagcaguagaaugggaaaguaacggacaaccagaaaauaauuacaaaaccacaccacccguacuagacucagauggaaguuucuuccuauauucaaaauuaacaguagacaaaucucgauggcaacaaggaaacguauucuccugcucagucaugcacgaagccuuacacaaccacuauacacaaaaaucuuuaucccuaucaccagguaaa

SEQ ID NO: 51102 - RNA, 1350 nt, Artificial Sequence
  derived and/or modified sequence opt6 from anti-influenza_Chain
gaaguacaacuaguagaaucaggagcugaaguaaaaaaacccggaucuucaguaaaaguaucuugcaaagccagcggagguacauuuuccucauauggaauaucauggguacgacaagcaccaggacaaggacuagaauggaugggcgacauaauaggaauguuuggaaguacaaacuaugcucaaaauuuccaaggaagacuaacaauaaccgcagacgaaucaaccucaacagcauacauggaauuaucaucacuaagauccgaagacaccgcaguauacuauugcgcaagauccucagguuauuaccccgccuaccuuccucacuggggccaaggaacuuuaguaacaguuuccuccgcaucuacaaaaggaccaucugucuuccccuuagccccaucaucaaaauccacaucaggaggaacagccgcccuaggauguuuaguaaaagacuauuucccagaaccaguaacaguaucauggaauucuggagcauuaacaucaggaguucacaccuuucccgcaguccuacaaucuagcggacuauacucauuaagcucaguaguaacaguaccuagcucauccuuagguacacaaacauauaucugcaacguaaaccauaaaccuucaaauacaaaaguagauaaaagaguugaaccaaaaucaugcgacaaaacacauacauguccaccaugcccagcaccagaacuccuagguggaccauccguauuucucuuccccccaaaaccaaaagacacacuuaugaucucacgcacucccgaaguuacaugugucguagucgacguaagccacgaagauccagaaguuaaauucaacugguacguagacgguguagaaguacacaaugcaaaaacuaaaccaagagaagaacaauacaacucaacuuaccgaguaguaucaguacuaacaguuuuacaccaagauuggcuaaacggaaaagaauauaaaugcaaagucuccaacaaagcacuaccagcaccaauagaaaaaaccauaucaaaagcaaaaggacaaccaagagaaccacaaguauauacauuaccacccucacgagaagaaaugacaaaaaaccaaguaucacuuacaugccuaguaaaagguuucuacccaucagacaucgcaguagaaugggaaucaaauggccaaccagaaaacaacuacaaaacaacaccaccaguacuagauucagacggaucauuuuuuuuauacucaaaacuaacaguagacaaaucuagauggcaacaaggaaacguauucucaugcucaguaaugcaugaagcacuccacaaccacuacacccaaaaaucacuuucacuaagccccggcaaa

SEQ ID NO: 51103 - RNA, 1350 nt, Artificial Sequence
  derived and/or modified sequence opt6 from anti-influenza_Chain
gaaguacaauuaguagaaucgggcgcagaaguaaaaaaacccggcucaucaguaaaaguaucauguaaagcaucaggcggaacuuucagcucauaugcaauaucauggguaagacaagccccaggacaaggcuuagaauggaugggaggaauaauaggaauguucggaacagcaaacuaugcccaaaaauuccaaggaagaguaacaaucaccgcagacgaauucacaucaacagcauauauggaacuaucuucauuacgaucagaagacacagcaguauauuacugcgcaagaggaaacuauuauuacgaaucaucauuagacuacuggggacaagguacacuaguaaccgucucuucagcaucaacaaaaggaccaucuguauuuccacuagcaccaucaucaaaaucaacaaguggaggaacagcagcacuaggaugccuaguaaaagauuauuuuccagaaccaguaaccgucucauggaauucaggagcauuaaccagcggaguacacaccuucccagcaguauuacaaucaucaggacuauauucauuaagcucagucguaacuguacccucaucauccuuaggaacacaaacauauauaugcaauguaaaccacaaacccuccaacacaaaaguagacaaaagaguagaaccaaaaucuugugacaaaacacauacauguccaccaugcccagcaccagaauuauuaggcggaccuucaguauuuuuauucccaccaaaaccaaaagauacacuaaugaucucaagaaccccugaaguaacguguguagucguagacguaagccacgaagauccagaaguaaaauuuaacugguacgucgacgguguagaaguacacaacgcaaaaacuaaaccaagagaagaacaauauaauucuacauauagaguaguuucagucuuaacaguacuacaucaagauuggcucaauggaaaagaauacaaauguaaaguaucgaauaaagcauuaccagcaccaauagaaaaaaccauaucaaaagcaaaaggccaaccaagagaaccccaaguauauacacuaccuccaagcagagaagaaaugacaaaaaaccaaguuucauuaacuugcuuggucaaaggauuuuauccguccgacauagcaguagaaugggaaucaaacggacaaccagaaaacaacuacaaaacaacaccacccguacuagacucagauggauccuucuucuuauauucuaaacuaacagucgacaaaucaagauggcaacaaggcaacguauucucuugcucaguaaugcacgaagcacuacacaaccacuauacacaaaaaucacuaagccuaucuccagguaaa

SEQ ID NO: 51104 - RNA, 1350 nt, Artificial Sequence
  derived and/or modified sequence opt6 from anti-influenza_Chain
gaaguccaacuaguacaaucuggagcagaagucaaaaaaccaggcucaucuaugaaagucucuugcaaagcauccggcucaauauucucaaacuacggaauaucauggguaagacaagccccaggucaaggacuagaauggaugggagguauaauacccauauuuggcgcagcaaauuacgcacaaaaauuccaaggaagaguuacaauuacagccgacgaaucaacaucaacaguauacauggaaguacgaucacucagaucagaagacacugcaguauacuacugcgcaagaagacaacaacuuuacaaagguuacuaucaucauuggggacaaggaacacuaguaacaguauccucagcaucaacaaaagguccaucaguuuucccacuagcaccaucauccaaaucaacaucaggaggcacagcagcacuaggcugccuaguaaaagacuacuuuccagaaccaguaacaguauccuggaacucaggagcauuaacuaguggcguacauacauucccugcaguauuacaaucaucaggcuuauacagccuaagcuccguaguaacaguaccaucuagcucacuagguacacaaacauacaucuguaacguaaaucauaaaccaagcaauaccaaagucgacaaaaaaguagaaccaaaaucaugcgacaaaacacauacaugucccccaugcccugcaccagaauuacuaggaggaccaagcguauucuuauuccccccaaaaccaaaagacacacuaaugaucucaagaacaccagaaguaacuugcguagucguagauguuucacaugaagauccagaaguaaaauucaauugguacguggacggagucgaaguacacaaugcaaaaacaaaaccacgagaagaacaauauaacucaacauacagaguaguauccguucuaacaguuuuacaccaagacuggcuaaacggaaaagaauacaaaugcaaaguauccaacaaagcauuaccagcccccauagaaaaaacaauaucaaaagccaaaggccaaccccgagaaccacaaguauacacacuaccaccaucaagagaagaaaugacaaaaaaccaaguaucucuuacaugucucguaaaaggauucuaucccucagacauagcagucgaaugggaaucaaauggacaaccagaaaauaacuacaaaaccacaccaccaguucuagacucagacggauccuucuucuuauacucaaaauuaacaguagauaaaucacguuggcaacaagguaacguauucucauguucaguaaugcacgaagcauuacauaaccacuacacucaaaaaucacuaucauuaucaccaggaaaa

SEQ ID NO: 51105 - RNA, 1350 nt, Artificial Sequence
  derived and/or modified sequence opt6 from anti-influenza_Chain
caaguccaacuuguacaaucaggagccggaguaaaaaaaccaggauccucaaugaaaguaucaugcaaagcaucaggaucaauauuuucaaauuaugguauaucauggguaagacaagcgccuggacaaggauuagaauggaugggaggaauuauaccaauauucggcgcagcaaacuacgcccaaaaauuucaaggaagaguaacaauaacugccgaugaauccacaucaacaguauacauggaaguacgaucauuaagaucugaagacacugccguauacuacugcgcacgaagacaacaacuuuauaaaggauacuaucaccauuggggacaaggcacauuaguaacaguaucaucagcaagcacaaaaggaccaucaguauuuccacuagcucccaguuccaaaaguacauccggaggaaccgcagcacuaggaugccucguaaaagauuacuuuccagaaccaguaacagucucauggaauucaggcgcauuaaccucaggaguccacacauuccccgcaguucuucaaucaaguggauuauacagccuaucaucaguaguaacagucccaucaagcagccuaggaacacaaacauacauaugcaacguaaaccacaaaccaucaaacacaaaaguagacaaaaaaguagaacccaaaucaugugauaaaacacacacauguccaccaugcccugcacccgaacuauuaggaggaccaucaguauuccuauuuccaccaaaaccaaaagacacccuaaugauaucuagaacaccagaaguaaccugcgucgucguagacguaucacacgaagauccagaaguaaaauuuaacugguacguagacggagucgaaguacacaacgcaaaaacaaaaccaagagaagaacaauauaacucaacauaccgcguaguaucuguucuuacaguccuccaucaagacugguuaaacggaaaagaauauaaauguaaaguaucaaacaaagcacuaccagcaccaauagaaaaaaccauaucuaaagcaaaaggacaaccacgagaaccacaaguauacacacucccaccaucaagagaagaaaugacaaaaaaccaaguaucacucacauguuuaguaaaaggcuuuuauccaucagacauagcaguugaaugggaaaguaauggccaaccagaaaacaacuauaagacaaccccaccaguacucgacagugacggaucauucuuccuauacucaaaauuaaccguagacaaaucaagguggcaacaaggaaacguauucucauguucaguaaugcaugaagcauuacauaaucacuauacccaaaagucccuaucacuuucaccaggaaaa

SEQ ID NO: 51106 - RNA, 1350 nt, Artificial Sequence
  derived and/or modified sequence opt6 from anti-influenza_Chain
caaguacaauuaguacaaucaggcgcagaaguacgaaaaccugguucuaguguaaaaguaucaugcaaaguaucaggaggcauaauaagaaaauacgcaauaaacuggguaagacaagcucccggccaaggccuagaauggaugggaggaauaauagccaucuucaacacagcaaauuacgcacaaaaauuucaaggacgagugacuauaacagcagacgaaagcacaagcacaguauauauggaacuaucaucucuacgaucagaagauacagcccuauacuacugcgcccgaggcaugaauuacuauucagauuauuucgauuacuggggacaaggaucacucguaaccguaucaccagcaucaacaaaaggacccucaguauuucccuuagcaccaucaaguaaauccacaucaggagguacagcagccuuaggaugccuaguaaaagacuacuucccagaaccaguaacaguauccuggaauucaggagcacuaacaucaggaguacacacauuuccagcaguacuacaaucaucaggucuauacucauuaucuagcguaguaacagucccaucaucaucacuaggaacccaaacauacauaugcaacguuaaccauaaaccaucaaauacaaaaguagauaaaaaagucgaacccaaaucuugugauaaaacacauacauguccaccgugcccagcaccagaauuacucggagguccaucaguauuuuuauucccuccaaaaccaaaagacacauuaaugauaucaagaacaccagaaguaacauguguaguagucgacguaucacacgaagauccagaagucaaauuuaauugguacgucgacggagucgaaguacauaaugcaaaaacaaaaccaagagaagaacaauauaacucaaccuaucgaguaguguccguauuaacagucuuacaucaagauuggcuaaacggcaaagaauauaaaugcaaagucuccaacaaagcacuacccgccccaauagaaaaaacuauauccaaagcuaaaggccaaccuagagaaccacaaguauauacucuaccaccuucacgugacgaacuuaccaaaaaccaaguuucauuaacaugccuaguaaaaggcuuuuacccauccgacauagcagucgaaugggaaucaaacggacaacccgaaaauaacuacaaaacaacuccaccaguacuagauucagacggaucauucuuucuauacucaaaacucacaguagacaaaucacgcuggcaacaaggaaacguauucuccugcucuguaaugcaugaagcacuucauaaccacuacacacaaaaaucauuaucccuaucacccggaaaa

SEQ ID NO: 51107 - RNA, 1350 nt, Artificial Sequence
  derived and/or modified sequence opt6 from anti-influenza_Chain
caaguacaacuaguucaaucaggagccgaagucagaaaaccaggaucaucaguaaaaguaucauguaaagucagcggaggcauaauacgcaaauaugcaauaaauuggguaagacaagcaccaggacaagguuuagaauggaugggcggcauaauagcaauauucaauacagcuaauuaugcacaaaaauuccaagguagaguaacaaucacagcagacgaaucaacaaguacuguauacauggaacuuucuucacucagaucagaagacacagccuuauacuacugcgcaagagguaugaauuauuacucagauuacuucgauuacuggggacagggaucacuaguuacaguaucaccagcauccaccaaaggcccaucaguauuccccuuagcaccaagcuccaaaucaacaucuggaggaacagcagcacuaggaugucuaguaaaagacuacuuuccagaaccaguaacaguaucauggaauucaggagcacuaacaucaggcguucacacauucccugcaguauuacaaucuucaggccuauauucauuaucaucagucguaacaguaccauccucaucacucggaacacaaacauauaucugcaacguaaaccacaaaccauccaacacaaaaguagacaaaaaaguagaaccaaaaucuugcgauaaaacacauacuugcccaccauguccagccccagaacuacuaggaggccccucaguauuccuauucccaccaaaacccaaagacacucucaugaucucacgaacacccgaaguaacauguguaguaguagaugucucacacgaagacccagaagucaaauucaacugguacguagacggcguugaaguacauaaugccaaaacaaaaccaagagaagaacaauacaacucaacauacagaguaguaucuguauuaacaguauuacaccaagacugguuaaacggaaaagaauacaaaugcaaaguaucuaacaaagcacuacccgcaccaauugaaaaaacaauaucuaaagcaaaaggacaaccacgagaaccacaaguauauacacuaccacccuccagagacgaacuaaccaaaaaucaaguaaguuuaacgugccuaguaaaaggauucuacccauccgauauagccguagaaugggaaucaaauggacaaccugaaaauaacuauaaaacuacaccaccagucuuagacuccgacggcucauuuuuccucuacucaaaauuaacaguagacaaaucaagauggcaacaaggaaacguauucucaugcaguguaaugcacgaagcccuacacaaccauuauacacaaaaaucacucucacuuucaccaggaaaa

SEQ ID NO: 51108 - RNA, 1350 nt, Artificial Sequence
  derived and/or modified sequence opt6 from anti-influenza_Chain
gaaguucaacuaguacaaaguggagcagaagucaaaaaacccggaucuaguaugaaaguaagcugcaaagcaucuggaucaauuuucucaaacuacggaauaucauggguaagacaagcaccaggacaaggacuagaauggaugggaggaauaauacccauauucggcgcagcaaacuaugcacaaaaauuucaaggaagaguaacaauaaccgcugaugaauccacaucaacaguauauauggaagugagaagccuaagaucagaagacacagcuguauauuacugugcuagaagacaacaacuauauaaaggauacuaucaccacuggggacaaggcacacuaguuacagugaguucugccucaacaaaaggcccaucagucuuuccacuagcacccucuaguaaaucaacaagugguggaacagcugcauuaggaugcuuaguaaaagacuacuuccccgaacccgucacaguaucuuggaacagcggugccuuaaccucaggaguacacacauucccugcaguacuucaaucaucaggcuuauauucacuaucaucaguaguaacuguaccuucaucaucccuuggaacucaaacauauauuugcaacguaaaucacaaaccaagcaauacaaaaguagacaaaaaaguagaaccaaaaucaugugacaaaacacacacaugcccaccaugcccagcccccgaauuacuaggaggaccaucaguauuccuauucccaccaaaaccaaaagacacacucaugauaucaagaacacccgaaguaacauguguagucguagacguaucccacgaagaccccgaaguaaaauuuaacugguacguagacggaguagaaguacacaaugccaaaacaaaacccagagaagaacaauacaauaguacauaucgaguaguaucaguacucacaguauuacaccaagacuggcuaaacggcaaagaauacaaauguaaaguaucaaauaaagcauuaccagcaccaauagaaaaaacaauaucaaaagcaaaaggccaaccaagagaaccccaaguauacacacuaccuccaucaagagaagaaaugacaaaaaaccaaguaucauuaaccugccuagugaaagguuuuuacccaucugacauagccguagaaugggaaucaaacggacaaccagaaaacaacuacaaaacaacaccaccaguacuagacagcgauggaucauucuuuuuauacucaaaauuaacuguagacaaaucuagauggcaacaaggaaacguauucaguugcagcgucaugcacgaagcacuccauaaucacuacacccaaaaaucauuaagcuuaagcccaggaaaa

SEQ ID NO: 51109 - RNA, 1350 nt, Artificial Sequence
  derived and/or modified sequence opt6 from anti-influenza_Chain
caaguccaacuagugcaaucuggcgcaggaguuaaaaaaccaggaucaucaaugaaaguaagcugcaaagcaucaggcucaaucuucucaaacuauggaauaucuuggguaagacaagcacccggacaaggauuagaauggaugggcgguauaaucccaauauucggagcagcaaacuaugcccaaaaauuccaaggaagaguuacaauaacagcagacgaaucaacaucaacaguauauauggaagucagaucacuaagaucagaagacaccgcaguauauuacugcgcaagaagacaacaauuauacaaaggauauuaucaccacuggggucaaggaacauuaguaacaguaucaucagccucaacuaaaggaccauccguauuuccccuagcacccucaucuaaaucuacaucaggaggaacagcugcacucgguugucuuguaaaagacuauuuuccagaaccaguaacaguaucauggaacucuggcgcauuaacaucaggcguccauacauuuccugcaguauuacaaucauccggacuauauucacuaucaaguguuguuacaguaccaucaucuucauuaggcacacaaacauacauauguaacguaaaucacaaaccaagcaacacaaaaguagauaaaaaaguugaaccaaaaucaugcgauaaaacccauacauguccccccugcccagcaccagaacuacucggaggcccaaguguauuccucuucccacccaaacccaaagacacacuaaugauaucacguacuccagaaguaacauguguagucguugacguaucacacgaagacccagaagucaaauuuaauugguauguagacgguguagaaguucacaacgcaaaaacaaaaccacgagaagaacaauacaacucaacuuacagaguaguaucaguccucacaguacuccaccaagacuggcuaaacggaaaagaauacaaaugcaaaguauccaacaaagcauuaccagcccccauugaaaaaacaaucucaaaagcaaaaggucaaccaagagaaccacaaguauacacucuuccaccaucacgggaagaaaugacaaaaaaccagguaucacuaacuugccuaguaaaaggauucuauccaucagacaucgcaguagaaugggaauccaacggucaacccgaaaacaauuacaaaacaacaccaccaguccuagacucagauggaucauucuucuuauauucuaaacuaaccguagacaaaucuagauggcaacaaggaaacguauucucaugcucuguaaugcacgaagcacuacauaaccauuacacacaaaaaucccucucucuaucaccaggaaaa

SEQ ID NO: 51110 - RNA, 1350 nt, Artificial Sequence
  derived and/or modified sequence opt6 from anti-influenza_Chain
caaguacaacuccaacaaagcggagcagaaguaaaaaaaccuggaucaucuguaaaaguuucaugcaaaguuucaggaguaauauucuccggauccgcaaucucaugggucagacaagcaccuggacaaggacucgaauggaugggaggcauauccccacuauucggaacaacaaauuaugcacaaaaauuccaaggaagggucacaauaacagcagaccaaucuacaaauacuacauacauggaaguaaacucauuaagauacgaagauaccgccguauacuuuugcgcacguggaccaaaauacuacucagaauacauggacgucuggggaaaaggaaccacagucacaguuuccuccgccucaacaaaaggaccauccguauuuccuuuagcaccaucaucuaaaucaacaucaggaggcaccgcagcauuaggaugucucguaaaagacuacuucccagaacccguaacaguaucauggaacucuggagcucuaacaucaggaguacauacuuucccagcagucuuacaauccucaggacucuacucacuaaguucaguaguaacaguacccucaucaucauuaggaacacaaacauacauauguaacguaaaccacaagccauccaauacuaaaguagacaaaagaguagaaccaaaaagcugcgauaaaacucacacauguccaccaugucccgccccagaacuauuaggaggaccaucaguauuccuauuuccuccaaaacccaaagauacacuaaugauaucacgaacuccagaaguaaccuguguaguaguugacguuucacacgaagacccagaaguuaaauucaacugguauguagauggagucgaaguacauaaugccaaaacaaaaccaagagaagaacaauacaauucaacauacagaguaguauccguauuaaccguacuucaccaagauuggcuaaauggaaaagaauauaaaugcaaaguaucaaacaaagccuuacccgcaccuauagaaaaaacaauaucaaaagcuaaaggacaaccaagagaaccacaaguauauacacuacccccuucuagagaagaaaugacaaaaaaccaaguaucauuaacaugucuaguuaaaggauucuaucccuccgacauagcaguagaaugggaaucaaauggacaacccgaaaacaacuacaaaacaacaccaccuguacucgacucugauggauccuucuuccuauacuccaaacuaacaguagacaaauccagauggcaacaaggcaacguauucucauguucaguaaugcaugaagcauuacacaaccacuauacccaaaaaucacuaucuuuaucaccaggaaaa

SEQ ID NO: 51111 - RNA, 1350 nt, Artificial Sequence
  derived and/or modified sequence opt6 from anti-influenza_Chain
caaguucaauuaguacaaagcggagcagaaguaaagaaaccaggaucaucagucaaaguaaguugcaaagcuagcggaggaacauuuucaucauacgcaauaucauggguaagacaagcaccaggacaaggauuggaauggaugggaggaauaaugggaauguuuggaacaacaaacuacgcacaaaaauuucaaggacgaguaacaauuacagcagacgaauuuacaucagcagcauauauggaacugagaucauuaagaucugaagauacagcaguuuacuauugcgcaagaucaaguggauacuauccugaauacuuccaagacuggggacaagguacccuagugacagucucaucagcaucaacuaaaggaccaucaguuuucccucuagcaccaucaagcaaaucaacaucagguggaacagcagcacuaggaugucuaguaaaagacuacuucccagaaccaguaaccguaucauggaauaguggugcauuaacaucaggaguccauacuuuuccagcaguauuacaaaguucaggacuauacucuuuaagcucaguagucacaguucccagcucaucacuagggacacaaacguauauaugcaacguaaaccacaaacccucgaauacuaaaguagauaaaagaguagaaccuaaaaguugcgacaaaacacacacaugcccaccaugcccagcacccgaacuauuaggaggaccaaguguauuccucuucccaccaaaacccaaagauacauuaaugauaucaagaacaccagaaguaacaugcguagucguagacguaucacacgaagaccccgaagucaaauucaacugguacguagacggaguagaaguacacaacgcaaaaacaaaaccccgcgaagaacaauauaauuccacauaccgaguagucucaguacugacaguacuacaucaagauuggcuuaacggaaaagaauacaaauguaaaguaucaaauaaagcauuaccagcaccaauagagaaaacaauaagcaaagcaaaaggacaacccagagaaccacaaguauacacauuaccaccaucaagggaagaaaugacuaaaaaccaaguaucacuuacaugcuuaguaaaaggauuuuauccaucagauauagccguagaaugggaaucuaacggacaaccagaaaauaacuauaaaacaacaccacccguacuagauucagauggaucauucuucuuauacucaaaauuaacaguugacaaaucccgauggcaacaaggaaauguauucucauguucaguaaugcacgaagcacuacacaaccacuacacacaaaaaucguuaucauuaaguccaggaaaa

SEQ ID NO: 51112 - RNA, 1350 nt, Artificial Sequence
  derived and/or modified sequence opt6 from anti-influenza_Chain
gaaguacaacucguagaaucaggugccgaaguuaaaaaacccggaucuucagucaaaguaaguugcaaagcuuccggaggaacauucagcucauacggaauaagcuggguaagacaagcaccaggacagggucuugaauggaugggagauauuauaggaauguucggaucaacuaacuaugcacaaaacuuccaaggaagauuaacaaucacagcagaugaaaguacaucaacagcauacauggaacuauccucauuaagaucagaagacaccgcaguauacuacugcgcgcgaucuagcgguuacuauccagcauauuuaccucacuggggacaaggaacacuaguaacaguaucauccgcaucaacaaaaggaccaucaguauucccauuagcuccauccucaaaaagcacaucaggcggcacagccgcacuagguugucuaguaaaagacuauuucccagaaccaguaacaguaucuuggaacucaggugcacucaccucaggaguacacacauuccccgccgucuuacaaucauccggccucuacucacuuucaucaguuguaacagucccauccaguucccuaggcacacaaacauacauaugcaacgucaaccacaaaccauccaauacuaaaguugauaaaagaguagaaccaaaaucaugugauaaaacccacacauguccaccaugcccagcaccagaauuauuaggagguccaucuguauuccucuuuccaccaaaacccaaagacacacuaaugauaagucgaaccccagaaguuacaugcguaguagucgacguaucacacgaagacccugaaguaaaauucaauugguacguagauggcguagaaguacacaaugcaaaaacuaaaccacgggaagaacaauacaauuccacauaccgcguaguuucaguacuaacaguccuacaccaagacugguuaaacggaaaagaauauaaaugcaaaguaucaaacaaagcacuaccagcacccaucgaaaaaacaauaucaaaagcaaaaggccaaccacgagaaccccaaguauacacacuaccaccauccagagaagaaaugacuaaaaaccaaguaucacuaacaugccuaguuaaaggauuuuacccauccgacauagcaguagaaugggaaucaaauggacaaccagaaaacaacuacaaaacaacacccccaguauuagacuccgacggaucauuuuuuuuauauucaaaacuaacaguagacaaaaguagauggcaacaaggaaacguauucucaugcucaguuaugcaugaagcauuacacaaucauuauacacaaaaaucauuaucuuuaucaccaggaaaa

SEQ ID NO: 51113 - RNA, 1350 nt, Artificial Sequence
  derived and/or modified sequence opt6 from anti-influenza_Chain
gaaguacaacucguagaaagcggagcagaaguaaaaaaacccgguucaucuguuaaaguaucaugcaaagccuccggaggaacauucagcuccuacgccauaucauggguaagacaagcaccaggccaagguuuagaauggauggguggaauaauaggcauguucggaaccgcaaacuacgcucaaaaauuccaaggccgaguaaccauaaccgcagaugaauucacaagcacagccuauauggaauuaucaucucuaagaucagaagacacugccgucuauuacugugcaagaggaaacuauuacuacgaaucuucacuagacuauuggggccaaggaaccuuaguaacaguaagcagcgcuucaacaaaaggaccaucaguauuuccacuagcacccuccucuaaauccacaucaggaggaacugcagcauuaggauguuuaguuaaagauuauuucccagaaccaguuacaguuagcuggaacuccggagcacuaacuucaggaguacacaccuucccagcaguacuacaaucaucaggccuauacucacuuucuucugucgucacaguacccucauccucauuaggcacucaaaccuauaucugcaacgugaaucauaaaccaucuaauacuaaaguagauaaaagaguagaaccaaaaucaugcgauaaaacacacacauguccaccaugcccugcaccagaguuauuaggaggaccaucaguauuccuauucccaccaaaaccaaaagacacacuaaugauaucacgaacaccagaagucacuuguguaguaguagacguuucacacgaagauccagaaguaaaauucaauugguacgucgacggaguagaaguacauaacgcaaaaaccaaaccaagagaagaacaauauaacucuacauaccgagucguuucaguacuuacaguauuacaccaagacuggcuuaacgggaaagaauacaaaugcaaaguaucuaacaaagcauuaccagcaccaauagaaaaaacaauaucaaaagcuaaaggacaaccaagagaaccucaaguauacacauuaccuccaucaagagaagaaaugacaaaaaaccaagucucauuaacuugccuaguaaaaggauuuuacccaucagacauagcaguagaaugggaaucaaacggucaaccagaaaacaacuacaaaacaacaccaccaguacuagacuccgacggaucauuuuuccuauacucaaaacuaacagucgacaaaucacgauggcaacaaggcaauguauuuucaugcucaguaaugcacgaagcucuccacaaccacuacacacaaaaaucacuaucauuaucaccagguaaa

SEQ ID NO: 51114 - RNA, 1353 nt, Artificial Sequence
  derived and/or modified sequence opt6 from anti-influenza_Chain
gaaguacaauuaguagaaucuggagcagaaguaaaaaaaccaggaucaucaguaaaaguaucaugcaaagcaucaggagguccauucagaucauacgcaauaucauggguaaggcaagcaccaggacaaggaccagaauggaugggaggaauaaucccaauauucggaacaacaaaauacgccccaaaauuccaaggacgaguaacaauaacagcagaugacuuugcagguacaguauauauggaauuaucaucuuuaagaucagaagauacagcaauguauuacugugccaaacauaugggauaucaaguaagagaaacaauggacguguggggaaaaggcaccacagucacaguaucaagcgcaaguaccaaaggcccaucaguauuuccacuagcaccaucaucuaaaucuacaucuggaggaacagccgcauuaggaugucuaguaaaagacuauuuuccugaacccguuacaguauccuggaacuccggugcacuaacaucuggaguacauaccuucccagcaguacuacaaagcucaggacuuuauaguuuaaguucaguaguaacaguaccaucaucuucuuuaggaacucagaccuauauaugcaacgucaaccauaaaccuucaaauacaaaagucgauaaaagagucgaaccaaaaaguugugacaaaacacacacaugcccaccaugccccgcaccugaacuacuuggagguccaagcguauuccucuucccaccuaaaccaaaagauacacuuaugauauccagaacaccugaaguaacauguguaguaguagacguaucacaugaagauccagaaguaaaauucaauugguacguagauggcgucgaaguucacaaugcaaaaacuaaaccaagagaagaacaauauaauucaacauauagaguugucucaguauuaacaguacuucaccaagacugguuaaacggaaaagaauauaaaugcaaaguuucaaauaaagcauuaccagcacccauagaaaaaacaaucagcaaagcuaaaggacaaccacgagaaccacaaguauacacacuaccaccauccagggaagaaaugacaaaaaaccaagucucacucacaugccuaguaaaaggauuuuaucccucagauaucgcagucgaaugggaaucaaauggacaacccgaaaacaauuauaaaacaacccccccaguucuagacucagauggaucauuuuuucuauacaguaaauuaacaguagacaaaagccgauggcaacaaggaaacguauuuucaugcucagucaugcaugaagcacuacauaaucacuauacacaaaaaucauuaaguuuaucaccaggaaaa

SEQ ID NO: 51115 - RNA, 1353 nt, Artificial Sequence
  derived and/or modified sequence opt6 from anti-influenza_Chain
caaguacaacucguacaaucaggagccgaaguaaaaaaaccaggcuccucaguaaaaguauccugcaaagcaucuggaggaccauucagauccuaugcaauauccuggguaagacaagcaccuggacaaggaccagaauggaugggcggaauaauacccauauucggaacuaccaaauaugcaccaaaauuccaaggaagaguaacaauaacagcagacgacuucgccggaaccguauacauggaacuaucuagucuaagaucagaagacaccgcaauguacuacugugcaaaacauaugggcuaccaaguaagagaaacaauggacguauggggaaaaggaacaacaguaacaguaucaagugcaucaacaaaaggaccaucaguauucccacuagcacccucaaguaaaucuacaucaggcggaacagcagcucuaggauguuuaguaaaagacuacuuuccagaaccaguaacaguaucauggaacucaggcgcacuaacaagcgguguucacacauuuccagcaguacuacaauccuccggauuauauagccucuccucaguaguuaccguaccaucaucaucacuaggaacacaaacuuauauaugcaacguaaaccauaaaccauccaacacaaaaguagacaaaagagucgaacccaaaucaugcgacaaaacucacaccugcccacccugcccagcaccagaacuacucggagguccaucaguauucuuauucccaccaaaacccaaagacacacuaaugauauccagaacaccugaagucacaugcguaguaguagacguaucacaugaagauccagaaguaaaauuuaauugguacguagauggcguagaaguacacaacgcaaaaacaaaaccaagagaagaacaauacaacucaacauacagagucguaucuguucuuaccguacuacaccaagacugguuaaacggcaaagaauauaaaugcaaaguaucaaacaaagcacuacccgcaccaaucgaaaaaacaauaucaaaagccaaaggacaaccacgagaaccacaaguauacacauugccacccucccgagaagaaaugacaaaaaaccaaguuuccuuaaccugucuaguaaaaggauucuacccuucagacauagcaguugaaugggaaucuaacggacaaccagaaaacaauuauaaaaccaccccaccaguauuagacucagauggaagcuuuuuccuauauucaaaacuaacagucgacaaaucccgauggcaacaaggaaacgucuuuagcugcucaguaaugcaugaagcauuacacaaucacuacacacaaaaaucucucucauuaucuccaggaaaa

SEQ ID NO: 51116 - RNA, 1353 nt, Artificial Sequence
  derived and/or modified sequence opt6 from anti-influenza_Chain
gaaguucaacuuguagaaagcggugcagaagucaagaaaccagguucuucaguaaaagucucauguaaagcuagcggaggcacauuuagcuuuuauucaaugucuuggguaagacaagcaccaggacaaggacuagaauggaugggcggaauaaucccaauguuugguacuacaaauuaugcucaaaaauuccaaggucgaguaacaauaacagcuguagaaagcacuucaaccgcauauauggaaguaagcagcuuaagaucagaagauacagcaguauauuauugcgccagaggagauaaaggaauuuauuacuauuauauggauguauggggaaaagguacaacagucacagucucuagugcaucaacaaaaggaccaucugucuucccauuagcaccaaguucaaaaucaacaucaggaggaaccgcugcacuaggcugccuuguuaaagauuacuucccagaaccaguaaccguuucauggaacucaggagcacuaacaagugggguacauacauuuccagcaguauuacaaucaucaggacuauauucauuaagcucugucguaacaguuccaucaucaucauuaggcacucaaacauauauuuguaacguaaaccauaaaccaucaaauacaaaaguagauaaaagaguagaacccaaaagcugugacaaaacacacacauguccuccauguccagcaccagaacuacuuggaggaccaucuguauucuuauucccaccaaaaccaaaagacacacuaaugauaucaagaacucccgaagucacaugcguaguaguagauguaagccaugaagaucccgaaguaaaauucaauugguacguagacggagucgaaguacacaaugcaaaaaccaaaccaagagaagaacaauacaacucaacauaucgagucgucucaguucuuacaguauuacaucaagauuggcuaaauggaaaagaauacaaauguaaaguaucaaacaaagcacuaccagcucccauagagaaaacaauaucaaaagcaaaaggacaaccaagagaaccacaaguuuacacauuaccaccaucuagagaagaaaugacuaaaaaccaaguaucacuaacauguuuagucaaaggcuucuacccaucagauauagcuguagaaugggaaucaaauggacaaccagaaaacaauuauaaaacaacaccacccguacuagauucagacggcagcuucuuuuuauauucuaaauuaacaguagacaaaucaagauggcaacaaggaaauguauuuucaugcucaguaaugcacgaagcccuccacaaucacuacacacaaaaaucacuaucacucaguccaggaaaa

SEQ ID NO: 51117 - RNA, 1353 nt, Artificial Sequence
  derived and/or modified sequence opt6 from anti-influenza_Chain
gaaguacaauuagucgaaagcggcgcugaaguaaaaaaacccggaucaucaguaaaaguaucauguaaagcuucaggaggcccauucagaaguuacgcaauaucuuggguuagacaagcaccaggucaaggaccagaauggauggguggaauaauaccaauauucggaacaacuaaauaugcuccaaaauuucaagguagaguuacaauaacagcugacgacuuugcaggaaccguuuacauggaauuauccagccuaagaucagaagacacagcaauguacuauugugcaaaacacaugggauaucaaguaagagaaacaauggacguauggggaaaaggcaccacaguaacaguaucuucugcaagcacaaaaggaccaagcguauuuccacuagcaccaucuucaaaaucaacaucaggaggaacagcagcauuagguugccuaguaaaagauuacuucccagaaccaguuacaguuucguggaacucaggagcacuaacuaguggaguacacacguuuccagcaguuuuacaaucaaguggacuauacagucuuuccucaguaguaacaguacccuccucaucauuaggaacacaaacauacauaugcaacguaaaccauaaaccaagcaacacaaaagucgauaaaagagucgaaccaaaaagcugcgacaaaacccauacaugucccccaugcccagccccagaauuacuaggaggaccaucaguguucuuauucccaccaaaaccaaaagacacacuaaugauaucacgaacuccagaaguaacaugcguaguaguagacguaucccaugaagaccccgaaguaaaauuuaacugguaugucgacggaguagaaguacacaaugcaaaaacuaaacccagagaagaacaauauaacucuacauaucgaguaguaucaguccuaacaguauuacaccaagacuggcuaaacggaaaagaauacaaaugcaagguaaguaauaaagcauuaccagcaccaauagaaaaaacaauaagcaaagcaaaaggccaaccaagagaaccacaaguauauacacuaccaccuucaagagaagaaaugacuaaaaaccaaguaagccuaacaugccuaguaaaaggauuuuauccaagugauauagcaguagaaugggaaucaaauggacaaccagaaaauaacuacaaaacaacaccuccagucuuagacucagacggauccuuuuucuuauacucaaaacuaaccguagauaaauccagauggcaacaaggaaauguguucucaugcucaguaaugcacgaagcacuacacaaccacuacacccaaaaaucccuuucacuaucuccuggaaaa

SEQ ID NO: 51118 - RNA, 1353 nt, Artificial Sequence
  derived and/or modified sequence opt6 from anti-influenza_Chain
caaguacaauuaguacaauccggagcagaagugaagaaaccaggaucuagcguaaaaguaucaugcaaagcuagugguggaccuuuuagaucauaugcaauaagcuggguacgacaagcuccaggacaaggcccagaauggaugggaggaauaauaccaauauucgguacaacaaaauaugcaccaaaauuucaaggacgcguuacaauaacagcagaugauuucgcaggaacaguauacauggaacuaucuucacuacgcuccgaagacacagcaauguauuacugugcaaaacauaugggauaucaaguaagagaaacaauggacguuuggggaaaaggcacaacagucacaguaaguagcgccagcacuaaaggucccucaguauuuccacuugcaccuucaucaaaaucaacaucaggaggaacagcagcgcuaggaugucuagucaaagauuacuuuccagaacccgucacaguaucauggaacucaggagcacuaacaucaggaguacauacauucccagcuguauuacaaucuucgggccucuauucacuaucaucaguaguaacaguaccauccuccuccuuagguacacaaacauacauaugcaauguaaaucauaaaccuucaaauaccaaaguagauaaaagaguagaaccaaaaucaugugacaaaacucauacaugucccccuugcccagcaccagaauuauuaggcggcccaucaguauuucuuuucccaccaaaacccaaagauacucuaaugauaucuagaacccccgaaguaacaugcguaguaguugacguaucccaugaagacccagaaguaaaauucaauugguauguagauggaguagaagugcacaaugccaaaaccaaaccaagagaagaacaauacaacucaacauauagaguaguaucaguauuaacaguacuacaucaagauuggcuaaacggaaaagaauacaaauguaaaguaucaaacaaagcacucccagcaccaauagagaaaaccauauccaaagcaaaaggacaaccaagagaaccccaaguauacacacuaccaccaucaagagaagaaaugacuaaaaaccaagucucauuaacaugcuuaguaaaagguuucuaccccucagauauugcuguagaaugggaaucuaauggccaacccgaaaacaacuacaaaacaacaccucccguauuagauucugacggauccuucuuuuuauauucaaaauuaacaguagacaaaucaagauggcaacaagguaacguauuuucauguucaguaaugcaugaagcacuucacaaucacuacacacaaaaaucacucucacuauccccaggaaaa

SEQ ID NO: 51119 - RNA, 1353 nt, Artificial Sequence
  derived and/or modified sequence opt6 from anti-influenza_Chain
gaaguacaacucguagaauccggcgcagaagucaaaaaaccugguucaagcguaaaaguaucauguaaagcaucuggaggaacauucucauucuauucaaugucauggguaagacaagcaccaggacaaggacuagaauggaugggcggaaucauaccaauguucggaaccacaaacuaugcacaaaaauuccaaggaagaguaacaauaacagcaguugaaaguacaucaacagcauacauggaaguaucuucauuacgaagugaagauacagcaguauauuauugugcaagaggagacaaaggaauauauuauuauuacauggacguuuggggaaaaggaacuacagucacaguuucaucagcaagcacuaaaggucccucuguauuuccauuagcaccaagcucaaaauccaccucaggaggcacagcagcuuuaggcugcuuaguuaaagacuacuuuccugaaccaguaacaguauccuggaauucaggagcacuaaccucuggaguccauaccuucccagcaguccuucaaucauccggauuauacucuuuaagcucaguagucacaguaccaucaucaucucuaggcacucaaacauacauaugcaacgucaaccacaaaccaucaaacacaaaaguagacaaaagaguagaacccaaaucaugcgacaaaacacacacaugcccaccaugcccagcaccagaauuacuaggcggaccaucuguauucuuauuuccaccaaaaccaaaagacacacucaugauaucuagaacaccagaaguaacaugcguaguagucgacguaucccaugaagauccagaagucaaauucaauugguauguagacggaguagaaguacacaaugcaaaaacaaaaccaagagaagaacaauauaacucaacauacagaguaguaucaguacuaacaguacuacaccaagauuggcuaaacggaaaagaauacaaaugcaaaguaucaaacaaagcauuaccagcuccaauagaaaaaaccauaucaaaagcaaaaggacaaccaagagaaccucaaguauacacacucccaccaucaagagaagaaaugacaaaaaaucaaguaucacuaacaugccuaguaaaaggauucuacccaucagauauugcaguugaaugggaaucaaacggacaaccagaaaauaauuacaaaacaacaccacccguacuagacucugacggaagcuuuuuccuauacucaaaacuaacaguugauaaaaguagauggcaacaaggaaauguauuuucaugcagugucaugcacgaagcucuacacaaucauuacacacaaaagucauuaagccuaucaccaggcaaa

SEQ ID NO: 51120 - RNA, 1356 nt, Artificial Sequence
  derived and/or modified sequence opt6 from anti-influenza_Chain
caaguccaauugguucaaucaggcggaggauuaguaaaaccuggaggaucacuaagacuauccugugccgcaucuggauucacauuuucaucauauucaaugaauuggguaagacaagcacccggcaaaggucuugaauggguauccucaaucuccucauccucuucauauaucuauuauguagacucaguaaaaggucgguucacaauuucaagagacaaugccaaaaauagccuauaccuacaaaugaauagucuaagagcagaagacacagcaguuuacuauugcgcaagagguggagguucauauggagcauacgaaggauucgacuauuggggccaagguacauuaguaacagucuccucagcaagcacaaaaggaccaucaguauucccacuagccccauccucaaaauccacaucaggcggaacggcugcauuaggaugccuaguaaaagauuacuuuccagaaccaguaaccguaucauggaacucuggagcucuaacaucagguguccauacuuuuccagcagucuuacaaucaucaggacuauauucauuaucaucggucguaacaguaccauccucaucacuaggcacacaaacauauauaugcaacguaaaccacaaaccaucaaauacaaaaguagauaaaagaguagaaccuaaaucaugcgacaaaacccauacaugcccaccuugcccagccccagaauuacuaggcgguccaucaguuuuucuauuuccaccaaaaccaaaagacacacuaaugauaucuagaacccccgaaguaacauguguaguaguagauguaucacaugaagauccagaaguaaaauuuaauugguauguagauggaguugaaguacacaacgcaaagacaaaaccaagagaagaacaauauaacuccacauacagaguaguaucagucuuaacaguacuacaucaagauugguuaaaugguaaagaauacaaauguaaaguaucuaacaaagcauuaccagcaccaauagagaaaacaauaucaaaagcuaaaggucaaccaagagaaccacaaguauacacacuaccaccaucuagagaagaaaugaccaaaaaccaaguaucacuuacaugucuaguaaaaggauuuuauccaagugauauagcaguugaaugggaaucuaacggacaaccagaaaacaacuauaaaaccacaccaccaguacuugacucagauggaucguucuuuuuauauucaaaauuaacagucgacaaaucacgauggcagcaaggaaacguauuuucaugcucagucaugcaugaagcccuacacaaucacuacacacaaaaaucccuaucacucagucccggaaaa

SEQ ID NO: 51121 - RNA, 1356 nt, Artificial Sequence
  derived and/or modified sequence opt6 from anti-influenza_Chain
caaguacaauuaguacagucaggagcagaaguaaaacaaccaggagcuucuguaaaagucucaugcaaagcaucaggauauacauuuaacgccuauuacauacacugggucagacaagcaccaggccaaggacucgaauggaugggauggauaaauccaaauuucggaggcacacacuacgcaagaaaauuccaaggucgaguuacaaugacaagagaugcuucaauuaauacagcauacauggaacuagaccgauuaauaucagacgauacagcagucuauuacugcguaagauggagggcagcagcaguaaucauggaccaauucuacaaaauggaugucuggggacaagguaccuuaguuaccguauccucagcaucaacaaaaggacccuccguauucccauuagcaccauguucaagaucaacaucugaaucuacagcagcacuuggaugccucguaaaagacuauuuuccagaaccuguaacugucuccuggaacucaggugcacuaacuuccggcguacacacauucccagcaguacuacaaucaucaggacuauacucacuaucaucagucguaacaguacccucaaguagucuuggaacaaaaacauacaccuguaacguagaccacaaaccaagcaacacuaaaguagacaaaacaagagaaucaaaauauggaccaccuuguccaucaugcccagcaccugaauucuuaggaggcccaucuguauuuuuauuuccaccaaaacccaaagacacacuaaugaucucaagaacaccagaagucacaugcgucguagucgacguaucccaagaagacccagaaguucaauuuaauugguacguagacggaguagaaguacacaacgcaaaaacaaaaccuagagaagaacaauucaacucaacauaucgaguaguauccguacuaacaguauuacaccaagacuggcuaaaugguaaagaauacaaaugcaaaguaucuaauaaaggauuaccauccucaauagaaaaaacaaucucaaaagcuaaaggacaaccaagagaaccacaaguauauacuuuaccuccagcacaagaagaaaugaccaaaaaccaaguaucauuaacuugccuaguaaaagguuuuuacccaucagacauagcuguagaaugggaaagcaauggucaaccagaaaauaacuacaaaaccacaccaccaguacuagauuccgauggaucauuuuuccuauauucaagauuaacaguagacaaaucaagauggcaagaagguaauguuuucucaugcucagucaugcaugaagcacuacauaaccacuacacacaaaaaucccuaucacuaucacucggaaaa

SEQ ID NO: 51122 - RNA, 1356 nt, Artificial Sequence
  derived and/or modified sequence opt6 from anti-influenza_Chain
gaaguccaacuaguacaaucaggagcagaaguaaaaaaaccaggagcaucaguaaaagucaguuguaaagcuucaggauacauauucacuggcuauuauauacacuggguacgacaagccccaggccaaggacuagaauggaugggucgcauagacccaaauggugcaggaacaacauaugcacaaaaauuucaaggaagaguaacauuaaccauggacacuaguauaacaacagccuacauggaacuaucaagacuaagauucgacgauacagcaaucuauuauugugcucguugggauuggaacuucgauuuauaccuaggcugguucgacccauggggacaaggaacaccaguaacuguagcaucagcaucaacaaaaggaccaucagucuuuccauuagcaccuucaucaaaaucuacaucaggaggaacagcagcgcuaggcugucuaguaaaagauuacuuuccugaaccaguaacaguaucauggaauucaggagcacuaacaucagguguacacacauuuccagcaguauuacaaucaucaggucuauauucauuauccucaguaguaacaguuccgucuucaucucuaggcacccaaacuuauauauguaacguaaaccacaaaccaucaaauacaaaaguagauaaaaaaguagaaccaaaauccugugauaaaacacauacauguccaccuugcgcacccgaacuucuuggaggacccucagucuucuuauuuccaccaaaaccuaaagauacacuuaugauuaguagaacaccugaaguaacaugugucguaguugacguaagucaugaagauccugaaguaaaauuuaauugguacguagacggaguagaaguacacaacgcaaaaaccaaaccccgugaagaacaauauaauucaacauacagaguaguaucaguccuuacaguacuacaccaagauugguuaaacggaaaagaauauaaauguaaaguaucaaauaaagcccucccagcaccaauagaaaaaacaaucaguaaagcgaaaggccaaccucgagaaccacaaguuuauacacuaccucccucacgugaagaaaugacaaaaaaccaaguuucacuaacaugucuuguaaaaggauuuuauccuucagauauagcaguugaaugggaaucaaauggacaaccagaaaauaacuauaaaacaacaccaccaguacuagauagcgaugguuccuuuuuuuuauacuccaaauuaacaguagauaaaucaagauggcaacaagguaacguauuuucuuguucaguaaugcacgaagcuuuacauaaccacuacacucaaaaaucauuaucauuaucaccugguaaa

SEQ ID NO: 51123 - RNA, 1356 nt, Artificial Sequence
  derived and/or modified sequence opt6 from anti-influenza_Chain
caaguacaacuaguacaaucaggagccgaaguuaaacaaccaggagccucaguaaaaguaucauguaaagccagugguuacacuuuuaaugcauauuauauacacugggucagacaagcuccaggacaaggcuuggaauggaugggauggauaaauccaaacuuugguggaacucacuaugcaagaaaauuucaaggaagagucacaaugacacgcgaugcaucaauaaauacagccuauauggaacuagacagacuaauaucugacgauacagcaguauauuauugcguccgcuggagagcagcagcaguaauaauggaccaauucuacaaaauggauguauggggacaaggaacacuaguaacaguauccucugcaucaaccaaagguccaucagucuuuccacucgcaccaugcucuagauccacaagcgaauccacagcagccuuaggaugucuaguaaaagauuacuuuccagaaccagucacagucucauggaacuccggagcacucacuucaggagugcauaccuucccagcaguacuacaaucaucaggacuauauucucuaucuucaguaguuacaguccccucuucaucucuagguaccaaaacauauacuuguaacguagaucauaaaccuucaaauacaaaaguagauaaaacuagagaaucaaaauacggaccaccaugcccaucuuguccagcaccagaauucuuaggagguccauccguauuucuauuuccaccaaaaccaaaagauacauuaaugauaucaagaacaccugaaguaaccuguguagucgucgauguaucacaagaagaccccgaaguccaauuuaauugguauguagauggaguagaaguccauaacgcaaaaacaaaaccuagagaagaacaauucaacucaaccuacagaguaguaucaguauuaacaguacuacaucaagacuggcucaaugguaaagaauauaaauguaaaguaucuaacaaaggccuccccucaucgaucgaaaaaacaauaucaaaagcaaaaggacaaccacgagaaccacaaguauauacauuaccacccgcacaagaagaaaugacuaaaaaucaaguuucacuaacaugucuugucaaaggcuuuuauccaucugacauagcaguugaaugggaaucaaacggacaaccagaaaauaacuauaaaacuacaccuccaguauuagauucagauggaaguuuuuuuuuauauucaagauuaacaguagauaaauccagauggcaagaaggaaauguauucucaugcucaguaaugcaugaagcucuacauaaccauuauacacaaaaaucucuaucauuaucacuuggaaaa

SEQ ID NO: 51124 - RNA, 1356 nt, Artificial Sequence
  derived and/or modified sequence opt6 from anti-influenza_Chain
caaguccaauuaguccaaucaggaggaggauuaguaaaaccugguggaucauuaagauuauccugcgcagcaucuggcuuuacauucucaucauacucaaugaauuggguuagacaagcaccaggcaaaggacuagaauggguaucaucaauaucaucaucaucaucauacauauauuacguagacuccguaaaaggaagauucacuauaucaagagacaaugcaaaaaauucacuauaccuacaaaugaauuccuuaagagcagaagauacagcaguauacuacugcgccagaggaggaggaucuuauggugcauacgaaggauuugacuacuggggucaaggaacauuaguuacagucucaucagccucaacaaaaggacccucuguauucccacuagcuccauccucaaaaucaaccucaggaggaacagcagcacuuggaugccuaguaaaagacuacuucccugaaccagucacaguaucauggaacucaggagcacuaacuuccggaguacacacauucccagcaguauuacaaucaucaggacuauacucucuaucaucaguaguaacagucccaagcucaucacuaggcacccaaacauacauauguaaugucaaccacaaacccucaaacacaaaaguagacaaaagagucgaaccuaaaagcugcgauaaaacacacacauguccacccuguccagcaccagaauuacuaggaggacccuccguuuuucuguuuccaccaaaaccaaaagacacccuuaugauaucaagaacuccagaaguaacuugcguaguaguagacguaagccaugaagauccagaaguaaaauucaauugguacguagacgguguugaaguacacaacgcuaaaacaaaaccaagagaagaacaauacaauucaacuuauagaguaguaucaguguuaacaguacuacaccaagauuggcucaaugguaaagaauacaaauguaaaguaucaaacaaagcauuaccagcaccaauagaaaaaacaauaucaaaagcaaaaggacaaccccgagaaccacaaguauacacccuacccccaucuagagaagaaaugacaaaaaaccaagucucacuaacaugucuaguaaaaggcuuuuacccauccgacauagccgucgaaugggaaucaaauggacaaccagaaaacaauuauaaaacaaccccaccugucuuagauucagacggauccuucuucuuauacagcaaacuaacagucgauaaaucaagauggcaacaaggcaaugucuuuuccugcucaguaaugcaugaagcauuacacaaccauuacacacaaaaaucuuuaagccuaucaccaggaaaa

SEQ ID NO: 51125 - RNA, 1356 nt, Artificial Sequence
  derived and/or modified sequence opt6 from anti-influenza_Chain
gaaguacaauuaguacaaucaggagcagaaguaaaaaaaccaggugcaagcguuaaaguuucauguaaagccaguggauauauauuuacaggauauuacauacacuggguaagacaagccccaggucaaggauuagaguggaugggaagaauagauccaaauggcgcaggaacaacauacgcccaaaaauuucaaggaaggguaacacuuacaauggauacaucuaucacaaccgccuauauggaauuaucaagacuacgauuugaugacacagcaauauauuacugugcuagaugggauuggaauuucgauuuauauuuagguugguuugauccauggggacaaggaacuccaguaacaguagcaucagcaucaaccaaagguccauccguauuuccauuagcaccaucaagcaaaaguacauccggaggcacagcugcauuaggaugccuagucaaagauuacuuuccagaaccaguaacaguaucauggaauucaggagcauuaacaucaggaguacauacauuuccagcuguacuacaaucaagcggccuauacucauuaucauccguaguaacaguacccagcaguagucuaggaacacaaaccuauauauguaacgucaaccacaaacccucaaauaccaaaguagacaaaaaaguagaaccgaaaucaugugacaaaacucauacauguccaccaugcgcaccagaacucuuaggaggcccaucugucuuuuuauucccgccaaaaccaaaagauaccuuaaugauuucuagaacaccagaaguuacauguguaguaguagauguaucacaugaagacccagaaguuaaauuuaauugguauguagauggaguagaaguacauaaugcaaaaacaaaaccaagagaagaacaauacaacagcacauacagagucguuucaguacuaacuguauuacaccaagauuggcuaaauggaaaagaauacaaauguaaaguauccaauaaagcauuaccagcaccaauagaaaaaacuauauccaaagcaaaaggacaaccaagagaaccacaaguauacaccuuaccaccgucaagagaagaaaugacaaaaaaucaaguuucauuaacauguuuaguaaaaggcuucuauccaucugacauagcaguagaaugggagucuaacggacaaccagaaaauaacuauaaaacuacaccacccguucuugauucagauggaaguuucuuccuauauucaaaauuaacaguagauaaaucaagauggcaacaaggaaaugucuuuucaugcucaguaaugcaugaagcacuacacaaucacuacacacaaaaaucucuaagccuuucuccaggcaaa

SEQ ID NO: 51126 - RNA, 1359 nt, Artificial Sequence
  derived and/or modified sequence opt6 from anti-influenza_Chain
caaguacaacucguccaaucaggagcagaaguaaaaaaaccaggcucaucaguccgaguaucuugcaaagcuagcggaucaauauuccgaaacuaugcaauguccuggguaagacaagcucccggacaaggacuagaauggaugggagguaucaucgcaauauucggaacaccaaaauacgcacaaaaauuccaaggaagaguuacaauaaccgcagaugaaucaacauccaccguauacauggaauuauccggccuuaggucagaagauacagcaauguacuacugcgcacgaauaccacacuacaauuucgguuccggcucauauuucgacuacuggggccaaggaacucuaguuacuguaucuucagcaucuacaaaaggacccagcguauucccucuagcaccauccucaaaaucaaccuccggaggaacagcagcauuaggcuguuuagucaaagauuacuucccagaacccguaaccguaucauggaauucaggagcacuaaccuccggaguacacacauuucccgcaguccuacaaucaucaggacuauacucauuaucaucaguagucacuguaccaucuucaucucuaggaacacaaacauacauaugcaacguaaaucauaaaccuuccaacacaaaaguagacaaacgagucgaaccaaaaucaugugacaaaacgcauacaugcccaccuugcccggcaccagaauuauuaggcggaccaucaguauucuuauuuccaccaaaaccaaaagauacacuaaugauaucuagaacacccgaaguaacaugcgucguaguagacgucucacaugaagacccagaaguaaaauuuaacugguauguagauggaguagaaguccacaacgcaaaaacaaaaccaagagaagaacaauauaauucaacauaccgaguagucuccguacuaaccguauuacaccaagacuggcuaaacggaaaagaauacaaaugcaaaguaucaaacaaagcauuaccagccccaaucgaaaaaacaauauccaaagcaaaaggacaaccccgggaaccacaaguauauacacuaccaccuucacgugaagaaaugacaaaaaaccaaguaucacucacuugccuuguaaaaggcuuuuauccaucagacaucgccguagaaugggaaucaaacggccaaccugaaaacaacuacaaaaccacaccaccuguacuagacucagacggauccuuuuuuuuauacucuaaauuaacagucgacaaaucacgauggcaacaaggaaacguauucucuuguucaguaaugcacgaagcacuucacaaccauuauacacaaaaaucacuaagcuuaucuccagguaaa

SEQ ID NO: 51127 - RNA, 1359 nt, Artificial Sequence
  derived and/or modified sequence opt6 from anti-influenza_Chain
caaguacaacuaguccaaucaggagccgaaguaaaaaaaccaggagcauccguaaaaguaagcugcaaagccuccggcuacauauuuacaggcuacuacauacacuggguuagacaagcaccaggacaaggucuagaauggaugggcagaauagacccuaacggaagcgguacaacuuaugcucaaaaauuucaaggaagaguaaccuuaacaauggauacuucaaucacaacagccuauauggaauuaucaagacuacgauuugacgauacagcaauauacuacugcgcaagaugggacuggaauuuugaccuauaccuaggaugguucgacccauggggacaaggaaccccaguaacaguggcaucagccucuacaaaaggaccuucaguauuucccuuagcaccaucaucuaaaucuacaucaggaggaacagcagcauuaggaugucuaguuaaagauuacuuuccagaaccaguaacaguaucauggaacucaggagcacuaacaucuggaguacacacauucccagcuguacuacaaucuucuggacucuacagccuaucaaguguaguaaccguaccaucaucaucacuaggaacucaaacuuauauaugcaacguaaaucacaaaccauccaacacaaaaguagacaaaaaagucgaaccaaaaucaugcgacaagacccauacuugccccccaugcccugcaccagaacuauuaggaggaccaucaguauucuuauucccuccaaaaccaaaagacacauuaaugauaucaagaaccccugaaguuacauguguaguaguagacguaucacacgaagacccagaaguaaaauucaacugguacguagacggaguagaaguacacaaugcaaaaacaaaaccaagagaagaacaauauaauucaacauaccguguagucucaguacuaacaguacuacaccaagauugguuaaauggaaaagaauacaaauguaaaguaucuaauaaagcauuaccagcaccuauagaaaaaacaauauccaaagccaaaggacaaccaagagaaccacaaguauacacauuaccaccaucuagagaagaaaugacaaaaaaccaagucagccuaacaugccuaguaaaaggauucuacccaucagauauagccguagaaugggaaucuaacggccaaccagaaaacaacuauaaaaccacaccuccaguacuagauucagacggaucauucuuucuauacucaaaauuaacuguagacaaaagcagauggcaacaaggcaacguuuucuccugcucaguaaugcacgaagcacuacacaaucauuauacacaaaaaucacucucauuaucaccaggaaaa

SEQ ID NO: 51128 - RNA, 1359 nt, Artificial Sequence
  derived and/or modified sequence opt6 from anti-influenza_Chain
gaaguacaacuuguccaaucaggagcagaaguaaaaaaaccaggagcaucaguaaaaguaaguugcaaagcauccggcuacauauucacuggauacuacauacacuggguaagacaagcaccaggccaaggacuagaauggaugggaagaauagacccaaauggcgcuggaacaacuuacgcacaaaaauuccaaggacgaguaacauuaacuauggacacaucuaucacaacugcauacauggaauuauccagacuuagauucgacgacacagcaauauauuacugugcccgaugggauuggaacuucgauuuauaccucggaugguucgacccauggggacaaggaaccccagucacaguagcaucagccuccacaaaaggcccaucaguauuuccccuagcaccaucaucuaaaucaacauccggcggcacagcagcauuaggaugccuaguaaaagacuacuucccagaaccaguaaccguaucuuggaacuccggagcacuaacuuccggaguacauacuuuuccagcaguauuacaauccucaggacuauauucauuauccuccguaguaaccguaccaucaucaucacucgguacacaaacuuauauauguaacguaaaccacaaaccaucaaauacaaaagucgauaaaaaaguagaacccaaaucaugugauaaaacacauacauguccaccgugucccgcaccugaacuucuaggaggaccauccguauuucuauuuccaccuaaaccaaaagacacuuuaaugauaucaagaacacccgaaguaacaugcguagucguagauguaucacacgaagacccagaaguaaaauucaauugguaugucgauggcguagaaguccauaaugccaaaacuaaaccaagagaggaacaauacaacucaacauauagaguaguaucagucuuaacaguacuccaccaagacuggcucaacggaaaagaauauaaaugcaaagucagcaacaaagcacucccagcaccuauagaaaaaacaauaucaaaagccaaaggacaaccacgagaaccucaaguauauacacuucccccaucaagagaagaaaugacaaaaaaccagguuucccucacaugccuagucaaaggauucuauccuucagauauagcaguugaaugggaaucaaacggucaaccugaaaacaauuacaaaaccacaccaccaguacuagauucagauggauccuucuuccucuacucuaaauuaacaguagacaaaucaagauggcaacaaggcaacguauucucaugcucaguaaugcaugaagcacuacacaaucauuauacccaaaaaucucuaucacucucaccaggaaaa

SEQ ID NO: 51129 - RNA, 1359 nt, Artificial Sequence
  derived and/or modified sequence opt6 from anti-influenza_Chain
caaguacaacuuguccaaucaggugccgaaguaaaaaaaccaggcgcaucaguaaaaguaaguuguaaagcaucuggauacaccuucaaugcacaucacaugcacugggucagacaagcaccaggacaaggucuaggauggaugggauggauagacccaaacaacgacggaacaauauaugcccaaaaauuccaaggaagaguaacacuaacaauggacacaucaauacauacagcauauauggaacuaucaggauuacgcuaugaugacacagcaauauacuacuguguacgaugggcauggaacuucgauuucuuccuagguugguucgaccccuggggacaagguacccuaguaacaguagcauccgcuucuacuaaaggaccaucaguauucccauuagcaccaucuucaaaaaguacaucuggaggcacagcagcucucggaugccuagucaaagacuacuucccugaacccguaaccguaucauggaacucaggggcacuaacaucagguguacauacauuuccagcaguccuucaaucaucaggauuauauucacuaucaucuguagucacuguacccucaucuucacuaggcacccaaacauacauuuguaauguaaaccauaaaccaucaaacaccaaaguagauaaaaaaguagaaccaaaaucuugugacaaaacacauaccugcccuccauguccagcaccagaacuucuaggaggccccucaguauuccuauucccacccaaaccaaaagacacacucaugauaucaagaacacccgaaguaaccugcguaguaguagaugucucucacgaagacccagaaguaaaauucaauugguacguagauggaguagaaguacacaacgcaaaaacaaaaccaagagaagaacaauauaacucaaccuaccgaguaguaucaguucuaaccguauuacaucaagauuggcuaaacggaaaagaauacaaauguaaagucuccaauaaagcacuaccagcaccaauagaaaaaacaauaucaaaagcaaaaggacaaccaagagaaccccaagucuauacauugccaccaucuagagaagaaaugacaaaaaaccaaguaucauuaacaugcuugguaaaaggauucuacccuucagauauagcuguagaaugggaaucaaauggccaaccugaaaacaauuauaaaacaacaccaccaguacuagauucagauggauccuuuuuuuuauauucaaaacuaacuguagacaaaucuagauggcaacaaggcaacguauucucaugcucagucaugcacgaagcucuacauaaucauuacacacaaaaaucucuaucuuuaucuccuggcaaa

SEQ ID NO: 51130 - RNA, 1359 nt, Artificial Sequence
  derived and/or modified sequence opt6 from anti-influenza_Chain
gaaguacaauuaguacaaucaggagcagaaguaaaaaaaccaggugaaagucuaaaaauaucauguaaaguauccggauacucauucacaagccaauggaucggauggguaagacaaaugccaggaaaaggccucgaauggauagguaugauguauccaggagacuccgacaccauauauucaccauccuuccaaggacaaguaaccauaucagcagauaauucaauauccacagccuaccuacaauggucaucacuuaaagccuccgauacagcaauuuacuacugcgcaucaggaccaggauacucaggcuaucacuauggaugguuugacacauggggccaaggaacacuuguuacaguuucaucagcaucuacaaaaggaccaaguguauucccauuagcaccaucaucaaaaucuacaagcggaggaacagcagcacuaggaugccuagucaaagauuacuucccagaaccagucacaguaucauggaauucaggugcacuaacaucaggcguccacacauuuccugccguauuacaaucaucaggacuauauucacuuucaagcguaguaaccgucccauccucuucccuuggaacccaaacauacauuuguaacguaaaucacaaaccaucuaacacaaaaguagauaaaaaaguagaaccaaaauccugcgacaaaacacauacaugcccaccaugucccgcacccgaacuccuuggaggaccaucuguauuucuuuucccaccuaaacccaaagacacacuaaugauaaguagaacucccgaaguaacaugcguaguuguagacguaucacaugaagacccagaaguuaaauucaacugguacguagacggaguagaaguacauaacgcaaaaacaaaaccaagagaagaacaauauaauucaaccuacagaguaguaucaguucuaacaguacuacaccaagacugguuaaacggaaaggaauacaaaugcaaagucuccaacaaagcuuuaccagcuccuauagaaaaaacaauaucuaaggcaaaaggacaacccagagaaccccaaguauauacccuaccacccucaagagaagaaaugacaaaaaaccaagucucacuaacaugucucguaaaaggauucuacccauccgacaucgcugucgaaugggaaucuaacggccaaccagaaaauaauuauaaaacaaccccaccaguccuagauucagacggauccuuuuuuuuauacucaaaacuaacaguugacaaaucacgauggcaacaaggaaacguauucucuugcucuguaaugcacgaagcccuucauaaccacuauacucaaaaaagccucuccuuauccccaggaaaa

SEQ ID NO: 51131 - RNA, 1359 nt, Artificial Sequence
  derived and/or modified sequence opt6 from anti-influenza_Chain
gaaguacaacuuguucaauccggagcagaaguaaaaaaaccaggagaaucauuaaaaauuucaugcaaaguaucaggauacucauuuacaagucaauggauaggauggguaagacaaaugccaggcaaaggccuagaauggauagguaugauguacccaggagaugcugacgcaauuuacucaccaucuuuccaaggacaaguaacaaucucagcagauaauagcauaucaacagcuuaccuacaauggucuucacuaaaagcaucagacacagcaaucuauuacugcgcaucaggacccggauauucuggauaucacuacggaugguucgacaccuggggacaaggaacccuaguaacaguauccucugcauccacuaaaggaccauccguauucccacuagcaccaucaagcaaaucaacuucaggagguaccgcagcacuaggaugccuaguuaaagacuauuuccccgaaccaguuacaguaucauggaacuccggagcucuaaccucugguguacacacauuucccgcaguacuucaaagcaguggucuauauucauuaucaucaguaguuacaguaccauccucaucauuagguacacaaacauauauauguaauguaaaucacaaacccucaaauacaaaaguugacaaaaaaguagaaccaaaaucaugcgacaaaacacacacaugccccccaugcccagcaccagaacuacuaggaggcccaucuguauuuuuauuuccaccaaaaccaaaagacacauuaaugauaucaagaacaccagaaguaacaugcguuguaguagacguaucacacgaagacccagaaguuaaauuuaauugguacguagauggaguagaaguacacaacgccaaaacaaaacccagagaagaacaauacaacucaaccuaccgaguaguuucaguauuaacuguacuucaccaagauuggcuaaacgguaaagaauacaaauguaaaguuaguaauaaagcacucccagcaccaauagaaaaaacaauaucaaaagccaaaggacaaccuagagaaccacaaguauacacacuaccaccuuccagagaagaaaugaccaaaaaccaaguaucacuuacauguuuagucaaaggauucuacccaucagacaucgcaguagaaugggaaucaaacggacaaccugaaaauaacuauaaaacaacaccacccguauuagacucagauggaucauucuuccuuuauuccaaauuaacaguagacaaaucaagauggcaacaaggaaacguauucuccugcucaguaaugcacgaagcacuacacaaccauuauacccaaaaaagucucaguuuaucaccaggcaaa

SEQ ID NO: 51132 - RNA, 1359 nt, Artificial Sequence
  derived and/or modified sequence opt6 from anti-influenza_Chain
gaaguacaacuaguacaaucaggagccgaaguaaaaaaaccaggagaaaguuuaaaaaucucauguaaaguuucugguuacucuuucacuucacaauggauaggcuggguuagacaaaugcccggaaaaggacuagaauggauaggaaugauguauccaggcgaaucagaaacaauauauucaccauccuuccaaggacaaguaacaauuuccgcugauaauaguaucucuaccgcauauuuacaauggucaucacuuaaagcaucagauacagccauauauuauugcgcauccggaccaggcuauucaggauaccacuauggaugguucgacacuuggggacaaggaacacuuguaaccguaaguuccgcaagcacaaaaggaccaucaguauuuccacuagcaccaucuucuaaaucaacaaguggcggaacagcagcacuagguugccuagucaaagacuacuucccagaacccguaacaguauccuggaacucaggagcccuaacaucaggaguacauacauuuccagccguauuacaauccucaggacuauacucauuaucaucuguaguaacaguccccucauccucacuaggcacacaaaccuauaucugcaacguuaaccauaaaccuuccaacacaaaaguggacaaaaaaguagaaccaaaaucaugugauaaaacucauacaugcccaccaugccccgccccagaacuauuagguggaccaucaguauuccucuucccuccaaaaccaaaagauacuuuaaugauaucacgcaccccggaaguaacaugcgucguaguagacguuucccacgaagacccagaaguaaaauucaacugguauguagacggcguagaaguacacaacgcaaaaacaaaaccucgcgaagaacaauauaauucuacauacagaguagucuccguccuaacaguauuacaucaagacuggcuuaauggaaaagaauauaaaugcaaagucucuaacaaagcacuaccagccccaauagaaaaaacaauauccaaagcaaaaggccaaccaagagaaccacaaguauauacauuacccccaucaagagaagaaaugaccaaaaaccaaguaagccuaaccugccuaguaaaaggauucuauccguccgauaucgcaguagaaugggaauccaauggacaaccagaaaacaauuauaaaacaacccccccuguacucgauucagacggaucauucuucuuauacucaaaauuaacaguagacaaaaguagauggcaacaaggaaauguauuuucaugcucaguaaugcaugaagcucuucauaaccacuauacccaaaaaucacuaucauuaucaccaggaaaa

SEQ ID NO: 51133 - RNA, 1359 nt, Artificial Sequence
  derived and/or modified sequence opt6 from anti-influenza_Chain
gaaguacaacuaguacaaagcggcgcugaagucaaaaaaccuggagaaucacuaaaaauauccuguaaaguuaguggauacuccuucacaucccaauggauaggauggguaaggcaaaugccaggaaaaggauuagaauggauuggaaugauguacccaggagaugcagacacaauauacucaccaucauuccaaggacaaguaacuauaucagcggacaacagcauauccacagccuacuuacaauggucaucacuaaaagcaucugacacugcaauauacuauugugcaucaggucccggauacucaggauaucacuacggaugguuugacacauggggucaaggaacauuaguaacaguaucauccgccuccacaaaaggaccaagcguauuuccacuagcaccaucaagcaaaucuacaucaggaggaacagccgcauuaggaugcuuaguaaaagauuauuucccagaaccagucacaguauccuggaacucaggagcauuaacaucagguguccacacauuuccagcaguucuacaaagcucaggauuauauucccucucaaguguaguaaccguaccaucaucaucccuaggaacacaaacuuacauauguaacguaaaucacaaaccaucaaauacaaaaguggacaaaaaaguugaaccaaaaucaugugacaaaacacacaccugcccaccauguccagcaccagaacuacuaggaggacccucagucuucuuauucccaccuaaaccaaaagauacacuaaugaucucuagaaccccagaaguaacuuguguaguagucgacguuucacaugaagacccagaaguuaaauucaacugguacguugacggaguagaaguacacaaugcaaaaacaaaaccaagagaagaacaauauaacucaacauacaggguaguaucaguucuuacaguacuacaucaagacuggcuaaauggaaaagaauacaaaugcaaaguaucaaauaaagcacuaccagcaccaauagaaaaaaccauauccaaagcaaaaggacaaccuagagaaccucaaguauacacacuaccaccaucaagagaagaaaugaccaaaaaccaagucucacuaacaugccuaguaaaaggcuuuuacccuagcgauauagcagucgaaugggaaucaaacggacaaccagaaaauaauuacaaaacaacacccccaguacuagacucugauggaucuuucuucuuauauucuaaacuaacuguagacaaaucaagguggcaacaaggaaacguauucucuuguucaguaaugcacgaagcacuacacaaccacuacacacaaaaaucacuaucauuauccccagguaaa

SEQ ID NO: 51134 - RNA, 1359 nt, Artificial Sequence
  derived and/or modified sequence opt6 from anti-influenza_Chain
gaaguacaauuaguacaaucuggagccgaaguaaaaaaacccggagaaucacuuaaaauaucuugcaaaguuucaggauacuccuucacaucacaauggauaggaugggucagacaaaugccaggaaaaggccuagaauggauaggaaugauguacccaggaucaucagauacaauauacucaccaucauuccaaggacaagucaccauauccgcagauaauucaauaucuacagcauacuuacaaugguccucauuaaaagcaucagacacagcaauauauuacugcgcaucugggccaggauacucaggauaucauuacggaugguucgauacauggggacaaggaacucuaguaacaguaucaucugcaucaacaaaaggacccuccguauucccacuagcaccauccucaaaauccacauccggagguacagcagcauuaggaugccuaguaaaagauuacuucccagaaccaguaacuguaagcuggaacucaggagcauuaacuucaggcguccauacuuuucccgcaguacuccaaagcucaggacucuacucauuaucaucaguuguaacuguacccucaucaucacuaggaacacaaaccuacauauguaacguaaaccauaaaccaucaaacacaaaaguagacaaaaaaguagaaccaaaaucaugcgacaaaacucauacuugcccuccaugcccagcaccagaauuacuaggaggcccaucaguauuucuauucccaccuaaaccaaaagauacacuaaugauuucaaggacccccgaaguaacauguguaguuguagacguaucacacgaagacccagaaguaaaauucaauugguacguagacggaguagaaguacauaacgcaaaaacuaaacccagagaagaacaauacaauucaacauaccgaguaguaucaguauuaacuguacuacaccaagacuggcuuaacgguaaagaauauaaaugcaaaguaucaaacaaagcacuaccagcccccauagaaaaaacaauaucaaaagcaaaaggacaaccaagagaaccacaaguauauacacuaccaccauccagagaagaaaugacaaaaaaccaaguaucacucacaugccuaguaaaaggcuucuacccaucagauauagccguagaaugggaaaguaauggacaacccgaaaacaacuauaaaacaacaccuccuguacucgauucagacggauccuucuucuuauacaguaaauuaacaguagauaaaucaagauggcaacaaggaaacgucuuuucaugcucugugaugcacgaagcccuccacaaccacuacacacaaaaaucucuaucauuaagcccaggaaaa

SEQ ID NO: 51135 - RNA, 1359 nt, Artificial Sequence
  derived and/or modified sequence opt6 from anti-influenza_Chain
gaagugcaacuaguacaaucuggagccgaaguaaaaaaaccaggugaaagccuaaaaauaucauguaaagucuccggauacucuuuuacaucacaauggauaggauggguuagacaaaugccgggaaaaggguuagaauggauuggcaugauguacccaggagacucugaugcaauuuacucaccaucauuccaaggacaaguaacaauaucugcagacaauucaauaucuacagcauaccuucaauggucaucccuuaaagcaucugauacagcaauuuacuacugcgcuucagguccuggauauucaggauaccacuacgggugguuugacacguggggacaaggaacacuaguaacaguaucauccgcaucuaccaaaggaccuucaguauucccccuugcaccaucaucaaaaucuacaucaggaggaacagcagcauuaggaugucucguuaaagauuacuuuccagaaccaguuacaguuuccuggaacucaggagcauuaacaucagguguacacacauucccagcaguauuacaaucaucuggacucuauucucuaucaucaguaguaacaguaccaucauccucgcucggaacucaaacauacauauguaacguaaaccauaaaccuucaaauaccaaaguagacaaaaaaguagaaccaaaaucaugcgacaaaacacacacaugccccccaugcccagcaccagaauuacuuggaggacccucaguauucuuauucccaccaaaaccaaaagacacacucaugauaucaagaacaccagaaguuacaugcguuguuguagacguuucacaugaagacccagaaguaaaauucaacugguacguagauggagucgaaguacauaacgccaaaaccaaaccacgagaagaacaauauaacucaaccuauagaguaguaucaguacucaccguccuacaucaagauugguuaaacggcaaagaauauaaauguaaaguaucaaacaaagcauuaccagcaccaauugaaaaaacaauaucuaaagcuaaaggacaaccuagagaaccucaaguauacacuuuaccaccuuccagagaggaaaugacaaaaaaucaagucucacuuacaugccuaguaaaaggauucuauccaagcgauauagcaguagaaugggaaucuaacggacaaccagaaaacaacuacaaaaccacaccacccguauuagacucugacggcucuuuuuucuuauacucaaaauuaacagucgauaaaucccgauggcaacaaggaaacguauucucauguucaguuaugcacgaagcauuacacaaucauuacacucaaaaaucgcuaucacuaucaccagguaaa

SEQ ID NO: 51136 - RNA, 1359 nt, Artificial Sequence
  derived and/or modified sequence opt6 from anti-influenza_Chain
gaaguccaacuaguacaaucaggugcagaaguaaaaaaacccggagaaaguuuaaaaauaucuuguaaaguuucaggauauucauucacaucacaauggauagguugggugagacaaaugccaggcaaaggauuagaauggauaggaaugauguacccaggagacacugacacaauauacucaccaucauuccaaggacaagucacaauaucugcagacaacucaauaucaacagcauaccuacaauggaguucuuuaaaagcaucagauacagccauauacuacugugcaucaggucccgguuacucaggauaccacuacggaugguuugauacuuggggccaaggaacacuagucacuguaucauccgcaucaacaaaaggcccaucagucuuuccucuagcaccaucuucaaaaucaacaucaggaggaacggcagcuuuaggcugucuaguaaaagauuacuuuccagaaccuguaacaguaucauggaacucaggagcucucacaagcggaguacauacauucccugcaguccuacaaucauccggacuauacaguuuauccucaguaguaacaguaccaucaucuucauuaggaacacaaacauacaucuguaauguaaaucauaaaccaucaaacaccaaaguagacaaaaaaguagaaccaaaaucaugcgauaaaacacauacaugcccaccaugcccugcucccgaacuacuaggaggacccucuguauuucuauuucccccaaaacccaaagacacacuaaugauaucacgaacaccagaaguaacaugcguaguaguugaugucucacaugaagacccagaaguuaaauuuaacugguauguagacggaguagaaguucauaacgcaaaaaccaaaccaagagaagaacaauacaauucuacauauagaguaguuucaguauuaacaguauuacaucaagacuggcuaaacggcaaagaauacaaaugcaaagucucaaacaaagcacuacccgcaccaauagaaaaaaccauaagcaaagcaaaaggacaaccuagagaaccacaaguauacacacucccaccaagcagagaagaaaugacaaaaaaucaaguaucccuaacaugucuaguaaaaggauucuauccaucagacauagcaguagaaugggaaucuaauggccaaccagaaaauaacuacaaaacaacacccccaguauuagacucugacggauccuucuucuuauacucaaaacuaacaguagauaaaucuagauggcaacaaggaaauguuuucucauguuccguaaugcacgaagcacuacacaaccauuacacacaaaaaucauuaucacuaucacccggaaaa

SEQ ID NO: 51137 - RNA, 1359 nt, Artificial Sequence
  derived and/or modified sequence opt6 from anti-influenza_Chain
gaaguacaacucguccaaucaggagccgaaguaaaaaaacccggagaaagucuaaaaauuucauguaaaguaucagguuauaguuucacaucacaauggauaggauggguccgucaaaugccaggcaaaggucuagaauggauaggaaugauguauccaggagaauccgacacaauauacucuccaucauuccaaggacaagucacaauaucagcagacaauucaauaucaacugcauaucuacaaugguccuccuuaaaagcauccgacacugcuauauauuacugcgcaucuggaccaggauacagcggauaucauuauggaugguuugacacauggggccaaggaacacuaguaaccguaucaagcgcaucaacaaaaggaccaucagucuucccacuagccccauccucaaaaucaacuuccggaggcacagcagcccuaggaugccucguaaaagacuacuucccagaaccaguaacuguaucuuggaacucuggagcccuuacaucgggaguacacacauucccagccgucuuacaaucaucaggacuauacagcuuaucuuccguagucacuguaccaaguucaagcuuaggaacucaaacauauaucugcaacguaaaccauaaaccaucaaacacaaaaguagacaaaaaaguagaaccaaaaucaugugacaaaacacauaccuguccaccauguccagcccccgaacuuuuaggcggaccauccguauuccuauucccuccaaaaccaaaagacacauuaaugauaucuagaacaccagaaguaacaugcguugucgucgauguaucacacgaagauccagaaguuaaauuuaacugguacguugauggaguagaaguacacaacgcaaaaacaaaacccagagaagaacaauacaacucaaccuaucgaguagucucaguauuaacuguacuacaccaagauuggcuaaauggcaaagaauauaaaugcaaaguaucaaacaaagcucuaccugcuccaauagaaaaaacaauuucaaaagcaaaaggccaaccaagagaaccacaaguauacacacuccccccaagucgagaagaaaugacaaaaaaucaaguaucacucacauguuuaguaaaaggauuuuaccccuccgacauagcuguagaaugggaaagcaacggacaaccagaaaacaacuacaaaaccacuccaccagucuuagacucagacggaucauucuucuuauacucaaaacuaaccgucgacaaaucaagauggcaacaaggaaacguauucucaugcucugucaugcacgaagcccuacacaaccauuacacacaaaaaucacuaucauuaucaccaggaaaa

SEQ ID NO: 51138 - RNA, 1359 nt, Artificial Sequence
  derived and/or modified sequence opt6 from anti-influenza_Chain
caaguacaauuaguucaaucaggagcggaagucaagaaaccaggaucauccguaagaguaucauguaaagcauccggaucaauuuuccgaaacuacgcaaugucuuggguucgucaagcuccgggucaaggauuagaauggauggguggaaucauagccaucuucgguacuccuaaauacgcucaaaaauuccaaggaagaguaacuauaacagcagacgaaucaacaucaacaguauauauggaacuaucaggacuaagaagugaagacacagccauguacuauugcgcaagaauaccucauuacaauuuuggaucaggaucauacuuugacuacuggggacaaggcacacuuguaacaguaucaucagcaucaaccaaaggcccaucaguauuccccuuagccccaucaucuaaaucaacaucaggaggaacagcagcuuuagguuguuuaguaaaagauuauuuuccagaaccagucaccguaucauggaacucaggagcccuaaccuccggaguacacacauuuccagcaguacuacaauccucaggauuauauucucuaucaucaguagucacaguaccaucauccucacuaggaacacaaacauacauuuguaacguaaaccacaaaccaucaaauacaaaagucgauaaaagaguagaaccaaaaagcugugauaaaacucauacuuguccaccaugcccagcacccgaauuacucggagguccaagcguauuccuuuuuccaccaaaaccaaaagacacacuaaugauaucgagaacuccagaaguaacuugcguagucguagacgucucacacgaagauccagaagucaaauuuaauugguacguagauggcgucgaaguacauaaugccaaaaccaaaccaagagaagaacaauauaacucuacauacagaguaguaucaguacucaccguacuacaucaagacugguuaaacgguaaagaauacaaauguaaaguauccaacaaagcacuaccagcaccaauagagaaaaccauauccaaagcaaaaggacaaccacgagaaccacaaguuuacacauuacccccuucucgcgaagaaaugacuaaaaaccaaguuucucuaacauguuuaguaaaaggauuuuacccaucagacauagcaguagaaugggaaucaaauggccaaccugaaaauaauuauaaaacaacuccacccguacuagacuccgacgguucauucuucuuauauuccaaacucacaguagauaaauccagauggcaacaaggaaacguauucucaugcucaguaaugcacgaagcauuacauaaccacuauacacaaaaauccuuaucuuuaucaccaggaaaa

SEQ ID NO: 51139 - RNA, 1359 nt, Artificial Sequence
  derived and/or modified sequence opt6 from anti-influenza_Chain
caaguucaacuaguacagucuggagcugaaguaaaaaaaccaggugcaagcgucaaaguaucaugcaaagcaucaggauacauauuuacaggauacuacauacauuggguuagacaagcaccaggacaaggacucgaauggaugggaagaauagacccaaacggaucaggaacaacauacgcacaaaaauuucaaggacgagugacacuaacaauggauacauccauaacaacagcauacauggaauugagucgacuaagauucgacgacacugcaauauacuacugugcuagaugggauuggaacuucgaucuauaccuaggaugguucgacccauggggccaaggaacaccagucaccguagcaucugcaucaacaaaaggaccaucaguuuuuccauuagcaccaucaucaaaaucaacaucaggaggaaccgccgcuuuaggcugccuaguaaaagauuauuucccagaaccaguaacaguaaguuggaacucaggagcauuaacaucaggcguacauacauucccagcaguacuccaaucaucuggucuauacucacuaucaucagucguaacuguuccaucauccucacuaggaacucaaacauauaucuguaauguaaaccacaaaccaucaaauacaaaaguagacaaaaaaguugaaccaaaaucuugugauaaaacacacacuugcccaccaugcccagccccagaacuauuaggaggaccauccguauuccuuuucccaccaaaaccaaaagacacacuaaugaucucucgcacaccagaaguaacauguguaguaguagauguaucacaugaagacccagaaguaaaauuuaacugguacguagauggagucgaaguacacaacgcaaaaaccaaacccagagaagaacaauacaacucaacauaccgaguaguuucuguucuaaccguacuacaucaagacugguuaaauggcaaagaauauaaauguaaaguaucuaauaaagcacuaccagcaccaaucgaaaaaacaaucucaaaagcaaaaggacaaccaagagaaccccaagucuacacauuaccaccaucacgagaagaaaugaccaaaaaucaaguaagucucacaugccuagucaaaggcuucuacccaucagauauugcaguagaaugggaaucaaacggacaaccagaaaauaauuauaaaacaacacccccaguacuagauucagauggaucuuuuuuucuauauucaaaacuaaccgucgacaaauccagauggcaacaaggaaacguauucucuugcucaguaaugcacgaagcccuacacaaucacuacacccaaaaaucacuaucauuaucaccaggaaaa

SEQ ID NO: 51140 - RNA, 1359 nt, Artificial Sequence
  derived and/or modified sequence opt6 from anti-influenza_Chain
gaaguccaauuaguacaaucaggagcagaaguuaaaaaaccuggagcaucaguaaaaguuagcuguaaagcaagugguuacauauuuacagguuauuacauacacuggguacgucaagcuccaggccaagguuuagaauggaugggaagaauugauccuaauggagcagguacaaccuacgcccaaaaauuucaagguagaguaacauuaacaauggacacaaguauaacaacagccuauauggaauuaucaagauuaagauuugacgacacagcaauauacuacugugcaagaugggauuggaacuuugaucuauauuuagguugguuugacccauggggacaagguacaccaguaacaguagcauccgcaagcacaaaaggaccaucaguauuuccauuagcaccaagcucuaaaucaacaucuggaggaacagcagcacuaggcuguuuaguaaaagauuacuuuccugaacccguaaccguaaguuggaacucaggcgcacuaacuucaggaguccauaccuuccccgcaguacuucaaucaucaggacuauauuccuuaagcaguguaguaacaguaccaucaucaucacucggcacacaaaccuauauaugcaauguaaaccacaaaccuaguaauacaaaaguagauaaaaaagucgaaccaaaaagcugcgauaaaacucauacuuguccacccuguccagcccccgaauuacucggaggcccaucaguauuccuauucccaccaaaacccaaagacacacuaaugauaucucgaacaccagaaguaacuugcguaguaguugacguaucacaugaagauccagaagucaaauucaauugguacguagacggaguagaaguacauaaugccaaaacuaaaccacgagaagaacaauacaauuccacauauagaguaguaucuguccuaacuguacuccaucaagacuggcuaaacggaaaagaauacaaauguaaaguaucuaauaaagcauuaccagcuccaauugaaaaaacaauaucaaaagccaaaggacaaccaagagaaccacaaguauacacacucccacccagcagagaagaaaugacaaaaaaccaaguaucucuaacaugucuaguaaaaggcuuuuacccaagugauauagcagucgaaugggaaucaaauggacaaccugaaaauaauuauaaaacaacaccaccaguacuagauuccgacggaagcuuuuuucuauacucaaaauuaacaguagacaaaagcagauggcaacaaggaaacgucuuuucaugcucagucaugcaugaagcacuacacaaucauuauacccaaaaaucacuaucauuauccccaggaaaa

SEQ ID NO: 51141 - RNA, 1359 nt, Artificial Sequence
  derived and/or modified sequence opt6 from anti-influenza_Chain
caaguucaacuuguccaaaguggagccgaaguuaaaaaaccaggcgccucuguaaaaguaucaugcaaagcuucagguuacacauucaaugcccaccauaugcauuggguaagacaagcaccaggacaaggacuaggauggaugggcuggaucgaucccaauaaugauggcacaauauacgcacaaaaauuucaaggaagaguaacauuaacuauggauacaucaauucacacagcauauauggaauuaucuggcuuacguuaugacgauacagcaauauacuacuguguaagaugggcuuggaauuuugauuuuuuucuaggcugguuugacccauggggacaaggaacuuuaguaacagucgccagugcaagcacuaaaggucccucuguauuuccauuagccccaagcucaaaaucgacaaguggaggaacagcugcacuagguugucuaguaaaagauuacuuuccagaaccaguaacagucucauggaauagcggagcacuaacaucaggaguacacaccuuucccgcaguauuacaaucaucaggucucuauaguuuaucaucaguuguaaccguaccaucaucaagucuaggaacacaaacauauauauguaauguaaaucauaaaccaucaaacacaaaaguagauaaaaaaguagaaccaaaaagcugugauaaaacacauacaugucccccuugcccugcaccagaacuacuagguggaccaagcguauuccuauucccaccaaaacccaaagauacauuaaugaucucaagaacaccagaaguaacuugcgugguaguagacguaagucacgaagauccagaaguaaaauucaacugguauguagaugguguagaaguacauaaugcaaaaacaaaaccuagagaagaacaauauaacucaacauauagaguaguaucaguacuaaccguacuacaccaagauuggcuuaacgguaaagaauauaaaugcaaagucuccaacaaagcacuuccagcacccauagaaaaaaccauauccaaagcaaaaggacaaccuagagaaccacaaguauacacucuaccaccaucaagagaagaaaugacaaaaaaucaaguaucauuaacaugcuuaguaaaaggauucuacccuucagauauagcaguagaaugggaaagcaauggacaaccagaaaacaauuacaaaacaacaccaccaguauuagacucugauggaaguuucuuuuuauacucaaaacuuacaguagacaaaucccgauggcaacaagggaacguuuuuucaugcucaguaaugcacgaagcacuccacaaucauuauacacaaaaaucacuaucauuaucaccaggaaaa

SEQ ID NO: 51142 - RNA, 1359 nt, Artificial Sequence
  derived and/or modified sequence opt6 from anti-influenza_Chain
gaaguacaacuuguccaaucaggugccgaaguaaaaaaaccuggagaauccuuaaaaauaucuugcaaaguauccggauacucauuuacaucacaauggaucggauggguaagacaaaugccaggaaaaggcuuagaauggauaggaaugauguauccaggagacuccgauacaauuuacucaccuucauuccaaggacaaguaacaauaucugcugauaauucaauaucaacagccuaccuacaaugguccucacuuaaagccucagacacugcaauauacuauugcgcaucaggaccaggauacucaggauaccauuacggaugguucgauacauggggacaaggaacacuugucacaguuucuucagcauccacaaaaggaccaucuguauucccacuagccccauccucaaaauccacaucaggaggaacagcugcacuugguugucuaguaaaagacuauuucccagaacccguaacaguaucauggaacuccggagccuuaacuucagguguccauacauucccagcaguccuacaaucuucaggucuuuacuccuuaucuucuguaguaacagucccaagcucauccuuaggcacacaaacauauauaugcaacguaaaccauaaacccucaaauacaaaagucgauaaaaaaguagaaccaaaaucaugcgacaaaacccauaccuguccaccaugccccgcaccagaacuauuagguggaccaaguguauuccuauucccacccaaaccaaaagacacccuaaugauaucacgaacaccagaaguaacaugcgucguagucgacguaucccacgaagacccagaagucaaauuuaacugguacguagacggaguagaaguacacaacgcaaaaaccaaaccaagagaagaacaauacaacucaacauaccgaguaguaagcguuuuaacuguauuacaccaagauuggcuaaacggaaaagaauauaaaugcaaaguauccaacaaagcauuaccagcaccaauagaaaaaacuauaucaaaagcaaaaggacaaccaagagaaccacaaguauauacacuacccccaucacgugaagaaaugacuaaaaaucaaguaaguuuaacaugcuuaguuaaaggauuuuacccuuccgauauagcaguugaaugggaaucaaacggacaacccgaaaacaauuacaaaacaacacccccaguauuagauucagacggaucuuucuucuuauacucaaaauuaacaguagauaaauccagauggcaacaaggaaauguauucucauguuccgucaugcaugaagcauuacacaaccauuacacucaaaaaucacuuucauuaucaccagggaaa

SEQ ID NO: 51143 - RNA, 1359 nt, Artificial Sequence
  derived and/or modified sequence opt6 from anti-influenza_Chain
gaaguccaacuaguccaaucaggagccgaaguuaaaaaaccuggagaaucauuaaaaauaucuuguaaaguaaguggauacucauuuacaucccaauggauaggauggguaagacaaaugccaggaaaaggauuagaauggauaggaaugauguacccuggcgaugcagacgcaauuuacuccccaucauuccaaggccaaguaacaauaucagcagauaauagcauaucaacagccuacuuacaauggucauccuuaaaagcaucagacacagccauauauuauugcgccucaggaccaggauauucaggauaccacuauggaugguucgauacauggggccaaggaacacuaguaacaguaucaucagcaucaacaaaaggaccuucaguauucccucuggcaccaucaucaaaaagcacaucuggaggaacugcagcccuaggcugcuuaguaaaagauuacuucccugaaccaguaaccguaucauggaacagcggagcauuaacaucaggcguacacaccuucccugcaguccuucaaucaagcggcuuauacucccuuucaagcgucgucacuguuccauccucaucccuaggaacacaaacuuacauaugcaauguaaaucacaaaccaucuaacacaaaaguagauaaaaaagucgaaccuaaaucaugcgacaaaacacauaccugccccccuugucccgcuccagaacuauuaggaggacccucaguauuucuauucccaccaaaaccuaaagacacauuaaugauaucaagaacaccagaaguaacaugcguaguuguagacguaucacacgaagauccagaaguaaaauucaacugguauguagaugguguagaaguccacaaugcaaaaacaaaaccaagagaagaacaguacaauucaacauacagaguuguaucuguucuaacaguuuuacaucaagauugguuaaauggaaaagaauauaaaugcaaaguaucaaauaaagcacuacccgcaccaauagaaaaaacaauauccaaagcuaaaggucaaccucgagaaccacaaguauauacacuccccccauccagagaagaaaugacaaaaaaccaaguaucauuaacgugcuuagucaaaggcuucuacccaagcgauauugccguagaaugggaaucaaauggacaacccgaaaauaauuauaaaacuacaccacccguccuugauucagauggaucauuuuuucuauacucaaaacuaacuguugauaaaucacgauggcaacaaggcaauguauucaguuguucugucaugcacgaagcacuacacaaccauuacacacaaaaaucacuaucucucucaccaggaaaa

SEQ ID NO: 51144 - RNA, 1359 nt, Artificial Sequence
  derived and/or modified sequence opt6 from anti-influenza_Chain
gaaguucaauuaguacaauccggagcagaaguaaagaaaccaggagaaucacuaaaaaucucauguaaaguaucaggauacucauucacaucacaauggauaggauggguaaggcaaaugccaggaaaaggacuagaauggauagguaugauguacccaggagaauccgaaacaauauauuccccaucauuccaaggacaaguaacaauaucagcugacaauucaauaucaacagcauaccuacaaugguccucacuaaaagcaucagauaccgcaauauacuacugcgcaucaggaccuggauauuccgguuaucacuaugguugguucgacacuuggggacaaggaacccuuguaacaguaucaucagcaucaacaaaaggacccucaguuuuuccuuuagcaccaucaucuaaaucaacaucaggcggaacagcagcacuaggaugcuuaguaaaagacuacuucccagaaccaguaacaguuucauggaacucaggugcauuaacaucuggaguacacacauucccagcaguauuacaaagcuccgguuuauacucacuaucaucagucguuacaguaccaucuucaucucuaggaacacaaacauacauuuguaacguaaaccauaaaccaucuaauacaaaaguagauaagaaaguagaaccaaaaucaugugacaaaacacacacaugcccaccaugcccugcaccagaauuacuaggaggacccucagucuuucuauuucccccaaaacccaaagauacauuaaugauaucaagaacaccagaaguaaccugcguaguaguugacguaucacacgaagaccccgaagucaaauucaacugguacguggacgguguagaaguacacaacgcuaaaacaaaaccaagagaagaacaauacaacagcacauacagaguaguaucaguacucacaguacuacaucaagauuggcuaaacggaaaagaauacaaauguaaaguauccaacaaagcacuaccagcacccauugaaaagacaauaucaaaagcaaaaggacaaccaagagaaccacaagucuacacauuaccaccaucaagagaagaaaugaccaaaaaccaaguaucacuaacauguuuaguuaaaggauucuacccaucagacauagcaguagaaugggaaucuaacggacaacccgaaaauaacuacaaaacaacaccaccgguauuagauuccgacggcucauucuuccuauacucaaaauuaacaguagacaaaagcagauggcaacaaggaaacguauucucauguucagugaugcacgaagcacuccacaaccauuacacccagaaaagucuaucacucucaccaggcaaa

SEQ ID NO: 51145 - RNA, 1359 nt, Artificial Sequence
  derived and/or modified sequence opt6 from anti-influenza_Chain
gaaguacaacuaguacaaucaggcgcagaagucaaaaaaccaggagaaucacucaaaauaucaugcaaagucucaggauacucauuuacaucccaauggauaggauggguuagacaaaugccaggaaaaggacucgaauggauaggaaugauguauccaggagaugcagacaccauuuauucuccaaguuuucaaggccaaguuacaauauccgcagacaacaguauaucaacagcuuaccuacaaugguccucccuaaaagcaucagacaccgcaauauacuauugcgcaucaggaccaggauacucaggauaucacuacggaugguucgacacuuggggucaaggaacuuuagucacuguauccucagcuucaaccaaaggaccaucagucuuuccacuagcaccaucaucuaaaucaacaucaggagguacagcagccuuaggaugcuuaguaaaagacuacuuccccgaaccaguaacaguaucauggaacucaggagcacuaacauccggaguacacaccuuuccagcuguacuacaaucauccggacucuauucauuaucaucaguaguaacuguaccaucaucuuccuuaggaacccaaaccuacauauguaacgucaaccacaaacccucaaacacaaaaguagacaaaaaaguagaaccaaaaucuugugauaaaacacacacaugcccaccauguccagccccagaauuauuaggaggaccauccguauuuuuauucccacccaaaccaaaagacaccuuaaugauaucaagaacaccagaagucaccugcguaguaguagacguaucacacgaagauccagaaguaaaauuuaauugguacguagacggaguagaaguacacaacgcuaaaacaaaaccaagagaagaacaauauaacuccacuuauagaguaguaucaguacuaacaguauuacaccaagacuggcuuaacggaaaagaauacaaauguaaaguauccaacaaagcacucccagcaccaauagaaaaaacaauaucaaaagccaaaggacaacccagagaaccacaagucuauacacuaccaccaucuagagaagaaaugaccaaaaaccaagucucacuaacaugcuuaguaaaaggauucuacccuucagacaucgcaguagaaugggaaucuaacggacaaccagaaaacaauuacaaaaccacacccccaguccuagauuccgauggaucuuucuuccuauacucaaaauuaacagucgauaaaucaagauggcaacaaggaaacguauucuccugcucaguaaugcacgaagcacuccauaaccacuauacacaaaaaucacuuuccuuaucaccuggaaaa

SEQ ID NO: 51146 - RNA, 1359 nt, Artificial Sequence
  derived and/or modified sequence opt6 from anti-influenza_Chain
gaaguucaacucguucaaucaggugcagaaguaaaaaaaccaggcgaaucacuaaaaauaucaugcaaaguaucuggauacucauucacaucccaauggauaggauggguuagacaaaugccuggaaaaggauuagaauggauaggcaugauguaccccggaucuagcgacacaauauauucaccauccuuucaaggacaaguaacaauuucagcagacaacucaauaagcaccgccuaucuacaauggucaucauuaaaagcaagugauacagcaauauacuacugugcauccggaccuggauacucaggauaucacuaugguugguucgauacauggggacaagguacauuaguaacuguaucaucagccucuacaaaaggaccuucaguauucccauuagcaccauccuccaaaucaacaucaggaggcacagcagcacuaggaugccucguaaaagauuauuucccagaaccuguaacaguaucuuggaacucaggagcauuaacaucaggagugcauaccuucccagcaguucuccaauccuccggauuauauucacuaucaucagucguuacuguaccaucaucuucacuaggaacacagaccuacauauguaacguaaaccauaaaccaagcaacacaaaaguagauaaaaaagucgagcccaaaagcugcgacaaaacccacacaugcccaccuugcccagcaccagaacuccuagguggaccuucaguauuccuauuuccaccaaaaccaaaagacacacuaaugauuucaagaacuccagaaguaacaugcguaguaguagacgucucacaugaagacccagaagucaaauuuaacugguaugucgacggaguagaaguacacaaugcaaaaacaaaacccagagaagaacaauacaauucaaccuauagaguagucucaguucucacuguacuacaccaagacuggcuaaacggaaaagaauauaaaugcaaaguaucuaacaaagcacuaccagcacccauagaaaaaacuauaucaaaagccaaaggccaaccuagagaaccucaaguuuacacucucccaccaucaagagaagaaaugacaaaaaaucaaguaucuuuaacaugccuaguaaaaggauucuacccaucagacauagcagucgaaugggaauccaacggacaaccagaaaacaacuacaaaacaacaccaccaguacuagacucagauggaucauucuuccuauacucuaaacucacaguagacaaaucaagauggcaacaaggaaacguauucucaugcucaguaaugcaugaagcacuacacaaucacuacacacaaaaaagcuuauccuuaucaccagguaaa

SEQ ID NO: 51147 - RNA, 1359 nt, Artificial Sequence
  derived and/or modified sequence opt6 from anti-influenza_Chain
gaaguacaacuuguacaaucaggagccgaagucaaaaaaccaggagaaaguuuaaaaauaucuugcaaaguauccggauacuccuucacaucacaauggauaggauggguaagacaaaugccaggaaaaggauuagaauggaucggaaugauguauccaggagacucugaugcaauauauagcccaucauuucaaggacaaguaacaauaucagcagacaauucaauaucaacagcauaccuccaauggucaucuuuaaaagcuucagauacagcaauauauuauugcgcaucaggcccagguuauagcggcuaucauuacggaugguucgauacauggggacaagguacucuaguaacaguauccucugccucaacaaaaggaccuucaguauuuccacuagcaccaucaucaaaaucaacaucaggcggaaccgcagcauuaggaugcuuggucaaagauuacuucccagaaccaguaacaguauccuggaacucaggcgcccuaacaucaggaguacacacauucccagcaguacuccaaucgucuggacucuacucauuaaguucuguuguaacaguucccucaucuucccuaggaacacaaacauauauaugcaacguaaaccauaaaccaagcaacaccaaaguagacaaaaaaguagaaccaaaaucaugugacaaaacacacacaugcccaccauguccagcaccugaacuacuagggggccccucuguauucuuauucccaccaaaaccaaaagauacuuuaaugauaucuagaacuccagaaguaacaugcguaguagucgacguaucacacgaagaucccgaaguaaaauuuaauugguacguagacggaguggaaguacauaaugccaaaacaaaacccagagaagaacaauauaacucaacauacagaguaguuucuguauuaacaguucuacaccaagacugguuaaacggaaaagaauacaaaugcaaaguauccaacaaagccuuaccagcaccuauagaaaaaacgauaucaaaagccaaaggacaaccaagagaaccacaaguauacacucuaccaccaucacgagaagaaaugacaaaaaaucaaguaucacuaacuugcuuagucaaaggcuucuaccccuccgauauagcaguagaaugggaaucuaacggacaacccgaaaauaacuacaaaacaacuccuccaguacuagauucugacggaucauucuuucuauacucaaaacugaccgucgauaaauccagauggcaacaaggaaacguauuuucaugcucagucaugcacgaagcacuacauaaucauuauacacaaaaaucacuaagccuaucgccaggaaaa

SEQ ID NO: 51148 - RNA, 1359 nt, Artificial Sequence
  derived and/or modified sequence opt6 from anti-influenza_Chain
gaaguacaacuaguacaaucuggcgcagaaguuaaaaaacccggagaaucauuaaaaauuucuuguaaaguauccggauacucauucacaagucaauggauaggcuggguaagacaaaugccaggaaaaggccuugaauggauagguaugauguacccuggagacacagauaccauauacucaccuuccuuccaaggacaaguaacaauaucagcagacaacucaauaucaacugcuuacuuacaauggucuucauuaaaagcaucagacacugcaauauauuacugcgcaucaggaccaggauacucagguuaccacuaugguugguuugauaccuggggccaaggaacauuaguaaccguauccagugcaucaacuaaaggaccaucaguauucccauuagcaccaucauccaaaucaacaucagguggaacagcagcauuaggaugccuaguaaaagauuacuuuccagaaccaguaacaguaucauggaacuccggagcccuaaccucaggaguacauacauuccccgcuguacuucaaagcucuggacuauauucauuaucuucaguaguaaccguaccaucaucaucauuaggaacacaaacauacauaugcaacguaaaucacaagccaucuaauaccaaaguagacaaaaaaguugaaccaaaaucuugcgauaaaacacacacaugcccaccaugcccagcgcccgaauuauuaggaggaccaaguguauuucuauuuccaccaaaaccuaaagauacacuaaugauaucaagaacaccugaagucacaugcguaguuguagauguaagccacgaagauccagaaguaaaauuuaacugguacgucgaugguguugaaguacacaaugcaaaaaccaaaccaagagaagaacaauacaauucaacuuaccgcguaguuucaguauuaacuguacuacaucaagauuggcuaaacggaaaagaauacaaaugcaaaguaucaaacaaagcuuuaccugcuccaauagaaaaaacaauaagcaaagcaaaaggacaaccacgagaaccacaaguauauacccuaccaccaaguagagaagaaaugacaaaaaaccaaguaucacuaacaugcuuaguaaaaggauuuuauccuucugacauagcagucgaaugggaauccaacggacaaccagaaaacaacuauaaaacaacccccccuguucuagacucagacggaucauucuuucuauacucaaaacuaacaguagauaaaucuagauggcaacaaggaaacgucuucuccugcuccgucaugcacgaagcacuacacaaccacuauacacaaaaaagccuaucauuaucuccaggaaaa

SEQ ID NO: 51149 - RNA, 1359 nt, Artificial Sequence
  derived and/or modified sequence opt6 from anti-influenza_Chain
gaaguacaacuuguacaaucaggagcagaaguaaagaaaccaggagaaucuuuaaaaauaucaugcaaaguaucaggauacucauucacaagucaauggauaggcuggguaagacaaaugccaggcaaaggacuagaauggauaggcaugauguacccaggagaaucagacacaauauauagcccauccuuucaaggccaaguaacaauaucagcagacaacucaauuucaacagcauaucuacaauggucaucacuaaaagcauccgauaccgcaaucuauuacugugcaucaggaccaggauauucaggauaccauuacggaugguucgacacauggggacaaggcacucuaguaacaguaucaucagcaagcacaaaaggaccaucaguauuuccauuagcacccucaucaaaauccacaucuggaggaacagcagcacucggaugcuuaguaaaagauuacuucccagaaccugucacaguuucauggaacucaggagcacuaacaucaggaguacauacauuuccagcaguauuacaaucauccggacuuuacucacuuucaucuguagucacaguaccuucaucaucacucggaacacaaaccuacauaugcaacguaaaccacaaaccaucaaacacaaaaguugauaagaaaguugaaccaaaaaguugugauaaaacacacacaugucccccaugcccagcacccgaacuacuaggaggcccaucaguauuccuauuuccucccaaaccaaaagacacacuaaugauaaguagaacaccagaaguaaccugcguaguaguagacguaucccacgaagacccagaaguaaaauuuaacugguacguagauggcguagaaguacacaaugcaaaaacaaaaccacgagaagaacaauauaauaguacauaccgagucguaucaguauugacaguacuacaucaagacugguuaaacggaaaagaauauaaauguaaaguaucaaacaaagcauuaccagcaccaauagagaaaacaauaucaaaagcaaaaggacaaccaagagaaccacaaguuuauacacuaccacccucaagagaagaaaugaccaaaaaccaaguuucacucacaugccuaguaaaaggauucuauccauccgauauagcaguugaaugggaaucaaauggacaaccagaaaacaauuacaaaacaacaccucccgucuuggacucagacggaucauuuuuccuauauucaaaacuaacaguagauaaaucccgauggcaacaaggaaauguauucucuuguucagucaugcaugaagcauuacauaaucacuacacacaaaaauccuuauccuuaucucccggaaaa

SEQ ID NO: 51150 - RNA, 1365 nt, Artificial Sequence
  derived and/or modified sequence opt6 from anti-influenza_Chain
caaguacaauuaguagaaucaggcggaggcguaguacaaccaggaagaagccuacgauuaucaugugcagccucugguuucgcauuccacaaucgagcaaugcacuggguacgacaagcccccggaaaaggacuagaauggguagcauuaaucuauuucgacggaaguaaacaauacuaugcagacucaguuaaagguagauucacaauauccagagacaauuccaaaaacacaguauuccuacaaaugaacucucuacgaccagaagauacagcaguauacuauugcgcaguaccaggacccauauucggcauauucccuccuugguccuauuucgaccacuggggccaagguauauuaguaacuguaucaucagcauccaccaaaggaccaucagucuucccacucgcaccaucaucaaaaucaaccucuggaggaacagcagccuuaggaugucuaguaaaagauuacuuuccugaacccgucacaguaucauggaacucaggagcauuaacaucuggaguacacacauucccagcaguacuacaaucaucaggcuuauacucucuaucaucaguaguaacaguacccucauccucacucgggacacaaacauacauauguaacguaaaucacaaaccuuccaauacaaaaguagauaaaaaaguugaacccaaaucaugcgacaaaacucacaccugcccaccaugcccugcaccugaacuacuaggagguccaucaguauuucuauucccaccaaaaccaaaagacacauuaaugaucucaagaacaccagaaguaacaugcgucguuguagacgucucacaugaagacccagaaguaaaauucaauugguacguagacggaguugaaguacacaacgccaaaacuaaaccaagagaagaacaauauaauucaacauauagaguaguaucaguacuaaccguauuacaccaagacuggcugaauggaaaagaauauaaauguaaaguaucuaacaaagcacuaccagcuccaauagaaaaaacaauaucaaaagcaaaaggucaaccaagagaaccccaaguauacacacuaccuccaagcagagaagaaaugaccaaaaaccaaguaucacuaacaugccucguaaaagguuuuuacccaucagauauagcaguagaaugggaauccaauggacaaccagaaaauaauuacaaaacaacaccaccaguauuagacucugauggaaguuuuuuccuauauucaaaacuaacaguagauaaaucacgauggcaacaaggaaacguauucucaugcucagucaugcacgaggcacuacauaaccacuacacccaaaaaucacuaucacuaucuccaggaaaa

SEQ ID NO: 51151 - RNA, 1365 nt, Artificial Sequence
  derived and/or modified sequence opt6 from anti-influenza_Chain
gaaguacaacuaguagaaucuggcggaggaguaguacaaccaggaagaucacuaagacuguccugugcagcaucaggcuuugcuuuccacaaucgagcaaugcacuggguuagacaagccccaggaaaaggacuagaauggguagcauuaauauauuucgacgguucaaaacaauacuaugcagacucaguuaaagguagauuuacaauuucaagagauaacucaaaaaacacuguauuccuacaaaugaauucacuacguccagaagauacagccguauauuacugcgcaguaccaggaccaauauuuggaauauuuccaccauggucauacuucgaccacuggggacaaggaauauuaguaacagucaguuccgcaucaacaaaaggaccauccguauuuccacuagccccaucaucaaaauccaccucaggaggaacugcagcucuugguugcuuaguuaaagacuauuuuccagaaccaguaacagucaguuggaacuccggagcacuaacaucaggaguacacacauuuccagcaguauuacaaucuucaggacuauacucacuaucauccgucguuacaguaccaucaucaucuuuaggcacacaaaccuacauaugcaauguaaaucauaaaccaagcaacaccaaaguagacaaaaaaguagaaccaaaaucaugcgacaaaacccacaccuguccaccaugcccagcaccagaacuccuaggaggacccucaguauuuuuauucccuccaaaaccaaaagacacucuaaugauuucccgaacaccagaaguaacuugcguuguaguagaugucucacacgaagauccagaaguaaaauuuaacugguauguagacggaguagaaguacacaaugcaaaaacaaaaccaagagaagaacaauacaacucaacauaucgaguaguaucaguauuaaccguauuacaucaagauugguuaaauggaaaagaauacaaaugcaaaguuucaaacaaagccuuaccagcccccauagaaaaaacaaucucuaaagcaaaaggccaaccaagagaaccacaaguauauacauuacccccuucacgagaagaaaugacuaaaaaucaaguaucacuaacaugcuuagucaaaggauucuauccuucagacauagccguagaaugggaaucaaacggacaaccagaaaauaauuacaaaacaacaccaccaguccuugacucagauggaucauucuuccuauauaguaaauugaccguagauaaaaguagauggcaacaaggaaacguuuucucgugcucagucaugcacgaagcacuccacaaucacuacacacaaaaaucacuaucuuuaucaccaggcaaa

SEQ ID NO: 51152 - RNA, 1365 nt, Artificial Sequence
  derived and/or modified sequence opt6 from anti-influenza_Chain
gaaguacaacuaguacaaucaggaggcggaguaguacaacccggaaaaucucuccgacuaucaugcgcagcaucuggauuaacuuucucaucauaugccguucauuggguacgacaagccccugguaaaggucuagaauggguaacacucauaucauacgacggugcaaaccaauacuacgcagauuccguaaaaggucgcuucacaauaucuagagacaacucaaaaaacacuguauaccuacaaaugaauucacuaagaccagaagacacagcuguauauuauugcgccguaccaggcccaguauucggaauauuuccaccauggucauacuuugacaauuggggacaaggaauacucguaacagucuccuccgcuucuacaaaaggcccauccguauucccauuagcacccuccucaaaaucaacaucaggcgguacagcagcacuaggaugucuaguaaaagacuacuucccagaacccgucacaguaucauggaacucaggagcacuaacaucugguguccacacauucccagccgucuuacaaucuucaggacucuauucauuaucaucaguaguaacaguccccucaucuucacuaggaacacaaacuuacauaugcaacguaaaucauaaaccauccaauacaaaaguagauaaaaaaguagaaccaaaaucaugcgacaaaacccauacaugcccaccuuguccagcaccagaauuacuaggaggaccuaguguauuccuauuccccccuaaaccuaaagacacacuaaugaucucaagaacaccagaaguaacaugcguaguaguagaugucucacacgaagauccagaaguaaaauucaauugguacguagacggaguagaaguacauaacgcaaaaacaaaaccaagagaagaacaauacaacuccacauauagagucguaagcguauuaaccguacuucaccaagacugguuaaacggaaaagaauacaaaugcaaaguaucaaacaaagccuuaccugccccuauagaaaaaacaauauccaaagcuaaaggacaaccuagagaaccacaagucuauacccuaccaccuucacgugaagagaugacaaaaaaucaaguuucccuaacuugcuuaguaaaaggauucuacccuucagacauagcagucgaaugggaauccaacggacaaccagaaaacaacuacaaaacaacacccccaguacuagacucagacgguucauuuuuuuuauauucaaaacuaacaguugacaaaucaagauggcaacaaggaaauguauucucauguuccgucaugcacgaagcacuacacaaucacuauacccaaaaaucauuaucacuaucaccuggaaaa

SEQ ID NO: 51153 - RNA, 1365 nt, Artificial Sequence
  derived and/or modified sequence opt6 from anti-influenza_Chain
caaguacaauuaguagaaucaggcggaggaguaguccaaccaggaaaaucauuaagacuaucaugugcagcaucaggacuaacauuuucuucuuacgccguacacuggguuagacaagcaccaggaaaaggauuagaaugggucacauuaauaucuuacgacggagcaaaccaauacuaugcagacucaguaaaagguagauucacaauuucuagagacaacucaaaaaacacaguauacuuacaaaugaacucucuacgaccugaagauacagcuguauauuacugugcaguaccaggaccaguauucggaaucuucccaccauggucuuauuucgacaauuggggacaaggcauacuaguaacagucuccucagcaucaacuaaaggaccaucaguauuuccacuagcccccucauccaaaucuacaucaggaggaacagcugcucuagggugcuuagucaaagauuacuuuccagaaccagucaccguuucauggaauucaggugcucuaaccuccggaguacauacauucccagcuguacuccaaucuucaggauuauacucacucaguucaguuguaacaguaccaucaucaagucuugguacacaaacauacauauguaacguaaaccacaaaccauccaauacuaaaguagauaaaaaagucgaaccuaaaucaugugacaaaacacauacaugcccaccaugcccagcaccagaauuauuaggaggccccucaguauuucuauuccccccaaaaccaaaagacacacuaaugauuucaagaacaccagaaguaacauguguaguaguagauguuucucaugaagacccagaaguaaaauuuaauugguacgucgauggcguugaaguacacaacgcaaaaacaaaaccacgagaagaacaauacaacucaacuuaccgaguuguaucuguauuaaccguauuacaucaagacuggcuaaacgguaaagaauauaaaugcaaaguuucaaauaaagcacuacccgcaccaauagaaaaaacuauaucuaaagccaaaggucaaccaagagaaccacaaguauacacauuaccaccaagcagagaagaaaugaccaaaaaccaaguuucauuaaccugccuaguaaaaggauuuuauccuucagacauagcaguagaaugggaaucaaacggccaacccgaaaacaacuauaaaacaacuccaccaguacuagacucugacggaagcuuuuuucuauacagcaaacucacugucgacaaaucacgauggcaacaaggaaauguauucagcugcuccguaaugcacgaagcgcuucacaaucauuauacccaaaaaucacuaucacuaucccccggaaaa

SEQ ID NO: 51154 - RNA, 1365 nt, Artificial Sequence
  derived and/or modified sequence opt6 from anti-influenza_Chain
caaguacaacuuguagaaaguggaggaggaguaguucaaccaggaaaaucaccaagauuaucaugcgcagcaucaggaccuacuuuuucaucauacgccguccauuggguacgacaagcuccaggaaaaggacuagaaugggucacacuaauaucauacgauggagccaaccaauacuacgcagacucagucaaaggacgauuuacaauaucacgcgacaacucuaaaaauaccguuuauuuacaaaugaacucauuaagaccagaagacaccgcuguauacuacugcgcaguaccagguccaguauuugguauuuucccaccauggagcuacuuugauaacuggggacaaggaauauuagucacaguaucaucagcaucaacaaaaggaccaucaguauucccacuagcaccaucaucaaaauccacaucaggaggcacagcagcauuaggaugcuuaguaaaagacuauuuucccgaaccaguaacaguaucauggaacucuggcgcucuaaccucagguguccauacauuuccagcaguauuacaaucaagcgguuuauauucauuaucaucaguaguaaccguaccaucaucaagccuaggcacccaaacauacaucugcaauguuaaccacaaaccaucaaauacaaaaguagacaaaaaaguagaaccaaaauccugugacaaaacacacacauguccacccuguccagccccagaacuacuaggaggaccaucaguauuuuuauuccccccaaaaccaaaagacacacuuaugauaucacgcacacccgaagucacauguguuguaguagacguaucacacgaagauccagaaguaaaauucaacugguacgucgacgguguagaaguucauaacgcaaaaacaaagccaagagaagaacaauauaacucaacauacagagucguaucgguauuaacaguauuacaucaagacugguuaaacgguaaagaauacaaauguaaaguaaguaauaaagcccuacccgcuccuauagaaaaaacuaucuccaaagccaaaggacaaccacgagaaccacaaguuuauacacucccaccaucaagggaagaaaugacuaaaaaucaaguaucacuaacauguuuaguaaaaggauuuuacccaucagauauagcaguugaaugggaaucuaauggacaacccgaaaacaacuauaaaacaacaccccccguacuugacucagacggaucauuuuuccuauacucaaaauuaacuguagauaaaucacgauggcaacaggguaaugucuuuucauguucaguaaugcacgaagcauuacacaaccacuauacacaaaaaucacuauccuuaucacccggaaaa

SEQ ID NO: 51155 - RNA, 1365 nt, Artificial Sequence
  derived and/or modified sequence opt6 from anti-influenza_Chain
gaaguacaauuagucgaaucugguggaggcgucguacaaccaggaaaaucccucagacuauccugcgcagcauccggacuaacauuuucaucauaugcaguacacuggguaagacaagcaccugguaaagggcuagaauggguaacauuaauaucguacgauggugcaaaccaauacuacgcagacuccguaaaaggaagauucacaauaucacgagacaacucaaaaaacacaguauaccuccaaaugaacagccuaagaccagaagauacugcaguauacuacugugcaguuccuggaccaguauucggaaucuucccuccguggucauacuucgauaauuggggacaagguauauuaguaacagucuccucagcaucaacaaaaggacccuccguuuucccauuagccccaaguucaaaaucuacaucaggaggcacagcagcucuaggaugucucguaaaagacuauuucccagaaccaguaacaguaaguuggaacuccggugcacuaaccuccgguguacacacauuccccgcuguacuacaaagcucaggacuauauucccuaucaucaguuguaacaguaccauccucaucccuuggaacacaaacauacauuuguaacguaaaccacaaaccaucaaacacaaaaguugauaaaaaaguugaaccaaaaagcugcgacaaaacccauacuugcccuccuugcccagccccagaacuacuaggaggaccaucuguauuucuauuuccaccaaaaccaaaagacacacuuaugauuucaagaacaccagaaguaaccugcguuguaguugacguuucacaugaagacccagaaguaaaauuuaacugguauguagacggaguugaaguacacaacgcaaaaacaaaaccuagagaagaacaauauaacucuacauauagaguaguaagcguacuaacaguacuacaccaagauuggcuuaauggaaaagaauacaaauguaaaguaucaaacaaagcucuaccagcaccaauagaaaaaacaauaucaaaagcuaaaggccaaccaagagaaccacaaguuuacacacuaccaccaucuagagaagaaaugacaaaaaaucaaguaucccuaaccugccucguaaaaggauucuacccauccgacauugcaguagaaugggaaucaaacggucaaccagaaaacaauuacaaaaccacaccuccaguacucgacucagacggcucauuuuuuuuauacucaaaacuaaccguugacaaaucacgauggcaacaaggaaacguauucagcugcuccguaaugcacgaagcacuucauaaucacuauacucaaaaaucauuaucauuaucaccagguaaa

SEQ ID NO: 51156 - RNA, 1365 nt, Artificial Sequence
  derived and/or modified sequence opt6 from anti-influenza_Chain
caaguacaacucguacaaucaggagcagaauuaaaaagacccggagcaucaguaaaaguauccuguaaaacaucaggcuacucauucaauaacuacgguauaaacuggguacgucaagcccccggccaaggacuagaauggaugggauggauaucugcauacacagguaauacacacuaugcaaaaaauuucgaaggaagaguaaccuuaacaacagacacuucaacaucaaccgcauacauggaaguaagaucauuaagaucugacgacucagcaguuuauuuuugcgccagagcaaugauacaaggcgucguaacuuuauaccuaagacccggugauuacuggggacaaggcacauuaguaaccguaucaucagcaucaacaaaaggaccaucaguauuuccucucgccccauccagcaaaucaacaucaggaggaacagcagcacuaggaugccuaguaaaagauuacuuccccgaacccgucacagucucauggaacucuggagccuuaaccucaggaguucacacuuuuccagcuguauuacaaucaucuggucuauauucuuuaucaucugucguaacagucccuucaucauccuuaggaacacaaacuuauauaugcaacgucaaccauaaacccagcaauacaaaaguagauaaaaaaguagaaccaaaauccugcgauaaaacacacacauguccaccaugcccagcaccagaauuauuaggaggucccuccguauuucuauuccccccuaaaccaaaagacaccuuaaugauuucaagaaccccagaaguaacauguguuguaguagacguaucacaugaagauccugaagucaaauucaacugguaugucgauggaguagaaguacacaaugccaaaaccaaaccacgagaagaacaauauaauucaacauacagaguaguaucaguccuuacaguacuacaccaagauuggcuuaacggaaaagaauacaaaugcaaaguaucaaauaaagcacuccccgcaccaauagaaaaaacaauaucaaaagccaaaggacaaccaagagaaccacaagucuacacacuaccacccucaagagaagaaaugaccaaaaaucaaguauccuuaacuugccuaguaaaaggcuuuuacccaagugacauagcaguagaaugggaaucaaauggacaaccagaaaacaauuacaaaacuaccccacccguccucgauucugacggaucauuuuuccucuauuccaaauuaacaguagauaaaucaagauggcaacaaggaaacguauucaguuguucagucaugcaugaagcauuacacaaccacuacacacaaaaaagcuuauccuugucaccaggaaaa

SEQ ID NO: 51157 - RNA, 1365 nt, Artificial Sequence
  derived and/or modified sequence opt6 from anti-influenza_Chain
caaguacaacucguagaaucagguggaggaguaguacaaccaggaagaucccuaagauuauccugcgccgcuucuggauucgcauuucauaaccgagccaugcacuggguaagacaagcaccuggaaaaggcuuagaauggguugcgcuaauauauuucgacggaucuaaacaauauuaugcagacucuguuaaaggaagauucacaauaucucgcgacaacucaaaaaacacagucuuucuacaaaugaacucauuacgaccagaagacacugcaguauacuacugugccgucccaggaccaaucuuuggaaucuucccuccauggucauacuucgaccauuggggacaaggaauauuaguaacuguaagcucagcaucaaccaaaggucccucagucuuucccuuagcucccucaucaaaaucaacaucagguggaacagcagccuuaggauguuuaguaaaagauuauuuuccagaaccagucacaguaucauggaacucaggagcauuaacaucuggcguacacaccuuccccgcaguacuacaaucauccggacucuacucacuaucaucaguaguaaccguaccuucaucaagucugggaacacaaacauauauuugcaauguaaaucacaaacccucuaauacaaaagucgacaaaaaaguagaaccaaaaucaugcgacaaaacacacacuugcccaccaugcccagcaccagaacuacuaggaggcccaucaguauuccuauucccacccaaaccaaaagacacauuaaugauaucacgaacacccgagguaacuugcguaguaguagacguaagccacgaagauccagaaguaaaauucaauugguacguagacggaguagaaguacacaacgcaaaaacaaaacccagagaagaacaauacaacuccacauacagaguaguaucaguacuaacuguauuacaucaagauuggcuaaacggaaaagaauauaaauguaaagucuccaauaaagcacuaccagcaccaauugaaaaaacuauaucaaaagcaaaaggacaaccacgcgaaccacaaguauacacacuaccaccaucaagagaagaaaugacaaaaaaucaaguaucacuaacaugccuagucaaagguuucuacccuucagacauagcaguugaaugggaaagcaacggacaaccagaaaacaacuacaaaaccacuccaccuguacuagacucagacggcucauucuuucuauacucaaaacuaacaguagacaaauccagauggcaacaaggaaauguauucucaugcucaguaaugcacgaagcacuacacaaucauuacacccaaaaaagucucucacuaucaccagguaaa

SEQ ID NO: 51158 - RNA, 1365 nt, Artificial Sequence
  derived and/or modified sequence opt6 from anti-influenza_Chain
gaaguacaacuaguugaaucaggaggcggaguaguacaacccggaagaagucuaagauuauccugcgcagcaucagguuuugcauuucacaaucgugcaaugcacuggguccgucaagcacccggaaaaggauuagaauggguagcacuaaucuacuucgauggaucaaaacaauacuacgccgacuccguaaaaggaagauucacaaucucaagagacaacuccaaaaacacaguauucuuacaaaugaacucacuacgcccagaagacacagcaguauauuauugcgcaguuccuggacccauauucgguauauucccaccauggucuuauuucgaccauuggggccaaggaauauuaguaacaguaucaucagcaucaacaaaaggaccaucaguauucccauuagcacccucauccaaauccacauccggagguacagcagcucuaggaugccucguaaaagauuacuuuccagaaccaguuacagucucauggaacucaggcgcucuaaccucaggcguccacacauuccccgcaguacuacaauccucaggucuuuacucauuaucgucaguaguuacaguacccucaucuagcuuaggaacacaaacauacaucuguaauguaaaucauaaaccuucaaauacaaaaguagacaaaaaaguagaaccaaaaucuugcgacaaaacccauacaugcccaccaugcccagcaccagaacuuuuaggcggaccaucaguauuccuauucccucccaaaccaaaagacacacuaaugauuucaagaacaccagaaguaacuuguguaguaguagacguaucacaugaagauccagaaguaaaauucaauugguacguagacggaguagaaguacacaacgcaaaaacaaaaccacgagaagaacaauacaacucaacauacagagucguaucuguauuaacaguccuccaccaagacuggcucaacggaaaagaauacaaaugcaaagucucaaauaaagcacuacccgcaccaauugaaaaaacaauaucuaaagcaaaaggacaaccacgugaaccacaaguauauacacuuccaccuuccagagaagaaaugacaaaaaaccaaguaucauuaacaugcuuagucaaaggcuuuuaucccagugacauagcaguagaaugggaaucaaacggacaaccagaaaacaacuacaaaacaaccccaccaguucucgauucagauggcucauucuuccuauauuccaaauuaacaguagacaaaucuagauggcaacaaggaaauguauucagcuguucaguaaugcacgaagcacuccacaaccauuacacccaaaaaucccuaucacuaucuccaggaaaa

SEQ ID NO: 51159 - RNA, 1365 nt, Artificial Sequence
  derived and/or modified sequence opt6 from anti-influenza_Chain
gaaguacaauuaguccaauccggaggaggaguaguacaaccaggaaaaucacuacgcuuaucaugcgcagcuuccggcuuaacauucucaucauacgcuguacauuggguacgacaggcaccuggaaaaggacuugaauggguaacauuaauauccuacgauggcgcuaaccaauacuacgcagacagcguaaaagguagauucacaauaucuagagauaacucuaaaaauacaguuuaccuacaaaugaauaguuuaagacccgaagacacggcaguuuauuacugcgcaguuccaggaccuguauucggaauauucccaccauggucauacuuugauaacuggggacaaggaauccuaguaacagucuccucagcuucaacaaaaggaccaucaguuuucccauuagcaccauccucaaaaucaacuucaggaggaacagcagcacucggaugccuaguaaaagacuauuucccagaaccaguuacaguaagcuggaacucuggagcacuaacaucaggaguacauaccuuuccagccguacuacaaucaucaggacuauacucccuaucuuccguugucacaguaccuucaucaucacuaggcacacaaacauauauaugcaacguaaaccacaaaccaucaaacacaaaaguagacaagaaaguagaacccaaauccugcgacaaaacccauaccugcccaccaugcccagcuccagaauuacuaggaggaccaucaguauuccuauucccaccaaaacccaaagacaccuuaaugaucucaagaacaccugaaguaacaugcguaguaguagauguuucacacgaagaucccgaaguaaaauucaacugguauguagauggaguagaaguacacaaugccaaaacuaaaccaagagaagaacaguauaacucaacauacagaguuguaucaguccuuaccguauuacaccaagacugguuaaacggaaaagaauacaaaugcaaaguaucaaacaaagcacuucccgcuccaauagaaaagacaauaucaaaagcaaaaggacaaccaagagaaccacaaguauacacuuuaccuccaucuagagaagaaaugacuaaaaaucaaguaucauuaacaugcuuagucaaaggauuuuacccaucagacauagcaguagaaugggaaucaaacggucaacccgaaaauaacuacaaaacaacaccaccaguacuagacucagacgguucauucuuucuauauucaaaauuaacaguagauaaaucaagauggcaacaaggcaacgucuuuucauguucaguaaugcaugaagccuuacacaaccacuacacccaaaaaucauuaucauuaagcccaggaaaa

SEQ ID NO: 51160 - RNA, 1365 nt, Artificial Sequence
  derived and/or modified sequence opt6 from anti-influenza_Chain
caaguacaacucguagaaagcggcggaggaguaguacaaccaggcaaaucccuacgcuuaucaugugcugcaaguggacucacauuuuccuccuacgcaguacacuggguacgacaagcacccgguaaaggacuagaauggguaacuuuaaucuccuacgacggagcgaaccaauacuaugccgauucuguaaaaggaagauuuacaauaucaagagacaauagcaaaaacaccguauaccuacaaaugaauucucuaagaccagaagacacagcaguauacuacugcgcaguacccggaccagucuuuggaauauuuccacccuggucauacuucgacaacuggggacaaggaauacuaguaacaguaucaagugcaucaacaaaaggacccucaguauuuccuuuagcaccaucuucaaaaagcacuucaggaggaacagcagcauuaggauguuuaguaaaagacuacuucccugaacccgucacaguaucauggaauucaggagcacuaacuaguggaguccauacauucccagcaguacuacaaucaucaggauuauauucccuaucaucagucguaacaguaccauccaguucauuaggaacccaaacauauaucugcaacguaaaccacaaacccucaaauacaaaaguagauaaaaaaguugaacccaaaucaugcgacaaaacacacacuugcccaccaugccccgccccagaauuacuagguggcccaucaguauuccuauucccuccaaaaccaaaagacacccuuaugauaagcagaacaccagaaguaacuuguguaguaguagacguaucccaugaagacccagaagucaaauucaacugguacguagacggcguagaaguucacaaugcaaaaaccaaaccaagagaagagcaauauaacagcacauaucgaguaguaucaguucucaccguacuacaccaagacuggcuaaacggaaaagaauacaaauguaaagucucaaacaaagcucuaccugcaccaauagaaaaaacaaucucuaaagcaaaaggacaaccuagagaaccacaaguauacacacuaccaccaucaagagaagaaaugaccaaaaaucaaguuucccuaacaugucucguaaaaggcuuuuacccuagugacauagcagucgaaugggaaucaaauggacaaccagaaaacaauuacaaaacaacaccaccaguccuagacucagacggauccuuuuuuuuauacucaaaauuaacaguagacaaaucacgauggcaacaaggaaacguauucucuugcucaguaaugcacgaagcauuacauaaucauuacacucaaaaaucacugucacuaagcccaggaaaa

SEQ ID NO: 51161 - RNA, 1365 nt, Artificial Sequence
  derived and/or modified sequence opt6 from anti-influenza_Chain
caaguacaacuuguagaaucaggcggcggaguaguacaaccaggaaaaagcccucgauuaucuugugcagcaucuggaccaaccuuuuccucauaugcaguacacuggguaagacaagcaccaggaaaaggauuagaauggguaacucuaauaucauacgacggugccaaccaauacuacgcagacucaguuaaaggucguuuuacuauaucaagagacaacuccaaaaauaccguauaccuacaaaugaacucauuaagaccagaagacaccgcaguauacuauugcgcuguuccaggacccguuuuuggcauauucccaccauggucuuacuuugauaauuggggucaaggaauauuaguuacuguaagcuccgcaucaaccaaaggaccaucaguauuuccacuagccccaucaucuaaaagcacaagcggaggaacagcugcacucggaugucucguaaaagacuacuuucccgaaccaguuacuguuucauggaacuccggagcucuaacaucaggcguacauaccuucccagcuguauuacaaucaucaggauuauacucucucucaucaguggucacaguaccuucuucaucacuagggacacaaacauacaucuguaacguaaaccauaaaccaucaaauacaaaaguagacaagaaaguugaaccaaaaagcugugacaaaacacauacaugucccccaugcccagcaccugaacuauuaggaggacccuccguauuccuauuuccaccaaaacccaaagauacacuaaugauaucuagaacaccagaaguaacaugcguuguaguagacgucucccaugaagaccccgaaguaaaauucaacugguauguagauggcguugaaguacacaacgcaaaaaccaaaccccgagaagaacaauacaauagcacauauagaguaguuucaguacucacuguauuacaccaagauuggcuaaacggaaaagaauauaaauguaaagucucaaacaaagcacuaccagcaccaauagagaaaacaauaucaaaagccaaaggacaaccaagagaaccacaaguauauacauuaccaccauccagagaagaaaugaccaaaaaucaaguaucauuaacauguuuaguaaaaggauuuuacccaucagauauugcaguagaaugggaauccaacggacaaccagaaaacaacuacaaaacaacacccccuguauuagacucagacgguucuuucuuuuuauacucaaaacuaacaguagauaaaucacgauggcaacaagguaacguauuuaguuguucagucaugcacgaagccuuacacaaucauuauacacaaaaaucuuuaucauuaucaccaggaaaa

SEQ ID NO: 51162 - RNA, 1365 nt, Artificial Sequence
  derived and/or modified sequence opt6 from anti-influenza_Chain
gaaguacaauuaguagaaucaggaggaggagucguacaacccggaaaaucacuacgccuaagcugugcagcaucaggacuaacauucucaucuuaugcaguccauuggguaagacaagcaccaggaaaaggauuagaauggguaaccuuaauaucauaugacggugcuaaccaauacuacgccgacuccguuaaaggacgauucacaauaucaagagauaacucaaaaaauacagucuacuuacaaaugaauucacuacgucccgaagauacagcaguuuauuauugcgcaguaccaggucccguauucggaauauuuccaccauggucauacuuugacaauuggggucaaggaauacucguuacaguaucuagcgcaucaacaaaaggaccuucuguauucccacuagcaccaucaucuaaaucaaccucaggagguacagccgcacuagguuguuuaguaaaagacuauuucccagaaccuguaacaguaucuuggaacuccggagcauugaccucuggaguucacacauuucccgcuguacuucaaucaucuggacuuuauucuuuauccucuguaguuaccguaccaucaagcucacuaggaacacaaacauacauauguaacguuaaccauaaacccucaaacacaaaaguagacaaaaaagucgaacccaaaucaugugacaaaacacauacaugcccaccaugcccagcaccagaacucuuaggagguccuuccguauuccuuuuuccuccaaaaccuaaagacacccuuaugauuucaagaacaccagaaguaaccugcguaguaguugacguaucucacgaagacccagaaguaaaauucaacugguaugucgacggaguagaaguccacaaugcaaaaacuaaaccaagagaagaacaauacaauagcacauaccgaguaguaucugucuuaacaguacuacaucaagacuggcuaaacggaaaagaauacaaaugcaaaguaucaaacaaagcacuaccagcaccaauagaaaaaacaauauccaaagccaaaggacaaccaagagaaccacaaguauacacacuaccaccaucaagagaagaaaugacaaaaaaucaaguaucacucacauguuuaguaaaagguuuuuacccaucagacauagcaguagaaugggaaucuaauggucaaccagaaaauaauuacaaaacaacuccuccugucuuagacucagacggaucuuuuuuccuauacucaaaauuaacaguagauaaaucaagauggcaacaaggaaacguauucagcuguucaguaaugcacgaagcccuacacaaucacuacacacaaaaaagucucucacucucacccggaaaa

SEQ ID NO: 51163 - RNA, 1365 nt, Artificial Sequence
  derived and/or modified sequence opt6 from anti-influenza_Chain
caaguacaacuaguacaauccggagcagaauuaaaacgaccaggugcauccguaaaaguaucauguaaaacuucaggauacaguuucaauaacuacggaaucaauugggucagacaagcaccaggacaaggauuagaauggaugggcuggaucuccgcuuacaccggaaauacacacuaugcaaaaaacuuugaaggaagaguuacacuuacaacagauacuucaacaucaacugcauacauggaaguacgcucacuaagaucagaugacucagccguauacuuuugcgccagagcaaugauacaaggaguaguaacccucuaccuaagaccaggagauuauuggggccaagguacauuaguaacaguauccucagcauccacaaaaggcccauccguauucccccuagccccaucaucuaaauccacaucuggaggaacagcagcacucggaugccuaguaaaagauuauuuuccagaacccguaacaguaucauggaacucaggagcucucacaucaggcguacacacauuucccgcaguacuacaaagcuccggauuauacucauuaucaucuguaguaacaguaccauccucuucauuaggaacacaaaccuacauaugcaacguuaaucauaaaccaucaaacacaaaaguagauaaaaaaguagaaccaaaaucaugcgacaaaacacacacauguccaccaugcccagccccagaacuuuuagguggaccuuccgucuuuuuauuuccacccaaaccaaaagauacauuaaugauaagcagaacaccagaagucaccuguguaguuguagacguaucacacgaagacccagaaguaaaauuuaacugguacguagauggaguagaaguacauaacgcaaaaacaaaaccaagagaagaacaauauaacucaacauacagaguaguaaguguccucacaguucuacaccaagacuggcucaaugguaaagaauauaaaugcaaaguaucaaacaaagcccucccugcaccaauagaaaaaacaauuuccaaagccaaaggacaaccaagagaaccacaaguauacacauuaccuccaucccgagaagaaaugaccaaaaaucaaguaucacuaaccugccuaguaaaaggauucuacccaucagacauugcagucgaaugggaaagcaauggacaaccagaaaacaacuacaaaacaacaccaccaguacuagauucagacggaaguuucuuucuauacuccaaauuaaccguagacaaauccagauggcaacaaggaaacguauuuucauguucaguaaugcacgaagcauuacacaaccacuauacacaaaaaucacuaucacucagcccaggaaaa

SEQ ID NO: 51164 - RNA, 1368 nt, Artificial Sequence
  derived and/or modified sequence opt6 from anti-influenza_Chain
gaaguccaacuuguacaaagcggaggaggaguaguacaaccacgaagaucauuaagacuaucuugugcagcuucaggauucacauucucuucauaugcaaugcauuggguaagacaagcaccuggaaaaggccuugaauggguugcaguaauauccuacgaugguagaaacaaauauuaugcagauucaguuaaaggacgauuuacagucagcagagacaacucaaaaaacacucuuuaccuccaaaugaauucacuacgcgcagaagauacaucuguauacuacugcgcaagagaauuacuaauggauuacuaugaccauauuggauacucacccggaccaacauggggacaagguaccuuagucaccguaucuuccgcauccacaaaaggaccuucuguauuuccacuagccccaucaucaaaaucaacuucuggaggaacugcagcccuaggaugccuaguaaaagauuauuuccccgaaccaguaacaguuagcuggaauucaggagcauuaaccuccggaguucacacauucccagccguuuuacaauccucaggccucuauucauuauccucagucguaacaguaccuucaucaucuuuaggaacacaaaccuacauaugcaacguaaaccacaaacccucaaauacaaaaguagacaaaagagucgaaccuaaaucaugugauaaaacacauacuugcccuccaugcccagcaccagaauuauuaggaggacccucaguauuucuauuucccccaaaaccaaaagacacacuuaugaucagcagaacaccagaaguaacaugcguaguaguagauguaucucacgaagacccagaaguaaaauucaauugguaugucgacggaguagaaguacacaacgcaaaaacaaaacccagagaagaacaauauaacuccaccuaucgaguagucucuguauuaacagucuuacaccaagauugguuaaauggaaaagaauauaaauguaaaguaaguaacaaagcauuaccugcaccaauagaaaaaacaauaucaaaagcuaaaggacaaccaagagaaccacaaguauauacacuacccccaucaagagaagaaaugacaaaaaaucaaguaucacuaacaugucuaguuaaaggauucuaccccucugacauagcuguagaaugggaaucaaacggacaaccugaaaacaauuacaaaacaacaccaccaguauuagauucagauggaucauuuuucuuauauucaaaacuaacaguugacaaaucuagauggcaacaaggaaauguuuuuucaugcucaguaaugcacgaagcucuacauaaccauuacacacaaaaaucacuuucacuaucccccggaaaa

SEQ ID NO: 51165 - RNA, 1371 nt, Artificial Sequence
  derived and/or modified sequence opt6 from anti-influenza_Chain
augguaauacaaaggaacaguauacuacuacuaaucaucauauucgcaucaucaauaucaacaugucgaucaaacguaauagaugacaaccuauuuaaacaaguauacgacaacauacuagaacaagaauuugcccacgacuuccaagcauauuuaagcuaccuaucgaaaaacauagaaaguaauaauaacauagauaaaguagauaaaaauggaauaaaaguaauaaacguacuaucguucggagcaaaaggagauggaaaaaccuaugacaacauagcauucgaacaagcauggaacgaagcauguuccaguagaacccccguacaauucguaguacccaaaaacaaaaacuaccuauuaaaacaaauaacauuuucaggaccauguagauccucaauaucaguuaaaauuuucggaucuuuagaagcaagcucaaaaauaucagacuacaaagacagacgauuauggauagccuuugacucaguacaaaaucuaguagucggcggagguggaacaaucaacggaaacggccaaguaugguggccaucaucaugcaaaauaaauaaaucuuuaccuugcagagacgcaccaaccgcccuaaccuucuggaacugcaaaaaccuaaaaguaaacaaccuaaaaaguaaaaacgcacaacaaauacacauaaaauucgaaucaugcacaaacguaguagcaucaaacuuaaugauaaacgcaucagcaaaaucaccaaacacagauggaguacauguaucaaacacacaauacauacaaauaucagacacaauaauaggaacaggagacgacugcauaagcauaguaagcggaucacaaaacguacaagcaaccaacauaacauguggcccaggacacggaauaucuauaggcagccucggcucaggaaacagcgaagcauacguaucaaacguaacaguaaaugaagcaaaaauaauaggagcagaaaacggaguccgaauaaaaaccuggcaaggaggaucaggacaagcaagcaauauuaaauuccugaacguagaaaugcaagacguaaaauacccaauaauaauagaucaaaauuacugcgacagagucgaacccugcauccaacaauucagcgcaguccaaguuaaaaacgucguauaugaaaauauaaaaggaacuucagcaacaaaaguagcaauaaaauucgacugcaguacaaauuuuccaugugaaggaauaauaauggaaaacauaaaccucguaggagaaagcggaaaaccaucagaagcaacaugcaaaaauguacacuuuaauaacgccgaacacguaacaccacacuguacaucucuagaaauaucagaagacgaagcacuacuauacaauuac

SEQ ID NO: 51166 - RNA, 1371 nt, Artificial Sequence
  derived and/or modified sequence opt6 from anti-influenza_Chain
augguuauacaaagaaacucaauacuacuacuaauaauaauauucgcaucaucuauaucaacauguagaucaaacguaauagacgauaauuuauuuaaacaaguauacgacaacauauuagaacaagaauuugcacacgacuuccaagcauaccuaucauaccuuucuaaaaauauagaaucaaacaauaauauagacaaaguugacaaaaacgguauaaaaguaauaaacguacuaucauucggagcaaaaggugacggaaaaacauaugacaacauagcauucgaacaagcauggaacgaggcuugcucaucacgaacuccuguacaauucguagucccuaaaaauaaaaacuacuuauuaaaacaaaucacauucucagguccaugcagaucaucaauaucaguaaaaaucuucggaucuuuagaagcaucaucaaaaauaagcgacuacaaagaccgacgacuauggauagccuucgacucaguacaaaaucuaguaguaggaggaggaggaaccauaaacggaaacggccaaguaugguggccaucaagcuguaaaauuaacaaaucacuaccaugcagagacgcaccaacagcccuaacuuucuggaacuguaaaaacuuaaaaguaaauaaccuaaaaagcaaaaacgcccaacaaauacacauaaaauucgaaucaugcacaaaugugguagcaagcaaccuaaugauaaacgcaucugcaaaaagcccaaacacagacggaguccacgucuccaauacacaauauauacaaaucucagacacaaucauaggaacaggagacgacuguauaucaauagucucuggaucacaaaauguacaagcaaccaacauuacaugcggaccaggacacggaauaucaauaggaucauuaggaucaggaaauucagaagcauauguaucaaacguuacaguaaacgaagcaaaaauaauaggagcagaaaacggaguaagaauuaaaacuuggcaaggagguagcggacaagccucaaacauaaaauuucuaaacguagaaaugcaagaugucaaauacccaaucauaaucgaucaaaacuauugugacaggguagaaccauguauacaacaauuuucagcaguacaagucaaaaacguaguauaugaaaauaucaaagguacaagugcaacuaaaguagcaauuaaauucgauugcucuaccaacuucccaugcgaaggaauaaucauggaaaauauaaaccuaguaggagaaucaggaaaaccauccgaagccacaugcaaaaacguacacuucaacaaugcagaacacguaacaccacauugcacaucacuagaaauaagugaagacgaagcacuacuauacaacuac

SEQ ID NO: 51167 - RNA, 1380 nt, Artificial Sequence
  derived and/or modified sequence opt6 from anti-influenza_Chain
augaaauuauggcuaaauuggaucuucuuaguaacacuccuaaacgauauacaaugcgaaguaaaacuuguugaaucagguggaggauuaguccaaccaggaggaucuuuaagauuauccugcgcaaccucuggauuuacauuuucagacuacuauaugucauggguaagacaaucaccaggaaaagcacuagaauggcuaggauuuacaagaucuagaguacuaggauacacaacagauuauuccgcaucaguaaaaggaagauucacuauaucaagagauaacucacaaucaauacuuuacuuacaaaugaacucacuaagaggagaagauucagcaacuuacuauugcgcgagagauagaccaauggauuacuggggacaaggaacuucaguaacagucucaucagcaaaaacaaccccacccucaguauacccucuagcccccggaucagccgcacaaacaaauucuauggucacacuaggcugcuuagucaaagguuauuucccagaaccaguaacuguaacauggaauucaggauccuuaagcaguggaguacacacauuccccgcaguccuacaaucagaucucuauacacuaucaucauccguaacaguaccaucuuccacauggccuuccgaaacaguuacaugcaacguagcacauccagcaucaucaacaaaaguagacaaaaaaauaguacccagagacugcggauguaaaccuugcauauguacaguaccugaaguuucauccgucuuuauauucccaccaaaaccaaaagacguacuaacaauaacacuaacaccaaaaguaacauguguaguaguagauauaucaaaagaugacccugaaguacaauuuucaugguuuguagaugacguagaaguacauacagcacaaacacaaccaagagaagaacaauucaauucaacuuucagaaguguaagcgaacuaccaauuaugcaucaagauugguuaaauggcaaagaauuuaaauguagaguuaacucagcagcauucccagcacccauagaaaaaacaauaucaaaaacaaaaggaagaccaaaagcaccacaaguauacacaauaccaccaccaaaagaacaaauggcaaaagauaaaguuucauuaacaugcaugauaacugacuucuuuccagaagacauuacaguagaauggcaauggaacggccaaccagcagaaaauuauaaaaauacacagccaaucauggacaccgacggaaguuacuucguauauucaaaauuaaauguucaaaaaaguaacugggaagccggcaauaccuuuacauguucaguacuacaugaagguuuacauaaucaucacacagaaaaaucacugucacacucuccaggaaaa

SEQ ID NO: 51168 - RNA, 1380 nt, Artificial Sequence
  derived and/or modified sequence opt6 from anti-influenza_Chain
augaaacuaugguuaaauuggauuuuuuuaguuacauuauuaaaugacauacaaugcgaaguaaaauuaguagaaaguggaggaggacucguccaaccaggaggaucucuacgacuaucuugcgcaacauccggauucaccuuuuccgacuacuacaugucuuggguacgccaaucaccaggaaaagcauuagaaugguuaggauuuaccaggucaagaguauuaggauauacaaccgacuacucagcaucaguaaaaggcagauucacaauaucacgagacaauucccaaucuauauuauacuuacaaaugaacucauuaagaggagaagauucugcaacauauuacugugcacgagauagaccaauggauuacuggggucaaggaacuucagucaccguaucaagcgcaaaaaccacuccaccaucagucuacccccuagcaccaggauccgcagcacaaacuaauucaauggucacucuaggaugccuaguaaaagguuacuucccagaaccuguaaccguaaccuggaauucaggaucauuauccuccggcguacacaccuucccugcaguacuccaauccgaucuauauacacuaucuucaucaguaacuguaccaucaucaacauggcccucagaaacaguaacauguaacguagcacauccagcuucaucaaccaaaguagauaaaaaaauaguuccaagagacuguggauguaaaccuugcauauguacaguaccagaaguaucaucagucuuuauauuuccaccaaaacccaaagaugucuuaacaauaacuuuaacaccuaaaguaacauguguagucguagauaucucaaaagaugacccagaaguccaauuuucaugguucguagaugauguagaaguucauacagcacaaacucaaccaagagaagaacaauucaacucaaccuuuagauccguuagugaauuaccaauaaugcaccaagacugguuaaacggaaaagaauuuaaaugcagaguaaauagugccgcauucccugccccuaucgaaaaaacaauaucuaaaacaaaaggaagaccaaaagcaccacaagucuauacaauaccaccacccaaagaacaaauggcaaaggacaaaguaucauuaaccuguaugauuacagacuucuuuccagaagacauuaccguagaauggcaauggaacggucaaccugcagaaaacuacaaaaacacacaaccaauaauggauacagacggaucauauuucgucuacuccaaacuaaauguccaaaaaucuaacugggaagcaggaaauaccuucacuuguucaguuuuacaugaaggcuuacacaaccaucacacugaaaaaucacuuucacacucucccggcaaa

SEQ ID NO: 51169 - RNA, 1386 nt, Artificial Sequence
  derived and/or modified sequence opt6 from anti-influenza_Chain
auggaauggagcuggauauuucuauuucuauuaucaggaacagcaggaguacauucagaaguucaauuacaacaauccggaccagaacuuguaaaaccaggagcaagcguaaaaaugucaugcaaagcuucaggauacacauucacaucauacguuaugcacuggguaaaacaaaaaccaggacaaggacucgaauggauaggauauauaaaccccuauaacgacggaaccagauacaaugaaaaauuccgaguaaaagcaacacuaacaagcgacaaaucaucaucaacagcauacauggaauuaucaucacuaacaagugaagacuccgccguuuauuacugcgcaagaagaggacuaauaacaacaccaacauuagauuacuggggucaaggcacuacauuaacaguauccucagcaaaaacaacaccuccauccguauauccauuagccccaggauccgcagcacaaacaaauucaaugguuacuuuaggcugccucguaaaaggauauuuccccgaaccuguuaccguaacauggaauucuggaucauuaucauccggaguacacacuuuuccagcaguacuacaaagcgacuuauacacacuaagcucaucaguaacaguaccauccucuacauggccaucugaaaccguaacaugcaacguagcacacccugcaucaucgacaaaaguagacaaaaaaauuguaccaagagauugcggaugcaaacccuguauaugcacagucccagaaguaucauccgucuuuaucuuccccccaaaaccaaaagacguauuaaccauaaccuuaaccccaaaaguaacuugcguaguaguugacauaucaaaagacgacccagaaguacaauucucauggguagacgacguagaaguacacacugcacaaacacaaccaagagaagaacaauuuaacucaacauucagaucaguuucagaacuaccaauaaugcaccaagacuggcuuaauggaaaagaauucaaaugccgagucaacucagcagcauucccagccccaaucgaaaaaacaauaagcaaaacaaaaggaagaccaaaagcaccacaaguauacacaauuccacccccaaaagaacaaauggcaaaagacaaaguaucucuaacauguaugauuacagacuuuuucccagaagauaucacaguagaauggcaauggaacggacaaccagcagaaaauuacaaaaacacccaaccaauaauggacacugacggaucauacuucguauacucaaaauugaauguacaaaaaucaaacugggaagcaggaaacacauucacauguagcgucuuacacgaaggauuacacaaccaucauacagaaaaaucuuuaucacacucaccaggaaaa

SEQ ID NO: 51170 - RNA, 1386 nt, Artificial Sequence
  derived and/or modified sequence opt6 from anti-influenza_Chain
caaguacaacucguccaauccggcgcagaaguaaagaaaccaggcgcaucagucaaagucucaugcaaaaccucaggcuacacauucacagccuacacaauccacuggguaagacaagcaccaggacaaagacuagaauggaugggauggauaaacgcaggaaacggacacacaaaauacucacaaagauucaaaggaagggucacaaucaccagagauacaucugcaagaacaacauacauggaauuaagaucacuaacaucagaagauacugcauuauacuucugcgcaagaggacccgaaacauacuacuaugacaaaaccaacugguuaaacucacauccugacgaauacuuccaacauuggggacacggcacacaaguaacagucucaucugcaucuacaaaaggaccaucaguauucccacucgcaccaucauccaaaucaacaucaggaggaacugcagccuuaggcugccuuguaaaagauuacuuuccagaaccaguuacaguaucauggaacucuggagcacuaaccucaggaguacacacuuucccagcuguacuucaauccucaggcuuauacucacuaucaucaguaguaacaguacccuccucaucacucggcacacaaaccuauauauguaacguaaaccacaaaccaucaaacaccaaaguagacaagaaagucgaaccuaaaucaugugacaaaacacauacaugcccuccauguccagcacccgaauuauuaggcggaccaucaguauuucuauucccaccaaaacccaaagacacauuaaugauaucaagaacaccagaaguaacaugcguaguaguagacguaucacacgaagaucccgaaguaaaauuuaacugguaugucgacggaguagaaguccauaaugccaaaaccaaacccagagaggaacaauacaauucuacuuaccgagucguaucaguauuaacaguccuacaucaagauuggcuaaacgguaaagaauacaaauguaaaguaaguaauaaagcacuaccagcaccgauagagaaaaccauauccaaagcaaaaggacaaccaagagaaccacaaguauacacauuaccaccaucaagagacgaauuaaccaaaaaucaaguuagccuaacaugccucguuaaaggauucuauccuucagauauagccguagaaugggaauccaacggacaaccagaaaacaacuacaaaacaacaccuccaguacuagacucugacggcuccuucuuccuauacaguaaauuaaccguagauaaaucaagauggcaacaagguaacguauucucaugcuccguaaugcacgaagcauuacacaaccauuacacacaaaaaucauuaucauuauccccaggaaaa

SEQ ID NO: 51171 - RNA, 1386 nt, Artificial Sequence
  derived and/or modified sequence opt6 from anti-influenza_Chain
caaguucaauuaguacaauccggagccgaagucaaaaaaccuggagccaguguaaaagucucauguaaaacaaguggauacacauuuacugcauacacaauacacuggguaagacaagcacccggccaacgacuagaauggaugggcuggauuaaugcaggaaauggucacacaaaauauucucaaagauucaaaggaagagucacaauaacccgagacacaucagccagaacaacauacauggaauuaagauccuuaacaucugaagacacagcuuuauacuucugcgcaagaggacccgaaacauacuacuaugacaaaacaaacuggcucaacucacauccagacgaauacuuucaacauuggggucacggcacacaaguaacagucucuucagcaucaacaaaaggaccuuccguuuucccacuagcaccaucauccaaaucaaccucaggaggaacagcagcauuaggauguuuaguaaaagacuacuucccugaaccaguaacaguaucauggaauagcggagcauuaacauccggaguucacacauuuccagcagucuuacaaucaucaggauuauauucucucucaagcguaguuaccguaccauccucaagccucggaacccaaacauauauaugcaauguaaaccacaaaccauccaauacaaaaguagacaaaaaaguagaaccaaaaucuugcgacaaaacacacaccugcccaccaugucccgcaccagaacuauuaggagguccaucaguauuucuauuucccccuaaaccaaaagauacucuuaugauaucaagaacaccagaaguuaccuguguaguuguagauguaucacacgaagacccagaagucaaauuuaacugguacguagacggaguagaaguccauaacgcaaaaacaaaaccaagagaagaacaauacaauucaacauauagaguaguaucaguacuaacagucuuacaccaagacugguuaaacggaaaagaauacaaauguaaaguauccaauaaagcuuuaccagcuccaauagaaaaaaccauaagcaaagcuaaaggacaaccacgagaaccacaagucuacacauuaccacccuccagagaugaacuaaccaaaaaucaagucucauuaacaugucuuguuaaaggcuucuauccaucagacauagcaguagaaugggaaucaaacggucaaccagaaaauaauuacaaaacaacuccaccagucuuagacuccgacggauccuuuuucuuauacaguaaacuaacaguagacaaaucccgauggcaacaaggaaacguauucagcugcagugucaugcacgaagcucuccacaaccacuacacucaaaaaucccuaucauuaucaccgggcaaa

SEQ ID NO: 51172 - RNA, 1386 nt, Artificial Sequence
  derived and/or modified sequence opt6 from anti-influenza_Chain
auggaauggucauggaucuucuuauuucuccuaucaggaacugcagguguacauucagaaguccaacuacaacaauccggaccugaacuaguaaaaccaggcgccuccguaaaaaugucuugcaaagcauccgguuacaccuuuacaagcuacguaaugcacuggguuaaacaaaaacccggacaaggucuagaauggaucggauacauaaacccauauaaugacggaacaagauacaaugaaaaauucagaguuaaagcaacacuaacaagcgauaaaucaucaucaaccgcauacauggaauuaucaucccuaacaucagaagacucagcaguauacuacugcgcacgacgaggacuaauaacaacaccuacuuuagacuacuggggucaaggaacuacauuaacaguauccucagcaaaaacaacaccaccaaguguauacccacuagcacccggaucagcagcacaaaccaacucuaugguaacauuaggauguuuagucaaaggcuacuucccagaaccaguaacaguaacauggaauucuggaucauuauccucaggaguacacacauuccccgcaguccuacaauccgacuuauauacauuauccucaagcguaacaguaccaucauccacauggccaagcgaaacaguaacaugcaacguagcccauccagcaucaucuacaaaaguagacaaaaaaauagucccaagagacugcgguugcaaaccuugcauaugcacaguaccagaaguaucaagcguuuuuauuuuccccccaaaaccuaaagacgugcuaaccauuacauuaacaccaaaaguaacaugugucguaguagauauaucaaaagaugaucccgaaguacaauucagcugggucgaugacguagaaguccauacagcccaaacucaaccacgagaagaacaauuuaacuccacauucagaucaguaucugaacuaccaauaaugcaccaagacuggcuuaacggcaaagaauucaaauguagaguaaacucagcagcauuccccgcacccauagaaaaaacaauaagcaaaacaaaaggccgaccaaaagcaccacaaguauacacaaucccaccaccaaaagaacaaauggcaaaagauaaaguaucccuaacauguaugauaaccgacuucuucccagaagauauaacagucgaauggcaauggaacggacaacccgcagaaaacuacaaaaauacccaaccaauaauggauacagacggauccuacuucguauauuccaaacuuaacguacaaaaaucuaacugggaagccggaaauacuuucacaugcuccguccuacacgaaggguuacacaaccaccacacagaaaaaucucuuucacauucaccaggaaaa

SEQ ID NO: 51173 - RNA, 1398 nt, Artificial Sequence
  derived and/or modified sequence opt6 from anti-influenza_Chain
augcuuccgucaaccguacaaacauuaacauuauuauuaacuagcgguggagucuuacuaucucucuauguaucagccagcuuaagcuauuuacuauauagugaugucuuacuaaaauuuagcagcacaaaaacuacugcaccaacaaugucauuagaauguacuaacgcaucaaacgcacaaacaguaaaccauucagcgacaaaagaaaugacauuuccaccacccgaacccgaauggacuuauccaagauuaucaugucaagguucaacauuucaaaaagcuuuauuaaucucaccucauagauucggagaaauaaaaggaaauagugcaccacuaauaauaagagaacccuucguugcuuguggaccuaaagaauguagacauuucgcauuaacucauuaugcagcacaaccaggaggauauuauaauggaacgcgaaaagaucgaaauaaacuaagacauuuaguaucaguaaaacucggaaaaauaccaacaguugaaaacuccauauuccauauggcugcauggucaggaucagcaugucacgacggaagagaauggacauauauaggaguagauggaccagacaacgaugcucuaguaaaaauaaaauacggagaagcauauacagacacauaccacagcuaugcacacaauauacuuagaacacaagaaucagcauguaauuguauagguggagauuguuaucuaaugauaacagauggaucagcaucaggaauaucaaaaugcagauuccuuaaaauacgagaaggaagaauaauuaaagaaauauugccaacaggaagaguagaacauacagaagaaugcacaugcggauuugcaucaaauaaaacaauugaaugugcuuguagagacaacucauauacagcaaaacgaccauuuguuaaacucaauguugaaacagauacagcagaaauaagacuaaugugcacaaaaacauaucuagauaccccacgaccagacgauggaucaauagccggacccugugaaucaaacggagacaaaugguuaggaggaauaaaaggcggauucguucaucaaagaauggcaucaaaaauuggaagaugguacagcagaacaaugaguaaaacaaauagaaugggaauggaauuauacguaaaauaugauggugauccauggacagauucagaugcauuaacauuaucagguguaaugguaagcauagaagaaccaggaugguauaguuucggauucgaaauaaaagauaaaaaaugugauguaccauguaucggaauagaaaugguacaugauggaggaaaagacacauggcacagugcagcaacagcaauauacuguuuaaugggaucaggacaacuauuaugggacacaguaaccggaguagacauggcacuu

SEQ ID NO: 51174 - RNA, 1398 nt, Artificial Sequence
  derived and/or modified sequence opt6 from anti-influenza_Chain
augcuaccaagcacaguacaaacauuaacauuacuacuaacaucaggaggaguauuauuaucauuauauguaucagcaucccuaucauauuuacuauauucagauguauuauuaaaauucagcucuacaaaaacuacagcaccaacaaugucgcuagaauguaccaacgcauccaaugcacaaacaguaaaccacagcgcaacaaaagaaaugaccuuuccucccccagaaccggaauggacauauccacgacuaucaugccaagguucuacauuucaaaaagcauuacuaauuucaccacauagauuuggcgaaauaaaagggaauagugcaccucuaauaauaagagaaccauuuguagcguguggaccuaaagaaugcagacauuucgcauuaacacauuaugccgcacaaccuggggguuauuauaauggaacaagaaaagacaggaacaaauuaagacaucuaguaucaguaaaauuagguaaaauaccuacaguagaaaacagcauauuucauauggcagcauggagcggaucugcaugucaugacggacgagaguggacauacaucgguguagauggcccagauaaugaugcccuaguaaaaauaaaauacggagaagcauauacagauacuuaucacucauaugcacauaauauauuaagaacacaagaaagugcaugcaauugcauaggaggagacuguuauuuaaugauaacugacggaagcgcaucaggcauauccaaauguagauuucuaaaaauaagagaagguagaaucauaaaagaaauacuaccuacaggacgaguagaacacacagaagaauguacauguggauuugcuaguaauaaaacuauagaaugugcaugucgugauaauaguuauacagccaaaagaccauuuguaaaauuaaacguagaaacagacacagccgaaauaagauuaauguguacaaaaacauauuuagacacaccaagaccagacgauggaagcauagcaggaccaugcgaaaguaacggagacaaauggcuuggaggaauaaaagggggauucguacaucaacgaauggcaaguaaaauaggcagaugguauucaagaacaaugucaaaaacaaauagaaugggaauggaguuauauguaaaauaugacggugacccauggacagauucagacgcauuaacauuaagcggcguuaugguaucaauagaagaaccugguugguacucauucggauuugaaauaaaagauaaaaaaugugauguaccauguauaggaauagaaaugguacaugauggaggaaaagauacauggcauagcgcagcaacagcaauuuauuguuuaaugggaucaggacaacuauuaugggauacaguuacaggaguagauauggcauua

SEQ ID NO: 51175 - RNA, 1407 nt, Artificial Sequence
  derived and/or modified sequence opt6 from anti-influenza_Chain
auggauuggacauggagauucuuauucguaguagcagcagcaacagguguacaaagucaaguacaacuaguacaaucaggagcagaaguaaaaaaaccuggaucaucaguaaaaguaucuugcaaagcaucaggcggaacacuaaacaauuacgcaauauccuggguaagacaggcaccaggucaaggacuagaauggaugggcggaaucaguccuauauuuggaacauuaaacuaugcugaaagauuucaaggaagaguaacaauaacagcagauguauuuaccaauacaguauauauggaacuuucaucacuaagaucugaagauacagccguauauuucugcgcaagagguugcggauacaacuguuauuauuuugacggcuggggacaaggaacacuagucaccguaucuagcgcaucuacaaaaggaccauccgucuuuccauuagcaccaucaucaaaauccacaucaggaggcacagcugcauuaggaugcuuaguaaaagauuacuuuccugaaccaguuaccguaucauggaacucuggagcucuaacaucaggaguacauacuuuucccgcaguuuuacaaaguucaggacuuuacagucuaucuucaguaguaacagugccauccucaucacuugggacacaaacauacauauguaauguuaaucauaaaccaucaaauacuaaaguagauaaaaaagucgaaccaaaaagcugugacaaaacucacacauguccuccaugcccagcccccgaauuacuuggcggcccaagcguauuucuauucccaccuaaaccaaaagauacuuuaaugauaucaagaacuccagaaguuacaugcguaguaguugauguaagccacgaagauccagaaguaaaauucaauugguauguagauggaguagaaguacauaaugccaaaacuaaaccaagagaagaacaauauaauucaacauacagaguagucucaguacuuacaguacuacaucaagauugguuaaauggaaaagaauacaaaugcaaagucucaaauaaagccuuaccugcuccaauagaaaaaacuauaucaaaagcuaaaggccaaccaagagaaccucaaguauauacacuaccacccucacgcgacgaacuaacaaaaaaccaaguaucacuaaccugucuuguaaaaggauucuacccauccgacauagcaguagaaugggaaucaaauggacaaccggaaaauaauuauaaaacuacuccaccaguauuagacucagacggaucauuuuuccuuuauucuaaauuaacaguagacaaauccagauggcaacaaggaaacgucuucucaugcucaguaaugcacgaaggacuacauaaucauuauacacaaaaaucacuaucacucucaccaggaaaa

SEQ ID NO: 51176 - RNA, 1407 nt, Artificial Sequence
  derived and/or modified sequence opt6 from anti-influenza_Chain
auggauuggacauggagauuccuauucguuguagccgcagcuacaggaguucaaucacaaguacaauuaguacaaucaggagccgaaguaaaaaaaccagguagcaguguaaaaguuuccuguaaagcaucuggaggaacauuaaauaauuacgccauaucauggguaagacaagcaccgggacaaggacuagaauggaugggaggaauaucuccaauauucgguacacuuaauuacgcugaaagauuucaaggaagaguaacaauaacagcagacguauucacaaauacugucuauauggaauuaucuucauuacgaucagaagauacagcaguauauuucugugcaagaggaugcggcuacaauugcuauuauuucgacggauggggacagggaacuuuaguaacaguuucaucugcuucaacaaaaggaccaucaguuuucccccuagcaccaucuucuaaaagcacaucaggaggaacugcagccuuaggcuguuuaguaaaagauuauuuccccgaaccugucacuguaucuuggaauucaggagcucuaacauccggaguacacacauucccagcaguucugcaaucaucuggacucuauagucuaucauccguaguaacaguaccaagcucaucauuagguacccaaacauacaucugcaauguuaaccacaaaccaucaaauacaaaaguugacaaaaaaguagaaccaaaaucaugugacaaaacucacacuuguccaccaugcccagcaccagaacuacuagguggaccaucuguauucuuauuuccaccaaaaccuaaagauacacuaaugauuucaagaacaccugaaguaacaugcguuguuguagacguaucacacgaagacccugaaguaaaauucaacugguauguagauggaguagaaguacauaaugcaaaaaccaaaccacgagaagaacaauauaauucaacuuauagagucguuuccguacuaacuguauuacaccaggauuggcuaaauggaaaagaauauaaaugcaaaguauccaauaaagcuuuaccagcacccauagaaaaaacaauaucuaaagcuaaaggacaaccucgugaaccucaaguauacacauuaccaccaucucgugacgaacuaacaaaaaaccaaguaucguuaacuuguuuaguaaaaggcuucuauccuucagauauugcaguagaaugggaaucaaacggacaaccagaaaauaauuauaaaacuacaccuccaguauuagauucagacggcucuuuuuuuuuauauucaaaauuaacaguugauaaaucuagauggcaacaagguaauguauuuucauguucaguaaugcacgaaggauuacacaaucauuacacccaaaaaagcuuaucacuauccccaggaaaa

SEQ ID NO: 51177 - RNA, 1407 nt, Artificial Sequence
  derived and/or modified sequence opt6 from anti-influenza_Chain
auggacuggacauggagauuucucuucguaguagccgcagcaacuggaguacaaucacaaguccaauuaguacaaucaggagcagaaguaaaaaaaccaggaucaucaguaaaaguaucauguaaagcaucaggaggaacacucaacaauuaugcaauauccuggguaagacaagcaccaggacaaggucuagaauggaugggagggauaucaccaauauucggcacauuaaauuacgccgaaagauuccaaggcagaguaacaauaacagcagauguauucacaaacacaguauacauggaacuaucaucauuaagaucagaagacaccgcaguauacuucugugcaagagguugcggauauaauuguuacuacuuugaugguuggggacaagguacuuuaguuacagucucaucagcaucaacaaaaggaccuuccguauucccauuagcaccuucauccaaaucuaccuccggaggaacagcugcauuaggcugccuaguaaaagacuacuucccagaaccaguaacaguaucauggaauucaggagcucuaacuagcgguguccacaccuucccagccguccuacaaucaucaggacuauauucauuaucaucuguaguaacaguaccaucaucaucauuaggaacacaaacauacauaugcaauguaaaccacaaaccaucuaauaccaaaguagauaaaaaaguagaaccaaaaucuugcgauaaaacacacacaugcccaccuugcccagcaccagaacuacuaggaggcccaucaguauucuuauuuccaccaaaaccaaaagacacucuaaugauaucaagaaccccagaaguuacauguguuguaguagacguaucacacgaagauccugaaguaaaauucaacugguacguugauggcguagaaguccacaacgcaaaaaccaaacccagagaagaacaauauaacucaacauacagaguugucuccgucuuaacaguuuuacaccaagacuggcuaaacggaaaagaauacaaaugcaaaguauccaauaaagcauuaccugcaccaauugaaaaaacuauaaguaaagccaaaggacaaccaagagaaccacaaguauauacacuaccuccaucacgugacgaacuaacaaaaaaucaaguaucauuaacaugccucguaaaaggauuuuauccaucagauauagcaguagaaugggaaucuaauggucaaccagaaaacaacuacaaaaccacacccccaguacuagacuccgacggaucauuuuuccuauacagcaaauuaaccguagacaaauccagauggcaacaagguaauguauuuucuugcucaguaaugcaugaaggauuacauaaucauuauacacaaaaaucacuaucacuaucaccaggaaaa

SEQ ID NO: 51178 - RNA, 1413 nt, Artificial Sequence
  derived and/or modified sequence opt6 from anti-influenza_Chain
gauggaguaaaaccauuaauacuaagagacugcucagucgccggauggcucuuaggaaauccaaugugcgaugaauuuauaaacguaccagaaugguccuacauaguagaaaaagccaaccccgcaaacgaccuauguuauccuggaaacuucaacgacuacgaagaauuaaaacauuuacucucaagaauaaaucacuucgaaaaaauacaaauaauaccaaaauccucauggagcgaucaugaagcaucaucaggcguaucaucugcaugcccauaucaaggaacaccuucauuuuuuagaaauguaguauggcuaauaaaaaaaaauaauacuuaccccacuauaaaaagaaguuacaauaacacaaaccaagaagaccuacuaauccucugggguauacaucacuccaacgacgcagcagaacaaacaaaauuauaucaaaacccaacaacauacauaucaguagguacaucaacacuaaaccaacgacuuguaccuaaaauagcaacaagaucaaaaguaaacggccaaaacggacgcauggacuuuuucuggacuauacucaaaccaaacgacgcaaucaacuucgaaucaaacggaaauuuuauagcaccagaauacgcuuauaaaauaguaaaaaaaggauacauaccagaagcaccaagagacggacaagccuacguacgaaaagauggagaauggguacuucucucaaccuuccuacgaucagauaaaacacacacaugcccaccaugcccagcaccagaacuacuaggaggcccaucgguauuccucuuuccaccaaaaccaaaagacacacuaaugaucucacgaaccccagaaguaacaugcguuguaguagauguaagccacgaagacccagaaguaaaauuuaauugguauguagauggagucgaaguucacaacgcuaaaaccaaaccacgagaagaacaauauaauucuacuuacagaguagucucaguauuaacagugcuacaccaagacuggcuaaacggaaaagaauacaaaugcaaaguaucaaacaaagcacuaccagcacccauagaaaaaaccauaucaaaagcaaaaggacaaccaagagaaccacaaguuuacacacuaccacccucacgagaagaaaugacaaaaaaccaaguaagcuuaaccugccuaguaaaaggcuucuaucccuccgacaucgcaguugaaugggaaucaaacggccaaccagaaaauaacuacaaaacaacucccccaguacuagacuccgauggcucauucuuuuuauauucaaaauuaacaguagauaaaucuagauggcaacaagggaauguauucucaugcuccguaaugcaugaagcccuacauaaccauuacacacaaaaaucucuaucacuuucacccggaaaa

SEQ ID NO: 51179 - RNA, 1413 nt, Artificial Sequence
  derived and/or modified sequence opt6 from anti-influenza_Chain
gauggaguuaaaccucuaauacuacgagacuguucaguagccggauggcuacuaggcaauccaaugugcgacgaauuuaucaauguaccugaauggucauauauagucgaaaaagcaaauccagcaaacgaccuauguuauccaggaaauuucaaugacuacgaagaacucaaacaucuacuaucacguauaaaucacuuugaaaaaauacaaauaauaccaaaaucaucauggucagaccacgaagcauccuccggaguaucuucagccuguccauaccaaggcacaccaucauucuucagaaacguaguaugguuaauaaaaaaaaacaauacauacccaacuauaaaaagaucauauaacaacaccaaucaagaagaccuacuaauucucuggggcauacaccauucuaacgacgcagccgaacaaaccaaacuuuaucagaacccaacaacuuacauuucuguuggaacaucaacauuaaaucaaagauuaguaccaaaaauagcaacccgaagcaaaguaaauggacaaaauggccgaauggacuucuucuggacaauauuaaaaccaaacgacgccaucaacuuugaaagcaacggaaauuucauagccccagaauacgcuuacaaaauaguaaaaaaaggauauauaccagaagcuccaagagacggacaagcauacguacgaaaagacggagaauggguacuacuauccacauucuuaagaucugacaaaacacauacaugcccaccauguccagcaccagaacuacuagguggcccaucagucuuccucuucccaccuaaaccaaaagauacacuaaugaucucaaggacaccagaagugaccugcguaguaguagacguaucucacgaagacccagaagucaaauucaacugguacguagacggaguugaaguccacaacgcaaaaacaaaaccaagagaagaacaauacaacucaacauacagaguaguaucaguacucacaguacuacaccaagacuggcuaaauggaaaagaauacaaaugcaaaguaucuaacaaagcacuuccggcaccaauagaaaaaacaauaucaaaagcaaaaggacaaccuagagaaccacaaguauacacacuaccaccaucaagagaagaaaugaccaaaaaucaagucucacuaacuugccuaguaaaaggauuuuacccaucagacaucgccguagaaugggaaagcaacggacaacccgaaaauaauuauaaaaccacaccucccguauuagacuccgacgggucauuuuuccuauacucaaaacuaacuguagacaaaucaagauggcaacaaggaaacguauucucaugcagcguaaugcaugaagcacuucauaaucacuauacacaaaaaagccuaucauuaucaccaggaaaa

SEQ ID NO: 51180 - RNA, 1416 nt, Artificial Sequence
  derived and/or modified sequence opt6 from anti-influenza_Chain
auggauuggacuuggagauuuuuauucguaguugccgcugcaaccggaguucaaugucaaguacaauuaguucaaucaggagcagaagucaaaaugccuggaucaucaguaaaaguaucaugcaaaacaucuggcguauucuucucaucacacgcgaucagcuggguuagacaagccccaggacaaggacuugaauggaugggaggaauauccccaauguucggcacuacacauuacgcacaaaaauuucaaggaagagucaccauuacagcagaucaaucaacaacaacagcauauauggaacuaacuucauuaacaagcgaagauacagcaguauacuacugcgcacgugauggagcaggaucuuauuacccauuaaauugguuugauccauggggccagggaacacucguaacuguaucaagugcuucuacaaaaggcccaaguguauuccccuuagcaccaucaagcaaaucaaccagcggaggaacagcagcacugggaugccuaguaaaagacuauuuuccagaaccagucacaguuucuuggaauagcggugcauuaaccuccggaguacacacauucccugcaguacuucaaucauccggacuauacucauuaucaagcguaguaacaguuccaagcucuucacuaggaacacaaacauauaucugcaacguaaaucauaaacccucaaauacaaaaguagauaaacgaguagaaccuaaaucuugcgauaaaacacauacgugcccuccauguccugcuccagaauuacuagguggaccaucaguauuucuauuuccaccaaaaccaaaagauacauuaaugaucucuagaacaccagaaguaacauguguaguuguagacguaucacaugaagauccagaaguaaaauuuaacugguauguagacggaguagaaguacacaacgcaaaaacaaaaccccgugaagaacaauauaacucaacuuacagaguuguaagcguacuaacaguauuacaucaagacuggcucaauggcaaagaauauaaaugcaaaguaucaaacaaagcguuaccagcuccaauagaaaaaacuauaucaaaagcaaaaggacaaccacgugaaccccaaguuuacacuuuaccaccaucacgagacgaacuaacaaaaaaucaaguaucacuaacaugccuaguaaaaggauucuauccaucagacauagcaguagaaugggaaucaaauggacaaccagaaaauaacuauaaaacaacaccaccaguccuugacagugauggaucuuucuuucuauauagcaaacuaacagucgauaaaucgagauggcaacaaggaaauguauuuucauguaguguuaugcaugaaggucuacacaaucauuacacacaaaaaucauuaucauuaucaccagguaaa

SEQ ID NO: 51181 - RNA, 1416 nt, Artificial Sequence
  derived and/or modified sequence opt6 from anti-influenza_Chain
auggauuggaccuggagguucuuauuuguaguagcagcagcaacaggaguccaaugccaaguacaacuaguacaaucaggugccgaaguaaaaaugccaggaucaucaguaaaaguaucaugcaaaacaucaggugucuuuuuuuccagucacgcaauuucauggguaagacaagcaccaggucaaggauuagaauggaugggaggaauaucaccuauguucggaacuacucauuacgcacaaaaauuucaaggaagaguaaccauaacagccgaccaaaguacuacaacagcuuauauggaacuaacauccuuaacaucagaagacacagcaguauauuacugugcaagagauggagcaggaucauacuacccuuuaaacugguucgauccauggggacaaggaacacucguuaccguaagcucugcaucuacaaaaggaccaucaguauucccauuagccccauccaguaaaucaacuucaggagguacagcagcacuaggaugcuuaguaaaagauuauuucccagaaccggugacaguaaguuggaauucaggcgcauuaacaucaggcguacacacauucccagcaguauuacaaaguucaggccuauauucacuaucuaguguaguaaccguacccaguucaagucucggcacacaaacauacauauguaaugucaaucauaaaccaaguaacacaaaaguagauaaaagaguagaacccaaaucaugugacaaaacacacacaugcccaccauguccagcaccagaacuacuagguggcccaucaguauuucuauucccaccgaaaccaaaagauacauuaaugauaucaagaacuccagaaguaacaugugucguaguagacguuucacaugaagacccagaagucaaauuuaacugguauguagauggaguagaaguacauaaugcaaaaacaaaaccaagagaagaacaauauaauucaacauauagagucguaucagucuuaacaguauuacaccaggacugguuaaacggaaaagaauauaaaugcaaaguuucuaacaaagccuuaccagcaccaauagaaaaaacuauaagcaaagcaaaaggucaaccaagagaaccacaagucuauacuuuaccaccaucaagagaugaauuaacaaaaaaucaaguaucuuuaacaugccuaguuaaagguuuuuauccaucagacauagccguagaaugggaaucaaauggacaaccugaaaacaacuacaaaacaacaccaccaguacuagacagugauggaaguuucuuccuauacucuaaauuaacaguagauaaaucacgauggcaacaaggaaauguauuuagcuguaguguaaugcacgaaggacuccauaaccacuacacacaaaaaucauuaucauuaucaccaggaaaa

SEQ ID NO: 51182 - RNA, 1416 nt, Artificial Sequence
  derived and/or modified sequence opt6 from anti-influenza_Chain
auggauuggacuuggcgauuucuauucguagucgcagcagcaacaggcguacaaugucaaguacaauuaguccaaucaggugcugaagucaaaaugccaggaucaucaguaaaaguaucauguaaaacuucaggaguauucuucucaucucaugcaauaucaugggucagacaagcaccaggacaaggacuagaauggaugggcggaauuagcccaauguucgggacaacacacuacgcacaaaaauuccaaggaagagugaccaucacagcagaccaaucaacaacaacagcauacauggaacuuacuucacuaaccucagaagauacugcaguauacuauugcgcaagagauggugcaggauccuacuacccacuaaauugguuugacccuuggggucaaggcacccuaguaacagucucaucugcaucuacaaaaggacccuccguauucccucuagcaccaucauccaaaucaacaucuggaggcacagcagcccuaggaugucuuguaaaagacuauuuuccagaaccaguaacaguaucauggaacucaggagcacuuacuucuggaguacacacauucccagcuguauuacaaucuuccggauuauacucacucucaucaguaguaacaguaccauccucaucacuaggaacacaaacauacauaugcaacgucaaucacaaaccaucaaauaccaaaguagacaaaagaguagaaccaaaaagcugcgacaaaacccacaccuguccacccugcccugcgccugaauuacucggaggacccaguguauuccuauucccuccaaaaccaaaagacacacucaugaucucuagaacaccagaaguaacaugcguaguagucgacguaucccaugaagacccagaaguaaaauuuaacugguacguagauggaguugaaguccacaaugcuaaaaccaaaccacgcgaagaacaauauaauucaacuuaucgaguaguaucuguauuaacuguauuacaucaagauuggcuaaacggaaaagaauauaaauguaaagucucaaacaaagcacucccagcaccaauagaaaagacaauaucaaaagcaaaaggacaaccaagagaaccucaaguuuacacauuaccucccucuagagacgaauuaaccaaaaaucaaguaucauuaacauguuuaguaaaaggauucuacccauccgauauagccguagaaugggaaagcaacggacaaccagaaaauaauuacaaaaccacaccuccaguucuagauucagaugguucauucuuucucuacucaaaauuaacaguagauaaaucacguuggcaacaaggaaauguauuuucaugcucaguaaugcaugaaggucuccauaaucacuauacacaaaaaucauuaucacugucaccagguaaa

SEQ ID NO: 51183 - RNA, 1419 nt, Artificial Sequence
  derived and/or modified sequence opt6 from anti-influenza_Chain
augacagaaagugcaaugacuucaagggcuggaaggggaagaggagccgauuuaguagcagcgguaguucaaggacaugcagcagcaucagaugcagcaggagauuuaaguuuuccagauggauucaucuggggagcagcaacagcagcauaucaaauagaaggggcauggcgagaagauggaagagguuuaugggauguauuuagucauacaccaggaaaaguagcaaguggacauacuggagacauagcaugugaucauuaucacagauaugcagaugacguaagauuaauggccggacuaggagacagaguauacagauuuucgguagcauggccaaggauaguaccagaugguucaggaccaguaaauccggcaggccuagauuuuuaugauagguuaguagaugaauuauugggucauggaauaacaccauauccgacauuauaccauugggauuuaccccaaacauuagaagacagaggagguugggcagcacgagauacagcauaucgauucgcugaauaugcauuagcaguacauagacgauuaggagauagaguuagauguuggauaacauuaaaugaaccauggguagcagcauuuuuagcgacucacagaggagcuccaggagcagccgauguaccuagauuuagggcgguacaucauuuacuauuaggacauggauuagguuuaagauugagaucagcgggagccggacaauuaggauuaacauuaaguuuaucaccaguaauagaagcaagaccaggagugagagguggagguagaagaguagaugcacuagcaaauagacaauuccuagacccagcacuaagagguagauauccagaagaaguauuaaaaauaauggcagggcaugcaagauuaggacauccuggaagggacuuagaaacgauacaucaaccgguagauuuacuaggaguaaauuauuauagucauguaagacuugcugcagaaggagaaccagcaaauaggcuaccuggcucagaaggaauaagauuugaaagaccaacggcaguuacugcuuggccuggagacagaccagauggguuaagaacacuauuauuaagacuaucaagggauuauccuggaguaggauuaauaauaacagaaaauggagcggcauuugacgacagagcagauggggauagaguucaugauccagaaagaauaagguacuuaacagcaacuuuaagagcaguacaugaugcaauaauggcaggagcugacuugcgaggauauuucguuuggagcguguuggacaauuuugaaugggcguauggcuaucauaaaagaggaauaguauauguagauuauacuacuaugagaagaauaccacgugagagugcauuaugguauagagauguuguaagaaggaacggauuaagaaacggagaa

SEQ ID NO: 51184 - RNA, 1419 nt, Artificial Sequence
  derived and/or modified sequence opt6 from anti-influenza_Chain
augacugaaagugcaaugacaaguagagcaggaaggggaaggggagcugauuugguagcagcuguaguacaaggacacgcagcagcaagugaugcagcaggagauuuaaguuuuccugacggauucaucuggggagcagcuacagcagcauaucaaauagaaggagcuuggagagaagauggaagaggauuaugggacguauucagccauacaccuggaaaaguagcaucagggcauacaggggauauugcaugugaccauuaucacagauaugcugaugauguaagauugauggcaggacuuggcgaccgaguuuauagauuuucuguagcauggccaagaaucguaccagauggaaguggaccaguaaacccagcaggccuagacuuuuaugaucgauuaguagaugaacuacuaggacauggaauaacaccauauccaacauuauaucauugggacuuaccacaaacauuagaagauagaggaggaugggcagcuagagauacugcauauagauuugcggaauaugcauuagcaguacacagaagauuaggagauagaguaagguguuggauuacauuaaacgaaccauggguugcugcauuucuagcaacacacagaggagcaccaggagcagcggauguuccaagauuuagagcaguccaucauuuauuacugggucaugguuuagguuuaagacuaagaucagcaggagcgggucaauuagguuuaacguuaaguuuaaguccaguuauagaagcaagaccaggaguaagaggagguggaagaagaguugacgcuuuagcaaauagacaauuuuuagauccagcauuaagaggaagauauccagaagaaguauuaaaaauaauggcuggacaugcaagauuaggacauccaggaagagaccuagaaacaauacaucaaccaguugaucuauuaggagugaacuauuauagucauguaagacuugcagcagaaggagaaccagcaaauagauuaccgggauccgaaggaauaagauuugaaaggccgacagcagugacugcauggccgggugauagaccugauggauuaaggacccuauuauuaaggcuaaguagagauuacccaggcguaggauuaauaauaacagaaaauggagcagcguuugaugauagagcugauggggauagaguacaugauccagaaagaauuagauauuuaacagcaacacuaagagcaguacacgaugcaauaauggcaggagcagauuuaagagguuacuucgucuggaguguccuagauaauuuugaaugggcauauggguaucauaaaaggggaauaguguauguagauuauacaacgaugagaagaauaccacgugaaucagcacuaugguauagagauguaguacgaagaaauggauugagaaauggggaa

SEQ ID NO: 51185 - RNA, 1422 nt, Artificial Sequence
  derived and/or modified sequence opt6 from anti-influenza_Chain
cuuuccagaauaaaccauuucgaaaaaauucaaauaauaccaaaaucauccugguccgaucacgaagccucuuccggaguaucaucagcauguccauaccaaggcacaccauccuucuucagaaacguaguauggcuaauaaaaaaaaacaacacauacccaacaauaaaaagaucauauaauaauacaaaccaagaagacuuacuaauacucuggggaauacaucacuccaacgacgcagcugaacaaacuaaauuauaccaaaauccaaccacauauauauccguaggaaccucaacacuaaaccaacgcuuagucccaaaaauagcaaccagaucuaaaguaaauggacaaaauggaagaauggacuucuuuuggaccauccuaaaaccaaacgaugcaauaaacuuugaauccaacggaaacuuuaucgcuccagaauacgcauacaaaauaguaaaaaaaggcgauucagcuauaguaaaaagugaaguagaauauggcaauugcaacacaaaaugucaaacccccauuggcgcaauaaauucaucaaugccauuccacaauauacacccacuaaccauaggagaaugcccaaaauacguaaaaucaaauaaacuuguauuagcaacaggauuaagaaacucaccauuagguuacauaccagaagcaccaagagacggacaagcauauguacguaaagacggagaaugggucuuacuaaguacauuccuaagaagcgacaaaacacacacauguccaccaugcccagcgcccgaauuacucggaggcccauccgucuuccuauucccacccaaaccuaaagacaccuuaaugauaucucgaacaccagaaguaacaugcguagucguagacguaucacaugaagauccagaagucaaauucaauugguacguagacggaguugaaguacauaacgcuaaaacaaaacccagagaagaacaauauaauagcacauaucgaguaguuuccguauuaacaguacuacaccaagauugguuaaacggaaaagaauacaaaugcaaaguauccaacaaagcucuaccugcaccaauugaaaaaacaaucucaaaagcaaaaggacaacccagagaaccacaaguauacacacuuccaccauccagagaagaaaugaccaaaaaucaaguaucauuaacaugccuagucaaaggauucuacccaucagacauagcaguagaaugggaaucgaacggacaacccgaaaacaacuacaaaacaacaccucccguccuagacagugacggaucuuucuuccuuuacucaaaacuaacaguagacaaauccagauggcaacaaggcaacguauucuccugcucugugaugcacgaagcauuacacaaucacuauacucaaaaaucauuaucacuaagccccggaaaa

SEQ ID NO: 51186 - RNA, 1422 nt, Artificial Sequence
  derived and/or modified sequence opt6 from anti-influenza_Chain
cuaucacgaauuaaccauuucgaaaaaauacaaauaaucccaaaaucaagcuggucagaucacgaagccucuucaggagucucuucagcaugcccauaccaaggaacaccaucauucuuuagaaacguaguauggcuaauaaaaaaaaauaacacauacccaacaaucaaaagauccuacaacaacacaaaccaagaagaucuccuaauacucugggguauacaccauucaaaugacgcagcagaacagacaaaacuuuaucaaaauccaacaacuuauauaucagucggaacaucaacccucaaccaaagauuagucccaaaaauagcaacaagaucaaaaguaaacggacaaaauggacguauggauuucuucuggacuauauuaaaaccaaaugacgcaauaaauuucgaaucaaacggaaauuucaucgcacccgaauaugcauacaaaauaguaaaaaaaggagacuccgcaauaguaaaaucagaaguagaauacggaaacuguaauacaaaaugucaaacaccaauaggugcaauaaauucauccaugccauuccauaauauacacccauuaacuauaggugaaugcccaaaauacguuaaaucaaacaaacuaguucuugccaccggacucagaaacuccccacuaggcuacauacccgaagcaccaagagauggccaagccuacguaagaaaagacggagaauggguauuauuaagcacauuucucagaucagacaaaacacacaccugccccccaugcccugcccccgaacuccuaggcgguccaagcguauuccuauucccaccaaaaccuaaagacacacuaaugauaucaagaacaccagaaguuacaugcguaguaguagacguuucacaugaagacccagaaguaaaauucaacugguacgucgauggaguagaaguacauaacgcaaaaacaaaacccagagaagaacaauauaauucaacauacagaguagucuccguacucacagucuuacaccaagauugguuaaacggaaaagaauauaaaugcaaaguaagcaacaaagcauuaccagcaccaauagaaaaaacaauaucaaaagcuaaaggccaaccaagagaaccacaaguauacacauuaccaccaucacgagaagaaaugacaaaaaaccaaguaucucuuaccugucuaguaaaagguuucuacccuucagacaucgccguagaaugggaaucaaacggacaaccagaaaauaauuacaaaacaacucccccaguuuuagacagcgacggaucauuuuuucuauacucaaaauuaacaguagacaaaucacgauggcaacaaggaaacguuuucucaugcuccgucaugcaugaagcacuacacaaucacuacacccaaaaaucccuaucccuaucaccagguaaa

SEQ ID NO: 51187 - RNA, 1428 nt, Artificial Sequence
  derived and/or modified sequence opt6 from anti-influenza_Chain
auggaauuuggcuuaagcuggguauuucuuguagcucuacucagaggaguucaaugucaaguacaacugguagaaaguggagguggaguaguacaaccaggaagaucucuuagacuuucaugcgcagcaucaggauucacauucuccagauuuggaauacauuggguaagacaagcaccaggaaaaggccuagaauggauggcgguaauaugguaugacggaucuaacaaauucuaugcugauucaguaaagggaagauuuacaauaucuagagauaacucuaaaaacaccguuuauuuacaaaugaacucauuacgagcagaagauacagccguauauuauugugcaaaagauucuagaggauauuguucaucuauaauaugcuuugaaggaggauuagacaauuggggacaaggaacccuaguaacaguaucaucugcuagcacaaaaggaccaucuguauuuccucucgcaccaucaucaaaaucaacaucagguggaacagccgcacuaggauguuuaguuaaagacuacuuuccggaaccagucacugucucuuggaacucaggagccuuaacaucagguguucauacuuuuccugccguccuucaaucaucagguuuauauucccuauccucaguuguaacaguuccuuccucaucacuaggaacacaaacauacauuuguaauguaaaucauaaaccaucaaauacaaaaguugauaaacgaguagaaccuaaaucaugugacaaaacccauaccuguccaccaugucccgcaccagaauuacuaggaggcccaucuguauuucuauuucccccaaaaccuaaagauacacuaaugauaagccgaacaccagaaguaaccuguguaguaguugauguuucacaugaagacccagaaguaaaauuuaauugguacguagauggaguugaaguacauaaugcuaaaacaaaacccagagaagaacaauauaauucaacauauagaguaguaucuguacuuacaguacuacaucaagacuggcucaacggaaaagaauauaaauguaaaguuagcaauaaagcauuaccagccccaauagagaaaacaauuucaaaagcaaaaggccaaccaagagaaccucaaguauauacucuacccccauccagagaugaauuaacuaaaaaucaagucucucuaacauguuuaguuaaggguuucuacccauccgauauagcaguagaaugggaaucaaacggacaaccagaaaacaauuacaaaacaacaccaccaguacuugauucagacgguucauucuuuuuauauucaaaauuaacaguagauaaauccagauggcaacaaggaaauguuuucucaugcucaguuaugcaugaaggauuacauaaucauuauacacaaaaaucuuuaucauuaucaccuggcaaa

SEQ ID NO: 51188 - RNA, 1428 nt, Artificial Sequence
  derived and/or modified sequence opt6 from anti-influenza_Chain
auggaauuuggccuaucauggguauuuuuaguagcacuacuacgaggaguacaaugucaaguacaauuaguagaaucuggagguggaguaguccaaccaggccgaucccuccgacuaucaugugcagcauccggauuuacauuuucaagauucggaauacauuggguucgacaagcaccaggaaaaggacuagaauggauggccguaauaugguaugauggaucaaauaaauuuuaugcagacucuguaaaaggaagauucacaauaucuagagauaacaguaaaaauacaguauauuuacaaaugaacucacuuagagcagaagauacagcuguauacuauugugcaaaagauuccagagguuauugcaguucaauaauuuguuucgaagguggauuagacaacuggggacaaggaacacucguaacuguuucuucagcaucuacaaaaggaccaaguguuuucccauuagcaccuucaucaaaaagcacaucaggcgguacagcagcauuaggaugcuuaguuaaagacuacuucccggaaccaguaacaguuucauggaacucaggugcauuaacuuccggaguacauacuuuuccagcaguccuacaaucaucaggacuauacucuuuaucuucaguaguuacuguucccagcuccaguuuaggcacacaaacuuauauauguaaugucaaucacaaaccaucaaauaccaaaguagacaagagaguagaaccaaaaaguugcgauaaaacucauacauguccaccaugucccgcuccagaauuauuaggcggaccaucaguauuucucuuuccaccaaaacccaaggauacauuaaugauaucaagaacaccagaaguuacuugcguaguaguagacguuucacaugaagacccagaagucaaauuuaacugguacguagacggaguagaaguacacaacgcaaaaacuaaaccuagagaggaacaauacaauuccacuuaccgagucguuucaguacuaacuguauuacaccaagacuggcuaaauggcaaagaauauaaauguaaaguaucaaauaaagcacuuccagcaccaauugagaaaacaauaucaaaagcaaaaggacaaccaagagaaccucaaguuuauacauuaccacccaguagagaugaacuaacuaaaaaccaaguaucauuaaccugucuaguaaaaggauuuuaucccucagacauagcaguagaaugggaauccaauggacaaccagaaaauaauuauaaaacaaccccuccaguacuagauucagacggcucauucuuuuuauauucaaaacuaacaguagauaaaucaagauggcaacaaggaaauguauuuucaugcucaguaaugcaugaaggccuccauaaucauuauacacaaaaaucacuaagccuuucaccaggaaaa

SEQ ID NO: 51189 - RNA, 1428 nt, Artificial Sequence
  derived and/or modified sequence opt6 from anti-influenza_Chain
auggaauuuggacuaagcugggucuuuuuaguagcauuauuaagaggaguacaaugccaaguacaauuaguagaaagcggaggaggaguuguacaaccaggaagaucuuuaagacuuucaugugcugcaaguggcuuuacauuuuccagauucggaauacacugggucagacaagcacccgggaaaggacuagaauggauggcaguaauaugguacgaugguagcaacaaauuuuacgcagauaguguaaaaggaagauuuacaauaaguagagacaacuccaaaaauacaguauauuuacaaaugaacucacuacgggcagaagauacagcaguauauuauugugcaaaagauucuagaggcuauuguucaaguauaauaugcuuugaaggaggacuagauaauuggggacagggaacacuuguuacaguaaguucagcaucaacaaaaggaccaucaguauuuccacuagcaccuaguucaaaaucaacaagugguggaacagcagcauuaggcugcuuagucaaagauuacuuuccagaaccaguuacaguuucguggaacucaggcgcacuaacaucaggcguacauacauuuccagcuguauuacaaucaucaggccuauauucauuaucaucaguaguaacaguuccuaguucaucuuuaggaacucaaacauauauauguaauguuaaucauaaaccaaguaauacaaaaguagauaaacgaguagaaccaaaaucaugugauaaaacucacacaugcccaccuugcccugccccagaacuccuaggaggaccaagcguauuucuauuuccaccaaaaccaaaagauacacuaaugauaucaagaaccccagaaguuacaugcgucguagucgacguuucucaugaagacccagaaguaaaauuuaacugguacguggaugguguagaaguacacaaugcaaaaacaaaaccaagagaagaacaauauaacaguacauacagaguaguaucaguauuaacgguauuacaccaagauugguuaaacggcaaagaauauaaauguaaaguaaguaauaaagcacuaccagccccaauagaaaagacaauaucaaaagcaaaaggacaacccagagaaccacaagucuacacucuaccaccaucaagagaugaauuaaccaaaaaucaaguaagccuaacauguuuaguaaaaggauuuuacccaucagauauugcaguagaaugggaaucaaauggacaaccagaaaauaauuacaaaacaacaccaccaguauuagauucagauggauccuucuuuuuauacaguaaauuaacaguggacaaaucaagguggcaacaaggaaauguuuuuagcuguucaguaaugcacgaaggauuacacaaucauuacacacaaaaaucacuaagucuaucaccaggaaaa

SEQ ID NO: 51190 - RNA, 1440 nt, Artificial Sequence
  derived and/or modified sequence opt6 from anti-influenza_Chain
augccaucaguaaaaaucggaauaauaggagccgguagcgcaguauuuucacuuagauuaguaagcgaccuaugcaaaacaccaggauuaucggguagcacgguaacucuaauggauauugaugaagaaagacuagaugccauccuaacaauagcaaaaaaauacguagaggaagugggagcugaucuuaaauuugaaaagacaaugaacuuggaugauguaauaauugacgcagauuucguaauaaacacagcaaugguaggaggacauacauaucuagaaaaaguaagacaaauaggagagaaauauggauacuacagaggaauagaugcucaagaauuuaacaugguaagcgauuacuacacuuuuucaaacuacaaucaauuaaaauacuucguagauauagcaagaaaaauagaaaaacuaucaccaaaagcaugguaucuacaagcagcaaauccaauauuugaaggaacaacacuaguaacacguacaguaccaauuaaagcaguaggauuuugucacggacacuacggaguaauggaaauaguagaaaaacuaggauuagaagaagaaaaagucgacuggcaaguagcaggaguaaaccauggaauauggcuaaauagauuuagauauaacgguggaaaugcauauccacuacuagacaaauggauagaagaaaaaucaaaagacuggaaaccugaaaauccuuucaaugaccaacuaucaccagcagcaauagauauguacagauuuuacggaguaaugccaauaggugacacaguaagaaacucaagcuggagauaucauagagaccuagaaacaaaaaaaaaaugguacggcgaaccauggggaggugcagacucagaaauaggauggaaaugguaccaagauacacuaggaaaaguaacagaaauaaccaaaaaagucgcaaaauucauaaaagaaaauccaucugugagacuaucagaccuaggaagcguacuagguaaagauuuaagcgaaaaacaauuuguguuagaaguugagaaaauacucgacccagaaagaaagaguggggaacaacacauacccuuuauagacgcguuacuaaaugacaauaaagcaagauucguuguaaauauaccaaacaaaggaauaauccauggaauagaugacgacguagucguagaaguaccggcacuaguagacaaaaauggaauucauccagaaaaaauagaaccaccgcuaccugauagaguaguaaaauacuaucuuagaccaagaauaaugagaauggaaauggcauuagaagcauucuuaacaggagacauaagaauuauaaaagaacuauuauacagagacccaagaacaaaaagugacgaacaaguggaaaaaguaauagaagaaauacuagcauuaccagaaaaugaagaaaugagaaaacacuacuuaaaaaga

SEQ ID NO: 51191 - RNA, 1440 nt, Artificial Sequence
  derived and/or modified sequence opt6 from anti-influenza_Chain
augccuagugugaaaauaggaauaauaggagcaggaagcgcgguauuuagccuacgauuaguaagugacuuaugcaaaacaccaggcuuaaguggaaguacuguaacucuaauggauauagacgaagaaagacuagaugcaauucuaacaauagcaaaaaaauacguggaagaaguaggagcagaucuaaaauucgaaaaaacaaugaauuuagaugacguaaucauagacgcagacuuuguaauaaacacagcaaugguaggaggacacacauaccuagaaaaaguaagacaaauaggggaaaaauacggauauuauagaggaauagacgcacaagaauucaacaugguaagugauuacuacacauucaguaauuauaaccaacuaaaauacuuuguagauauagcaagaaaaauagaaaaauuaaguccgaaagcgugguaccuacaagccgcaaacccgauauuugaaggaacaacauuaguaaccagaacaguaccaauaaaagcgguaggauucugucacggacacuauggaguaauggagauaguagaaaaauuaggauuagaagaagaaaagguagacuggcagguagcuggaguaaaucauggaauaugguuaaauagauuuagauacaacggaggaaaugcauauccgcuacuugauaaauggauugaagaaaaaagcaaagauuggaaaccagaaaauccauuuaacgaucaauuaucaccugcagcaauagauauguauagauuuuacggagugaugccaauaggagauaccgugagaaacagcucauggagauaucacagagaucuagaaacaaaaaaaaaaugguauggagaaccauggggaggagcagacagugaaauaggauggaaaugguaucaagauacauuaggaaaaguaacagaaauaacaaaaaaaguagcaaaauuuauaaaagaaaacccgagcguaagacuaagcgaucucgguaguguauuagggaaagaucuaagcgaaaagcaauuuguacuagaaguagaaaaaauacuggauccggaaagaaaaaguggagaacaacauauaccauucauagaugcacuauugaaugauaacaaagcaagauuuguaguaaauauaccaaacaaaggcauaauacacggaauagaugaugacguuguaguugaagugccagcgcuaguagacaaaaacggaauccauccagaaaaaauagaaccaccacuaccugacagagugguaaaauauuauuuaagaccaagaauaaugagaauggagauggcacuagaagcguuuuugacaggagauauaagaauaauaaaagaauuauuauauagagaucccaggacaaaaagugacgaacaaguagaaaaaguaauagaggaaauauuagcacuaccggaaaaugaagagaugagaaaacauuacuuaaaaaga

SEQ ID NO: 51192 - RNA, 1443 nt, Artificial Sequence
  derived and/or modified sequence opt6 from anti-influenza_Chain
augaaauucccuaaagacuuuaugauuggauacucauccuccccuuuccaauuugaagcaggaauaccaggaagugaagacccaaauucagacugguggguauggguacaugauccagaaaauacagcagcaggacucguaucaggagacuuuccagaaaauggacccgguuauuggaauuuaaaccaaaaugaucaugauuuagcagaaaaacuaggaguaaauacuauaagggucggaguagaauggagucguauauucccaaaaccaacuuuuaauguuaaaguuccagucgaaagagaugaaaauggaagcauaguacaugucgauguagaugacaaagcaguagaaaggcucgaugaauuagcaaauaaagaagcagugaaucauuauguagaaauguauaaagauuggguagaaagaggaagaaaacuaauauuaaacuuauaccauuggccauuaccuuuauggcugcauaauccaauaaugguaagaagaaugggaccagauagagcaccuucaggauggcuaaaugaagaaucaguaguagaauuugcaaaauacgcagcauauauagcauggaaaaugggcgaauuaccaguaauguggucaacaaugaaugaaccaaauguaguauaugaacaaggguauauguuuguaaaaggagguuuuccaccaggauauuuaucacuagaagcagcagacaaagcuagaagaaauaugauacaagcacaugcaagagcauacgauaauauaaaaagguucucaaaaaaaccagucggauuaauauaugcauuucaaugguuugaacuauuggaagggcccgcugaaguauucgauaaauuuaaaaguagcaaauuauauuacuuuacagauauaguaucaaaggguagcucuauaauuaauguagaauauagaagagacuuagcuaacagacuugauugguuaggaguaaauuacuacucucgauuaguauauaaaauuguagaugauaaaccuauaauauuacacggauauggauucuuauguacaccuggaggaauuucaccagcagaaaauccauguucugauuuuggaugggaaguauacccagaaggucuuuaucuauugcuaaaagaacuuuauaauagauauggaguugaucucauaguaaccgaaaaugguguuucggauaguagagacgcauuaagaccagcauaucuaguaagucauguauauaguguauggaaagcagcaaacgaggguauacccguaaaaggauaucuacacuggaguuuaaccgauaauuaugaaugggcacaaggauuuagacagaaauuuggauuaguaaugguggauuuuaaaacaaaaaaaagauauuuacgaccuagugcacuaguauuuagagaaauagcaacacauaauggaauacccgaugaacuucaacacuugacauuaauacaa

SEQ ID NO: 51193 - RNA, 1443 nt, Artificial Sequence
  derived and/or modified sequence opt6 from anti-influenza_Chain
augaaauuucccaaagauuuuaugauaggauacagcuccagcccauuccaauuugaagcagguauaccuggaucugaagauccgaauucagacugguggguaugggugcaugauccugaaaacacagcagcaggacuuguuucaggagauuuuccagaaaaugguccaggauauuggaacuuaaaccaaaacgaucaugaccuagcagaaaaauuaggaguaaauaccauaagaguaggaguagaauggucuagaauuuuuccaaaaccaacauuuaauguuaaagugccaguagaacgagaugaaaauggaucaauaguacauguagauguugaugauaaagcaguugaaagacuugaugaauuagcaaauaaagaagcaguaaaucauuacguagaaauguauaaggauuggguagaaagagguagaaaacuuauauuaaaccuauaucauuggccauuaccauuaugguuacauaaccccauaaugguuagaagaaugggaccagauagagcaccuucuggaugguuaaaugaagaaagcguaguagaauucgcaaaauaugcagcauacauagcauggaaaaugggagaauuaccagucauguggaguacaaugaaugaaccuaaugucguauacgaacaagguuauauguuuguuaaaggcggauuccccccaggauauuuaagucuagaagcagcagacaaagcccguagaaauaugauacaagcacaugcaagagcauaugauaauauuaaaagauuuaguaaaaaaccaguagguuuaauauacgcauuucaaugguuugaacuccuggaaggaccagcagaaguauuugauaaauuuaaaaguaguaaauuauauuauuuuacugauaucgucaguaaaggaucuagcauaaucaauguagaauauagaagagaccuagcaaauagacuagauugguuaggaguaaacuauuauaguagacuagucuauaaaauaguugaugacaaaccaauaauuuuacauggauauggauucuuauguacaccagguggaauaaguccagcagaaaauccaugcucagauuuugguugggaaguauauccagaagguuuauauuuauuauuaaaagaacuuuauaauagauauggaguagauuuaauaguaaccgaaaauggaguuucagauucaagagaugcuuuacgccccgccuacuuaguaagucacguauauaguguauggaaagcagcaaaugaaggaauuccaguaaaaggauauuuacauuggagcuuaacagauaacuacgaaugggcccaaggauuuagacaaaaauuuggacuaguaaugguagauuuuaaaacuaaaaaaagauacuuaagaccuuccgcacuuguauucagagaaauugcuacucauaauggaauaccagaugaauuacaacauuuaacacuuauccaa

SEQ ID NO: 51194 - RNA, 1464 nt, Artificial Sequence
  derived and/or modified sequence opt6 from anti-influenza_Chain
cacgcacaagauauauuagaaaaaacacacaauggaaaauuaugcgaccuagauggaguaaaaccccuaauauuacgcgacugcucaguagccggauggcuacugggaaacccaaugugugacgaauuuauaaauguaccagaauggagcuauaucguagaaaaagcaaacccagcaaacgaccuaugcuacccagguaacuucaacgacuacgaagaacugaaacaucuacucucaagaaucaaucacuucgaaaaaauucaaauaauaccuaaauccuccuggagugaccacgaagcaucaaguggagucaguucagcaugcccauaccaaggaacaccaucauuuuucagaaacguugucugguuaauaaaaaaaaacaauacauauccaaccauaaaacgaucauacaacaacacaaaucaagaagauuuacuuauacuauggggcauacaccacuccaacgacgcagcagaacaaaccaaauuauaucaaaacccaacaacuuacauauccguaggaacaucaaccuuaaaucaaagacuaguacccaaaauugcaacaagauccaaaguaaacggucaaaauggacgaauggacuucuucuggacaauacuaaaacccaacgaugcaauaaauuuugaaucuaacggaaacuuuauagcaccagaauacgcauauaaaauaguaaaaaaaggcuacaucccagaagccccaagagauggacaagccuacguaagaaaagacggcgaauggguacuacuaucaacauuccuaagaucagacaaaacccacacaugcccaccauguccagcaccagaacuacuaggaggaccauccguauuccuauucccaccaaaaccaaaagauacauuaaugauaucuagaacaccugaagucaccuguguaguaguagacguaucacaugaagauccugaaguuaaauucaauugguacgucgacggaguagaaguucauaacgccaaaaccaaacccagagaagaacaauauaauucaacauauagaguaguaucgguacuaacaguacuacaccaagacuggcuaaacggaaaagaauauaaauguaaaguaucaaacaaagcucuaccagcaccaaucgaaaaaaccauauccaaagcaaaaggacaacccagagaaccccaaguuuauacauuaccaccaucaagagaagaaaugacaaaaaaucaaguaucauuaaccugccucguaaaaggauucuacccaucagacauagcaguagaaugggaaucaaacggccaaccagaaaacaacuacaaaacaacaccaccaguacuagauucagacggauccuucuucuuauacucaaaacuaacaguugacaaaucuagauggcaacaagguaacguauuuucauguucuguaaugcacgaagcauuacacaaccacuauacccaaaaaucacucucacucaguccuggaaaa

SEQ ID NO: 51195 - RNA, 1464 nt, Artificial Sequence
  derived and/or modified sequence opt6 from anti-influenza_Chain
cacgcacaagacauacuagaaaaaacacacaauggaaaacuaugugauuuagauggaguaaaaccccuaauacuacgugauugcucaguagcaggauggcuuuuaggaaaccccaugugugaugaguucauuaacguaccagaauggucauauaucguagaaaaagcaaaccccgcaaacgaccuauguuauccaggcaacuucaacgacuacgaagaacuaaaacacuuacuaucaagaauaaaccacuuugaaaaaauacaaauaauaccaaaaucaucauggucagaccacgaagccucaucagguguaucaucagcauguccauaccaaggaacaccaucauucuucagaaacgucguaugguuaauaaaaaaaaauaacacuuauccaacaauaaaaagaucauacaacaacacuaaccaagaagauuuauuaauacuuuggggaauacaucacagcaacgaugcagccgaacaaacgaaauuauaucaaaacccaacaacauacauauccguaggaacaucuacacucaaccaacguuuaguaccaaaaauagcaacacgaaguaaaguaaauggacaaaacggaagaauggacuuuuuuuggacaauacuaaaaccaaacgaugcuauaaauuuugaauccaacggaaacuucauagcaccagaauaugccuacaaaauagucaaaaaaggauacauaccagaagcaccacgagacggacaagcauacguaaggaaagacggcgaauggguacuacuaucaacauuccuaagaucagacaaaacucacacaugucccccuuguccagcaccagaauuacucgguggcccaucaguauuucuauuccccccaaaacccaaagauacacuaaugaucucaagaacaccagaaguuacaugcgucguaguagacguuucacacgaagauccagaaguaaaauuuaacugguacguugauggaguagaaguacacaacgcaaaaacaaaaccaagagaagaacaauacaacucaacauaccgaguaguuucuguccuaacaguacuccaccaagacuggcucaauggaaaagaauauaaaugcaaaguauccaacaaagcauuaccagcucccauagaaaaaacaauaucaaaagccaaaggacaaccacgugaaccccaaguauauacccuuccccccucuagagaagaaaugaccaaaaaccaaguaucauuaacaugcuuaguaaaaggcuuuuauccaucagacauagcaguagaaugggaaucaaacggacaaccagaaaacaacuacaaaacaacuccuccaguauuagauucugacgguaguuucuuucuauacaguaaacuaacaguagacaaaucaagauggcaacaaggcaauguguuuucauguucaguaaugcaugaagcacuacacaaccauuacacacaaaaaucauuaucacuaucaccuggaaaa

SEQ ID NO: 51196 - RNA, 1473 nt, Artificial Sequence
  derived and/or modified sequence opt6 from anti-influenza_Chain
augcuuuccuuuccaaaaggauuuaaauuuggauggucacaaucaggauuccaaucagaaaugggaacaccaggaagcgaagauccuaauagugauuggcauguauggguacacgaccgagaaaauauaguaucccaaguaguaagcggggaucuuccagaaaacggaccaggauauuggggcaauuacaaaagauuucaugaugaagcagaaaaaauaggacuaaaugcaguaagaaucaaugucgaauggagcagaauauuuccaaggccauuaccaaaaccagaaaugcaaacaggaacagacaaagaaaauucaccaguaauaaguguggaucuaaacgaaucaaaacuaagagaaauggacaauuaugcaaaucaugaagcacuaucacauuauagacaaauauuagaagauuuaagaaaucgaggauuucauauaguacuaaauauguaucauuggacauuaccaauaugguuacaugauccaauaagaguuagaagaggagauuuuacaggaccaacaggauggcuaaauucaagaacaguauaugaguuugcaagauuuucagcauauguugcauggaaacuagaugaucuugcaucagaauaugcuacuaugaaugaaccaaauguuguuuggggcgcaggauacgccuuuccaagagcaggcuuuccaccaaauuaucuaaguuuucgauuaucugaaauagcaaaauggaauauaauucaagcccacgcaagagcuuacgaugcaauaaaaaguguuucaaaaaaaucagucggaauaauauacgcaaauacaaguuacuacccacuaagaccacaagacaaugaagcaguagaaauagcugaaagacuaaaucguuggaguuucuuugauagcauaauaaaaggugaaauaacaucagaaggccaaaacguaagagaagauuuaagaaauagauuagacuggauaggaguaaacuauuauacacgaacaguaguaacaaaagccgaaucaggauaccuaacauuaccaggauacggagacagaugugaaagaaauucauuaucuuuggcaaaucuaccuacaucugauuuuggaugggaauuuuuuccugaaggcuuauacgauguacuguuaaaauacuggaaccgauauggacuaccacuauacguaauggaaaauggaauagcagaugaugcugauuaucaaagaccauacuauuuaguaucacauauuuaucaagugcauagagcuuugaacgaaggaguagacguaagaggguauuuacauuggucccuagcagauaauuaugaauggucuucaggcuuuucaaugagauuuggauuauuaaaaguugacuacuuaacaaaaagacuuuacuggcgaccaagcgcauuaguuuacagagaaauaacaagaaguaauggaauacccgaagaauuagaacaucuaaauagagucccuccaauaaaaccauuaagacau

SEQ ID NO: 51197 - RNA, 1473 nt, Artificial Sequence
  derived and/or modified sequence opt6 from anti-influenza_Chain
auguuaucauuuccuaaaggauuuaaauuugguuggucacaaagcggcuuucaaucagaaaugggaacaccaggaucagaagauccaaauagugauuggcauguauggguacaugauagagaaaauauaguaagucaagucguaaguggugaucuaccagaaaauggaccaggauacuggggaaauuauaaaagauuccaugaugaagcugagaaaauagguuuaaaugcaguaagaauaaauguugaauggucaagaauuuuucccagaccacuuccaaaaccagaaaugcaaacaggaacugacaaagaaaauucaccaguaauaucaguagacuuaaaugaaaguaaauuaagagaaauggacaauuacgcaaaucaugaagcacuaucacauuacagacaaauacuagaagauuuaagaaacaggggauuucacauagucuuaaauauguaccauuggacauuaccaaucugguuacaugauccaauaagaguaagaagaggggauuuuacaggaccaacaggaugguuaaauucaagaaccguauaugaauuugcucguuucagugcauauguagcauggaaauuagacgauuuagcaagcgaauaugcaacaaugaaugaaccaaacguaguauggggagcaggauacgcauuuccaagagcaggauuuccaccuaauuauuuaucauucagauuaucagaaauagcaaaauggaauauuauacaagcacaugcaagagcauacgacgccauaaaaagcguaucuaagaaaucaguaggaauaauauaugccaauacaucauauuauccauuacguccacaagacaaugaagcuguagaaauagccgagagacucaauagauggagcuucuuugauucaauaauaaaaggugaaauaacauccgaaggacaaaauguuagagaagauuuaagaaauagauuagacuggauaggaguaaauuacuauacuagaacagucguaacaaaagcagaaagcgguuaucuuacucuacccggauauggagauagaugugaacgaaauucacuaucauuagcaaauuuaccaacauccgauuuuggaugggaauuuuuccccgaagguuuauaugauguauuacuaaaauauuggaacagauauggguuaccauuguauguaauggaaaaugguaucgcagaugaugccgauuaucaaagaccauauuaucuagugucucacauauaucaaguacacagagcauugaaugaagguguagauguaagaggauacuuacauuggucacuagcagacaauuacgaauggucaucaggauucucaaugcguuuuggucuacuuaaaguugauuaccuuaccaaaagacuauauuggagaccaagugcauuaguauauagagaaauaacaagaaguaauggaauaccagaggaauuagaacaccucaauagaguaccaccaauaaaaccauuaagacau

SEQ ID NO: 51198 - RNA, 1494 nt, Artificial Sequence
  derived and/or modified sequence opt6 from anti-influenza_Chain
auggcaucacaaggaacaaaaagaaguuaugaacaaauggaaacagauggagaaagacaaaaugcuacagaaauaagggcaaguguaggaaagaugauaggaggaauagguagauuuuauauacaaauguguacggaauuaaaacugagcgacuaugaaggaagauugauacaaaauaguuuaacuauagaaagaaugguauugagugcauuugaugaacgaagaaauaaauacuuagaagaacauccuucagcgggaaaagacccgaagaaaacaggaggaccaauauauagaagaguaaauggaaaauggaugagagaguuaauauuauaugauaaagaagaaauucgaaggaucuggagacaagcaaauaacggugaugaugcuacagcaggacuaacacauaugaugauauggcauagcaauuuaaaugacgcaacauaucaaagaacaagggcauuagugagaacaggaauggauccaagaaugugcaguuuaaugcaaggaagcacauuaccaagaagaucaggggcagcaggagcagcaguaaaaggaguaggaacaaugguaauggagcuaguaagaaugauaaaaagaggcauaaacgacagaaacuuuuggagaggcgaaaauggaagaaaaacacgaauagcguaugaaagaauguguaauauacuaaaaggcaaauuucaaacagcugcacaaaaagcaaugauggaccaaguaagagaaagccgugauccuggaaaugcagaauuugaagauuuaacauuucuggcuagaagcgcacuaauauugaggggaucgguagcacauaaaagcuguuuaccugcguguguauaugguccugcuguggcuucaggauacgauuuugaaagagaaggauauagccuaguggguauagauccuuuucgauugcuacagaauagucaaguuuauagcuuaaucaggccaaaugaaaauccagcacauaaaagucagcuaguauggauggcaugucacagugcagcauuugaagaccuucgaguacuaucauuuauuaaaggaacaaaaguaguacccagaggaaaauuaagcacaagagguguacaaauugcaucuaaugaaaauauggaaacaauggaaaguaguacauuagaauuaagaucaagauacugggcaaucaggacaaggagugguggcaacacaaaucaacaaagagcaucagcaggacaaauaaguauacaaccuacauuuucaguacaaagaaauuuaccauuugauagaacaacaguaauggcagcauucacagguaauacggaaggaaggacaagugacaugagaacagaaauaauaagaaugauggaaagugcaagaccagaagacguaaguuuucaaggaaggggaguauuugaauuaagugacgagaaagccgcaucgccaauaguaccaaguuucgauaugagcaaugaaggaagcuacuucuuuggcgacaaugcagaagaauaugauaau

SEQ ID NO: 51199 - RNA, 1494 nt, Artificial Sequence
  derived and/or modified sequence opt6 from anti-influenza_Chain
auggcaagucaaggaacaaaacgaucauaugaacaaauggaaacggauggagaacgacaaaaugcaacagaaauacgagcaaguguagguaaaaugauugauggaauuggacgauucuauauacaaauguguacagaauugaaauuaucagauuacgaaggaaggcuaauacaaaauaguuuaaccauagaaagaaugguucuaagugcauucgaugaaagaagaaauaaauacuuggaagaacauccuagcgcaggaaaagacccuaaaaaaacagguggaccuauauauaaacgaguagauggaaaauggaugagagaacucguacuauaugauaaagaagaaauaagaagaauauggcgacaagcuaacaacggagacgaugcaacagcaggauuaacacauaugaugauauggcauagcaacuuaaaugauacaacguaucaaagaacgagagcauuagucagaacagguauggauccaagaauguguaguuuaaugcaaggaagcacauuaccaagaagauccggcgcagcaggagcagcagugaaaggaguaggaacaaugguaauggaauuaauacgaaugauaaaaagaggaauaaaugacagaaacuuuuggagaggagaaaauggaagaaaaaccagaagugccuaugaaagaauguguaauauacuaaaagguaaauuucaaacggcagcucaaagagcaaugauggaucaaguaagagaaucaagaaauccuggaaacgcagaaauagaagaucuaauauuuuuagcaagaucagcauuaauacuaagaggaaguguugcacauaaaagcugucuaccggcaugcguauaugguccagcaauagcuucaggauauaacuucgaaaaagaaggauauucauuagucggaauagauccauuuaaauuacuacaaaauucacaaguauauagucuaauaagaccaaacgaaaacccugcacacaaaucacaacuaguauggauggcaugcaauucagcagcuuuugaagaccugaggguacuaucauuuauaagaggaacaaaaguaaguccaagaggaaaauuaucuacccgagguguacaaauagccucuaaugaaaauauggauacaauggaaagcucaacacuagaacuaagaucacgauauugggcaauaagaacaagaucaggagguaauacaaaucaacaaagagcaucagcaggccaaauaagcguacaacccgcauuuucaguucaaagaaaucuaccauuugauaaaccuacaauaauggcagcauuuacaggaaauacagaaggacgaacaagugauaugagagcugagauaauaagaaugauggaaggagcgaaaccggaagaaaugaguuuucaaggaagaggaguauuugaacuaucagaugaaaaagcaacaaauccaauaguaccaaguuuugauaugaguaacgaaggaagcuacuucuuuggggauaaugcagaagaguaugauaac

SEQ ID NO: 51200 - RNA, 1494 nt, Artificial Sequence
  derived and/or modified sequence opt6 from anti-influenza_Chain
auggcaucacaaggaacuaaaagaucauaugaacaaauggaaacaggaggagaaaggcaaaaugcaacagaaauaagagcaagcgugggaagaaugguaggaggcauaggaagauuuuauguacaaauguguacagaauuaaaauuaucagaucaagaaggaagauuaauccaaaauaguauaacaauagaaagaaugguauuaagugcuuucgaugaaagaagaaacagauauuuggaagaacauccuagugcaggaaaagacccaaagaaaacagguggaccaauauauagaagaagagaugguaaaugggucagagaacuuauucuauacgauaaagaagaaauuaggagaauauggaggcaagcaaacaauggggaagaugcaacagcaggauuaacccauaugaugauauggcacucaaacuuaaacgaugcuacauaucaaaggacacgagcauuagugagaacaggaauggauccaaggauguguagcuuaaugcaaggaucaacacuaccaagaagaaguggagcagcaggagcagcaauaaaaggugucggaacaaugguaauggaauuaauacgaaugauaaaaagaggaauaaacgauagaaauuuuuggaggggagauaauggaagacgaacgaggauagcauacgaacguauguguaauauauuaaaaggaaaauuucaaacagccgcacaaagagcgaugauggaucaaguaagggaaagcagaaauccaggaaaugcagaaauagaggaucuaauauuuuuagcgcgaagugcacuaauacuaagaggaucgguagcacacaaaaguuguuuaccggcaugcguauaugguuuagcaguggcgaguggauacgacuucgaacgagaaggauacagccuaguaggcauagauccauuuagauuacuccaaaacagucaaguuuuuagcuuaauaagaccuaacgaaaauccugcacauaaaucacaauuaguuuggauggcaugucacucggcagcauuugaagaccuaagaguaaguagcuuuauacgaggaacaagaguaauaccaagaggacaacuaagcacuagaggaguacaaauagcaaguaacgaaaauguagaagcaauggacucaagcacauuagaauuaagaucaagauauugggcaauuagaacgagaucaggaggcaacaccaaucaacaaagagcaagcgcaggacaaauuaguguacaaccuacauucucaguucaaagaaaucuaccauucgaaagaccaaccauaauggcagcauuuaaaggaaauacagaagguagaacaucagacaugaggacagaaauuauaagaaugauggaaucagcuagaccagaagacgugagcuuucaaggaagaggaguguuugaacuaucagaugaaaaagcgacaaauccaauagucccaaguuucgauaugaguaaugaaggaucguacuuuuucggagacaaugcugaagaauaugauaac

SEQ ID NO: 51201 - RNA, 1494 nt, Artificial Sequence
  derived and/or modified sequence opt6 from anti-influenza_Chain
auggcaagccaaggcaccaaaaggaguuacgaacaaauggaaacagauggagaaagacaaaaugccacagaaauaagggccucaguaggaaaaaugauaggggggauaggaagauuuuauauccaaauguguacagaacuaaaacuuucagauuaugaaggucgcuuaauacaaaauucacugacaauagaaagaaugguuuuaagcgcauuugacgaaagaaggaauaaauaucuagaagaacacccaucagcaggaaaagauccaaaaaaaacaggaggaccgauuuauagaagaguaaacggaaaauggaugcgagaauuaauauuauaugauaaagaagaaauuagaagaauauggagacaagcaaauaauggagaugaugcaacggcaggacuaacucauaugaugauauggcauucaaaucuaaaugacgcaacauaucaaagaacaagagcacuaguacgaacagguauggauccacgaauguguaguuuaaugcaagguaguacucuaccaagaagaagcggugcugcaggcgcagcugugaaaggaguaggaacaaugguaauggaauuaguaagaaugauaaaaagagggauaaaugauagaaauuuuuggagaggcgaaaacggcagaaaaacgagaaucgcauaugaaagaaugugcaauauauuaaaaggaaaauuccaaacugcagcacaaaaagccaugauggaccaaguaagagaaaguagagauccaggaaaugccgaauuugaggauuuaacuuuucuagcaagaagugcacuaauauuaagaggaaguguugcacacaaaagcuguuuaccagcaugcguauauggaccagcaguagcaucaggauaugauuucgaaagagaagguuauagucuuguuggaauagauccauuucgauuauuacaaaauucacaaguauacagucuaauaagaccaaaugaaaauccagcacauaaaagucaacuaguauggauggcuugucacagugcagcuuuugaggaccuaagaguacuaagcuuuauaaaaggaacaaaaguuguaccaagaggaaaacuaaguacgagaggaguacaaauagcaaguaacgaaaauauggaaacaauggaaaguaguacuuuagaacuaagaucacguuacugggcaauacgaacaagaucaggggguaauacaaaucaacaaagggcuucugcaggacaaaucaguauacaaccaaccuuuagcguacaaagaaauuuaccuuuugacagaacgacaguaauggcagcauuuacaggaaauacagaaggaagaacaagugacaugagaacugaaaucauaagaaugauggaaagugcaagaccagaagauguaagcuuccaaggaagagguguguucgaacuaucagacgaaaaagcagcaucaccaauaguaccaucauuugauaugucaaaugaaggaucauacuucuuuggagauaaugcagaagaauacgacaau

SEQ ID NO: 51202 - RNA, 1494 nt, Artificial Sequence
  derived and/or modified sequence opt6 from anti-influenza_Chain
auggcaucucaagguacaaaaagaagcuaugaacaaauggaaacagacggugaaagacaaaaugcgacagaaauaagggcaucaguagggaaaaugauagauggaauaggacgauuuuauauacaaaugugcacagaacuuaaacuaagcgauuacgaaggaagacuaauacaaaacucauuaacaauagaaagaaugguauuaucagcauuugacgaaagaagaaauaaguacuuagaagaacauccgucagcaggaaaagauccaaagaaaacgggaggaccaauauauaaaaggguagauggaaaauggaugagagaauuaguacuuuaugauaaagaagaaauaagaagaauauggagacaggcuaauaauggagacgaugcaacagcaggauugacacauaugaugauauggcauaguaauuuaaacgauacaacauaucagcguaccagagcuuuaguaagaaccggaauggauccaaggaugugcagucuaaugcaaggaagcacauugccaagaaggaguggugcugccggagcggcaguaaaaggggugggaacgaugguaauggaauuaauaagaaugauaaaaaggggaauaaaugacaggaauuuuuggagaggagaaaauggaagaaaaacaagaagugcauaugaaaggauguguaauauacuaaaaggaaaauuucaaacagcggcacaaagagcaaugauggaucaaguaagagaguccagaaauccugguaaugcagaaauagaggauuuaauauuuuuagcaagaagugcauuaauauuacgagggucaguagcacacaaaagcuguuuacccgcauguguauaugguccggcuauagcaucuggguauaauuuugaaaaagaaggauacagcuuaguaggaauugauccguuuaaauuacuacaaaacucucaaguauauucauugauaagaccaaaugaaaacccagcacauaaaucucaauuaguauggauggcuuguaauagugcugcauuugaagaucuaagaguacuaucauuuauaagaggaacaaaagucagccccagaggaaaauuaaguacaagaggaguacaaauagcaaguaacgaaaauauggauacgauggaaucaaguacauuagaauuaaggucgagauacugggcaauuagaacaagaagcgggggaaauacaaaucaacaaagagcaucagcggggcaaauaucaguacaaccagcauucaguguacaaagaaauuuaccauuugacaaaccaacaauaauggcagcauuuacaggaaacacagaaggaagaacaagcgacaugagagcagaaauaauuagaaugauggaaggcgcaaaaccagaagaaaugaguuuccaagguagagguguauucgaacuaucagaugaaaaagcaacaaauccaauagucccaaguuuugauaugagcaaugaaggaaguuacuuuuucggagauaaugcagaagaauaugauaau

SEQ ID NO: 51203 - RNA, 1494 nt, Artificial Sequence
  derived and/or modified sequence opt6 from anti-influenza_Chain
auggcaucacaaggaacaaaaaggucauacgaacaaauggaaacaggaggugaaaggcaaaaugcaacagaaauaagagcaaguguuggaagaaugguaggaggaauaggaagauuuuauguacaaauguguacggaauuaaaauuaagugaucaagaagggagguuaauacaaaauaguauaaccauagaaagaaugguacuuucugcauuugaugaacguagaaauagguauuuagaagaacauccaagugcaggaaaggauccaaagaaaacaggaggaccaauuuaucgaagaagagauggaaaauggguuagagaauuaauauuauacgauaaagaagaaauuagaagaauauggaggcaggcaaauaauggagaagaugcgacagcagguuuaacacauaugaugauauggcacaguaaucuaaacgaugcaacauaucaaagaacaagagccuuaguaagaacaggaauggauccaagaauguguaguuuaaugcaaggaagcacauuaccaaggagaaguggagcagcaggggcagcaauaaaaggaguaggaacgaugguaauggaauuaauaagaaugauaaaaagagguaucaaugauagaaauuuuuggaggggugacaauggaagacgcacaagaauagcauaugaaaggauguguaauauauuaaaaggaaaauuucaaacagcagcacaaagagcaaugauggaucaaguaagagaaaguagaaauccaggaaaugccgagauagaagauuugauauuuuuagcacguucagcauuaauacuaagaggaagugucgcucacaaaagcugcuuaccugcauguguauauggauuagcaguagcaaguggauacgauuucgaaagagaagguuauucuuuaguaggaauagauccauuuagauuacuacaaaauucacaaguauuuagucuaauuagaccaaaugaaaacccagcacauaaaagccagcuaguauggauggcaugucauucggcugcauuugaagauuuaagaguaaguaguuucauuagaggaaccagaguaauuccaagaggacaauuaucaacaagaggaguacaaauagcuucaaaugaaaauguggaggcaauggauaguagcacguuagaguugagaagccgauacugggcaauaagaacuaggaguggagguaauacuaaucaacaaagagcaucagcaggacaaauaagcguacaaccuacauuuagcguucaaagaaauuugccauucgaaaggccaacaauaauggcagcauuuaaagguaacaccgaaggaagaaccagugauaugagaacugaaauaauaaggaugauggaaagugcuagaccagaagacguaaguuuucaaggaagagguguauuugaacuaagugaugaaaaagcaacaaauccaauaguaccuagcuuugacaugaguaaugaagguaguuauuucuuuggagacaacgcagaagaauacgauaau

SEQ ID NO: 51204 - RNA, 1530 nt, Artificial Sequence
  derived and/or modified sequence opt6 from anti-influenza_Chain
auguuucccgaaaaauuccuauggggaguagcacaaagcggauuccaauuugaaaugggagacaaauuaagaagaaauauagauacaaacacagacugguggcacugggucagagauaaaacuaauaucgaaaaaggucuaguaagcggagaccuaccagaggaaggaauaaauaacuaugaacuuuacgagaaagaucaugagauagcaaggaaacuaggacucaaugcauauagaauuggaauagaaugguccagaauauuuccauggcccacaacauuuauagauguugacuacaguuauaaugaaucauauaauuuaauagaagauguaaaaauuacuaaagauacauuagaagaacuagaugaaauagccaauaaaagagaagucgcauauuacagaucuguaauaaauucauuaagauccaaaggauucaaagucauagugaauuuaaaucacuucacauuaccauauuggcuacacgaccccauugaagcaagagaaagagcucuaacgaacaaaagaaacggauggguaaaucccagaacaguaauagaauuugcaaaauacgcagcauauauagcauauaaauuuggagauauaguagacauguggucaacauuuaacgaaccaauggucguaguagaacuaggcuaucuagcaccauacucaggcuuuccaccaggaguccuaaauccggaagcagcaaaauuagcaauuuuacacaugauaaaugcacacgcacuagcauauagacaaauaaagaaauucgauacagaaaaagcugacaaagacucaaaagaacccgcagaaguaggaauaauauacaacaauauaggcguagcauacccaaaagacccaaaugauaguaaagauguaaaagccgcagaaaacgacaauuucuuucacaguggacuauucuucgaagccauacauaaaggaaaauuaaauauagaauuugauggagaaacuuucauagacgcaccauauuuaaaaggcaaugacuggauaggaguaaauuauuauacaagagaaguaguaacauaucaggaaccuauguucccaucaauaccauuaauaacauuuaaaggaguacaaggauacgguuacgcuugucgaccaggcacauuaucaaaagaugacagaccaguaucagacaucggaugggaauuauauccagaagguauguaugacucaauaguagaagcucauaaauacggaguaccaguauacguaaccgaaaacggaauagcagacucaaaagauauauuaagaccuuacuacauagcaucacauaucaaaaugaccgaaaaagcauucgaagauggauaugaagucaaaggcuacuuucauugggccuuaacagacaacuuugaaugggcauuaggauuuagaaugagauuuggccuauacgaaguaaaucuaauaacaaaagaaagaauaccaagagaaaaaucaguaucuauauuuagagaaauaguugcaaacaauggagucacaaagaaaauagaagaagaacuacuaagaggu

SEQ ID NO: 51205 - RNA, 1530 nt, Artificial Sequence
  derived and/or modified sequence opt6 from anti-influenza_Chain
auguucccagaaaaauucuuauggggaguagcacaaucaggauuccaauucgaaaugggagauaaacuacgaagaaauauagauacaaauaccgauugguggcacuggguaagagacaaaaccaauauagaaaaaggauuaguaaguggagaccuaccagaagaaggaaucaauaacuaugaacuauacgaaaaagaccacgaaauagcaagaaaauuaggauuaaacgcauaccgaauuggaauagaauggucaagaauauuuccguggccaacaacauuuauagauguagauuacucauacaacgagagcuauaauuuaauugaagauguaaaaaucacuaaagauacauuagaagaacuagaugaaauagcaaauaaacgagaaguagcauacuacagaucaguaauaaacucauuaagaucaaaaggauuuaaaguaauaguaaaucuuaaccacuucaccuuaccuuauuggcuacacgauccaauagaagccagagaacgagcauuaacgaacaaaagaaauggcuggguuaauccaagaacaguaaucgaauuugcaaaauaugcagcauacauagcuuauaaauucggagacauaguagauauguggucaacauuuaacgaacccaugguaguagucgaacuuggauacuuagcaccauacucuggauucccaccaggcguacuaaauccagaagcagcaaaacuagcuauacuacauaugaucaacgcacacgcacuagccuauagacaaauaaagaaauucgauacagaaaaagcagacaaagauucuaaagaaccagcagaagucggaauaauauacaauaauauaggaguagcauauccaaaagauccaaacgacaguaaagauguaaaagcagcugaaaacgacaauuucuuucacucuggauuauucuuugaagcaauccacaaaggaaaacuaaacauagaauuugauggagaaaccuuuauagaugcucccuauuuaaaaggaaaugacuggauaggcgucaacuacuacacaagagaagucguaacauaucaagaaccaauguuucccaguauaccacuaauaacauuuaaagguguacaaggauauggauacgcauguagaccaggaacauuaagcaaagaugaccgaccaguaucugacauaggaugggaacuuuauccagaaggaauguaugauaguauagucgaagcccauaaauauggagucccuguauauguaacagaaaaugguaucgcagacucaaaagacauacuaagaccuuacuauauagcaucacauauaaaaaugacagaaaaagcauuugaagauggauaugaaguaaaaggauacuuucacugggcacuaacagauaacuuugaaugggccuuaggcuuucgcaugagauuuggauuguacgaaguaaauuuaauaacaaaagaaagaauacccagagaaaaaucaguaucaauauuuagagaaauaguagcaaacaauggaguaacaaagaaaauagaagaagaacuauuaagaggu

SEQ ID NO: 51206 - RNA, 1536 nt, Artificial Sequence
  derived and/or modified sequence opt6 from anti-influenza_Chain
augaaaagaaaaguaaaaaaaauggcagcuauggcuacaaguauaauuauggcaauaaugauaauauuacauagcauaccugucuuagcaggaagaauaauauaugauaacgaaacaggaacacauggcgguuacgacuaugaauuauggaaagauuacgguaauacaauaauggaacuaaaugauggaggaaccuuuaguugucaauggaguaauauagggaacgcucuuuuccgaaaaggaagaaaauuuaacucagacaaaacauaucaagaacucggagacauugucguagaauauggaugcgacuauaauccuaacgguaauagcuacuuaugcgucuacggauggacacgaaauccauuaguagaauacuacauaguagaaaguuggggaaguuggagacccccaggcgccacaccaaaaggcacuauaacacaauggauggcaggaacauaugaaauauaugaaacaacacgaguuaaccaacccucaaucgacggcacugcuaccuuccaacaauauuggagcguaagaacaaguaaaagaacaagcgguacaauuucagucacagaacauuuuaaacaaugggaacgaaugggaaugagaaugggaaaaauguacgaaguagcauuaacaguagaaggauaucaaucaucaggauaugcaaauguauauaaaaaugaaauaagaauuggcgcaaaccccacaccggccccaucgcaaucaccaauuagaagagacgcauucucaauaauagaagccgaagaauauaacucaacaaauucaucuacacuacaaguaauaggaaccccuaauaauggaagaggaauaggauauauagaaaacggaaacacaguaacauauucaaauauugauuuuggcaguggcgcaacaggauuuucugcaacuguagcaaccgaaguaaauacaaguauacaaauaagaucagauucaccaacaggaacauuacuugguacauuauauguuuccucaacaggaucauggaauacauaccaaacuguaagcacaaacauuucaaaaauaacaggcguacacgauauaguacuaguauucucaggaccaguaaacguugauaauuucauuuucagucgaucaagucccguaccagcaccaggagacaauacaagagacgcauauucaauaauacaagcagaagauuaugauucuaguuauggaccaaaucuacaaauauucucacuccccggcggaggauccgcuauaggauacauagaaaauggcuacucuacuacauauaaaaauauagacuuuggagacggagcaacaucagucacagcaagaguagccacccaaaaugcuaccacuauacaaguaagacuaggaucaccuuccggaacauuauuaggaacuauauauguaggaucaacuggcuccuuugauacauaccgagauguaucugcaacaauuucaaacaccgccggaguuaaagauauuguacuuguauuuucaggaccagucaauguagauugguuuguauucucaaaaucugguaca

SEQ ID NO: 51207 - RNA, 1536 nt, Artificial Sequence
  derived and/or modified sequence opt6 from anti-influenza_Chain
augaaaagaaaaguaaagaaaauggccgcaauggcaaccuccauaauaauggcaauaaugauaaucuuacauaguauaccaguacuagcaggcagaauaaucuacgauaacgaaacaggcacacauggaggauacgauuacgaacuauggaaagauuacggaaauacaaucauggaacuaaaugacggaggaacauuuaguugucaauggaguaacauaggaaacgcauuauuucgaaaaggaagaaaauuuaauucugauaaaacauaucaagaauuaggagacauagucguagaauauggaugugauuacaauccaaauggaaacucauacuuauguguauacggauggacuaggaauccguuaguagaauauuauauaguagaaaguuggggaaguuggagaccaccaggagcaacaccuaaaggaaccauuacucaauggauggcagguacauacgaaauauaugaaaccacaagaguaaaccaaccaagcauagacgguacagcaacauuccaacaauacuggagcguuagaacuucaaaaagaacaucaggaacaauaagcgucacugaacauuuuaaacaaugggaaagaaugggaaugagaaugggaaaaauguaugaaguagcauuaacaguagaaggauaccaaucaaguggauacgcuaauguauauaaaaaugaaauaagaaucggagcaaacccgacaccagcaccgucacaaaguccuauaagaagagaugcuuuuagcauaauagaagcugaagaauauaauaguacaaauucuucaacccuacaaguaauagguaccccaaacaacggacgaggaauaggauacauagaaaacggaaauacagucacauacucuaacauugacuuuggaagcggagcaaccggauucagugcuacaguagcaacugaaguaaauacaucaauacaaauaagauccgauaguccgacaggaacauuacuaggaacauuauacguaagcucaacaggaucauggaacacuuaccaaacaguaaguacaaacauaucaaaaauaacaggaguacacgauauuguuuuaguauucaguggaccagucaacguagauaauuucauauuuucaagaaguucaccaguaccagcaccaggagacaauacaagagacgcauauuccauaauucaagcagaagacuacgauaguucauacgguccaaaucuucaaauauuuagucuaccagguggugguucagcaauuggauacauugaaaauggauauagcacaacauauaaaaacauagauuucggugacggagcaacaagcguaacagcccgaguggcaacacaaaacgccaccacaauacaaguuagauuaggaagcccaaguggcacacuacuaggaacaauauacguaggaucaacgggaucauuugacacauauagggaugugucagcaacgauaucaaauacagcaggaguaaaagauauaguauuaguauuuucagguccaguaaauguagacugguucguauuuucaaaaucagguaca

SEQ ID NO: 51208 - RNA, 1539 nt, Artificial Sequence
  derived and/or modified sequence opt6 from anti-influenza_Chain
aucuguauaggcuaccaugcaaacaacaguacagaacaaguugacacaauuauggaaaaaaacguaacaguaacccaugcacaagacauacuagaaaaaacacacaacggaaaacuaugcgaccuagacggagucaaaccccuaauacucagagauugcucaguagcuggaugguuauuaggcaauccuaugugugacgaauucauaaauguaccagaauggucauacaucgucgaaaaagccaacccugcaaacgaucuaugcuauccagguaacuuuaacgauuacgaagaauuaaaacaucuacuaucaagaauaaaccauuucgaaaaaauacaaaucauuccaaaaagcuccuggucagaccacgaagcauccucuggaguaucaagcgcauguccauaucaaggaacaccaucuuucuuuagaaauguuguauggcuaauaaaaaaaaauaauacauauccaacaauuaaaagaucauacaacaauacuaaccaagaagaucuacuuauacucuggggaauacaccacucuaacgacgccgcagaacaaaccaaauuauaccaaaaucccacuaccuacauauccguaggcacaucaacacuaaaccaaagacuagucccaaaaauagcuacaagaucaaaaguaaacggucaaaaugguagaauggacuuuuucuggaccauacucaaaccaaaugaugccauuaacuucgaaucaaacgguaacuuuauagcuccagaauacgccuauaaaauugucaagaaaggauacauacccgaagcaccucgugauggacaagccuacguacgaaaagacggugaauggguauuacuaucaaccuuuuuaagaucagacaaaacacacacaugccccccuugcccagcaccugaacucuuaggaggucccucuguauucuuauuucccccuaaaccaaaagacacacuaaugauuucacgcacaccagaaguaacaugcguaguagucgauguaucacacgaagaccccgaaguuaaauucaacugguaugucgacggcguagaaguacacaaugcaaaaacaaaaccuagagaagaacaauacaacucaacuuacagaguaguaucaguccugacaguccuacaucaagacuggcuaaauggaaaagaauacaaaugcaaaguaagcaauaaagcacuacccgcaccaauagaaaaaaccauaagcaaagccaaaggacaaccaagagaaccacaaguauacacccuaccuccuucaagagaagaaaugacaaaaaaccaaguaucacuaacaugucuaguaaaaggauucuauccauccgacauagcaguagaaugggaaucaaacggacaaccagaaaacaacuacaaaacaacaccaccaguacuagacucagauggaucauuuuuucuuuacucaaaauuaaccguagacaaauccagauggcaacaaggaaacguauucucauguucagucaugcacgaagcauuacacaaccacuacacccaaaaaucauuaucacucucaccaggaaaa

SEQ ID NO: 51209 - RNA, 1539 nt, Artificial Sequence
  derived and/or modified sequence opt6 from anti-influenza_Chain
aucugcauaggauaucacgcuaauaacucuacugaacaaguagauacaauaauggaaaaaaacguaacagucacacacgcccaagacauacuagaaaaaacacacaauggaaaauuaugcgaucuagacggaguaaaacccuuaauacuccgagacugcucugucgccggauggcuucuaggaaauccaaugugcgacgaauucauaaauguacccgaauggucauacauaguagaaaaagcaaacccagcaaacgaccuauguuauccagguaacuucaaugauuacgaagaacucaaacauuuauuaucacgaaucaaccacuuugaaaaaauccaaaucauaccaaaaucaucauggucagaccacgaagcaucaucaggcguaucaucagcaugcccauaucaagguacaccaucuuuuuuuagaaacguaguauggcuaauaaaaaaaaauaauacauacccaacaaucaaaagaucauacaacaauacaaaccaagaagaccuccuaauucuguggggaauacaccacuccaacgacgcagcagaacaaacuaaacuauaccaaaacccaacaaccuacauaagcguaggaacaucaacccuaaaccaacgacucguucccaaaauagcaacaagaucaaaaguaaauggacaaaauggcagaauggacuuuuucuggacaauauuaaaaccaaaugacgcaauuaacuucgaaucaaacggaaacuucauagccccagaauacgcauauaaaauaguaaaaaaaggauauauaccagaagccccacgagacggacaagcauauguacgcaaagauggagaauggguccuauuaucaacauuccuacgaucagacaaaacccacacaugcccaccaugcccagcaccagaacuccucggaggaccaucaguauucuuauucccaccaaaaccaaaagacacacuaaugauaucuagaacaccagaaguaaccugcgucguaguugacguuucacacgaagacccagaaguaaaauuuaacugguacguugacggaguagaaguacacaaugcaaaaacaaaaccuagagaagaacaauauaacucaacguaccgaguaguaucaguucuaacuguacuacaccaagauuggcuuaauggcaaagaauacaaaugcaaaguauccaacaaagcauuacccgcacccauagaaaaaaccauauccaaagcuaaaggacaaccacgagaaccacaaguauauacacucccaccaucaagagaagaaaugacaaaaaaccaaguuucacuaacaugcuuaguaaaaggcuucuacccuucagacauagcagucgaaugggaauccaauggacaaccagaaaacaacuauaaaacaacaccaccagucuuagacagcgacggaucauuuuucuuauacucaaaacugacuguagacaaaucucgauggcaacaaggaaauguauucuccugcucaguaaugcacgaagccuuacauaaucacuacacucaaaaaucucuaucauuaucaccaggaaaa

SEQ ID NO: 51210 - RNA, 1593 nt, Artificial Sequence
  derived and/or modified sequence opt6 from anti-influenza_Chain
acacuaugcauaggauaccacgcaaauaauagcacagacacuguagacacuguacuagaaaaaaacguaacaguuacucacagugucaaccuauuagaagacaaacacaacggaaaacuauguaaacugcgcggaguagcaccucuacacuuagguaaaugcaauauagcaggauggauacucggaaaucccgaaugugaaucccucagcacggcaucaagcuggucauauauaguagaaacgagcucaucagauaacggaacaugcuauccaggcgacuuuauagauuacgaagaacuacgcgaacaacuaaguucaguaaguucauuugaacgauucgaaauauucccuaaaaccaguucauggccaaaccacgacucaaacaaaggagucacagcagcauguccacaugcaggcgcaaaaucauucuacaaaaauuuaauauggcugguaaaaaaaggaaacagcuacccaaaauuaucaaaaucauacauaaacgauaaaggcaaagaaguauuaguacuuugggggauacaccacccaagcacaucagcagaccaacaaucacuauaccaaaacgcagaugccuauguauuuguaggcacaucuagauauucaaaaaaauucaaacccgaaauagcaauacgaccaaaaguucgagaccaagaaggcagaaugaacuacuauuggacacucguagaaccuggugacaaaauaacauucgaagcaacaggaaaccuaguuguacccagauacgcauuugccauggaacgagaugcaggaucaggaauuaucauaucagacacaccaguacacgacuguaacacaacaugccaaacaccuaagggagcaauaaacacaucacuacccuuucaaaauauacacccaauaacaauaggaaaauguccaaaauacgucaaaucaacaaaacuacgauuagccacgggacuaagaaaugugccaucuauacaaucaagaggauuauuuggagccauagcaggauuuauagaaggcggauggacuggaaugguagauggaugguauggauaccaucaccaaaacgaacaaggaucaggauacgccgcagacuuaaaaaguacacaaaacgcaauagacgaaauaacaaacaaaguaaacucaguaaucgaaaaaaugaauacacaauuuacagcagucgguaaagaauucaaccaccuagaaaaaagaauagaaaaccuaaauaaaaaaauagaugacggcuucuuagacauauggaccuacaaugccgaacuacuaguauuauuagaaaaugaaagaacacucgauuaccaugacuccaacguaaaaaauuuauaugaaaaagucagaagucaacuaaaaaacaacgcaaaagaaauaggcaacggaugcuucgaauucuaccauaaaugcgacaacacaugcauggaaaguguaaaaaauggaacauaugacuacccaaaauacagugaagaggcaaaauuaaaccgcgaagaaauagacggaguaaaacuugaaucaacaagaaucuaucaaauauuagcaauauauuccacaguagcaucaucauuaguacucguaguaucauuaggagcu

SEQ ID NO: 51211 - RNA, 1593 nt, Artificial Sequence
  derived and/or modified sequence opt6 from anti-influenza_Chain
acauuauguaucggauaccacgcaaacaacucaacagauacaguagacacaguacuagaaaaaaauguaacaguuacacacucuguaaaucuucuagaagacaagcauaacggaaaacucugcaaauugagaggaguugcucccuuacaccucggaaaauguaacauagcagguuggauucuaggaaauccagaaugcgaaucacuaucaacagcaaguaguuggucauguauaguagaaacuagcucuucagacaacggaacauguuacccaggagauuuuauagacuacgaagaauuaagagaacaacuuucaaguguaaguagcuucgaacguuucgaaauauucccaaaaacaucaucauggccgaaucacgauagcaauaaagguguaacagcagccugcccgcacgccggagcaaaaagcuucuacaaaaaccuaauauggcuagugaaaaaaggaaauucauacccaaaacuaucaaaaagcuauauaaacgacaaaggaaaagaaguauuaguacuauggggaauccaucacccuucaacuagugcagaccaacaaucacuauaucaaaacgcagacgcguacgucuucguaggaacuaguagauauucaaaaaaguucaaaccagaaauagcaauaagaccaaaaguacgagaccaagaaggaagaaugaacuacuacuggacacuaguagaaccaggagauaaaauaacauucgaagcuacaggaaaccuaguaguaccacgauacgcauuugcuauggaaagagacgcaggaucuggaauaauaauaucggauacuccagugcacgauuguaauacgacaugccaaacaccaaaaggugcuauaaacacaaguuuaccguuccaaaacauacacccaauaacgauaggcaaauguccaaaauauguaaaaucaacaaaauuaagauuagccacuggauuaagaaauguaccaagcauccaaucaagaggauuauucggagcaauagcaggauucauagaaggaggauggacaggaaugguagacggaugguacggauaucaccaccaaaaugaacaaggaagcggcuaugcagccgacuuaaaaaguacacaaaacgcaauagacgaaauuacuaacaaaguaaacucaguaauagaaaaaaugaacacacaauucacagcagucggaaaagaauucaaccaucuagaaaaacgaauagaaaacuuaaauaaaaaaauagaugacggauuuuuagacauauggacauacaaugcagaacuacucguuuuacuagaaaacgaaagaacucuagauuaucacgacuccaacguaaaaaaccuauacgaaaaaguacgaucacaauuaaaaaacaaugccaaagaaauaggaaacgguugcuucgaauucuaucacaaaugcgacaauacauguauggaaucagugaaaaauggaacauacgacuacccgaaauacucugaagaagccaaauuaaaucgagaagaaauugacggaguaaaacuagaaagcaccagaauauaucaaauacuagcaauauacucaacaguagcaucuagccuaguacuaguaguaucacuaggagca

SEQ ID NO: 51212 - RNA, 1593 nt, Artificial Sequence
  derived and/or modified sequence opt6 from anti-influenza_Chain
acauuaugcauaggauaccacgcaaacaauucaacagacacaguagacaccguacuagaaaaaaacguaacuguaacacacagcgucaaucuauuagaagauaagcacaacggaaaauuauguaaacuaagaggaguugcacccuuacacuuaggaaaaugcaacauagcagguuggauacucggaaauccagaaugcgaaagccuaucaaccgcaucaucuuggucauacauaguugaaacauccucaagcgauaauggcacuugcuacccuggagauuucauagauuacgaagaacuacgagaacaacuauccagcguaaguucauucgaaagauucgaaauauucccaaauacaucaucauggccaaaucaugauucaaauaaaggaguaacagcagccugcccacaugcaggagcaaaaucguuuuacaaaaacuuaauauggcucguaaaaaaaggaaacucauauccaaaacuaucaaaauccuacauaaaugacaaaggaaaagaaguccuaguauuauggggaauacaucauccaaguacauccgcugaucaacagucauuauaccaaaacgccgaugccuauguauuuguaggcacaucacgauacucaaaaaaauucaaaccagaaauagcaauuagaccaaaaguaagagaucaagaaggaagaaugaauuauuacuggacacuaguagagccaggugauaaaauaacauuugaagcaacagguaacuuaguagucccaagauacgcauuugcaauggaaagagacgcaggaucaggaauaauaauaucagauacaccaguacaugacuguaauacaacaugccaaacaccaaaaggagccauaaacacaucccuaccauuccaaaacauacacccaaucaccauaggaaaaugcccaaaauacgucaaaagcacaaaacuaagacuugccacaggauuaagaaacguacccaguauacaaucacgaggacuauuuggagcaauagcaggauucauagaaggaggauggacaggaaugguagauggcugguauggauaccaucaucaaaacgaacaagguucaggauacgcagcugaucuaaaaucaacucaaaacgcaauagaugaaauaacaaacaaaguaaauagcguaauagaaaaaaugaacacucaauucaccgcagucggaaaagaauuuaaccaccuagaaaaaagaaucgaaaaucuuaacaaaaaaauagaugacggauuccuagacauauggacauacaaugccgaacuuuuaguacuacuugaaaaugaaaggacauuagacuaccacgauucaaauguaaaaaaccuauacgaaaaaguaagaucacaacuaaaaaacaaugcaaaagaaauuggaaauggcugcuucgaauuuuaucacaaaugcgauaacacaugcauggaaagcguaaaaaauggaacauacgauuaucccaaauauucagaagaagcaaaauuaaauagagaagagauagacggcguaaaauuagaauccacacgaaucuaccaaauacuagcaauauacucaacaguugcaaguucccuaguacuagucguuagccuaggagca

SEQ ID NO: 51213 - RNA, 1593 nt, Artificial Sequence
  derived and/or modified sequence opt6 from anti-influenza_Chain
acauuaugcauaggauaccacgcaaacaauuccacagacacaguugacacaguauuagaaaaaaacguaacuguuacacacucuguaaaccuuuuagaagacaaacacaacggaaaacuaugcaaacuaagaggaguagcaccauuacaccuaggcaaauguaauauugccgguuggauauuaggcaacccagaaugcgaaucucuuagcacagcauccagcuggagcuauauaguagaaaccaguucaagugauaacggaacauguuauccaggagacuucauagacuaugaagaauuaagagaacaacuaucaucagucagcucauuugaacgauuugaaauauucccaaaaacuagcucauggccaaaucaugacucaaacaaaggaguaacagcagcaugcccacaugccggagcaaaaucauucuauaaaaacuuaauauggcuaguaaaaaaaggaaauagcuaccccaaauuaucaaaaucauacauuaacgacaaaggaaaagaaguauuaguauuauggggaauacaucacccuuccacuucagcagaucaacaaucacucuaccaaaacgcagaugcauauguauuuguaggaaccagcagauacucaaaaaaauucggaccagaaauagccauaagaccaaaaguaagagaucaagaaggaagaaugaauuacuacuggacauuaguagaaccuggagauaaaauaacauuugaagcaacagguaaucuagucguacccagauacgcauucgcaauggaacgagacgccggcaguggaauaaucauaucagacacaccuguacacgacuguaauaccacaugccagacacccaaaggagcuauaaacacaucauuaccauuucaaaauauccacccaauaaccauaggaaaaugcccaaaauacguaaaaucaaccaaacugagguuagccacaggcuuaagaaacgucccuucaauacaaucaagaggacuauuuggagcaaucgcgggauuuaucgaaggaggauggacagguaugguugauggaugguauggauaccaccaccaaaacgaacaaggaucaggauaugcagcagaucucaaaucaacacaaaacgcaauagacgaaauaacaaacaaaguaaacucagucauagaaaaaaugaauacacaauucacagcaguaggcaaagaauuuaaucacuuagaaaaaagaauagaaaaucuaaauaaaaaaauagacgacgguuuccuggacauuuggacuuauaaugccgaacuuuuaguacuucuagaaaacgaacgaacgcuagauuaccaugacagcaacguaaaaaacuuauacgaaaaaguucgaucacaauuaaaaaacaaugcaaaagaaauaggaaauggcugcuuugaauuuuaccacaaaugcgauaacacaugcauggaaucuguaaagaauggaacauacgacuauccuaaauauucagaagaagcaaaacucaauagagaggaaauagacggaguaaaacucgaaucaacaaggauauaucaaauauuagcaauauacuccaccguagcaucaagucuaguacucguaguuucucuaggagcg

SEQ ID NO: 51214 - RNA, 1593 nt, Artificial Sequence
  derived and/or modified sequence opt6 from anti-influenza_Chain
acccucuguauaggauaucaugccaacaacucaacagauacaguagauacaguacuugaaaaaaacguuacaguaacacauucaguaaauuuacuagaagauaaacauaacggcaaacucugcaaauuaagaggaguagcaccauuacaccuuggaaaaugcaacauagcaggcuggauccuaggaaacccagaaugcgaaaguuuaaguacagcaucaagcuggucauauaucguagaaacaaguuccagcgacaauggaacauguuauccaggcgauuuuauagauuacgaagaacuaagggaacaacuaaguucaguaucaagcuuugaaagauucgaaauuuucccaaaaacaagcaguuggccuaaccacgauucaaauaaaggaguaacagccgccuguccacacgcaggcgcaaaaucauucuauaaaaaucuaauauggcucguaaaaaaaggcaauucauacccaaaauuaucaaaaaguuacaucaacgacaaaggaaaagaagucuuagugcuauggggaauacaccacccaaguaccagcgcagaccaacaaagucuauaccaaaacgcggacgcauacguauucguaggaaccucaagauacagcaaaaaauuuaaaccagaaauugcaauaagaccaaaaguaagagaccaggaaggaagaaugaauuauuacuggacacuaguagaaccaggagacaaaauuacauucgaagccacaggcaauuuaguaguaccacgauacgcuuucgcgauggaaagagaugcaggaaguggaauaaucauuagcgacacaccuguacacgauuguaacacaacaugucagacaccuaaaggagcaauaaacacaaguuugccauuccaaaacauacauccaauaacaauaggaaaaugcccaaaauacguaaaaucaacaaaacuaagauuagcaacaggauuacgaaauguaccaucaauccaaucaagagguuuauucggagcaauagcaggauuuauagaaggaggauggaccggaauggucgacggcugguacggauaccaucaccaaaacgaacaaggaucaggauacgcagcagaccuaaaaaguacccaaaaugcaauagacgaaauaacaaacaaaguaaacucaguaauugaaaaaaugaacacacaauucacagcagucggaaaagaauucaaucaccuagaaaaaagaauugaaaaccuaaauaaaaaaaucgacgacggcuucuuagacauauggacauacaaugcagaauuauuaguauuacucgaaaacgaaagaacauuagacuaccaugacucaaacguaaaaaauuuauacgaaaaaguuagaucccaauuaaaaaacaacgccaaagaaauaggaaacggauguuuugaauucuaucacaaaugugauaauacaugcauggaaaguguaaaaaacggaacauaugacuauccaaaauacagugaagaagcaaaauuaaaccgggaggaaauagacggcguuaaacuagaaucaaccagaaucuaccaaauacuagcaauauacagcacaguagccucaucauuaguucuagucguaagcuuaggagca

SEQ ID NO: 51215 - RNA, 1593 nt, Artificial Sequence
  derived and/or modified sequence opt6 from anti-influenza_Chain
acacuuuguaucggauaccacgcaaacaacuccacagauaccguagacaccguccuagaaaaaaauguaacaguaacacacucaguuaaccuucuugaagauaaacauaacggcaaacuaugcaaauuaagaggugucgcaccucuacacuuaggcaagugcaacauagcuggauggauauuaggaaacccagaaugcgaaucccuaucaaccgcuucauccuggucauguauaguagaaacaucaagcucagacaacggcacauguuauccgggagauuucauagacuacgaagaacuaagagaacaacuaaguaguguaucaucuuuugaacgauucgaaauuuucccaaaaaccucaucauggccaaaucaugacucaaacaaaggaguuacagcagcauguccacaugcaggugcuaaaucauucuacaagaaccuaauaugguuaguaaaaaaaggaaauaguuaccccaaacuaucaaaaucauacaucaaugauaaaggaaaagaaguacuaguauuauggggaauacaucacccaaguacaagcgcagaucaacaaagccuauaucaaaacgcagaugcuuaugucuucguagguacaucaagauacagcaaaaaauuuaaaccagaaauagcaauaagaccaaaaguacgcgaccaagaaggaagaaugaacuauuacuggacucuaguagaacccggagacaaaauaacuuuugaagcuaccggcaaucuaguaguaccgagauacgcauucgccauggaaagagacgcaggcuccggaaucauaauaucugacacaccaguccacgacugcaacacaacaugccaaacaccaaaaggagccaucaauacaagccuacccuuccaaaacauacacccuaucacaauuggaaaaugucccaaauacguaaaaaguacaaaauuaagauuagcaacaggauuacgaaacguaccgaguauacaaucacgaggauuauucggagcaauugccggcuucauagaaggcggauggaccggaauggucgacggaugguacggauaccaccaccaaaacgaacaaggaucuggauacgcagccgaccuaaaaucaacacaaaaugcaauagaugaaaucacaaacaaaguaaacucaguaauagaaaaaaugaauacacaguuuacagcaguaggaaaagaauucaaucaucuagaaaaaagaauagaaaaucuuaacaaaaaaauagaugacggguuuuuagacauauggacauauaacgcagagcuauuaguauuacuagaaaaugaaagaacauuagacuaccacgauucuaacgucaaaaaccuauaugaaaaaguaagaagccaacuaaaaaacaacgcaaaagagaucggaaacggaugcuucgaauucuaucauaaaugcgacaacacuugcauggaaucaguaaaaaauggaacauacgauuaucccaaauauagcgaagaagcaaaacuaaaucgagaagaaauagauggaguuaaacuagaaucaacccgaauauaccaaaucuuagcaauauacucaacaguagcaucaucccuaguacuaguaguuucacuaggugca

SEQ ID NO: 51216 - RNA, 1593 nt, Artificial Sequence
  derived and/or modified sequence opt6 from anti-influenza_Chain
acauuauguauagguuaccacgcaaauaauucaacagacacaguagauacaguauuagaaaaaaacguaacggucacccacagcguaaaccuacucgaagauaaacauaacgggaaacucugcaaauuacgaggaguagcaccacuacaccucggaaaaugcaacauagccggauggauacugggaaacccagaaugugaaucacuuucaacagcaaguucauggaguuauaucguagagacaaguucaagcgacaacggaaccugcuacccaggcgacuucauagacuacgaagaacuccgcgaacaacuaucauccguaaguagcuuugaaagauuugaaauuuuuccaaauacuucaucauggccaaaccaugauaguaacaaaggaguaacugcagcaugcccacaugcaggagcaaaaucauucuacaaaaaccuuauauggcuagucaaaaaagguaacucauacccuaaacuaucaaaaagcuacauaaacgacaaaggaaaagaaguauuaguauuauggggaauccaccacccaucaacaucagccgaccaacaaucacucuaucaaaaugcagaugccuacguauuuguaggaacaucaagauacagcaaaaaauucaaaccagaaauagccauuagaccaaaaguaagagaucaagaaggaagaaugaauuacuacuggacauuaguagaacccggugacaaaauaacauucgaagcuacuggaaaccuaguaguuccccgcuaugcauucgcaauggaaagagacgcagguucagggauaauaauaagugacaccccaguucacgauuguaacacaacaugccaaacccccaaaggagcaauaaacacaagucuaccauuccaaaacauacacccaauaacaauaggaaaauguccaaaauacguaaaaucaaccaaauuacgacuagcaacaggccuaagaaauguaccaucaauacaaucaagaggacuauucggagcgaucgcaggauuuaucgaaggaggauggacaggaaugguagauggaugguacggcuaccaucaccaaaacgaacaaggcucagguuacgcugcagacuuaaaaucaacacaaaacgcaauagaugaaauaacaaacaaaguaaacuccguaauugaaaaaaugaauacacaauuuacagcuguaggaaaagaauucaaccaccucgaaaaacgcauugagaaccuaaauaaaaaaauagacgacggauuccuagauauauggacauacaaugcagagcuacuaguacuccuagaaaaugaaagaacacuagacuaucaugauuccaacguaaaaaacuuauacgaaaaaguaagaagccaacugaaaaauaaugcaaaagaaauaggaaauggaugcuuugaauucuaccauaaaugcgacaacacaugcauggaaucaguaaaaaacggaacauacgauuaucccaaauauagcgaagaagcaaaacucaaccgagaagaaauagacggcguaaaauuagaaucaacaagaauauaucaaauauuagcaaucuacucaacaguagcaucuucauuaguauuaguaguaucauuaggugcc

SEQ ID NO: 51217 - RNA, 1593 nt, Artificial Sequence
  derived and/or modified sequence opt6 from anti-influenza_Chain
acccuaugcaucggauaccacgcuaacaauuccacagauacagucgacacaguacuagaaaaaaacguaacagucacccacagcguaaaccuacuagaagacaaacauaauggcaaacuauguaaauuacgaggaguagcaccacuacaccuaggaaaauguaacaucgcaggcuggauacuaggaaauccagaaugcgagucacuaagcacagccucaucauggucauacauaguagaaacaucaucaucugauaauggaacauguuaccccggagacuucauagacuaugaagaacuaagagaacaacuaagcagcgucagcucauucgaacgauucgaaauauuucccaaaacauccucuuggccaaaccacgauaguaauaaaggaguaacagcagcuuguccacacgcuggagcaaaaucauuuuauaaaaaccuaauaugguuaguaaaaaaaggaaauaguuauccaaaacuaagcaaaucauacauaaacgacaaagguaaagaaguauuaguacuaugggguauccaucacccaagcacaagcgcagaccaacaaucacucuaucaaaaugcagacgcauacguauuugucggaaccucaagauacagcaaaaaauucggaccagaaauagcaauaagaccaaaaguaagagaccaagaaggaagaaugaacuauuacuggacacuaguagaaccaggcgacaaaauaacauucgaagcaacaggaaaucuaguaguaccaagauaugcauucgcaauggaacgugaugcaggaaguggaauaauuauauccgacacuccaguacacgacuguaacaccacaugccaaacaccaaaaggagcaauaaauacaagucuaccauuccaaaauauacaucccauaacaauaggcaaaugcccaaaauacgucaaaagcacaaaacuaagacuugcaacaggcuuaagaaauguaccaagcauacagagccgaggacuauuuggagcaaucgcaggauucauagaaggaggauggacaggcaugguugaugguugguauggauaucaccaucaaaaugaacaaggaucaggauaugcggcagaucuaaaaucaacacaaaacgcaauagaugaaauaacaaacaaaguaaacaguguaaucgaaaaaaugaacacucaauucaccgcagucggaaaagaauuuaaccaccuggaaaaaagaauagaaaaucuuaauaaaaagauagacgauggauuucuagacauauggacauacaacgccgaacugcuaguacucuuggaaaacgaacgaacauuagacuaccacgacucaaauguaaaaaaucuuuaugaaaaaguacgaucacaauuaaaaaacaaugcaaaagaaauaggcaacggcugcuucgaauucuaccacaagugcgauaacacuuguauggaaagcguaaaaaacggaaccuaugauuauccaaaauacagugaagaagcaaaauuaaaccgagaagaaauagacggaguaaaacuagaaucaacacgaauauaccaaauauuagcaaucuacucuacaguugcaucaucauuaguacuaguaguaucauuaggagcg

SEQ ID NO: 51218 - RNA, 1605 nt, Artificial Sequence
  derived and/or modified sequence opt6 from anti-influenza_Chain
gcaaacgcggacacauuauguauaggauaucaugcaaacaauucaacagauacaguagacacaguauuagaaaaaaacgugaccgucacacacaguguaaaucuacuugaagacaaacauaacggaaaauuauguaaacuaagaggaguugcaccacuacacuuaggaaaauguaacauagcaggauggauacuaggaaacccagaaugugaaucacucucaacagcaucaucauggucauacauaguagaaacuucuucaucagacaacggaacaugcuacccaggagacuuuauugauuacgaagaacuaagagaacaauuaagcucagugucaucauucgaacgauucgaaaucuucccaaaaaccucaucauggccagaccacgauucaaacaaagguguuacagccgcaugcccgcaugcaggagccaaaaguuuuuacaaaaacuuaauuuggcuaguaaaaaaaggaaauucauacccaaaacuuucuaaaucauacauaaacgauaaaggaaaagaaguucuuguacuuuggggcauacaucaccccucaacaagugcagaucaacaaucauuauaccaaaacgcagacgcauacguuuuuguaggaacaaguagauacaguaaaaaauuuaaaccugaaauagcuauucgaccaaaaguccgagaccaagaaggcagaaugaacuacuacuggacacuaguugaacccggugacaaaauaacauucgaagcaacaggaaauuuaguuguaccaagauaugcauucgcuauggaaagaaaugcaggaagcggaauaauaaucucagacacaccaguacaugacugcaacacaacuugccaaacaccaaaaggagcuaucaacacaucacuaccauuucaaaauauacacccgauaacaauuggaaaauguccaaaauauguaaaaucaacaaaauuaagacuagcaacaggacuaagaaauguaccaagcauacaaaguagaggcuuauuuggagccauagcuggauucauagaaggaggauggacaggaaugguagacggcugguacggauaccaccaccaaaaugaacaaggaucaggauacgcagcagaucuaaaaagcacccaaaacgcaauagacaaaauaacaaauaaaguaaauuccgucauagaaaaaaugaacacacaauucacagcaguaggaaaagaauucaaccaucucgaaaaaagaauagaaaaucuaaacaaaaaaguagacgacggauucuuagacauauggacauauaacgcagaacuacuaguauuacuagaaaacgaaagaacacucgacuaccaugacucaaacguaaaaaaccuauaugaaaaaguaagaucacaacuaaaaaacaacgcaaaagaaaucggaaauggaugcuucgaauucuaccauaaaugugacaacacaugcauggaaagcguaaaaaauggcacauaugacuaccccaaauacagugaagaagcaaaacuaaaucgagaagaaauagacgguguaaaacuagaaaguacaagaaucuaucaaauacuagcgauauacucaacuguagcaucaagccuaguacuaguaguaaguuuaggagca

SEQ ID NO: 51219 - RNA, 1605 nt, Artificial Sequence
  derived and/or modified sequence opt6 from anti-influenza_Chain
gcgaaugcagauacacucugcauaggauaccacgcaaacaacucaacagacacaguagacacuguacucgaaaaaaacguaacaguaacucacagcguaaauuuacuagaagacaaacauaacggaaaauuaugcaaacuuagagguguugccccauuacauuuaggaaaaugcaacauagcaggauggauacuaggcaacccagaaugcgaaucauuaucaacagcauccaguuggagcuauauaguagaaacaucaucaucagacaacggaaccugcuauccaggggauuuuauagauuacgaagaacuaagagaacaacuaucaagcguaucaucauucgaacgauuugaaauauuuccaaaaacaaguucauggccaaaccacgacucaaauaaagguguaacagcagcaugcccacgagccggagccaaaggcuucuauaaaaaucuaauauggcuaguaaaaaaaggaaacagcuaccccaaacuaaacaaaucauacauaaaugauaaaggaaaagaaguacuaguauuauggggaauacaccacccaucaacaaccgcagaccaacaaagcuuauaccaaaacgcagacacauacgucuuugucgguacaaguagauauuccaaaaaauucaaaccagaaauagaaauaagaccaaaaguaagagaccaagaagggcgaaugaauuacuacuggaccuuaguagaaccaggagacaaaauaacauucgaagcaacaggaaaucucguaguaccacgcuacgcauucgcuauggaacgaaaugcaggauccgguauaauaauauccgacacaccaguacacgauuguaauacaacaugccaaacaccaaagggugcaauaaacacaucacuaccauuccaaaacauucauccaauaacaauaggaaaaugcccaaaauauguuaaaagcacaaaauuacgacuagcuacaggauuaagaaauguuccaucaauacaaucaagaggacucuucggagcgauagcaggauuuauagaaggcggauggacaggaaugguugacggaugguacggauaccaucaucagaacgaacaaggaaguggauaugcagcagauuuaaaaagcacacagaacgcaauagacaaaauaacaaauaaaguaaauucaguaauagaaaaaaugaauacccaauuuacagcuguagauaaagaauucaaccaccuagaaaagagaauagaaaaucuaaacaaaaaagucgaugauggauuucuagacauauggacauacaaugcagaauuacuaguacuacucgaaaaugaaagaacacuagauuaucaugacucaaacgucaaaaaucuauaugaaaaaguaagaaaucaauuaaaaaauaacgcaaaagaaauuggcaacggaugcuuugaauucuaucauaaaugugauaacacaugcauggaaucagucaaaaacggcacauacgacuacccaaaauacucagaggaagccaaacuaaacagagaagaaauagauggaguuaaacuagaaagcacaagaauauaccaaauacucgccauauacucuacagucgcaaguagcuuaguauuagucguaagcuuaggagca

SEQ ID NO: 51220 - RNA, 1605 nt, Artificial Sequence
  derived and/or modified sequence opt6 from anti-influenza_Chain
gcaaacgcagacacacuauguauuggauaccacgcaaacaauuccacagauacaguagauacagucuuagaaaaaaacguuaccgucacacauucaguaaacuuacuagaagacaagcacaacggcaagcuauguaaauuaagaggaguagcaccacuacacuuaggaaaauguaauauagcaggauggauauuaggaaacccagaaugugaaucauuaaguacagcaucaagcuggucauacauuguagaaacgucauccagcgauaacgguacuuguuauccaggagauuuuauagacuaugaagaauuacgagaacaacuaucaaguguuucaucauucgaaagauuugaaauauucccgaaaacaucuucuuggccagaucaugauucaaauaaaggagucacagcagcaugcccccacgcaggagccaaaagcuuuuacaaaaacuugauaugguuaguuaaaaaaggaaauucauauccaaaauuaaguaaaagcuacauaaacgauaaaggaaaggaaguacuuguacuaugggggauacaucaccccagcacaagcgcagaccaacaaucauuauaccaaaacgcagacgcauacguuuucguagguacaucacgauacucaaaaaaauuuaaaccagaaauagcuauaagaccaaaaguaagagaucaagaagguagaaugaacuacuacuggacauuaguagaaccgggagacaaaauaaccuuugaagcaacaggaaacuuaguaguuccacgauaugcauucgccauggaaagaaacgcaggaagcggcauaauaauaucagacacuccaguacacgacugcaauacaacaugucaaacaccaaaaggagcuauaaacacaaguuuaccauuucaaaacauacacccaauaacaauaggaaaaugcccaaaauacguaaaaucaacaaaacuaagauuagcaaccggauuaagaaacgucccaaguauacaaucaagaggauuauucggugccauagcaggauuuauagaaggaggauggacuggaaugguagacggaugguacggauaccaucaucaaaacgaacagggaaguggauacgccgcagaccuaaaauccacacaaaaugccauagacaaaauaacaaacaaaguaaauagcguaauagaaaaaaugaacacucaauucacugcagucgguaaagaauucaaucacuuagaaaaaagaauagaaaaccuaaauaaaaaaguagacgacggguuccuagacauauggacauauaaugccgaauuacuagucuuacuagaaaacgaaagaacacuagacuaucaugacucaaacguaaaaaaccuauacgaaaaaguuaggucacaacuaaaaaacaacgcaaaagaaauagguaauggauguuucgaauuuuaccacaaaugugacaauacaugcauggaaucaguaaaaaacggaaccuacgacuacccaaaauacucugaagaggccaaacuaaaccgagaagaaauagacggaguaaaauuagaaucaacuagaaucuaccaaauccuagcaauauacucuacuguggcaucaucccuaguacuagucguaagccuaggcgca

SEQ ID NO: 51221 - RNA, 1605 nt, Artificial Sequence
  derived and/or modified sequence opt6 from anti-influenza_Chain
gcuaaugcagauacauuauguauaggauaccaugcaaacaacucaacugacacaguagauacaguuuuagaaaaaaacguaacuguaacacacaguguaaaucuccuagaagacaaacacaacgguaaauuauguaaauuaagaggaguagcaccccuccacuuagguaaauguaacauagccggauggauacuaggaaauccagaaugcgaauccuuaagcacagcaucaucauggagcuauauaguagaaacaucaucaagcgacaaugggacauguuacccaggagauuuuauagauuacgaagaacuacgcgaacaacuuucaucaguaagcucauuugaaagauuugaaauauuuccaaaaacaagcuccuggccaaaucacgauucaaauaaaggaguaacagcagccugcccaagagccggagcaaaaggauucuacaaaaaucuaaucuggcuaguaaaaaaaggaaacucauauccaaaacuaaauaaaucauacauaaacgauaaaggaaaagaagucuuaguauuaugggggauacaccacccaucaacaacagcagaccaacaaucccuauaucaaaacgcagauacauauguauucguaggaacuucaagauacucaaaaaaauucaaaccagagauagaaauaagaccaaaaguaagagaccaagaaggaagaaugaauuauuacuggacuuuaguagaaccaggagauaaaauaacauucgaagccacaggaaaucuagucgucccaagguaugcauucgcaauggaaagaaacgccggaagcggaauaauaauaagcgacaccccuguacacgacuguaacaccacaugucaaacacccaaaggugcaauaaacacaucuuuaccauuccaaaauauacauccaauaacaaucgggaaaugcccgaaauacguaaaaucaacuaaauuaagauuagcaacagguuuaagaaacgucccaucaauacaaucaagaggacucuucggagcaauagcaggauucauagaaggaggcuggacuggaaugguugacggaugguacggauaccaucaccaaaacgaacaagguagcggauacgcagccgaccuaaaaucaacacaaaaugccauagauaaaauaacaaacaaaguaaauucaguaauugaaaaaaugaacacacaauucacugccguagacaaagaauucaaccaccuagaaaaacgaauagaaaauuuaaauaaaaaaguagacgauggauuucuagauauauggacauauaacgcagaauuauuggucuuacuagaaaacgaacguacauuagauuaccacgacucaaacguaaaaaaccuauaugaaaaaguaagaaaucaacuaaaaaacaacgccaaagaaauaggaaacggaugcuucgaauucuaccacaaaugcgauaacacaugcauggaaucaguuaaaaacggaacauacgacuacccaaaguauucagaagaagcaaaacuaaacagagaagaaauagauggaguaaagcuugaaagcacaagaauauaccaaauacucgcgauauacucaaccgucgcaagcagccucguacucguaguaagccuuggagca

SEQ ID NO: 51222 - RNA, 1644 nt, Artificial Sequence
  derived and/or modified sequence opt6 from anti-influenza_Chain
caaaaacuaccaggaaaugauaacaguacugcuacauuauguuuaggacaucaugcuguaccaaauggaacaauaguaaaaacaauaaccaaugaccaaauagaaguaacaaacgccacagaacuagugcaaucaucaagcacaggugaaauaugugauucaccacaucaaauccucgauggcgaaaacugcacccuaauagacgcccuauuaggagacccacaaugcgacggauuucaaaauaaaaaaugggaucuauucguagaaagauccaaagccuauucaaacugcuacccauaugacguaccugauuaugcaucacuaagaucacuugucgcaagcuccggaacccuagaauucaacaaugaaagcuucaauuggaccggaguaacacaaaacggaacaucaagcgcaugcauaagaagaucaaacaacucauuuuuuucaagauuaaauuggcuaacacaccuaaaauucaaauauccagcacuuaauguaaccaugcccaacaacgaaaaauuugacaaauuauacauuuggggaguccaccacccaggaacagacaacgaccaaaucuucccauaugcacaggcaucugggcgaaucacuguaucuacaaaaagaucacagcaaaccguaauaccaaacauaggauccagaccaagagucagaaacauaccauccagaauaagcauauacuggacaauagucaaaccgggagacauacuacuaauaaacagcaccggaaauuuaauugcaccaagaggcuacuucaaaauaagaagcggaaaaucaucaauuaugcgaucagacgccccuaucggaaaaugcaacucugaaugcauaacaccaaacggaaguauaccaaaugacaaaccauuccaaaauguaaacagaauuaccuacggagcaugcccaagauacguaaaacagaauacacuaaaauuagcaacaggcaugagaaauguaccagaaaaacaaacaagaggaauauucggcgcuauagcaggauucauagaaaauggaugggaaggaaugguagaugggugguacggcuucagacaccaaaacagugaaggaauaggacaagcagcagaucuaaaaucaacccaagccgccauagaccaaauaaauggaaaacuaaauagacugauagguaaaacaaacgaaaaauuccaccaaauagaaaaagaauucucagagguagaaggcagaauacaagaccuagaaaaauacguagaagacaccaaaauagaccuauggagcuauaacgcugaauuacuaguagcauuagaaaaucaacacaccaucgauuuaaccgacagcgaaaugaacaaacuauucgaaaaaacaaaaaaacaauuaagagaaaaugcagaagacaugggaaacgguuguuucaaaauuuaccacaaaugcgacaaugcauguauaggaaguaucagaaacggcacauaugaccacgauguauaucgagacgaagcacuaaacaacagauuccaaauaaagggaguagagcuaaaaucaggauauaaagacuggauauuauggauaagcuuugccauaagcuguuucuuacuaugcguagcauuacuuggauucauaaugugggcaugccaaaaaggcaacauaagauguaacaua

SEQ ID NO: 51223 - RNA, 1644 nt, Artificial Sequence
  derived and/or modified sequence opt6 from anti-influenza_Chain
caaaaacuaccaggaaacgauaacucaaccgcaacacuaugccucggacaucacgcaguacccaauggaacaauaguaaaaacaauaacaaacgaucaaauagaaguaaccaaugccacagaacuaguacaaucaucaucuacaggagaaauaugcgauucaccucaccaaauucuugauggugaaaauuguacauuaaucgacgcacuauuaggagacccucaaugcgacggcuuucaaaacaaaaaaugggaccuauuuguagaaagaagcaaagcauauagcaacuguuacccauacgauguaccagacuacgcaucccuaagaucauuaguagcaucaagcgggacacuagaauucaauaacgaauccuuuaacuggacaggcguaacacaaaauggaaccucaucagcuuguauaaggagaucaaacaacucguucuuuucaagauuaaacugguuaacccaucuaaaauucaaauauccagcauuaaauguaacaaugccaaacaacgaaaaauuugacaaauuauacaucuggggaguacaucaccccgggaccgacaacgaccaaauauucccuuaugcacaagcaagugguagaauaaccguuucaacaaaaagaucccaacaaacaguuauaccaaacauaggaucucggccaagaguaagaaauaucccuucaagaauaaguauauacuggacaauaguaaaaccaggagauauacuauuaauaaacucaaccggaaaccuaauagcuccacgagguuacuuuaaaauaagaagugguaaaagcucaaucaugcgaucagacgcaccuauaggaaaauguaacucagaaugcauaacaccaaauggcagcauaccaaaugacaaaccauuccaaaacguaaauagaauaacguacggcgcaugcccaagauacgugaaacaaaacaccuuaaaauuagcaacaggcaugcgaaauguaccagaaaaacaaacacgaggaauauuuggagcaaucgcaggauucauagaaaaugguugggaaggaaugguagauggaugguauggauuuagacaccaaaacucagaagggauaggacaagcagccgacuuaaaaucaacgcaagcugccauagaucaaaucaacggcaaauuaaacagacuaauaggaaaaacaaacgaaaaauuccaccaaaucgaaaaggaauucagcgaagucgaaggaagaauccaagaucuagaaaaauacguagaagacacgaaaauagaccuauggaguuacaacgcagaauuauuaguugcauuagaaaaucaacacacaauugaucuaacugauagugaaaugaacaaauuauuugaaaaaacaaaaaaacaauuacgagaaaacgcagaagacaugggcaacggcugcuucaaaauauaucauaaaugugacaacgcaugcauaggaucaauaagaaacggaacauacgaucacgacguauauagagaugaagcauuaaauaacagauuccaaauaaaaggcguagaacuaaaaucgggauacaaagauuggauucuauggauaucuuucgcaaucagcugcuuuuuacuauguguagcauuacuagguuucauaaugugggcaugucaaaaaggaaacauaagauguaauaua

SEQ ID NO: 51224 - RNA, 1647 nt, Artificial Sequence
  derived and/or modified sequence opt6 from anti-influenza_Chain
auguuaacauuucauagaauaauaagaaaagguuggauguuuuuauuagcauuccuauuaacugcacuuuuauuuugcccaacaggccaaccagcaaaagcagcagcaccauuuaauggaacaaugaugcaauauuucgaaugguacuuaccagacgaugggacacuguggacaaaaguagcaaaugaagcaaauaaucuaucaucauuaggaauaacagcacuaugguuaccuccagcauauaagggaacuucaagaagugaugucggauauggaguauaugauuuauaugauuuaggagaauuuaaucaaaaaggggccguccguacaaaauauggcacaaaagcacaauauuuacaagcaauacaagcggcacaugcagcaggaaugcaagucuaugcagauguaguuuuugaucauaaaggaggagcagaugguaccgaauggguagaugcagucgaaguaaauccaagcgauagaaaccaagaaauaucaggaacauaucaaauccaagcauggacaaaauucgauuuuccaggaagaggaaauacuuauaguaguuucaaauggagaugguaucauuuugauggaguugauugggacgaaagucgaaaauuaaguagaauauauaaauuuagaggaauuggaaaagcaugggauugggaaguagauacagaaaacgguaauuacgacuauuuaauguaugcagaucuagauauggaucacccugaaguuguaacagaauuaaaaucuuggggaaaaugguauguaaacaccacaaacauagauggauuuagacuagacgccguaaaacauauaaaauuuagcuucuuucccgauuggcuuagugauguaagaucacaaacaggaaaaccacuuuuuacaguaggagaauauuggucauaugacauaaauaaauuacauaauuauauaaugaaaacaaacgguacaaugagucucuuugaugcuccucuucacaauaaauuuuauacagcaagcaaaaguggaggaacauuugauaugagaacauuaaugaccaauacauuaaugaaagaucaaccaacacuagcgguaacauuuguugauaaucaugacacagaaccaggccaagcauuacaaucauggguagauccaugguuuaaaccauuagcauaugcauuuauacuaacaagacaagaaggauaucccuguguauuuuauggagauuacuacggaauaccccaauauaauauaccaucuuuaaaaaguaagauagacccauuacuaauugcacgaagggauuacgcguauggaacccaacaugauuaucuagaucauucagauauaauagguuggacacgugaaggcguaacagaaaaaccaggaaguggacuugcugcacuaauaacugacggaccaggugguucaaaauggauguauguaggaaaacaacaugcaggaaaaguauuuuaugauuuaacaggaaauagaagugacacaguuacaauaaauucagauggauggggagaauuuaaaguaaacggagguagcguaucuguaugggucccaagaaaaacuacaguaaguacuauagcauggucgauuacaacaagaccauggaccgaugaauuuguaagauggacagaaccuagauuaguagcuuggcca

SEQ ID NO: 51225 - RNA, 1647 nt, Artificial Sequence
  derived and/or modified sequence opt6 from anti-influenza_Chain
aucugcauaggcuaucaugccaauaacucaacagaacaaguagauacaauaauggaaaaaaacguaacaguaacacacgcacaagacauauuagaaaaaacacacaauggcaaacucugcgaucucgacggaguuaaaccucucauauuacgagacugcuccguagcaggaugguuacuaggaaacccaaugugcgaugaauuuaucaauguaccugaauggucauacauagucgaaaaagcuaaucccgcaaacgaccuaugcuacccaggaaacuucaaugacuacgaagaacuaaaacaccugcuaucacgaauaaaccauuucgaaaaaauacaaaucauuccaaaauccucauggucugaccacgaagcaucaucagguguuuccucagcaugcccauaccaaggaacuccaaguuuuuuuagaaacgucgucugguuaaucaaaaaaaacaacacauaccccacaauaaaaagauccuauaauaacacaaaccaagaagaucuuuuaaucuuauggggaauacaucauuccaacgaugcagcagaacaaacaaaacuauaccaaaacccaacaacauacauuagcguaggcacaucuacacuuaaccaaagacuaguaccaaaaauagcaacaagaagcaaaguaaacggccaaaacggacgaauggauuucuucuggacaauacuaaaaccaaacgacgccauaaacuuugaauccaacggaaacuucauagcaccagaauacgcauacaaaauuguaaaaaaaggagacuccgcaauaguaaaaagcgaaguagaauacggaaacuguaauaccaagugccaaacaccaauaggagcaauaaacucaucaaugccauuccacaauauucacccacuaacaauuggagaaugcccaaaauacguaaaaucgaacaaacuaguauuagcaacaggucuaagaaacucaccacuccgcucagauaaaacucacacaugcccaccaugcccugcuccagaacuauuaggaggcccaucaguauucuuguucccuccuaaaccaaaagauacacucaugauaucacguacaccagaaguaaccuguguagucguagacguaucacaugaagaccccgaaguaaaauucaacugguauguagacggaguagaaguccacaaugccaaaacaaaaccccgagaagaacaauacaacucaacuuacagggucguaucaguacuaacaguauuacaccaagacuggcuuaauggaaaagaauauaaauguaaagucucaaacaaagcacucccagcaccaauagaaaaaacaauaucaaaagcaaaaggacaaccaagagaaccacaaguauauacucuaccaccuaguagagaagaaaugacaaaaaaucaaguaucacuaacaugccuaguuaaaggauucuacccaucagauauagcagucgaaugggaauccaacggacaacccgaaaauaauuacaaaaccacuccaccaguacuagauucugacggaucuuucuuucuauauucaaaauuaacugucgacaaaucuagauggcaacaaggaaacguauuuucuugcuccgucaugcacgaagcacuacauaaucacuacacccaaaaaucacuuuccuuaucaccaggaaaa

SEQ ID NO: 51226 - RNA, 1647 nt, Artificial Sequence
  derived and/or modified sequence opt6 from anti-influenza_Chain
auaugcauaggauaucacgcaaauaauagcacugaacaaguagacacuaucauggaaaaaaauguaacgguuacacacgcacaagacauccuagaaaaaacccauaauggaaagcuuugcgaucuagacggaguaaaaccacuaauauuaagagauuguucuguagcaggaugguuauuaggcaaccccaugugugacgaauuuaucaacguaccugaaugguccuacauaguagaaaaagcaaacccagcaaacgaucucugcuauccaggcaacuucaacgacuacgaagaauuaaaacauuuacuuucacgaauaaaccauuuugaaaaaauccaaauaauaccaaaauccucauggucagaccacgaagcaucaucaggcguaucaucagccugcccauaucaagguacaccuuccuuuuucagaaacguaguauggcuaaucaaaaaaaacaauacauacccuacaauaaaaagaucauacaauaacacuaaucaagaagaccuauuaauauuguggggaauacaucauucuaacgacgcagcagaacaaacaaaacucuaucaaaacccaacaacauacauaucaguaggcacaucaacauuaaaccaaagauuagucccaaaaauagccacaagaucaaaaguaaauggacaaaacgguagaauggauuucuuuuggacaauauuaaaacccaacgacgcaauaaacuucgaaagcaacggcaacuuuauagcaccagaauacgcauacaaaauaguuaaaaaaggagauuccgcaauaguaaaaucugaaguugaauacggaaacugcaacacuaaaugccaaaccccaaucggagcaauaaauucaucaaugccauuucauaacauccacccucucaccauaggagaaugcccaaaauacguaaaaucgaacaaacuaguacuagccacaggacuacgcaauagcccccuccgcucugacaaaacacauacaugcccaccaugcccggcaccagaacuuuuaggaggacccucaguguucuuauuuccuccaaaaccaaaagacacauuaaugauauccagaacacccgaaguaacauguguaguuguagaugucucacacgaagauccggaaguaaaauucaauugguaugucgacggaguugaaguucauaacgcaaaaacuaaaccacgagaagaacaauauaauuccacuuacagaguaguaucaguauuaacaguauuacaucaagauuggcuaaauggaaaagaauauaaaugcaaagucagcaacaaagcucuuccagcaccaaucgaaaaaacaauaagcaaagcaaaaggucaaccaagagaaccucaaguauacacacuaccaccaucccgcgaagaaaugacuaaaaaccaaguaagccuaacaugcuuaguaaaaggcuuuuacccaucagacauagcaguagaaugggaaucaaacggacaaccagaaaacaacuauaaaacaacaccacccguacuagacuccgauggaaguuuuuuccuauacucaaaacuaaccguagacaaaucccgauggcaacaaggaaacguauucuccugcuccguaaugcaugaagcacuccacaaccauuauacacaaaaaucacuaucacucucaccaggcaag

SEQ ID NO: 51227 - RNA, 1647 nt, Artificial Sequence
  derived and/or modified sequence opt6 from anti-influenza_Chain
augcuaacuuuucauagaauuauaagaaaaggauggauguuucuacuagcauuuuuauuaacagcacuauuauuuugucccacaggacaaccagcaaaagcagcagcgccauucaauggaacaaugaugcaauauuucgaaugguauuuaccagaugaugguacacuauggacaaaaguagcaaaugaagcaaauaauuuaagcagucuagguauaacugcacuaugguuaccaccagcauauaaagguacaagcagaucagauguugguuauggcgucuaugauuuauaugauuuaggagaauuuaaucaaaaaggagcaguuagaacaaaauacggaacaaaagcacaauaucuacaagcaauacaagcagcacacgcagcaggaaugcaaguauaugcagacguaguauucgaucauaaagggggagcagaugggacagaaugggucgaugcaguagaaguuaauccaucagacagaaaucaagaaauaagcggaacauaccaaauacaagccuggacuaaauuugauuuuccaggacgaggaaacacauauucaucauuuaaauggagaugguaucauuucgauggaguagauugggacgaaucaagaaaguuaagcagaauuuauaaauuuagagguauaggaaaagcaugggauugggaaguugauacagaaaauggaaauuaugacuaccucauguaugcagauuuagauauggaucauccugaaguagucacugaauuaaaaaguuggggaaaaugguauguaaacaccacaaacauagauggauuuagacuagaugcaguaaagcauauaaaauuuucauucuuuccagauuggcuaagugauguaagaucucaaacuggaaaacccuuauuuacaguaggggaauauuggagcuaugauauaaauaaauuacacaauuauauaaugaaaacaaauggaaccaugucacuauuugacgcaccacugcacaauaaauuuuauaccgcaaguaaaucaggagguacguuugauaugagaacacuaaugacaaacacauuaaugaaagaucaaccaacacuugcaguaacauuuguagauaaucaugacacagaaccaggccaagccuuacaaucauggguagauccaugguuuaaaccauuagccuaugcauuuauacuuaccaggcaagaagguuauccuuguguauuuuauggugauuauuauggaauaccccaguauaauauacccucauuaaaaagcaaaauagaccccuuacuaauugcaagaagagauuaugcauacgguacacaacaugacuacuuagaccauucagacauaauagguuggacaagagaagguguaacagaaaaaccaggaucaggacuagcagcacuaauaacagauggcccaggaggaagcaaauggauguacguaggaaaacaacaugcaggaaaaguauuuuaugauuuaacaggaaauagauccgauacaguaacaauaaauagugauggauggggagaauuuaagguaaauggaggaucaguaucaguuuggguaccaagaaaaacuacaguuaguacaauagcauggagcauaacaacaagaccauggacagacgaauuuguacgauggacagaaccuagauuaguugcauggcca

SEQ ID NO: 51228 - RNA, 1650 nt, Artificial Sequence
  derived and/or modified sequence opt6 from anti-influenza_Chain
gaccaaauaugcaucggcuaucaugcaaauaacaguaccgaacaaguagacacaauaauggaaaaaaacguaacaguaacacacgcacaagacauacuagaaaaaacccacaacggaaaauuaugcgacuuagauggaguaaaaccacuaauauuaagagacuguucagucgcaggcugguuacuagguaauccaaugugugacgaauuuaucaacguaccugaauggucauacauuguagaaaaagcuaauccaaccaaugaccuaugcuacccaggcaguuuuaaugauuacgaagaacuaaaacaucuacuaagccgaauaaaucacuuugaaaaaauccaaauaaucccaaaaucaucauggagugaccacgaagcaucaucaggaguaagcagcgcaugccccuaccuaggaucaccaucauucuucagaaauguaguaugguuaauaaaaaaaaauuccacauacccaacgauaaaaaaaagcuauaauaacacgaaccaagaagaccugcuaguacuauggggaauacaucaccccaacgaugcagcagaacaaaccagacuauaccaaaauccaaccacguauauaagcaucggaacgucaacacucaaccaaagacuaguaccaaaaauagcaacaagaucaaaaguaaauggccaaucuggaagaauggaauuuuuuugggcaauauuaaaaccaaaugaugcaauaaacuucgaauccaaugguaacuuuauagccccagaauaugcauacaaaaucguaaaaaaaggagacucagcaauaaugaaaucagaauuagaauacggaaacugcaacacaaaaugucaaacuccaaugggggcaauaaauucaaguaugcccuuucacaacauucacccauuaacaauaggcgaaugcccaaaauauguaaagucaaacagacuaguccuugccacaggacuccgcaauucaccacaaagagaaagccgaagaaaaaaaaggggccuauucggcgccaucgcaggcuuuauagaaggaggauggcaagguaugguagauggcugguauggauaccaccauagcaaugaacaaggaucaggcuaugcugcagacaaagaaagcacacaaaaagcaauaggaguaacaaauaaagucaacaguauaauagauaaaaugaauacacaauucgaagccguaggaagagaauuuaacaaccucgaaagacgaauagaaaaccuaaauaaaaaaauggaagauggcuuucuagacguauggacauacaacgcagaauuacuaguauuaauggaaaacgaaagaacauuagauuuccacgacaguaacguaaaaaaucuauacgacaaaguaagacuacaacuacgagauaacgcaaaagaauuaggaaauggauguuuugaauuuuaucauaaaugcgacaacgagugcauggaauccauaagaaacggcaccuauaacccacaauacucagaagaagcaagacuaaaacgagaagaaauauccggaguaaaacuggaaagcauaggaacauaccaaaucuuauccauauacucuacaguugcaucaucacuagcacuagcaauaaugaucgcaggcuuaucacuauggaugugcucaaacggauccuuacaauguagaaucuguauc

SEQ ID NO: 51229 - RNA, 1650 nt, Artificial Sequence
  derived and/or modified sequence opt6 from anti-influenza_Chain
gaucaaauaugcauaggcuaccaugccaacaacucaacagaacaaguagacacaauaauggaaaaaaauguaacaguaacacacgcacaagacauauuagaaaaaacacacaacggcaaacuaugcgaccuagauggaguaaaaccacuaauccuacgagacugcucaguagccgguuggcuauuaggcaauccaaugugcgacgaauucauaaacguaccagaauggucuuacauaguagaaaaagcaaauccaacaaaugacuuaugcuauccaggcucauucaacgacuacgaagaacuuaaacauuuacuaaguagaauaaaucauuucgaaaaaauucaaaucauaccaaaaucauccuggucagaucacgaagcaucauccggaguuucuucagcaugcccauacuuaggaaguccaucauucuuuagaaauguaguauggcucauaaaaaaaaauucaacuuauccaacuauaaaaaaaucauacaauaacacaaaucaagaagauuuauuaguacuguggggaauacaucacccaaacgaugcagcagaacaaacacgauuauaucaaaauccaacaacauacauaagcauaggaacaagcacacuaaaccaaagauuaguaccaaaaauagcaacucgaucaaaaguaaauggacaaucaggaagaauggaauuuuucugggcaauacuaaaaccuaacgacgcuaucaacuucgaaagcaacggaaauuuuauagcaccagaauaugcuuauaaaauaguaaaaaaaggugacuccgcaauaaugaaaucagaacuagaauacggaaauuguaacacaaaaugccaaacaccaaugggcgcaaucaauucaucaaugccauuccacaauauacacccucuaacaauaggcgaaugcccaaaauacguaaaaaguaacagacuaguucuagcuacgggauuaagaaacagcccucaaagagaaucacgacgaaaaaaaagaggccuuuucggugcaauagcagguuucauagaaggggguuggcaagguauggucgaugggugguacggauaccaucacuccaacgaacaaggaagcggauacgccgcagacaaagaaagcacacaaaaagcaauaggagucacaaauaaaguaaacagcauaauugauaaaaugaacacacaauucgaagcaguaggaagggaauuuaacaaccuagaaagaaggauugaaaaccuaaauaaaaaaauggaagacggauuccuagaugucuggaccuacaacgcagaacuacuaguauuaauggaaaaugaacgaacauuagacuuucaugauucaaacguuaaaaauuuauacgauaaaguucgccuacaauuacgagacaaugcaaaagaauuaggaaauggaugcuuugaauucuaccacaaaugcgauaacgaaugcauggaaagcauaagaaacggaacauacaacccacaauacucagaggaagcaagacuuaaaagagaagaaauaaguggcguaaaacuagaaucaaucggaacauaucaaauauuaucgauauacucaaccguagcaucauccuuagcauuagcaauaaugaucgcaggauuaucacuguggauguguucuaacgguucacuacaauguagaauauguaua

SEQ ID NO: 51230 - RNA, 1656 nt, Artificial Sequence
  derived and/or modified sequence opt6 from anti-influenza_Chain
augaacauacaaauacuugcauucauagcauguguauuaacaggagcaaaaggagacaaaauaugcuuaggacaucacgccguugcaaauggaacaaaaguaaacacauuaacugaaaaaggaauugaaguagucaacgcaacagaaacagucgaaacagcagacguaaagaaaauauguacacaaggcaaaagagcaacagacuuaggaagauguggacuacucgggacauuaauagggccaccacaaugcgaccaauucuuagaauuuucaagugaccuaauuauagaacgcagagaaggaacagauguuugcuauccaggcagauuuacuaacgaagaaucacuaagacaaauacuaaggagaucaggaggaaucggaaaagaaaguaugggauuuacauauucaggaauacgaacaaacggcgccgccagugcauguacucgaucuggaucaucauuuuacgcagaaaugaaauggcuacuaagcaacucagauaauucagcauuuccacaaaugaccaaagccuacagaaauccaagaaacaaaccagcauuaauaauauggggaguacaucauuccgaaucagcaagcgaacaaacaaaauuauacggaucaggaaauaaauuaauaacaguaagaucaaguaaauaucaacaaucauucacaccaucuccaggcacaagaagaaucgacuuccacugguuacuacucgacccaaacgacacagugacauucacauucaauggcgcauucauagcaccagacagagcgucauucuucagaggagaaucacuuggaguacaaucagacgcaccauuagacucaucaugucgaggagacuguuuucauucagguggcacaauuguaaguucguuaccuuuucaaaacauaaacuccagaacaguaggaagauguccacgauauguaaaacaaaaaucacuauuauuagcuacaggaaugcgaaacguuccagaaaaaccaaaaccaagaggauuauuuggagcaauagcaggauucauagaaaaugguugggagggacuaauaaauggcugguauggauuuagacaccaaaacgcccaaggcgaaggaaccgcagcagacuacaaaaguacacaaucagcaauagaccaaauaacaggaaaacuaaacagacugauaggaaaaaccaaucaacaauucgaauuaauagacaacgaguuuaaugaaauagaacaacaaauaggcaacguaauaaacuggaccagagacgcaaugacagaaaucuggucuuacaacgcagaacuauuaguugcuauggaaaaucaacacacaaucgaccucgccgauucagaaaugucaaaacuauacgaaagagucaagaaacaacuaagggaaaacgcagaagaagacggaacaggaugcuuugaaauauuccauaaaugugacgaucaauguauggaaucaauaagaaauaacacauacgaucauacucaauacagaacugaaaguuuacaaaauagaauacaaauagauccaguaaaauuaagcaguggauacaaagacauaauacuuugguuuucauucggugcgucauguuucauacucuuagccauagcaaugggucuaguauucauauguauuaaaaacggaaauaugcaaugcacaauauguaua

SEQ ID NO: 51231 - RNA, 1656 nt, Artificial Sequence
  derived and/or modified sequence opt6 from anti-influenza_Chain
augaacacacaaaucuuggcauucauagcaugcguauuaacaggaguaaaaggagacaaaauaugucuaggucaccacgcaguagcaaacgggaccaaaguaaacaccuuaacagaaaaaggaauagaaguaguaaacgcaacagaaacagucgaaacagcagaugucaagaaaaucugcacacaaggcaaaagagcaaccgacuuaggcagaugcggccuauuaggaacacuaauaggaccaccacaaugcgaccaauuucuugaauuuucaucagaucuuaucaucgaaagaagagaaggcacagauguuugcuacccuggcagauuuaccaaugaagaaucacuuagacagauuuuaagaagaucaggaggaauaggaaaagaaucaaugggauucacauauucaggaauaagaacaaauggagcaacgucagccugcacaaggucaggaucaagcuucuaugccgaaaugaaaugguuauuaucaaacagcgacaacuccgcauuuccgcaaaugaccaaagccuacagaaacccaagaaauaaaccagcuuuaauaauauggggaguacaccauucagaaucaguuagcgaacaaacaaaacuauacggauccggaaacaaacuaauaacaguaagaucaaguaaauaucaacaaucauuuacaccaucaccaggagcccgaagaauagauuuccauugguuauuacucgacccaaaugacaccguaacauucacauuuaacggagcauucauagccccagauagagcaucauucuuuagaggagaaucacuaggaguacaaagugauguaccacuagacucauccuguagaggugauugcuuucauucaggaggaacaauagugucaagucuaccauuccaaaacaucaauucaagaaccguagguaaaugcccaagauacguaaaacaaaaaucauuauuauuagcaacaggaaugagaaauguaccagaaaaaccuaaacccagaggacucuucggagcaauagcaggcuucauagaaaauggaugggaaggcuuaauaaauggaugguauggauuuagacaccaaaaugcacaaggagaaggaacugcagccgauuauaaaucaacacaaucugcuaucgaucaaaucacuggaaaacuaaacagacuaauaggaaaaacuaaccaacaauucgaauuaauagacaacgaauuuaaugaaauagaacaacaaaucggaaauguaauaaacuggacaagagacgcaaugaccgaaaucuggucauauaaugcagaacuacucguagccauggaaaaucaacauacaauagaccuagcagacagcgaaaugucaaaacuuuaugaaagaguaaaaaaacaauuaagagaaaacgcagaagaagauggaacaggauguuuugaaauauuccauaaaugugacgaccaaugcauggaaucaauaagaaacaacacuuacgaucacacacaauauagaacagaaucauugcaaaacagaauccaaauugaccccgucaaacuaucaaguggauacaaagacauaauacucugguuuucauuuggugccaguugcuuccuacuuuuagcaauagccaugggacuaguauuuauaugcauaaaaaacggcaauaugcaaugcacaaucugcaua

SEQ ID NO: 51232 - RNA, 1656 nt, Artificial Sequence
  derived and/or modified sequence opt6 from anti-influenza_Chain
augaauauacaaauauuagcauuuauagccuguguacucacaggagcaaaaggagacaaaaucugcuuaggacaucacgcaguagcaaacggaaccaaaguuaauacauuaacugaaaaaggaauugaaguaguaaacgcaaccgagacuguagaaacagcaaacauaaaaaaaauaugcacacaaggaaaaagaccaacagacuuaggacaauguggacuauuaggcacccuaauaggcccuccacagugcgaucaauuccuagaauucucgucagaucuaauaauugaaagaagagaaggaaccgacguaugcuaccccggaaaauucacaaaugaggaaaguuuaaggcaaauucuaagaagaucaggaggaauaggaaaagaaagcaugggauuuacauauagcgguauaagaaccaauggagcaacgucagcauguacaagaagcggaagcagcuucuacgcagaaaugaaaugguuacuaaguaacucagacaacgcagcauuuccacaaaugaccaaaagcuaucgaaauccaagaaacaaaccagcacuaauaauauggggaguacaucauagugaaagcguaucagaacaaacaaaauuauacggaucaggaaacaaacuaauaaaaguacgaucaucgaaguaccaacaaucauuuacaccaaauccaggcgccagaagaauugacuuucauugguuacuauuagauccaaacgauacagugacauuuaccuucaauggagcauuuauagcaccagacagagcaucauuuuuuagaggagaaagcauaggaguucaaucagaugcaccgcuagauagcaguugcggaggaaauuguuuucacaacggcggaacaauaguaucaagucucccauuucagaacauuaauccacgaacaguaggaaaauguccaagauacgugaaacaaaaaagucuucuauuagcaacaggaaugagaaacgugccagaaaaacccaaaaaaagaggauuauucggagcaauagcaggauucauagaaaauggaugggagggauuaauuaacgguugguauggcuuuagacaccaaaacgcacaaggcgaaggcaccgcagcagacuacaaaagcacucaauccgcaauagaucaaaucaccggaaaauuaaacagauuaauaggaaaaaccaaccaacaauucgaauuaauaaauaaugaauuuaacgagguagaacaacaaauaggaaacguaaucaauuggacacaagacgcaaugacugaagucuggaguuacaaugcagaauuauugguagcgauggaaaaccaacauacaauagauuugacagauucagaaaugucaaaacuauacgaacgaguaagaaaacaauugagagaaaaugcagaagaagacggaaccggauguuuugaaauauuucauaaaugugacgaucauugcauggagucaauaagaaacaacacauacgaucacacccaguauagaacagaaucauuacaaaacagaauacaaauugauccaguaaaacuaaguggaggguauaaagauauaauacucugguucagcuucggagcgagcuguuuccuucuacuagccaucgcaaugggacuuguuuucauauguauaaaaaacgguaacaugcaaugcacaauauguaua

SEQ ID NO: 51233 - RNA, 1656 nt, Artificial Sequence
  derived and/or modified sequence opt6 from anti-influenza_Chain
gaccaaaucugcauugguuaucacgcaaacaauucaacagaacaaguugauaccauaauggaaaaaaacguaacaguaacacaugcccaaaacauccuagaaaaaacucauaauggcaaacuaugugaucuagauggaguaaagccacuuauacuaagagacugcucagucgcaggauggcuacuaggaaauccuaugugcgaugaauuccuaaauguaccagaguggaguuacaucguagaaaaaauaaaccccgcaaacgaccuuugcuacccaggaaacuucaacgacuaugaagaacucaaacaccuacugucacgaauaaaccacuucgaaaaaauccaaauaauaccaaaaucaucauggucagaccaugaagccuccucaggagucucuagcgcuugcccuuaccaaggaagaagcucuuuuuuccgaaaugucguauggcuuauaaaaaaagauaacgcauacccaacaaucaaacgaucauacaauaacacaaaucaagaagacuuacuaguccuauggggaauacaccauccaaacgaugcagcagaacaaacaagacuauaucaaaacccaacaacauauauaagcguaggaacaucaacauuaaaccaaagacuaguuccaaaaauagcaacaagaagcaaaguaaacggacaaucuggaagaauggaauucuuuuggacaauucugaaacccaaugacgcaauaaacuuugaaagcaacggaaacuuuauagcaccagaaaacgcuuauaaaauagucaaaaaaggagacucaacuauaaugaaaucagaacuagaauacggcaacuguaacacaaaaugucaaacaccaaucggagcuauuaacuccucaaugccauuucauaauauccacccauuaacaaucggagaauguccuaaauacguaaaaucaaacaaacuagucuuagcaacaggacuacgaaacucaccacaaggcgaaagacgaagaaaaaaaagaggauuauucggagccauagcaggcuucaucgaagguggauggcaaggaaugguagacggaugguacggcuaucaccacucaaaugaacaaggaucuggauaugccgcagacaaagaaucuacacaaaaagccauagacggaguaacaaacaaaguaaacucaauaauagacaaaaugaauacacaauucgaagcaguaggaagagaauucaacaaccuagaaagacgaauagaaaaccuaaacaaaaaaauggaagacggcuuuuuagacguauggacauauaacgcagaacucuuaguauuaauggaaaaugaaagaacacuugacuuccaugauucaaacguaaaaaacuuauacgacaaaauaagacuacaacugcgagauaaugcaaaagaacuaggaaauggaugcuucgaauucuaccauagaugcgauaaugaauguauggaaucuguuagaaacggaacauacgauuauccucaauacucugaagaagcaagacuaaaacgagaagaaauauccggaguaaaacuagaauccauaggaaccuaccaaauacuaucaauauauagcacgguagcaaguucauuaacacuagcaauaaugguagcggguuuaucauuauggaugugcucaaauggaucacuacaaugcagaauaugcauc

SEQ ID NO: 51234 - RNA, 1656 nt, Artificial Sequence
  derived and/or modified sequence opt6 from anti-influenza_Chain
gaccaaauaugcauaggcuaucaugcaaauaacucuacagaacaaguagauacaauaauggaaaaaaacgucacaguaacacaugcccaagacauacuagaaaaaacacauaacgguaaacuaugcgaucuagacggaguaaaaccacugauauuacgagacuguagcguagcaggaugguuauuaggaaaucccaugugcgacgaauuuauaaacgucccugaauggucauauaucguagaaaaagcaaacccaacaaacgauuuaugcuauccaggcagcuucaaugacuacgaagaauuaaaacaccuacuaaguagaauaaaccacuuugaaaaaauacaaauaauaccaaaaucaucauggucagaccacgaagccucaucaggcguaucaucagcuugcccauaccuaggaucaccaucuuucuuuagaaacguagucugguuaauaaaaaaaaacuccacauacccaacaauaaaaaaaucauacaacaacacaaaccaggaagaccuuuugguacucuggggaauacaccauccaaaugacgcagcagaacaaacaagacuauaucaaaauccaaccacauacauaagcauaggcacaucaacacuaaaccaaagacuuguaccaaaaauugcuacaagaucaaagguaaacggacaaagcggcagaauggaauuuuuuuggacaauacuaaacccaaaugacgcaauaaauuucgaaagcaacggaaacuucauugcaccagaauacgcauacaaaauuguaaaaaaaggcgacucagcaauuaugaagucagaacuagaauacggaaacuguaauacgaaaugucaaacaccaaugggagcaauaaauucaucaaugccauuucauaacauacauccauuaacaauaggagaaugcccaaaauacguaaaaucaaauagauugguacuagcaacaggccuaagaaacucaccacaaagagaaagcagaagaaaaaaaagaggacuauucggagcuauagcaggauucauagaaggaggauggcaaggaaugguugacggaugguacggauaucaucauaguaaugaacaaggaucaggauacgccgcagauaaagaaucaacccaaaaagcaaucgaugguguaacaaacaaaguaaauagcauaaucgacaaaaugaacacacaauucgaagcaguagguagagaauucaauaauuuagaaaggcgaauagaaaacuuaaacaaaaaaauggaagacggauuuuuagacguauggaccuacaaugcagaguuacuaguacuaauggaaaacgaaagaacauuagacuuccaugacucaaacguaaaaaauuuauaugacaaaguaagacuccaauuaagagacaacgcuaaagaacuagguaauggauguuuugaauuuuaccacaaaugcgauaacgaaugcauggaaucaauaagaaauggaacauauaacuauccacaauacucagaagaggcaagacuaaaacgagaggaaauaucaggcguaaaacucgaauccaucgguacauaccaaaucuuaucuauauacucaacaguagcaagcagucuggcacuagcaauaaugauggcuggauuaucccuuuggaugugcucaaacggaucauuacagugucgaauuuguaua

SEQ ID NO: 51235 - RNA, 1656 nt, Artificial Sequence
  derived and/or modified sequence opt6 from anti-influenza_Chain
augaacauucaaauacuagcauuuauagcuugugucuuaacaggggcaaagggagauaaaauaugcuuaggacaucaugcaguagcaaauggaacaaaaguaaauacacuaacugaaaaaggaauagaaguaguaaacgcaacugaaacagucgaaacagccgacguaaaaaaaauaugcacccaagguaaaagagccacagacuuaggcagaugugguuuauuaggcacacuaauaggaccaccacaaugcgaucaauuuuuagaauucaguagugauuuaauaauagaaagacgagaagggacugauguauguuaucccggaagauuuacaaacgaagaaucacuccgacaaauauuaagaagaucuggcggaauagggaaagaauccaugggauucacauauucagggauccgaacaaauggagccgcaucagcauguacaagaucaggaucaucauuuuacgcugaaaugaaauggcuucuaucaaacagcgacaauagugcauucccgcaaaugaccaaagcauacagaaaucccagaaacaaaccagcauuaauaauauggggagugcaccauagugaaucugcaucagaacaaacuaaauuauacggaagcgguaauaaauuaaucacuguaagaagcucaaaauaccaacaaucauuuacaccaagcccaggaaccagaagaauugacuuccauuggcuucuauuagauccgaaugacacagucacauuuacauucaacggcgccuucauagcuccagauagagcaucauucuuuagaggagaaucauuaggaguacaaucagaugcaccuuuagacucaucauguagaggagauugcuuccacucaggaggaacgauaguaucaagcuuaccauuucaaaauaucaauucuagaacaguuggaagaugcccaagauacguaaaacaaaaaaguuuacuauuagcaacaggaaugagaaauguaccagaaaaaccaaaaccaagaggucuauuuggagcaauagcaggauuuauagaaaacggaugggaagggcuuauaaacggaugguauggauucagacaucaaaaugcucaaggagaaggcacagccgcagacuacaaaagcacacaaucagccauagaucaaauuacaggaaaacuaaacaggcuaauaggaaaaacuaaucaacaauuugaauuaauagacaacgaauuuaaugaaauagaacaacaaauaggaaacguaauaaauuggacccgagacgcaaugacugaaauauggucauacaaugcagaauuauuagucgcaauggaaaaucaacauacaauagaccuagcagauagcgaaaugucaaaauuauacgaacgaguaaaaaaacaauuaagggagaaugcagaagaagacgguaccggauguuuugaaaucuuucauaaaugcgacgaucaaugcauggaaagcauaagaaauaauaccuacgaucacacucaauaucguacagaaucacugcaaaaccgaauacaaauagauccaguaaaacuaagcucaggauacaaagauauaauacuaugguuuucauuuggagcuaguuguuuuauacuauuagccauagcuaugggauuaguauuuauauguauaaaaaacggcaacaugcaauguacaauauguauu

SEQ ID NO: 51236 - RNA, 1656 nt, Artificial Sequence
  derived and/or modified sequence opt6 from anti-influenza_Chain
augaacacacaaauacuagcauucauagcuuguguuuuaacaggaguaaagggagacaaaauaugccuuggacaucacgcagucgcaaaugggacaaaaguaaauacacuaaccgaaaaaggcauagaaguaguuaaugcaacagaaacaguagaaacagcagauguaaaaaaaauaugcacacaaggaaaacgagcaacagacuuaggaagauguggauuacuaggaacauuaauagggccaccacaaugcgaccaauuucuggaauuuucaucagaucuaauaauugaaagaagggaaggaacagauguuugcuauccaggaagauucacaaaugaagaaucauuaagacaaauacuaagaagaaguggaggaauaggaaaagaauccaugggauucacauauucagguauacguacaaacggagcaacaagcgcauguacaagauccggaucaucauuuuaugcagaaaugaaauggcuacuaucaaauagugauaacagugcauucccacaaaugacaaaagccuauagaaaccccaggaauaaaccugcauuaaucauauggggaguacaccauagcgaaucagugagugaacaaacuaaauuauaugguagcggaaacaaacugauaacaguaagaucuaguaaauaucaacaaucauuuacaccaucaccuggagcccgaagaauagauuuccauugguuauuacucgacccaaacgacacaguaacauucacguuuaauggagcauuuauagcuccagacagagcaucguuuuucagaggugaaucacucggaguacaaucagauguaccacuagacucaaguugcagaggagauuguuuccauagcggaggaacaauaguaaguucauuaccauuucaaaacauaaauagucgcacaguaggaaaauguccaagauauguaaaacaaaaaucacucuuauuagccacuggaaugagaaauguuccagaaaaaccaaaaccaaggggacuauuuggagcaauagcaggauucauagaaaauggaugggaaggcuuaauaaaugguugguauggauucagacaccaaaaugcucaaggagaaggcacagcagcagacuauaaaucaacacaaucagcaauugaucaaauaacaggaaaauuaaauagacuaauagguaaaacuaaucaacaauucgaacuuauagacaaugaauuuaacgaaaucgagcaacaaauaggaaauguaauuaauuggacaagagaugcaaugacagaaauauggucauauaacgcagaacuacuagucgcaauggaaaaucaacauacaauagaccuagcagacucagaaaugagcaaauuauacgaaagaguuaaaaaacaauuaagggaaaacgcugaagaagacgguacaggaugcuucgaaauauuccauaaaugugaugaucaaugcauggaaagcauacgaaacaacacuuaugaucacacacaauauaggacagaaucacuacaaaaccgaauacaaauagauccuguaaaacuaucaaguggauauaaagacaucauauuaugguuuucauucggagccucaugcuuucucuuacuagccauugcaaugggacuaguauucaucuguauaaaaaauggaaauaugcaauguacaauauguaua

SEQ ID NO: 51237 - RNA, 1656 nt, Artificial Sequence
  derived and/or modified sequence opt6 from anti-influenza_Chain
augaacauacaaauacuagcauucauagccuguguauuaaccggugcaaaaggagacaaaauaugcuuaggacaucacgcaguagcaaacgguacaaaaguaaauacacuuacagaaaaaggaauagaaguaguaaaugcaacagaaacaguugaaacagccaauauaaaaaaaauuugcacacaaggaaaaagaccaacagacuugggccaguguggauuacuaggcacauuaauaggaccaccacaaugcgaucaauuccuagaauuuucaagcgaccuaauaauagaaagaagagagggcacugacgucuguuacccaggaaaauucacaaacgaagaaucacuucgacaaauacuaagaagaucaggaggaauaggaaaagaaagcaugggauucacauauuccggaauaagaacaaauggagcuacaagugcauguacaagaucaggaucaucauuuuaugcagaaaugaaauggcuacuaaguaauucagacaacgcagcuuucccacaaaugacaaaauccuacagaaauccaagaaacaaaccagcacugauaauaugggguguacaucauucagaaagugucagugaacagacuaaauuauacggcucaggaaacaaauuaauaaaaguaagaucaucaaaauaccaacaaagcuucacuccaaacccgggagcaagaagaauagacuuucacuggcuccuauuagauccaaaugacacaguaacuuucacauucaauggugcauuuauagcaccggaucgugccaguuucuucagaggagaaucuauuggaguacaaucagaugcaccccuagauucaaguuguggaggaaauugcuuucauaauggaggcacaauaguaucauccuuaccuuuucaaaauauaaacccaaggaccguuggaaaauguccaagauauguaaaacaaaaaucacuacuauuagcaacagguaugagaaacguaccugaaaaaccgaaaaaaagaggauuauuuggagcaaucgcaggauucaucgaaaaugguugggaaggacuaauaaauggaugguauggcuuccgacaucaaaacgcacaaggcgaaggaaccgccgccgauuauaaaucaacccaaucugcaauagaucaaauaacugguaaacuuaacagauuaauaggaaaaacaaaccaacaauucgaacuaauuaauaaugaauuuaaugaaguagagcaacaaauaggaaauguuauuaauuggacucaagaugcaaugacagaaguauggaguuacaaugcagaauuacuuguagcaauggaaaaccaacauacuauugaccucacagacucagaaaugucaaaauuauacgaaagaguacgaaaacaauuaagagaaaacgcugaagaagacgguacaggauguuuugaaaucuuccacaaaugugaugaucacuguauggaaaguauccgaaauaacacauaugaccacacacaauauagaaccgaaagccuacaaaauagaauacaaauagaucccguaaaauuaagcggcggauauaaagauauaauauuaugguucagcuucggagcuucuugcuuucuacuacuugcuauagcaaugggcuuaguauucaucuguauaaaaaacggaaacaugcaauguacaaucuguaua

SEQ ID NO: 51238 - RNA, 1656 nt, Artificial Sequence
  derived and/or modified sequence opt6 from anti-influenza_Chain
gaccaaauaugcauaggauaccacgcuaauaacucaacagaacaaguagauacaauaauggaaaaaaacgucacaguaacacaugcacaaaauauacuggaaaaaacacacaacggaaaacuuugcgaccuagacggaguaaaaccauuaauacuaagagacuguagcguugcaggauggcuacucggaaacccaaugugcgaugaauuccuaaacguuccagaauggaguuacaucguagaaaaaauaaauccagccaaugacuuauguuacccuggaaauuucaacgacuaugaagaacuaaaacaccuacuauccagaauaaaucauuuugaaaaaauacaaauaauuccaaagucaucauggucagaccacgaggcuucaaguggaguaucaagcgcaugcccauaucaaggaagaucaaguuucuuucgcaacguaguauggcuaauaaagaaagacaaugcauauccaacaauaaaaagaucauauaauaacacaaaccaagaagacuuauuaguauuauggggaauacaccauccaaacgaugccgccgaacaaacacgauuauaccaaaaccccacaacauacauaucuguaggaacgucaacacuaaaccaaagauuagucccaaaaauagccaccagaucaaaaguaaacggacaaagcggacgaauggaauucuucuggacaauacuaaaaccuaaugaugcaauaaacuucgaaucaaauggaaauuucaucgcaccugaaaaugcauacaagaucguaaaaaaaggagacucaaccauaaugaaaucagaauuagaauauggaaacuguaacacaaaaugccaaacaccuauaggagcaauaaacuccucaaugccuuuccauaacauacacccacuaacaauuggagaguguccaaaauaugucaaaucaaacaaacucguacuagcaacaggccuaagaaauucaccacaaggagaaagaagaagaaaaaaacgaggacuauucggagcaauagcaggauuuauagaaggaggcuggcaaggaaugguagacggcugguacggauaccaccacagcaaugaacaagguagcggauacgcagcagacaaagaaucaacccaaaaagcuaucgauggcguuacuaacaaaguaaacucaauaauagacaaaaugaacacccaauucgaagccgugggaagagaauuuaauaaccuagaaagaagaaucgaaaacuuaaacaaaaaaauggaagacggauuucuugacguuuggacauauaacgcagaacuacucguauuaauggaaaaugaaagaacauuagacuuucaugauucaaacguaaaaaacuuauacgacaaaauaagauuacaauuacgagauaacgcuaaagaacuaggcaacgguuguuuugaauucuaccacagaugcgacaaugaaugcauggaaucaguucgaaacggaacauacgacuauccacaauacucagaagaagcaagauuaaaaagagaagaaauuucaggcguaaaauuagaaagcauaggaacauaucaaauacuuucaauauauuccaccguagcuagcucacugacucucgcaauaaugguagcaggauuaagucuauggaugugcucaaacgggucauuacaauguagaauauguaua

SEQ ID NO: 51239 - RNA, 1656 nt, Artificial Sequence
  derived and/or modified sequence opt6 from anti-influenza_Chain
gaccaaauauguauaggcuaccacgcaaacaacagcacagaacaaguagauaccauaauggaaaaaaacguaacaguaacacaugcacaagauauacuagaaaaaacacauaacggaaaauuaugcgacuuagauggcguaaaaccuuuaauauuaagagacugcucaguagcaggauggcuauuaggaaauccaaugugugacgaauuuauaaacgucccagaauggucauacauaguagaaaaagcaaacccaacaaacgaccuauguuacccaggaucauuuaacgacuacgaagaacuaaaacaccuacuaucaagaauaaaccauuucgagaaaauacaaaucauaccuaaaucaucauggucagaccacgaagcaucaagugguguaucaucagccuguccauaccuaggaucaccuuccuuuuucagaaacgucguauggcuaaucaaaaaaaacucaacuuacccaaccauaaaaaaaucauauaauaacacaaaccaagaagaucuccuaguauuauggggaauacaccauccgaacgacgcugcagaacaaacacgauuauaccaaaauccaacaacauauauaucaauaggaacaucaacauuaaaccaaagacuuguaccaaaaauagccacaagaucaaaaguaaacggacaaagcggaaggauggaauucuuuuggacaauauuaaaucccaacgacgcaaucaacuucgaaaguaacggaaacuucauagcaccagaauaugccuauaaaauaguaaaaaaaggagacucagccauaaugaaaucagaacucgaauacggaaacugcaacacuaaaugucaaacaccuaugggagccauaaacucauccaugccauuccauaauauccacccacuaacaauaggagaauguccuaaauacguaaaaagcaacagauuaguacuagcgacaggauuaagaaacagcccacaacgcgaaagucgaagaaaaaaaagaggacuauucggagcgauagcaggguucauagaaggaggauggcaaggaaugguagauggaugguacggcuaucaucauagcaacgaacaaggaucaggauaugcugccgauaaagaaagcacacaaaaagcaaucgacggaguaacaaacaaaguuaacuccauuauagacaaaaugaacacacaauucgaagcaguaggaagagaauucaauaaccuggaaagaagaauagaaaacuuaaacaaaaaaauggaagacggauuccuagacguauggaccuauaacgccgagcuacuaguacuaauggaaaaugaacguacacuagacuuccaugacagcaacguaaaaaauuuauaugacaaaguaagacuacaauuaagagacaaugcaaaagaacuaggaaacggaugcuucgaauucuaccacaaaugcgacaacgaaugcauggagucuauacgaaacggaacauauaacuauccacaauacagcgaagaagcaagauuaaaaagagaagaaauaucuggaguaaaacuagaaucaaucggaacauaucaaauacuaagcaucuauaguacaguagcaagcucacuagcucuagcgauaaugauggcaggauuaucacuauggaugugcucaaacggauccuuacaaugucgaauaugcauc

SEQ ID NO: 51240 - RNA, 1680 nt, Artificial Sequence
  derived and/or modified sequence opt6 from anti-influenza_Chain
augucaaacauggauauagacucaauaaauaccggaacaauagacaaaacuccagaagaacucacaccaggaacaucaggagcaacuagaccuauaaucaaaccagcaacacuagcaccaccauccaauaaaagaaccagaaauccaucacccgaaagaacgacuacauccucagaaacagauauaggaaggaaaauacaaaaaaaacaaacaccaaccgaaauaaaaaaaucaguauauaaaaugguaguaaaacuaggagaauuuuacaaucaaaugauggucaaagccggacuaaacgaugacauggaacgcaacuuaauacaaaacgcccaagcaguggaaagaauacuacuagcagcuacagacgauaaaaaaacugaauaucaaaaaaaacgaaaugcaagagauguaaaagaaggcaaggaagaaauagaccauaauaaaacaggaggaacuuuuuacaaaauggucagggacgauaaaacaauauauuuuaguccaaucaaaauaacauucuuaaaagaagaaguaaaaacaauguacaaaacaacaaugggaucagauggauuuucgggauuaaaucacauaaugauaggacacucacaaaugaacgauguaugcuuucaaagaucaaaaggauuaaaaagaguaggauuagauccaagccuaauuaguacauuugcaggaagcacacuaccaagaagaagcggcacuacaggaguugcaauaaaaggaggaggaacccugguagacgaagcaauaagauuuauaggaagagcaauggcagauagaggacuauuaagagauauaaaagcaaaaacagccuaugaaaaaauacuauuaaacuuaaaaaauaaauguucagcaccacaacaaaaagcacuaguagaccaaguaauagguucaagaaauccuggaauagcagauauagaagaucuaacacuacuagcaagaaguaugguaguagucagaccaucaguagcaucaaaaguagucuuaccaauaaguauauaugcaaaaauaccacaacuaggguucaauacggaagaauacuccaugguuggauacgaagcuauggcccuauacaauauggcaacaccuguuucaauauuaagaaugggagaugacgcaaaagacaaaagucaacuauuuuucaugucaugcuucggagcagcauacgaggauuuaaggguauuaucagcauuaacaggaacagaauucaaaccgagaucagcacuaaaaugcaaaggauuccacguaccagcaaaagaacaaguagaaggaaugggcgccgcauuaaugucaauaaaacuacaauucugggcaccaaugacuagaucaggaggaaacgaaguaucaggagaaggaggaaguggacaaauaucaugcucaccaguguuugcugucgaaagaccaauagcacuaucaaaacaagcaguacgaagaaugcuaucaaugaauguagaagguagagacgcagacguuaaaggaaaccuauuaaagaugaugaacgauaguauggcaaaaaaaacaucaggaaacgcauucauuggaaaaaaaauguuucaaaucucagacaaaaauaaagucaaucccauagagauaccaauuaaacaaacgauacccaacuucuucuuuggaagagacacagccgaggacuacgaugacuuagacuac

SEQ ID NO: 51241 - RNA, 1680 nt, Artificial Sequence
  derived and/or modified sequence opt6 from anti-influenza_Chain
augaacacacaaauauuagcacuuauagcauacauguuaaucggagcaaaaggagauaaaauaugucuaggacaucacgcuguagcaaauggaacaaagguaaauacauuaacagaacgaggaauagaaguaguaaaugcaacagaaacagucgaaacaguaaacauaaagaaaauuugcacacaaggaaaaagaccaacagacuuaggacaaugcggauuauuaggaacuuuaauaggcccaccacaaugugaucaauuccuagaauuugaugcagaucuaauaauugaaagaagagaaggcaccgacguauguuacccaggaaaguucacuaacgaagaaucauuaagacaaauauugagaggaaguggagggauagacaaagaaagcauggguuuuacauacagcgggauaaggacaaauggaguaacgucagcuuguagaaggucagggucaaguuucuacgcagaaaugaaaugguuacuaucaaacagugauaacgcagcuuuuccucaaaugacaaaaucguacagaaauccaagaaacaaaccagcacuaauaauauggggaguacaccauucaggaucugcaacagaacaaacaaaacuuuauggcagcgguaacaaauuaauaacuguaggaucuaguaaauaccaacaaucguuuacacccagucccggagcaagaccacaaguaaauggucaaucaggaagaauugacuuucauugguuacuacuagauccaaaugauacaguaacguuuacauucaauggagcauucauagcaccagacagagccaguuucuucagaggggagagcuuaggaguccaaucagaugugccacuagauagcggaugcgaaggcgauuguuuccauagccgaggaacuauaguaaguaguuuaccuuuccaaaacauaaauccaagaacuguagguaaauguccaagauauguaaaacagacaucauuacuacuagcaacuggaaugagaaauguaccugaaaauccuaaaacaagaggauuauucggagcaauagcaggauucauugaaaauggaugggaaggauuaauagauggaugguacggcuuucgacaccaaaaugcacaaggagaaggcacagcagcagacuauaaaucaacacaaagcgcaauagaccaaauaaccggaaaauuaaauagauuaauagauaaaacaaaccaacaauucgaauuaauagacaaugaauuuucugaaaucgaacaacaaauaggaaacguaauaaauuggacaagagacagcaugacagaaguauggucauauaaugcagaauugcuaguagcaauggaaaaucaacauacuauagauuuagcagauagcgaaaugaauaaacuauacgaaagaguaagaaaacaacuaagagaaaacgccgaagaagacggaacaggaugcuuugaaauauuucacaaaugugacgaucaauguauggaauccauuaggaauaacacauaugaucacacacaauauagaacagaaucacuacaaaacagaauacaaauagauccaguaaaauuauccagcggauacaaagauaucauacuaugguucucauuuggagcaaguuguuuccuauuauuagcaauagcuaugggauuaguuuucauauguaucaaaaacggaaauaugagauguaccauauguaua

SEQ ID NO: 51242 - RNA, 1680 nt, Artificial Sequence
  derived and/or modified sequence opt6 from anti-influenza_Chain
augaauacacaaauauuagcuuuaaucgccugcaugcuaauaggagcaaaaggagauaaaauauguuuaggccaucacgcaguagcgaacggaacaaaagucaauacauuaaccgaaagaggaauagaaguaguaaacgcaacagaaacaguagaaacagcaaauauuaaaaaaauauguacucaagguaaaagaccaacagaccuuggccagugcggacuauuaggaacacuaauaggcccgccacaaugcgaucaauuucuagaauuugacgcagaccuaauaauagaaagaagggaaggaaccgauguauguuacccaggaaaauucaccaaugaagaaucacuuagacaaauauuaagaggaaguggcggaauagacaaagaaucaauggguuucaccuauucagguauaagaacaaauggagcaacaucagcauguagaagaucagguaguucauucuaugccgaaaugaaauggcuacuaucaaacagcgacaaugccgcauucccucaaaugacuaaaucauacagaaauccacgaaauaaacccgcacuaauaauauggggaguacaucauagugguagcgcaacagaacagacaaaauuauacggauccgguaauaaacuaauaacaguaggaucaucuaaauaccaacaaaguuuuacaccgucaccaggagccagaccacaagugaauggacaaucgggaagaauagacuuucacugguuauuacuagaccccaaugauacaguaacauuuacuuuuaacggagcuuuuauagcaccagaucgagcaaguuuuuuuagaggaggaucacuaggaguacaaucagauguaccauuagauaguggaugcgaaggagauugcuuccacagcgguggaaccauugugucaagccuaccauuccaaaacauaaauccaagaacaguaggaaaauguccuagauacgugaaacaaacaucauuacuacuagcuacaggaaugcgaaauguaccagaaaauccaaaaaccagaggacuauuuggugcaauagcaggauucauagaaaauggaugggaagguuuaauagacggaugguauggauuucgacaucaaaaugcacaaggagaaggaacagcagcagacuauaaaucaacacaaagugcgauagaucaaauaacaggaaaacugaacagacuaauagauaaaacaaaucaacaauucgaacuaauagauaaugaauuuaacgaaauagaacaacaaaucggaaacguaaucaauuggacgagagauaguaugacagaagucuggaguuacaaugccgaauuacuaguagcuauggaaaaucagcacacaauagaccuagcagauagcgaaaugaacaaacucuaugaaagaguaagaaaacaauuaagagaaaacgcagaagaagauggaacaggauguuuugaaauauuucauaaaugugacgaucaaugcauggaaucaauaagaaauaacacauacgaucacacacaauauagaacagaaucacuccaaaaccgcauacaaauaaauccaguaaaacuuucaucaggauauaaagauauaauacuaugguuuucauucggagcuuccugcuuuuuauuacuagcuauugcaaugggacuaguauuuauaugcaucaaaaauggaaauaugagaugcacuaucuguaua

SEQ ID NO: 51243 - RNA, 1680 nt, Artificial Sequence
  derived and/or modified sequence opt6 from anti-influenza_Chain
auggaaagaaucguauuauugcuagccauaguaucuuuaguaaaaucagaccagauauguauaggauaccacgcaaauaacucuacagaacaaguagacacaauaauggaaaaaaacguaacagucacacacgcacaagauauacuagaaaaaacacauaauggaaaacuaugugacuuagacggcguuaaaccccuaauacuacgagauugcaguguagccggaugguuauugggaaaucccaugugcgacgaauuucuaaacguaccagaauggucuuacauaguagaaaaaauaaaucccgcaaacgacuuauguuacccaggaaauuucaaugacuacgaagaauuaaaacaucuauuaucaagaauaaaccacuuugaaagaauacaaauuauuccuaaaucauccuggagcgaccaugaagcaucgagugguguaucuucagcaugcccauaccaaggaagaucaucauuuuucaggaauguaguuuggcuaauaaaaaaaaauaaugcauacccuaccauaaaaagaagcuauaacaacacaaaccaagaagauuuauuaguacuauggggaauacaccauccaaaugacgcagcagaacaaacaagacucuaucaaaacccaacuacauacauaucaguuggaacaagcacauuaaaccaaagauuaguacccaaaaucgcaacaagguccaaaguaaacggacaaucaggaagaauggaauucuuuuggacaauacucaaacccaaugacgcaauaaacuucgaaucaaauggaaacuuuauagcaccagaaaaugcauauaaaaauugccaaaaaggagacuccacaauaaugaaaucagaauuagaauacggaaauugcaauacaaaaugccaaacuccaaucggagccaucaacaguucaaugcccuuucacaacauacauccacuaacaaucggagaauguccaaaauacguaaaaaguaacaggcuaguauuagcaacaggauuaaggaacucaccacaaggagagagaagaagaaaaaaacgcggacuauucggagccauagcaggauucauagaaggaggauggcaaggaaugguagacggaugguacggauaucaccauucaaaugaacaaggaucaggauaugccgcugauaaagaaagcacucaaaaagcaauagacggaguaacgaauaagguaaauucaauaauagauaaaaugaauacacaauuugaagcgguaggaagagaauuuaacaacuuagaaagaagaaucgaaaaucuaaacaaaaaaauggaagacggcuuucucgauguuuggaccuacaaugcggaacucuuaguacuaauggaaaacgaaagaacgcuagacuuucaugauucaaacgucaaaaaccuuuaugacaaagucagauuacaacuaagagauaaugcaaaagaacuaggaaacggauguuucgaauuuuaucauagaugugacaaugaauguauggaaaguguaagaaauggaacauaugauuacccacaauauagcgaagaagcccgauuaaaaagagaagaaaucucaggaguaaaauuagaaucgauaggaacguaccaaauacuaucaauauauaguacaguagccucaucacuagcacuagcaauuaugguagcgggauuaagucuauggauguguaguaacgga

SEQ ID NO: 51244 - RNA, 1680 nt, Artificial Sequence
  derived and/or modified sequence opt6 from anti-influenza_Chain
augucaaacauggauauugauaguauuaacacaggaacaauagauaaaacaccagaagaacuaacaccaggaacaucaggggcaacaagaccaauaauaaaaccagcuacacuagcaccacccucaaacaaaagaacaagaaacccaucaccagaaagaacaacaacuagcucagaaacagauauaggaagaaaaauccaaaaaaagcaaacaccuacagaaauuaaaaagucaguguacaaaauggucgucaaauuaggagaauuuuacaaccaaaugauggucaaagcagguuuaaacgacgacauggaaagaaacuuaauucaaaacgcacaagcaguagaaagaauucuacuugcagccacagacgacaaaaaaacagaauaucaaaaaaaaagaaaugcaagggacgucaaagaaggaaaagaagaaauagaccauaauaaaacaggcggaacuuucuacaaaaugguaagagaugacaagacaauauauuucucacccauaaaaauaacauuccuaaaagaagaaguaaaaacaauguauaaaaccaccaugggaagugacggauuuaguggauuaaaccauauuaugauuggacauagucaaaugaacgacguauguuuccaaagaucuaaaggccuaaaaagagucggacuagaccccagcuuaauaucaacauucgcaggaagcacauuaccaagacgaaguggcacaaccggaguagcuauaaaaggaggaggaacucuaguugaugaagcaauaagauuuauugguagagcaauggcagacagaggacucuuacgagauaucaaagcgaaaaccgcuuaugaaaaaauccuacuaaaucuuaaaaacaaguguucagccccucaacaaaaagcacuugucgaccaaguuauaggaaguagaaaccccggaauagccgauauagaagaccuaacacuacuagcacgaagcaugguaguagucagaccaucaguagccagcaaaguagugcucccaauaagcauauacgcaaaaauaccacaacuaggauuuaauacagaagaauauaguaugguaggauaugaagcaauggcauuauacaacauggcaacuccaguaaguauacuaagaaugggagacgaugcaaaagauaaaucucaauuauucuucaugucaugcuuuggagcagcauacgaagacuuaagaguccuuucagcacucacaggaacggaauuuaaaccaagaagcgcuuuaaaaugcaaaggauuucacguaccugcaaaagaacaaguugaaggaaugggagcagcauuaaugaguauaaaauuacaauuuugggccccaaugacaagaaguggaggaaacgaaguaucaggagaaggaggaucaggacaaauuucgugcucaccaguauuugcaguagaacgaccaauagcauuaaguaaacaagcaguccgaagaaugcuaagcaugaacgucgaaggaagagaugcagacguaaaaggcaaccuauuaaaaaugaugaacgacucaauggcaaaaaaaaccaguggcaaugcauuuauaggaaaaaaaauguuucaaauuagcgacaaaaauaaaguuaauccgaucgaaaucccaauaaagcaaaccauuccaaauuucuuuuuuggaagagauacugcagaagacuacgacgaucuagacuau

SEQ ID NO: 51245 - RNA, 1680 nt, Artificial Sequence
  derived and/or modified sequence opt6 from anti-influenza_Chain
augaacacccaaauacuagccuuaauagcuuacauguuaauuggagcaaaaggagauaaaauaugucuaggacaccaugcaguagccaauggaacaaaaguaaacacacuaacagaaagaggaauugaagucguaaacgcaacagaaacaguagaaacaguaaauaucaaaaaaaucuguacccaaggaaaaagaccaacagacuuaggucaaugcggucuucuaggaacauuaauuggaccaccucaaugugaccaauuucuagaauucgacgcagaucugauaauagaaaggcgagaaggcacagauguauguuacccaggaaaauuuacuaaugaggaaucauuaagacaaauacuacgaggaaguggaggaauagauaaagaaagcaugggcuucacauauucaggcauacgaaccaauggaguaacaagcgcaugcagaagaucaggaagcaguuucuaugcagaaaugaaaugguuacuaucaaacagugauaaugccgcuuucccucaaaugacaaaaagcuauagaaauccaagaaacaaaccagcauuaauuaucugggguguucaccacagcggcagcgcaacagaacaaacaaaacucuacggaagugguaacaaauugauaacaguaggaucaaguaaauaccaacagaguuuuaccccaucuccaggagcuagaccacaaguaaauggccaaucuggaagaauagacuuucauuggcuacuauuagauccaaacgacacaguaacauucaccuucaauggagcauuuauagcaccugaucgagcgucauuuuuccguggagaaagucuugggguacaaagugauguuccauuagauagcggaugugaaggagauugcuuccauaguagagguacaauaguaucuucauuaccauuucaaaacauuaauccaagaacaguaggaaaaugcccaagauacguaaaacaaacaagccuacuucuagcaacaggaaugagaaauguaccagaaaauccaaaaacuagaggauuauucggagcuauugcaggauucauagaaaauggaugggaaggacuaauagacggaugguacgguuuuagacaccaaaaugcacaaggagaagggacugcagcugauuacaaaucaacacaaagcgcaauagaucaaauaacaggaaaauuaaauagacuaauugacaaaaccaaucaacaauucgaacucauagacaaugaauuuagugaaauagaacaacaaauaggcaauguaaucaacuggacuagagacucaaugacagaagucuggucauauaaugcagaauuauuaguagcaauggaaaaucaacauacaauugaccuagcagauucagaaaugaauaaauuauaugagagaguaagaaaacaauuaagagaaaaugcagaagaggacggaacaggcugcuucgaaaucuuccauaaaugcgacgaccaauguauggaaagcauacgaaacaacacauacgaucacacacaauacagaacagaaucauuacaaaacagaauacaaauugauccagucaaauuaucaucaggcuacaaagauauaauauuaugguuuucuuuuggagccucaugcuuucuccuacuagcaauagcaauggguuuaguauucauuuguauaaaaaauggaaacaugagauguacaaucugcaua

SEQ ID NO: 51246 - RNA, 1680 nt, Artificial Sequence
  derived and/or modified sequence opt6 from anti-influenza_Chain
augaauacucagauauuagcauuaauagcaugcaugcuaauaggagcaaaaggagauaaaauaugccuaggacaucaugcaguugcuaaugguacaaaaguaaacaccuuaacagaaagaggaaucgaaguuguaaacgcaacugaaacuguagaaacagccaacaucaaaaaaauaugcacacaagguaaaagaccaacugaccucggacaaugugggcuauuaggaacacuaauuggaccaccgcaaugugaucaauuucuugaauuugaugcugaucuaauaauagaacgaagagaagguacagacgucuguuacccaggcaaauuuacaaacgaagaaucacuuagacaaauauuacgaggauccggaggaauagauaaagaauccaugggauuuacuuauagcggaauaagaacaaacggagccaccagugcauguagaagaucugggucaucauucuacgcagaaaugaaauggcuauuauccaauagcgacaaugccgccuucccacaaaugaccaaaucauacagaaaucccagaaauaaaccagcacucauaaucuggggaguacaucauucagguuccgcaacagaacaaacuaaacuauacggaaguggaaacaaacuaauaaccguaggaaguagcaaauaccaacaaucauuuacgccaagcccaggagcacgaccacaagucaauggacaaucaggcagaauagacuuucauuggcuacuacuagauccaaaugacacuguaacuuuuacauucaauggagcauucauagccccugacagagcaucauucuuuagaggaggaucacugggaguacaaagcgauguaccauuagauuccggaugugaaggcgacuguuuucacagcggcggaaccauaguaucuucucugccauuucaaaauauuaauccgaggacuguagguaaaugcccacguuauguaaaacaaacaucacuucuacuagcaacaggaaugagaaauguaccagaaaauccuaaaacaaggggauuauucggagcaauagcagguuucauagaaaacggaugggaaggccuaauagacggcugguauggauucagacaccaaaaugcacaaggagaaggcacagcugcagacuacaaaucaacacaaagugcaaucgaucaaauuacaggaaaacuaaacagacuaauagauaaaacaaaucaacaauucgaacuuauugacaacgaauuuaacgaaauagaacaacaaaucggaaacgucaucaauuggaccagagauucaaugacggaaguauggaguuacaaugcagaacuauuaguugcuauggaaaaucaacauacaauagacuuagcagacucugaaaugaauaaauuauacgaaaggguaagaaaacaacuaagagaaaacgcagaagaagacggaacaggcugcuuugaaauauuucauaaaugugacgaucaaugcauggaaucaauaagaaauaacacauaugaccauacacaauauagaacagaaucccuacaaaacagaauacaaauaaauccuguaaaauuaucuucaggauauaaagauaucauauuaugguucaguuuuggggcaucaugcuuccuacuauuagcaauugcaaugggccuaguauuuauauguauaaaaaauggaaacaugagauguacaauauguaua

SEQ ID NO: 51247 - RNA, 1680 nt, Artificial Sequence
  derived and/or modified sequence opt6 from anti-influenza_Chain
auggaaagaauaguauuauuauuagcaauaguaucacugguaaaaucagaccaaauaugcauaggauaccacgccaauaacaguacagaacaaguagauacaauaauggaaaaaaacguaacaguuacacacgcacaagacauucuagaaaaaacacacaacggaaaauuaugugaccuagauggaguaaaaccuuuaauacuaagagacugcucagucgcaggaugguuacuaggcaauccuaugugcgacgaauuucuaaacguuccagaauggucauacauaguagaaaaaauaaauccugcaaacgaccugugcuacccaggaaacuuuaacgauuacgaagaacuaaaacacuuacuaucacgcauaaaccauuuugaaaggauacaaauaauacccaaaucaucauggagcgaccacgaagcaucaagcggaguaaguucagcauguccauaucaaggcagaucauccuuuuuuagaaauguuguauggcuaauaaaaaaaaacaacgcauacccaacaauaaaaagaucauauaacaauacaaaucaagaagauuuacuaguacuuuggggaauacaccacccaaacgaugcagccgaacagacaagacucuaucaaaaccccacaacauacauaagugucggaacaucaacauuaaaccaaagauuaguaccaaaaauagcaacaagaagcaagguuaacggacaaucagguagaauggaauucuucuggaccauacuaaaaccaaacgaugcuaucaacuuugaaucaaacggaaacuucauagcgccagaaaacgcauauaaaaauugucaaaaaggagacagcacaauaaugaaaucagaacuagaauauggaaacuguaauacaaaaugucaaacaccaauaggagcaauaaacaguucaaugccauuccauaacauucauccucuaacuauaggagaaugcccuaaauauguaaaaucaaaccgauuaguucuagcaacuggccuaagaaauucaccacaaggcgaaagaagaagaaaaaaaagaggucuauucggagcaaucgcaggauuuauagaaggaggauggcaagguaugguugacggaugguauggauaucaccauagcaaugaacaaggaaguggauacgcagcagauaaagaaagcacacaaaaagccauagauggaguaacaaacaaaguaaauucaaucauagauaaaaugaacacucaauucgaagcaguuggacgagaauucaacaacuuagaaagaaggauagaaaacuuaaauaaaaaaauggaagacggcuuccuagacguauggacuuacaacgcagaacuacucguacuaauggaaaaugaaagaacucuagauuuucacgauucaaauguaaaaaaucuauacgacaaaguaagacuacaacuaagagacaacgcaaaagaacuaggaaacggaugcuucgaauucuaccauagaugugacaacgaaugcauggaaaguguacgaaacggaacauaugauuacccacaauacucagaagaagcaagacuaaaacgagaagaaaucucaggaguaaaacuagaaucaauaggaacuuaucaaauacuaucgauauauucaacgguagcaucaagucuagcuuuagcaauaaugguagcuggacuaucacucuggauguguaguaaugga

SEQ ID NO: 51248 - RNA, 1686 nt, Artificial Sequence
  derived and/or modified sequence opt6 from anti-influenza_Chain
augccaagagcacuaaggagaguacccgguucacgaguaauguuaagaguagguguuguuguugcaguauuagcgcuaguugcugcacuagcaaaucuagccgucccaagaccagcaagagcagcuggaggaggauauuggcauacaagcggaagagaaauauuagacgcuaauaauguaccaguaagaauagcaggcauaaauugguuuggguuugaaacauguaacuauguaguacauggacuauggucaagagacuauagaaguauguuagaucaaauaaaaagucuagguuauaacacaauaagauuaccuuacagugacgauauauuaaaaccagguacaaugccaaauucuauuaauuuuuaucaaaugaaucaagacuuacaaggucugacaaguuuacaaguaauggauaaaaucguagcauacgcaggacaaauaggauuacgaauaauauuagauagacauagaccagauugcucaggacaaucagcuuuaugguauacaucaucaguaucagaagcaacauggauuucagaucuacaagcauuagcacaaagauauaaaggaaauccaacagugguaggauucgaucuacauaacgaaccacaugauccagcuuguuggggcuguggugauccuagcauagacuggagacucgccgcagaaagagcuggaaaugcgguacuaucaguuaaccccaaccuacuuauauuuguagaaggaguacaaaguuauaauggagauagcuauugguggggcggaaauuuacaaggagcaggucaauauccgguuguacuuaauguaccaaauagguuaguauacagugcacaugauuaugcaacaucaguauauccacaaaccugguucucugauccaacauucccaaacaauaugccaggcauauggaacaaaaauugggguuacuuauucaaucaaaacauugcuccaguauggcuaggugaauuugguacaacauuacaaucaacuacagaucaaacaugguuaaaaacgcuaguacaauaucuuagaccaaccgcccaauauggagcagauucauuucaauggacauuuuggucauggaaucccgauagcggagauacaggagguauacuaaaagaugauuggcaaacaguagauaccguuaaagauggauauuuagcacccauaaaaucaucaauauucgauccuguaggagcaagcgcuucucccucaucgcaaccaaguccauccguaucaccaaguccuucaccgagcccaucagccucaagaacaccuacaccaacaccaacaccaacagcaucaccuaccccuacuuuaacuccaacagcaacaccaacacccacagcauccccaacgccaucaccaacagcagcuaguggagcccguuguacagccagcuaccaagugaacagugacuggggaaauggcuuuacaguaaccguagcaguuacaaauuccgguucuguugcuacaaaaacuuggacuguaucuuggacauucggaggaaaucaaacaauaacaaauucguggaacgcagcaguaacacaaaacggacaaagcgucacagcaagaaauaugucauacaauaacguaauacaaccaggacaaaacacaacauuuggauuucaagcaucauauacuggaaguaaugcugcaccuacuguagccugugcugcaagu

SEQ ID NO: 51249 - RNA, 1686 nt, Artificial Sequence
  derived and/or modified sequence opt6 from anti-influenza_Chain
auggaaagaguaugguggaaagaagcaguaguauaucaaauuuacccaagaucauuuuaugauucaaacggcgacggaauaggugacauaagagguauaauagccaaauuggacuauuuaaaagaauuaggcguagauguaguguggcucucaccaguauauaagagcccaaaugaugacaacggcuaugacauaagcgauuacagagauauaauggacgaauuuggaaccauggcagauuggaaaacaauguuagaagaaaugcacaaaagaggaaucaaauuaguaauggaucuaguagucaaucacacuagcgaugagcacccaugguucauagaaucaaggaaaagcaaagauaauccauauagagacuauuacauauggagaccagggaaaaacggaaaggaaccaaacaauugggaaucaguuuuuuccggaagugcaugggaauaugaugaaaugacaggugaauauuaccuacaucucuuuagcaaaaaacaaccagacuuaaauugggaaaauccaaaagugcgacgagaaguuuacgaaaugaugaaauuuuggcucgacaaagguguagauggauuuagaauggacguaauaaauaugauuaguaaaguaccagaacuaccagauggagaaccacaaagugguaaaaaauaugcaucaggcucgagguacuauaugaacggacccagaguccacgaauuucuacaagaaaugaauagggaaguguuaucaaaauacgauauaaugacaguaggagaaacaccagggguaacaccaaaagaaggaauuuuauauacagaccccucaagaagagaauuaaacauggucuuucaauuugaacacauggaucuagauucaggucccgggggaaaaugggauauaagacccuggagccuagccgaucuaaaaaaaacaaugacuaaauggcaaaaagaauuagaagguaaaggauggaauaguuuauauuugaacaaucaugaccaaccaagagcagugaguagauuuggagaugacggaaaauauagaguagaaagugcaaaaaugcuagcaacauuuuuacacaugaugcaaggaacgccuuauauauaucaaggagaagaaauaggaaugacaaauguaagauuuccaucaauagaagacuauagagacauagaaacauuaaacauguacaaagaaagaguagaagaauacggagaagacccucaagaaguaauggaaaaaauuuauuauaaaggaagagauaaugcacgaacaccaaugcaaugggaugauagugaaaaugcaggauucacagcaggaacaccauggauaccaguaaacccaaacuauaaagaaauaaauguaaaagccgcauuagaagacccaaacucaguauuucauuacuacaaaaaguuaauccaacugagaaaacaacaugauauaauaguauauggaacauacgauuuaauauuagaagaugacccauauauauacagauauacaagaacacuaggcaaugaacaacuaauaguaauaacaaauuuuucagaaaaaacaccaguauucagacuaccagaucacauaauauauaaaacaaaagaauuauuaauaucaaauuaugauguagacgaagcagaagaacuaaaagaaauucgauuacgaccaugggaagcaaggguauacaaaauaagacuaccu

SEQ ID NO: 51250 - RNA, 1686 nt, Artificial Sequence
  derived and/or modified sequence opt6 from anti-influenza_Chain
augccaagagcauuaagacgaguaccuggaaguagaguaaugcuaagagucggagucguuguagcaguauuagcauugguugcagcacuagcaaaucuugcuguaccaagacccgcaagagcagcaggcggaggcuauuggcauacaagcggacgagaaauccuagaugcuaauaaugucccaguacgcauagccggaaucaacugguucgguuuugaaaccuguaauuacguaguccauggacuuuggucaagagauuacagaucaauguuagaccaaauuaaaucauuaggauauaauacaauaagauuaccauauucagacgauauauuaaaaccaggaacuaugccaaauucaauuaacuuuuaucaaaugaaccaagauuuacaaggacuaacaucucuacaagucauggauaaaauuguagcauaugcaggucaaauuggccuacgaauaauauuagacagacacagaccagacuguucaggacaaucagcuuuaugguacacaucaaguguaucagaagcaacauggauaucugauuuacaagcucuagcucaaagauauaaaggaaauccaacaguuguaggauucgauuuacauaaugaaccacaugauccagcauguuggggaugcggugauccaucaauagacuggagacuagcagcagaaagagcaggaaaugcagucuuaucuguaaacccaaaucuauuaauauuuguagaaggaguacaaaguuauaauggagauaguuauugguggggaggaaauuuacaaggagcaggccaauauccuguuguauuaaauguccccaacagauuaguauauucagcucacgauuaugccacaucaguauauccacaaacaugguuuucagauccaacuuucccaaacaauaugccaggaauauggaacaaaaauugggguuaucucuuuaaccaaaauauagcaccaguauggcuaggagaguucggaacuacauuacaaaguacaacagaccaaacauggcuaaagacucuaguccaauauuuaagaccaacagcacaauauggugcagacucuuuucaauggacauuuuggucauggaauccggauucaggagauacaggaggcauuuuaaaagaugauuggcaaacaguagauacgguaaaagacggauacuuagcuccaauaaaaaguucuauuuuugauccaguaggagcaucagcaucaccuaguagucaaccaucaccuucagucucacccucaccgucaccaucaccaucagcauccagaacuccuaccccaacuccaacaccaacagcaagcccaacaccuacacuaacaccaacagcaaccccaacacccacagcauccccaacuccaucaccuacagcagccuccggagcaagauguacagcaucauaccaagucaacuccgacuggggaaauggauuuacaguaaccguagcagucacaaauagcggcucaguagcaacaaaaacauggacuguauccuggacauucggugguaaccaaacaauaacaaauucauggaaugcagcaguaacucaaaauggucaaaguguaacagcacgaaacaugucauauaacaauguaauucaaccuggacaaaauacaacuuucggauuucaagcaucuuauacaggaaguaacgcagcaccaacaguagcaugugcagcauca

SEQ ID NO: 51251 - RNA, 1686 nt, Artificial Sequence
  derived and/or modified sequence opt6 from anti-influenza_Chain
auggaaagaguuugguggaaagaagcaguuguauaucaaauauaccccaggucauuuuaugacucuaacggagacggaaucggugacauaagagggauaauagcaaaauuagauuacuuaaaagaauuaggaguggacguaguaugguuaucaccaguauauaaaucaccaaaugacgauaacggauaugauauaagugauuauagagacaucauggaugaauuuggaacaauggcagauuggaaaacaaugcuagaagaaaugcacaaaagaggaauaaaauuagugauggaccuaguaguaaaucacacuucagaugaacauccaugguucauagaaaguagaaaaagcaaagauaacccguauagagacuauuauauauggagaccugguaaaaacggaaaagaaccaaauaacugggaaagcguauucaguggaagcgcuugggaauacgaugaaaugacaggagaauauuaccuacaccuauuuucgaagaaacaaccagacuuaaauugggaaaacccaaaaguacgacgagaaguauaugaaaugaugaaauuuugguuagauaaaggagucgacggauuuagaauggacguaauaaacaugauaucaaaaguaccagaacuaccagauggagaaccccagaguggcaagaaauacgcaucagguagcagauauuauaugaauggcccaagaguacaugaauuuuuacaagaaaugaacagagaaguauuaaguaaauacgauaucaugacaguaggugaaacaccaggagucacaccaaaagaagguauauuauauacagauccgucuagaagagaauuaaacauggucuuccaauuugaacauauggauuuagauagugguccaggaggaaaaugggauaucagacccuggagcuuagcagaucuaaagaaaacaaugacaaaauggcaaaaagaauuagaaggaaaaggguggaauaguuuguacuuaaauaaccacgaucaaccucgagcaguaagccgauuuggagaugacgggaaauacagaguagaaagcgcaaaaauguuagcaacauucuuacacaugaugcaaggaacaccauauauauaccaaggugaagaaaucggaaugacgaauguacgauuuccuagcauagaagauuauagagauauagaaacauuaaacauguauaaagaaagaguagaagaauauggcgaagauccacaagaaguaauggaaaagauauauuacaaaggaagagacaaugcaagaacaccaaugcaaugggaugauucagaaaacgcagguuuuacugcagguacaccauggauaccaguaaacccaaacuacaaagaaauaaauguaaaagcagcucuagaagauccaaacucaguuuuucacuacuacaagaaauuaauacaauuaagaaaacaacaugauauaauuguauauggcacguacgauuuaauuuuagaagacgaucccuacauauauagauauacacgaacacuaggaaacgaacaacuaauagugauaacuaauuucagugagaaaacuccaguauuuagauuaccagaccacauaauauauaaaacaaaagaacuauuaauaucaaauuaugacguagacgaagccgaagaacuaaaagaaauacgacuaagaccaugggaagcaagaguauacaaaauaagauuaccg

SEQ ID NO: 51252 - RNA, 1689 nt, Artificial Sequence
  derived and/or modified sequence opt6 from anti-influenza_Chain
auggagaaaauaguacuacucuucgcaauaguaagucuaguaaaaagcgaccaaauaugcaucggauaucaugcaaauaauaguacagaacaagucgauacaaucauggagaaaaacguaacaguaacucacgcacaagacauacuugaaaaaaaacacaacggaaaacuaugugacuuagauggaguaaaaccacuaauacuacgagauuguagcguagcaggcuggcuacugggaaacccaaugugugacgaauucaucaauguaccagaauggaguuacauaguagaaaaagcaaauccaguaaacgaucuaugcuaccccggagauuuuaacgacuacgaagaacuaaaacaccuucucucaagaauaaaccacuucgaaaaaauacaaauaaucccuaaaagcucauggucuucacacgaagcaucacuaggagucucuucagcaugcccguaccagggaaaaacaaguuucuuuagaaacguaguuugguuaauuaaaaaaaauucaacauauccaacaauaaaaaggucauacaauaacacaaaccaagaagacuuacucguacuuugggguauacaccaccccaacgacgcagcugaacaaacaaaacuauaccaaaacccaacaacauacaucuccguaggcacaucaacacuuaaucaaagguuagucccaagaauagcaacaagaagcaaaguaaacggacaaaguggacgaauggaauucuucuggacaauauuaaaaccuaacgaugcaauaaacuucgaaaguaacgggaauuuuauagcaccagaauaugcauacaaaauaguaaaaaaaggagacucaacaauaaugaaaagugaacuagaauacggaaauugcaacacaaaaugccaaacaccaaugggugcaauaaacucaucaaugccauuucacaauauucauccacuaacaauaggagaauguccaaaauacguaaaaucuaauagauuaguauuagccacaggauuaaggaacucaccgcaacgagaaaccagaggauuauucggagcaauagccggauucauagaaggaggauggcaaggaauggucgacggcugguacggauaccaccacucaaacgaacaaggaagcggauaugccgcagacaaagaaucaacacaaaaagcaauagauggagugacaaacaaaguaaacuccauaauagacaaaaugaacacacaauucgaagccguaggaagagaauucaauaaccuagaaaggcgaauagaaaacuuaaacaaaaaaauggaagacggauucuuagacguauggacuuacaacgccgaacuauuaguacuaauggaaaaugaaagaacacuagauuuccacgauucaaacguaaaaaauuuauacgauaaaguccgauuacaacuacgagacaaugccaaagaacucggaaacggcuguuucgaauuuuaccauaaaugcgacaacgaaugcauggaaucaguaagaaacggaaccuaugauuauccacaauacucagaagaagcaagauuaaagcgagaagaaauuucagguguaaaacuagaauccauaggaauauaccaaauuuuaagcauauacucaacuguagcaagcagccuugcccucgcgauaaugguagccggacuaagccucuggaugugcucaaacggcucacuacaauguaggauaugu

SEQ ID NO: 51253 - RNA, 1689 nt, Artificial Sequence
  derived and/or modified sequence opt6 from anti-influenza_Chain
auggaaaaaauaguauuacuuuuugcaauaguauccuuaguaaaaucagaucaaaucuguauaggauaucacgcuaacaacucaacagaacaaguagacaccauaauggaaaaaaacguaacaguaacacaugcccaagacauacuagaaaaaaaacacaauggaaaauuaugcgauuuagacggaguaaagccacuaauacucagagacuguucuguggcaggauggcuacucggaaaccccaugugcgacgaauuuauaaauguaccagaauggucauauauaguagaaaaagcaaaccccguaaaugacuuaugcuacccaggugauuucaacgacuaugaagaacuaaaacaucuccuaagcagaauaaaucacuucgaaaaaauccaaauaauaccaaaaucgucauggaguucacaugaagcaucacuaggagucucaucagcauguccguaccaagguaaaacaucuuucuuuagaaaugucguauggcucauaaaaaaaaauuccacuuacccuacaauaaaaagaucauacaauaauacaaaccaagaagaccuucuaguacuauggggaauacaucaucccaaugacgcagccgaacaaacaaaacuauaccaaaacccaacaacauauauaucuguaggaacaucaacucuaaaucaaagacuaguaccaagaauagcaacaagaagcaaagugaacggucaaucaggaagaauggaauucuucuggacaauacuaaaacccaaugaugcaauaaauuucgaaucaaaugguaacuucauugcaccagaauaugcauacaaaauagucaaaaaaggagacucaacaauaaugaaaucugaacuagaauacggaaacugcaacacaaaaugccaaacuccaaugggcgcuauaaauagcagcaugccauuucauaacauacacccuuuaacuauaggagaaugcccuaaguacguaaaaucaaacagacuuguccucgccacaggucucagaaauucuccacaacgcgaaaccagaggacuauucggugcaauagcaggauucaucgaaggaggauggcaaggaaugguagacggaugguauggcuaucaucauagcaaugaacaaggaagcggcuacgcugcugacaaagagaguacacaaaaagccauugacggagucacaaauaaaguaaauucaauaauagacaaaaugaauacacaauuugaagcaguaggaagagaauucaauaaucucgaaagaagaaucgaaaaccuaaacaaaaaaauggaagacggauuucuagacguuuggacauacaacgcagaacuacuaguacuaauggaaaacgaaagaacauuagauuuucaugauucaaauguaaaaaacuuauaugauaaaguaagacuucaacuuagagauaacgcaaaagaacuagguaacggaugcuucgaauuuuaucacaaaugcgacaacgaauguauggaaagcguaagaaaugggacauacgauuauccacaauacucagaagaagcacgauuaaaaagagaagaaauaucaggaguaaaacuagaaucaauaggaauauaucaaauuuuaucaauauacucaacagucgcaucaucuuuagcccuagccauaaugguagcaggauuaucauuauggauguguagcaacggaagccuccaaugcagaaucugc

SEQ ID NO: 51254 - RNA, 1692 nt, Artificial Sequence
  derived and/or modified sequence opt6 from anti-influenza_Chain
auggaaaaaaucguacuacuauucgcuauaguaagccuagucaaaagcgaucaaauaugcauaggauaccacgcaaauaauuccacagaacaaguagacacuauaauggaaaaaaacguaacaguaacacaugcccaagacauccuagaaaaaacacacaacggaaagcuaugcucacucaacggaguaaaaccauuaauauuaagagauugcaguguagcagguuggcuacuaggaaacccaaugugcgaugaauucuuaaacguaccagaauggucauacauaguagaaaaagauucaccaauuaacggacucuguuauccaggagacuucaacgauuacgaagaacuaaaacacuuacucaguagcacaaaucacuucgaaaaaauacaaauaaucccaagaagcucauggagcgaccacgaugcaaguagcggaguaucaagugcaugccccuacaacggucgcaguucguucuuuagaaacguaguaugguugauaaaaaaaaauaacgcauaccccacaauaaaacgaaacuauaacaauacaaaucaagaagaccuacuaguguuauggggcauucaucacccgaacgaugcaacagaacaaacgaaauuauaucaaaauccaacaacauacguaagcguaggcacuagcaccuuaaaucaaagauccguaccagaaaucgcaacacgaccaaaagucaacggccaaucaggcagaauagaauucuucuggaccauacuaaaaccaaaugaugcaauaaacuuugaaagcaauggaaauuuuauagcaccagaauaugcuuauaaaauugcaaaaaaaggagauucagcaaucaugaaaucaggauuagaauacggaaacugcaacacaaaaugccaaacaccaaugggugcaauaaauucuagcaugccguuccacaacauacauccacucacaauaggagaauguccaagauacguaaaaucagauagauuaguacuagcgacaggauuacgaaaugucccacaaagagaaaccagaggauuauucggagcaauagcagguuucaucgaaggaggauggcaaggaaugguagacggaugguacggcuaucaucauaguaaugaacaaggaucaggauaugcagcagauaaagaaaguacacaaaaagcuauagauggaauaaccaauaaaguaaauuccauuauagacaaaaugaauacacaauuugaagcaguaggcaaagaauuuaacaaccuagaaagaaggauagaaaacuugaauaaaaaaauggaagauggauuccuagauguauggacauacaacgcagaacuacuaguauuaauggaaaaugaaaggacacuagacuuucacgacucaaaugucaaaaauuuauacgacaaaguaagauuacaacuaagagacaaugcaaaagaauuaggaaauggaugcuucgaauuuuaucacaaaugugacgaugaauguauggaaagcguaagaaacggaacguaugauuacccacaauacucagaagaagcaaggcuaaacagagaggaaauaucaggaguuaaauuagaauccauaggaacuuaucaaauacuaucaauauauucaacaguagcaaguucccuagcacuagcaaucaugguagcugggcuaagcuuuuggauguguucuaacggaucauuacaaugcagaauaugcaua

SEQ ID NO: 51255 - RNA, 1692 nt, Artificial Sequence
  derived and/or modified sequence opt6 from anti-influenza_Chain
auggaaaaaaucguacuacuauucgcaauagugucacuaguaaaauccgaccaaauaugcauaggauaccacgcaaauaauucaacagaacaaguagacacaauaauggaaaaaaacguuaccguuacacaugcacaagauauauuagaaaaaacacauaacggaaaauuaugcucacuaaacggagucaaaccauuaauauuaagagacugcucaguagcuggaugguuacuaggaaauccgaugugcgacgaauuucuaaaugucccagaauggaguuauaucgucgaaaaagacucaccaauaaacggacuuugcuauccgggagauuucaacgauuacgaagaauuaaaacaccuccuaucaaguacaaaccauuuugaaaaaauucaaauaauaccacguucaagcuggucagaucacgacgcaucaucaggaguaucaucagccuguccuuauaacggaagaaguucauucuuuagaaacguaguguggcuaauaaaaaaaaauaacgcuuacccaacaauuaaaagaaauuacaacaauacaaaccaagaagaucuauuaguucuaugggguauacaccacccaaacgacgcaacagaacaaacaaaauuauaccaaaacccaacaacauacguuucgguaggaaccagcacgcuaaaccaaagaucaguaccugaaauagcaacaagaccaaaaguaaauggccaaucaggaagaauagaauuuuuuuggacuauccucaaaccaaacgaugcaauuaacuucgaaucaaacggcaacuucauagccccagaauacgcauacaaaauagcuaaaaagggagacucagcaauaaugaaaaguggauuagaauauggaaacuguaacacaaaaugucaaacaccaaugggugcaauaaauaguucaaugcccuuccauaacauacauccauuaaccauaggagaaugcccaagauacguaaaaucagacagacuaguccuagcaacaggacuucgaaacguaccacaaagagaaacgagaggucuauuuggagcaauagcaggauuuauagaaggaggauggcaaggaaugguagacggcugguacggauaccaucacagcaaugaacaaggaucaggcuaugcugcagauaaagaaucaacacaaaaagcaauagacgguauaaccaauaaaguaaauagcauaaucgacaaaaugaacacacaauucgaagcaguaggcaaagaauucaacaauuuagaaagaagaauagaaaaccuaaacaaaaaaauggaagacggauuccuagaugucuggacguauaacgcugaguuacuaguacuaauggaaaaugaacgaacacuagacuuucaugauagcaacguaaaaaacuuauacgacaaagucagauuacaauuaagagacaacgcaaaagaacucggaaauggaugcuucgaauuuuaccacaaaugugacgaugaaugcauggaaucaguaagaaauggaacauacgacuacccacaauacagcgaagaagcccgauuaaauagagaagaaauauccggugucaaacuagaaagcauaggaacauaccaaauacuaucaauauacucaacagucgccucaagccuagcacuugcaauaaugguagcaggacuaucuuucuggaugugcucgaaugguucauuacaauguagaauaugcaua

SEQ ID NO: 51256 - RNA, 1695 nt, Artificial Sequence
  derived and/or modified sequence opt6 from anti-influenza_Chain
auggaaaaaauaguuuuauuguuugcaauugucagccuuguuaaaucagaccaaauaugcauaggauaccacgcaaacaauucaaccgaacaaguagacaccauaauggaaaaaaacguaacaguaacacaugcucaagacaucuuagaaaaaaaacauaacggaaaauuaugcgaccuagauggaguuaaaccuuuaauauuaagagacugcucaguagcaggaugguuacuuggaaacccaaugugcgacgaauuuauaaacgucccagaauggagcuacauuguagaaaaagcgaacccuguaaacgaccuaugcuauccuggagacuucaacgacuaugaagaauuaaaacaccuacuaucccgaauaaaccauuucgaaaaaauacaaaucauuccaaaaucaaguuggucaucacacgaagcaagcuuaggaguaucaucagccugcccuuaccaaggaaaaucaucauucuucagaaacguaguauggcuaauaaaaaaaaacucaacauacccaacaauuaaaagaucauauaacaauacuaaccaagaagaucuacuaguacuauggggaauacaccacccaaaugaugccgcagaacaaacaaaacuauaccaaaauccaacaaccuauauaucaguuggaacaagcacacuaaaucaaagacuaguaccacgaauagcaacacgaucaaaaguaaauggucaaucaggaagaauggaauucuucuggaccauauuaaaaccaaacgacgcaauuaacuucgaaucaaacggcaacuucauagcaccugaauacgccuacaaaauagucaaaaaaggagacagcacuauuaugaaauccgaacuagaauacggaaacuguaauacaaaaugccaaaccccaaugggagccauaaacucaucaaugcccuuccacaacauacauccauuaacuauaggagaauguccaaaauacguaaaaagcaauagacuaguauuagcaacaggacuaagaaacucaccacaaagagaaagaagaagaaaaaaacgaggccuuuuuggagcaaucgcaggauucaucgaagggggauggcaaggaaugguagauggaugguacggauaccaccacucaaacgaacagggaucaggauacgcagcagacaaagaauccacacaaaaggcaauagaugguguaacaaacaaaguaaacucaauuauagacaaaaugaauacccaauucgaagcaguagguagagaauucaacaacuuagaaagacgaauagaaaaccucaauaaaaaaauggaagacggauuccuagacguauggaccuacaacgcagaacuacuaguacuaauggaaaacgaaagaacacuugacuuucacgacucaaacguaaaaaacuuauacgacaaaguaagacuacaauuaagagauaacgcaaaagaauuaggaaacggaugcuucgaauucuaccacaaaugcgacaacgaaugcauggaaucaguaagaaauggaacauaugacuauccacaauauucagaagaagcaagacuaaaaagggaagaaauaucaggagucaaacucgaaucuauaggaauauaucaaauccuuuccauauacucaacagucgcaucaucucucgcacuugcaauaaugguagcaggacuaagcuuauggaugugcucaaauggaagccuacaaugccga

SEQ ID NO: 51257 - RNA, 1695 nt, Artificial Sequence
  derived and/or modified sequence opt6 from anti-influenza_Chain
auggagaaaauaguacuacuauuugcaauagucucauuaguaaaaucagaccaaauaugcaucggcuaccacgcaaacaacucuaccgaacaaguugacacaauaauggaaaaaaacguaacuguaacacaugcucaagacauacuagagaaaacacacaacggaaagcuaugcgaucuagacggaguaaaaccauuaauauuaagagacugcagcguagcaggauggcucuuaggcaacccaaugugugacgaauucaucaacguaccagaauggucauacauaguagaaaaagcaaacccaguaaaugaccuaugcuauccuggugauuucaacgauuaugaagaacucaaacaucuauuauccagaauaaaccacuuugaaaaaauacaaauaauaccaaaaucauccuggucaagccacgaagccucauuaggaguaagcucagcaugcccauaccaagguaagagcucauucuucagaaauguaguaugguuaauaaaaaaaaacagcacauacccaacaauaaaaagaucauacaauaacacuaaccaagaagaccuauuaguauuauggggaauacaccaccccaacgaugcagcagaacagacuaaacuauaucaaaacccaacaacauacauaagcgugggaacuucaacauuaaaccaaagauuaguaccuagaauagccacaagaucaaaagucaauggacagaguggacggauggaauucuucuggaccauacuaaaaccaaaugacgcaauaaauuucgaaucuaacgguaauuucauugcaccggaauacgcauauaaaauaguuaaaaaaggagacucaacuauaaugaaaucagaauuagaauacggaaacugcaacacaaaaugucaaacuccaaugggagcaauaaacucaucaaugccauuucacaauauacauccauuaacuauuggagaauguccaaaguauguaaaaucaaaucgauuaguacuagcaacaggccuaagaaacuccccacaaagagaaagaagacgaaaaaaaagaggauuauucggugcaauagcaggauucauagaaggaggauggcaagguaugguagacgggugguacggauaucaccacucaaacgaacaaggaucaggauaugcagcagacaaagaaaguacccaaaaagcaauagacggcguaacaaacaaaguuaauucaauuauagacaaaaugaacacacaauucgaggcaguaggaagagaauuuaacaacuuagaacgaagaauagaaaaucuaaacaaaaaaauggaagauggauuccuagauguauggacauacaacgcagaacugcuaguacuaauggaaaacgaacgaacauuagacuuucaugacucaaacgucaaaaaccuauaugacaaaguaagacuacaacuaagagauaaugcaaaagaacucggaaacggaugcuucgaauuuuaucacaaaugcgacaaugaaugcauggaaaguguaagaaacggcacauaugacuacccacaauacagcgaggaagccagacugaaaagagaagaaauaucuggaguuaaacucgaaucaaucggaauauaccaaauucucagcauauauaguacaguagcuucaucacuagcacuagcaauaaugguagcaggauuauccuuauggauguguucgaacggaucccuacaauguaga

SEQ ID NO: 51258 - RNA, 1695 nt, Artificial Sequence
  derived and/or modified sequence opt6 from anti-influenza_Chain
auggaaaaaauaguacuacuauuggcaauagucagccuagucaaaucggaccaaaucugcaucggauaccacgcaaacaauagcaccgaacaaguagauacuauaauggaaaaaaacguaaccguaacacaugcacaagauauacuagaaaaaacacacaacggaaaguuaugcgaccuagacggagucaaaccauuaauuuuaagagacuguucuguagcaggaugguuacuaggcaacccaaugugcgaugaauucauaaauguaccagaauggucauauauaguagaaaaagccaacccagcuaacgauuuaugcuauccaggcaauuucaacgauuaugaagaacuaaaacacuuauuaucacgaauaaaccacuucgaaaaaauacaaauaauuccaaaaucgaguuggucagaccacgaagcaagcaguggcguaucaucagcaugcccauaucaaggaaaaucaucauucuuccgaaaugucguaugguuaauuaaaaaaaacaguucauauccaacaauaaaaagaucauauaacaauacaaaccaagaagaccuccuuguacuauggggcauucaccaccccaacgacgcggcugaacaaacaagacucuaccaaaacccaacaacauauauuaguguaggaacaagcacccuaaaccaaagauuaguucccaaaaucgccacacgaagcaaagucaauggacaaagcggaagaauggaauuuuuuuggacaauauuaaaaccaaacgaugcaauaaacuucgaaucaaaugguaauuucauagccccagaauacgcauauaaaauagucaaaaaaggagauucagcaauaaugaaaagcgaacuagaauauggaaauugcaacacaaaaugccaaacaccaaugggagcaauaaacaguagcaugccauuucacaacauacauccacuaacaauaggagaaugcccaaaauacguuaaaucaaauagauuaguccuagcaacaggauuaagaaacucaccacaaagagaacggagacguaaaaaaagagguuuauucggagcaauagccggauuuauagaaggaggcuggcaagguaugguagacgguugguauggcuaucaccacucaaacgaacaaggaucaggauaugcagcagacaaggaaaguacucaaaaagcaauagauggaguaaccaacaaaguuaauucaauaauugacaaaaugaauacucaauucgaagcaguaggcagagaauucaauaaccuagaaagacgcauagaaaacuuaaacaagaaaauggaagauggauucuuagacguauggacauacaacgcagaacuccuaguauuaauggaaaaugaaaggaccuuagacuuucacgauagcaacguuaaaaacuuauacgauaaaguacgacuacaacugagagacaaugccaaagaauuaggaaauggaugcuuugaauuuuaccacaaaugugacaaugaaugcauggaaucagucagaaacggaacguacgauuacccacaauauucagaagaagcaagauuaaaaagagaagaaauuucaggaguuaaacucgaaucaauaggaauuuaucaaaucuuaucaauauacucaacaguugcaucaucauuagcucuagcuauaaugguagccggacuaucacuauggauguguagcaacggaaguuuacaaugucga

SEQ ID NO: 51259 - RNA, 1695 nt, Artificial Sequence
  derived and/or modified sequence opt6 from anti-influenza_Chain
augagcgauagaaggcaaaauagaaaaaccccagaugaacaaagaaaagccaacgcauuaauaauaaaugaaaauauugaagcauacauagcaauauguaaagaaguaggauuaaauggagaugaaaugcuaauauuagaaaacggaauagcgauagaaaaagcaauaaggauauguugugauggaaaauaccaagaaaaacgagaaaaaaaagcuagggaagcacaaagagcagacaguaauuucaacgcagacucaauaggaauaagacuaguuaaaagagcgggaagugguacaaacauaacauaccacgcagugguagaacuuacaucaagaucacgaauaguacagauauuaaaaucacacugggguaaugaauugaacagagcgaaaauagcaggaaaaagacuaggauuuagcgcuuuauucgcaucaaauuuagaagcuauaauauaucaaagaggacgaaacgcagcccguagaaauggaucagcagaauuauuuacacuaacacaaggagcaggaauagaaacaagauauaaauggaucauggagaaacacauaggcauaggagucuuaauagccgaugcaaaaggucuaauaaacggcaaaagagaagguaaacgaggaguagacgcaaauguaaaauuacgagcgggaacaacaggaaguccauuagaacgagcaaugcaagguauagaaaaaaaggcauucccuggaccgcuaagagcauuagcgagaagaguuguaaaagcaaauuacaacgaugcacgggaagcacuaaauguuaucgcagaagcaagucuauuacuaaaaccacaaauaacuaauaaaaugacgaugcccuggugcaugugguuagcagcuagacuaacauuaaaagaugaauuugcaaacuucugcgcauaugcaggacgacgugccuuugaaguauuuaacauagcaauggaaaaaauaggaauaugcucauuucaaggcacaauaaugaacgaugaugaaauagaaucaauagaagauaaagcacaaguuuuaaugauggcgugcuuuggauuagcauacgaagauuucaguuuaguaagcgcaauggugagucauccauuaaaauuaagaaaccgaaugaaaauaggaaacuucagaguaggagaaaaaguaucaacaguauuaagcccguuacuaagauucacacgaugggccgaauucgcucaaagauuugcccuacaagcaaauacaucaagagaaggagcacaaauaaguaauucagcaguauuugcaguugaaaggaaaauaacaacugaugugcaaagaguagaagaacuacuaaacaaaguacaagcacaugaagaugaaccguuacaaacucuauauaaaaaaguaagagaacagauauccauaauagguagaaacaaaucagagauuaaagaauuccucgguaguucgauguaugauuuaaacgaucaagaaaaacaaaauccaauaaauuucaggaguggagcccauccauuuuucuuugaauuugacccugauuauaaucccauaagaguaaaaagaccaaaaaaaccaauagcaaaaagaaacucaaauauaucaagacuagaagaagaaggaauggacgaaaauagugaaauaggacaagccaaaaaaaugaaacccuuagaccaacuaacgucaacaaguucaaauauaccagggaaaaau

SEQ ID NO: 51260 - RNA, 1695 nt, Artificial Sequence
  derived and/or modified sequence opt6 from anti-influenza_Chain
augaaaguuaaacuauuaguacuauuaugcacauucacugcaacauacgcagacacaaucuguaucggauaucaugcaaauaacucaaccgacacaguagacacaguacuagaaaaaaacguaacagucacacacucaguaaaccuacuagaaaacagucacaaugguaaauuaugccuacucaagggaauagcuccacuacaacuaggaaauuguagugucgcaggauggaucuuagguaacccagaaugugaacuacuaauaucaaaagaaucaugguccuacauaguagaaaaaccuaacccagaaaaugguacaugcuaccccggacauuucgcagauuaugaagaauuaagagaacaacuuucuuccguaaguucauuugaaagauucgaaauauuuccaaaagaaucaucauggccaaaccacacuguaacaggagugagcgcauccugcagccauaauggcgaaaguucuuucuacagaaauuuacuuuggcuuacuggaaaaaauggacuauacccaaacuuaucaaaaaguuacgcaaauaacaaagaaaaagaaguacuaguauuauggggaguccaccauccaccaaauauuggcgaccaaaaagcauuauaucauacagaaaaugcauacguaaguguaguaagcucacauuacucaagaaaauucacaccagaaauagcaaaacgaccaaaaguaagagaccaagaaggcagaauuaacuaccacuggacacuuuuagaaccaggagauacuauaauauucgaagcaaacggaaaccuaauugcaccaagauacgcauucacauuaucgagaggauucgguagcggaauaauaaacucaaacgcaccaauggacaaaugugacgcaaaaugucagacaccccaaggcgcaauuaacucaagucuaccuuuccaaaacguacaccccguaacuaucggcgaaugucccaaauacguaagaucagcaaaacuacguaugguaacaggcuuaagaaauauaccuucaauacaaucacgcggacuauucggcgcaauugcuggauucaucgaagggggauggacaggaaugguugauggaugguacggauaccaucaccaaaaugaacaagguucaggauaugcagcagaucaaaaaucaacacaaaacgcaauaaacgguauaacaaacaaaguaaauucaguaaucgaaaaaaugaauacgcaauucaccgcaguaggaaaagaauuuaacaaacucgaaagaagaauggaaaacuuaaauaaaaaaguagacgacggguucauagauauauggaccuacaacgcagaauuacuaguauuacuagaaaacgaaagaaccuuagacuuccaugacucaaacguaaaaaaccuauaugaaaaaguaaaaagccaacuaaaaaauaacgcaaaagaaauaggaaacggaugcuuugaauuuuaccacaaauguaacgacgaaugcauggaaucagucaagaacggaaccuaugauuaccccaaauacucagaagaaaguaaauuaaaccgcgaaaaaauagauggaguaaaauuagaaucaaugggaguauaccaaauacuagcaauauacucaacaguagcaucaagucugguucuacuaguaucacuaggugcaauaucauucuggaugugcucaaacgguucauuacaaugcagaaucuguaua

SEQ ID NO: 51261 - RNA, 1695 nt, Artificial Sequence
  derived and/or modified sequence opt6 from anti-influenza_Chain
augaaaguaaaacuauuaguauuacucuguacauucacagcaacauaugcagacacaauaugcauaggauaucaugccaauaacucaacagauacaguagacacaguacuagaaaaaaauguaacaguaacgcacucaguaaaucuucuagaaaauagucauaacggaaaauuaugucuccuaaaaggcauagcaccacuucaauuaggaaacugcuccguagcaggauggauucuuggaaauccagaaugcgaacuacuaauaucaaaagaaaguuggucauauauagucgaaaaacccaacccagagaacgguacuuguuaccccggacacuucgccgauuaugaagaauugagagaacaauugucaaguguaucuucauucgaaagauucgaaauauuccccaaagaaaguuccuggccaaaccauacagugacaggaguaucagcaucaugcagccauaacggugaaucauccuucuacaggaaccuauuauggcuuacaggaaaaaacggacuauacccaaacuuaagcaaaaguuacgcaaacaauaaagaaaaagaaguuuuaguauuauggggaguccaccacccaccaaauauaggagaucaaaaaacacuauaccacacagaaaacgcuuacgucucaguugucaguagucauuacagcagaaaauucacacccgaaauagcaaaaagaccaaaaguacgcgaucaagaaggaagaauaaacuacuauuggacauuauuagaaccaggcgacacaauuauauuugaagcaaaugguaacuuaauagcacccagauaugccuucgcacuaaguagaggauucggaucaggaauuauaaacucaaacgcaccaauggacaaaugcgacgcaaaaugccaaacaccacaaggagcaauaaacucaucuuuaccauuucaaaacguacauccaguaacaaucggagaauguccgaaauauguaagauccgcaaaacuaagaaugguuaccggacuaagaaacauacccucaauacaaaguagaggacuuuucggagcaaucgcaggcuucauagaaggcggauggacaggaaugguagacggaugguaugguuaucaccaucaaaacgaacaaggaucaggauacgcagcagaccaaaaaucaacacaaaaugcaaucaauggaauuacaaauaaaguaaacagcguaaucgaaaaaaugaacacacaauuuacagcuguaggaaaagaauucaacaaacucgaaagaagaauggaaaacuuaaacaaaaaaguagacgauggauuuauagacauauggacauacaaugcagaauuacuaguacucuuagagaaugaaagaaccuuagauuuucacgauucaaauguaaaaaaccuauacgaaaaaguaaaaagccaacucaaaaauaacgcaaaagaaauaggaaauggaugcuucgaauuuuaucacaaauguaacgaugaauguauggaaucgguaaagaacggaacuuacgacuauccuaaauacagugaagaaaguaaacuaaacagagaaaaaauagaugguguaaagcuagaaagcauggguguauaucaaauacuagccauauacaguacaguagcuagcucacuaguacuauuaguuagccuaggcgcaauaagcuucuggaugugcucaaacggaucacuacaauguagaauaugcaua

SEQ ID NO: 51262 - RNA, 1695 nt, Artificial Sequence
  derived and/or modified sequence opt6 from anti-influenza_Chain
augaagguaaaacucuuaguccugcucugcacauuuacagcuaccuacgcagacacuauaugcauaggauaucacgcaaacaacucaacagacacaguagauaccguacuagaaaaaaacgucacaguaacacauucagugaaccuacuagaaaacucacacaauggaaaacuaugccuauuaaaagguauagccccucuacaauuaggaaauugcucaguagccggauggauacuaggaaauccagaaugcgaauuauuaauaucaaaagaaucauggucauacauagucgaaaaaccaaacccagaaaacggcacaugcuacccaggacacuucgcagauuacgaagaacuaagagagcaacuaagcucaguuucaaguuuugaacgauuugaaauauucccaaaagaaucuucauggccaaaccacacaguaaccggaguauccgcaucaugcucacacaauggagaaucaaguuuuuacagaaauuuauuauggcucacaggaaaaaauggauuauauccaaacuuaucaaaaaguuacgcaaauaauaaagaaaaagaaguacuuguacuauggggaguccaccacccaccagacauaggagaucaaaaaacacuuuaucacacagaaaacgcauacgucucaguaguuucaucacacuauagccgaaaauucaccccagaaauagccaaaagacccaaaguaagagaucaagaaggaagaauuaacuauuacuggacccuauuagaacccggcgauacaauaauauuugaagcaaauggcaacuuaauagcacccagauacgcauucgcauuaucacgaggauuuggaagugguauaauuaauucaaaugcaccaauggacaaaugugaugcaaaaugucagacaccacaaggagcaauaaacagcagccuccccuuucaaaauguacacccuguaacuauaggagaauguccgaaauacguuagaucagcaaaauuacgaauggucacaggacucagaaacauaccaaguauacaaucuagaggacucuucggugcgauagcaggauucauugaagguggcuggacaggaaugguagacggaugguauggauaucaucaccaaaaugaacaaggaucaggauaugcagccgaccaaaaaaguacucaaaaugcaauaaauggaaucacaaacaaagucaauaguguaauagaaaaaaugaauacacaauucacagcaguuggaaaagaauuuaauaaacuagaaagaagaauggaaaaccuuaacaaaaaaguagacgacggcuucauagacauauggacuuauaaugccgaacuacuaguccuauuagaaaaugaaagaacacuagauuuccacgauucaaacgucaaaaaccuauacgaaaaagucaaaucacaacuaaaaaauaaugcaaaagaaauaggcaacggauguuucgaauucuaucauaaauguaacgaugaaugcauggaaucaguaaaaaacggcacauacgacuacccaaaauacagugaagaaucaaaacuaaaccgagaaaaaauagacggaguaaaacuagaaucaaugggcguauaccaaauucuagcuauauacucaacaguagcaagcagcuuaguacuauuaguaucacuaggagcaauaagcuucuggaugugcagcaacggcucacuucaaugcagaaucugcauc

SEQ ID NO: 51263 - RNA, 1695 nt, Artificial Sequence
  derived and/or modified sequence opt6 from anti-influenza_Chain
augaaaguaaaacuauuaguacuccuauguacauucacagcaacauacgcugacaccauauguauaggauaucacgcaaacaauagcacagauaccguagacacaguccuagaaaagaauguaacagucacacauaguguaaauuuacuugaaaacucccacaacggaaaacuaugucuauuaaaaggcaucgcaccccuacaauuaggcaacugcucaguagccgguuggauauuaggcaacccagaaugcgaacuauuaaucucuaaagaaucauggagcuacauaguagaaaaaccuaacccagaaaacggcacaugcuacccaggccacuucgcagacuacgaagaacuaagggaacaauuaucaucaguaucaucuuuugaaagauuugaaauauucccaaaagaaucuucauggccaaaccauacaguaacaggaguaucagcaagcugcucacauaauggagaaaguucuuucuacagaaauuuacuaugguuaacaggcaaaaauggacuauacccuaaucuaucaaaaucauacgcuaacaauaaagaaaaagaaguccuagucuuauggggaguacaccaucccccaaacauaggagaccaaaaagcauuauaccauacagaaaaugcauauguaucaguaguaaguucacacuauagccguaaauuuacaccagaaauagcaaaacguccuaaaguaagggaucaagaaggaagaauaaauuauuacuggacacuacuagaaccaggggauacaauaauauuugaagcaaauggcaaccugauagccccaagauacgcauuugcacuuucacgaggauuuggauccggaauaauaaacagcaaugcaccaauggacaaaugugacgcaaaaugccaaaccccacaaggagcaauaaauuccucacuaccauuccaaaacguucauccaguaacaauaggagaaugcccaaaauacguacgaagcgcaaaauuaagaauggucaccggacucagaaauauuccauccauacaaucacguggacuauucggagcuauugcaggauucauagaaggagguuggacaggaaugguagacgguugguacggcuaccaucaccaaaaugaacaaggcucaggauacgcagcagaccaaaagagcacacaaaacgccaucaacggaauaacaaacaaaguaaauaguguaauagagaaaaugaauacgcaauucacagcagucggaaaagaauuuaacaaacuagaaagaagaauggaaaacuuaaacaagaaaguagacgauggcuucauagauauauggacauacaacgcagaauuauuaguacuacuagaaaaugaaagaacauuagacuuccaugauucaaauguuaaaaaccucuacgaaaaaguaaaaagucaacuuaaaaauaacgcaaaagaaauaggaaacggaugcuucgaauuuuaccacaaaugcaacgacgaaugcauggaaucagucaaaaauggcacauaugauuauccaaaauacagugaagaaucaaaacuaaauagagagaaaauagacggaguaaaacuagaaaguaugggcguauaccaaauacuugcaaucuauagcacaguagcaucaucauuaguacuauuaguaagucuaggggcaaucagcuucuggaugugcaguaacgguuccuuacaaugcagaauaugcaua

SEQ ID NO: 51264 - RNA, 1695 nt, Artificial Sequence
  derived and/or modified sequence opt6 from anti-influenza_Chain
augaaagcaaaacuccuaguucuacuaugcaccuuuacagcgacauacgcagacaccauauguauagguuaccaugcaaacaacucaacagauacaguagacacaguacuugaaaaaaauguaacuguaacacacucaguaaaccuacuagaagacagccauaauggaaaauuaugucuauuaaaaggaauagcaccacuacaacuaggaaauuguucaguagcagguuggauccucggaaacccagaaugcgaauuauuaauauccaaagaaucauggucuuacauagucgaaaccccaaauccugaaaauggaaccuguuacccaggauacuuugcagacuacgaagaacuacgagaacaacuuucaucuguuuccaguuuugaacgauucgaaaucuucccaaaagaaucaagcuggccaaaccacacaguaacaggaguaucagcaucaugcucacacaaugguaaauccucauucuacagaaacuuauuaugguuaacugguaagaacggauuauauccaaauuuaucaaaauccuacguaaacaacaaagaaaaagaaguauuaguauuauggggaguccaucacccaccaaacauuggaaaucaacgcgcacuuuaccauacagaaaacgcauaugugucaguaguaagcagccacuacucacgaagauucacuccagaaauagcaaaaagaccaaaaguaagagaccaagaaggaagaaucaacuacuacuggaccuuacuagaaccaggcgacacaauaauauucgaagcaaaugguaaccuaauagcaccaugguaugcauucgcucuaucucgaggcuuuggaagcggaauaauaaccucaaaugcacccauggacgaaugcgaugccaaaugucaaacaccacaaggagcaauaaacagcucacugccuuuucaaaacguccacccagucacaauaggagaaugcccuaaauacgucagaucagcaaaacuuagaaugguaacaggacuacgaaauauaccaucaauacaaucucgaggacuuuucggcgccauagcaggcuucauagaaggaggcuggacaggaaugguagacggaugguacggauaccaccaucaaaacgaacaaggauccgguuaugccgcagaccaaaaaaguacacaaaacgcaauaaacggaauaacuaauaaaguaaauagcgucauagaaaaaaugaacacacaauuuacagcaguuggaaaagaauuuaacaaauuagaaaggagaauggaaaaucuaaauaaaaaaguagaugacggauuuuuagacauauggacauauaacgcagaauuacuaguccuucuagaaaacgaacgaacgcuagacuuccaugacaguaacguaaaaaaccuauacgaaaaaguuaaaucacaauuaaaaaacaacgcaaaagaaauaggcaauggaugcuucgaauuuuaccacaaauguaacaacgaaugcauggaaaguguaaaaaacggaaccuacgacuauccaaaauacucagaagaaagcaaacuaaauagagaaaaaauagauggaguuaaacuagaaucuaugggaguauaccaaauauuagcaauauacagcacgguagcaagcaguuuaguacuucuaguuucacuaggagccauaagcuucuggaugugcucaaauggaucauuacaauguagaauaugcaua

SEQ ID NO: 51265 - RNA, 1695 nt, Artificial Sequence
  derived and/or modified sequence opt6 from anti-influenza_Chain
augaaaguaaaacuauugguacuauuauguacuuucacagcaacauaugcagacacaauaugcauuggauaccacgcaaauaauaguacagacaccgucgacacaguccuagaaaaaaacguaacaguaacacauagcgucaaccuauuagaagacucacauaacggaaaauuaugcuuauuaaaaggaauagcaccauuacaguuaggaaauugcagcguagccgguuggaucuuaggaaacccagaaugugaacuacucaucaguagagaaaguuggagcuacauuguugaaaaaccaaacccagagaauggaacauguuauccaggucacuucgcagauuacgaagaacuaagagaacaacuaucaucaguaucaucauuugaaagauuugaaauauuucccaaagaaucaagcuggccaaaccauacaacaacaggcguaagcgcaucaugcucccauaacggagaaucaaguuuuuauaaaaacuuauuauggcuaacaggaaaaaacggacuauacccaaaccuauccaaaucauacgcaaauaacaaagaaaaagaaguauuaguauuauggggaguucaucacccaccaaauauaggagaccaaagagcacuguaccacaaagaaaaugccuacguaaguguugucucaucacauuauuccaggaaauucacgccagaaauagccaaaagaccaaaaguccgagaccaagaaggcagaauaaauuacuauuggacacucuuagaaccaggagauaccauaauauucgaagcaaacggaaaccuaauagcaccaagauacgcauucgcacuuaguagaggauucggcagcggaauaauuaacucgaaugcaccaauggaugaaugugacgcaaaaugccaaacaccacaaggggcaauaaauucaagccuaccuuuucaaaauguacaccccgucacaauaggagaauguccuaaauaugucagguccgcaaaacuucgaaugguuacaggauuaagaaacauuccaagcauccaaaguagagguuuauuuggagccauugcaggauuuauagaaggaggauggacuggaaugguggauggaugguauggauaccaccaccaaaaugaacaaggcucaggauacgcagccgaccaaaaaucaacacaaaaugcaauaaacgguauaacaaacaaaguaaauucagucauagaaaaaaugaauacacaauuuacagcaguaggcaaagaauucaauaaauuagaacgacgaauggaaaaccuaaauaaaaaaguagacgacggauucauagacauuuggacauacaaugcagaacuacuaguucuacuagagaacgaaagaacacuagauuuccacgauucaaauguaaaaaaucuauaugagaaaguaaaaagucaacuaaaaaacaacgcaaaagaaauaggaaacggaugcuucgaauucuaucauaaaugcaacgacgaauguauggaaucagucaaaaacgguacauaugauuacccaaaauacucugaagaaaguaaacucaacagagaaaaaauagacggaguaaaacuagaaaguaugggaguauaccaaauauuagccauauacaguacaguagcaucgucccuaguacuacucguaagcuuaggugcaauaaguuuuuggaugugcaguaacggaaguuuacaauguagaauauguauc

SEQ ID NO: 51266 - RNA, 1677 nt, Artificial Sequence
  derived and/or modified sequence opt6 from anti-influenza_Chain
gauaaaauaugcauaggcuaccaaucuacaaauucaacugaaacaguagauacccuaacaaaaaccaauguaccaguaacacaagcuaaagaacuauuacauacagaacauaacggaaugcuaugcgcaacaaaucuaggacacccacuaauacucgauacguguacaauugaaggauuaauauacgguaauccuucaugcgauuuauuauuagguggaagagaauggaguuauauaguagaaagaccaucagcaguaaauggaaugugcuacccaggaaacguugaaaacuuagaagaauuaagacuacuauuuucuucagcaucaagcuaucaaaggguccaaauauuuccagauacaauauggaauguuaccuauucaggaacaucuagcgcaugcaguaacucauuuuaucgaucaaugagauggcuaacacaaaaagauaacacauacccaguacaagacgcacaauauacuaacaacagagggaaaucaauacuauuuaugugggguauaaaccacccacccacagacacuguccaaacaaaucucuauacuagaacagacacaacaaccucaguaacaacugaagacauaaaccgagcauucaaaccaguaauaggaccaagaccauuagucaacggacuacaaggaagaauagacuacuauuggaguguauuaaaaccaggacaaaccuuaagaguaagaucaaaugggaaccucauagcaccaugguacggccauauauuaagcggagaaagucauggaagaauacuaaaaucagaccuaaacaguggaaauugcguuguacaaugucaaacugaacgaggaggacuaaauacaacacuaccauuccacaaugucaguaaauacgcauuuggaaauuguccuaaauacgucgguguaaaaagucuaaaauuagcaguuggaaugagaaauguaccagcacgaagcucaagaggcuuauuuggugcaauagcgggauuuauagaaggaggauggccaggauuagucgcaggaugguauggauuccaacauagcaaugaccaagguguaggaauggccgcugaccgagacucaacacaaaaagcaauugacaaaaucacaucaaaaguaaacaauauaguagauaaaaugaacaaacaauacgaaauaauagaccacgaguucagugaaauagaaacaagauuaaauaugauaaacaacaaaauagacgaccaaauacaagacauaugggcuuacaaugcagaauuauuaguucuucuagaaaaccaaaagacacucgaugaacaugacgcuaauguaaauaaccuauauaacaaagucaaaagagccuuaggaucaaacgcaauggaagauggaaaaggaugcuuugaacuauaucacaaaugcgacgauagauguauggaaacuaucagaaauggaaccuacaaucgaggaaaauacaaagaagaaaguagauuagaaagacagaaaauugaagguguaaaacuagaaucagaaggaacauacaaaucaggaagacuugugccuagaggaucaccaggaucaggauauauaccagaagcucccagagacggacaagcauauguaaggaaagacggagaauggguacuauuaaguaccuuccuaggaaaaccaauaccaaacccauuacuuggauuagauaguacaggc

SEQ ID NO: 51267 - RNA, 1677 nt, Artificial Sequence
  derived and/or modified sequence opt6 from anti-influenza_Chain
gacaaaauauguauuggguaccaauccacuaauuccacagagacaguagauacauuaaccaaaacaaacguaccuguaacacaagcaaaagaauuacuacacacagaacauaauggaaugcuuugcgcaacaaauuuaggccacccacuaauacuugauacauguacaauagaaggacuaauauacggaaacccaaguugugaucuauuacucggaggaagagaauggucauauauaguagaaagacccagugcaguaaauggcaugugcuacccaggaaacgucgaaaaccuagaggaacuccgacuauuauuuucuucggcgucaagcuaucaaagaguucaaauauuuccugacacaauauggaauguaacuuauucaggcacaucaucagcauguucaaacucauuuuacagaucaaugcgauggcugacacaaaaagacaauacuuauccaguacaagacgcacaguauaccaauaacagaggaaaaucuauucuauuuauguggggaaucaaccacccaccaacagacaccguucaaacaaaccuauacacaaggacagacacuacaacaucuguaacaacagaagacauuaaccgagcuuucaaaccaguuauaggcccaagacccuuaguuaacggauuacaagguagaaucgacuacuacuggucaguacuaaaacccggacaaacauuaagaguacgaagcaauggaaaucuaauagcaccaugguauggacacauacuaucuggagaaucccacggaagaauauuaaaaagcgaccucaacucaggaaacuguguuguacaaugucaaacagaaagaggaggacuaaacacaacacuaccauuccauaacguaucuaaauaugccuuuggaaacugcccuaaauauguagguguaaaaucauuaaaauuagcaguaggaaugagaaacguuccugccagauccaguagaggauuauucggagcaauagcaggcuucauugagggaggauggccaggacuaguagcaggaugguacggauuccaacacaguaacgaucaaggaguaggaauggcagcagaccgcgauuccacacaaaaagcaauagauaaaauaacaucaaaaguaaauaauauaguagacaaaaugaacaaacaauacgaaauuauugaccacgaauucucugaaauagaaacaagauuaaauaugauaaauaauaaaauagaugaccaaauccaagauauaugggccuacaacgcagaacuauuaguauuauuagagaaccaaaaaacuuuagaugaacaugaugcaaauguaaacaacuuauacaacaaaguaaaacgagccuuaggaucuaacgcaauggaagacgguaaaggaugcuucgaauuauaccacaaaugugaugacagaugcauggaaacaauuagaaauggaacauacaacagggguaaauacaaagaagaaucaagacuagaaagacaaaaaauagaaggcguaaaacuagaaagugaaggaacauacaaaaguggaagauuaguuccacgaggaagcccagguagugguuacauaccagaagcaccaagagacggacaagcuuacguacguaaagauggagaauggguauuauuaucaacauuucuaggaaaaccaauaccaaacccauuacuaggauuagacaguacugga

SEQ ID NO: 51268 - RNA, 1695 nt, Artificial Sequence
  derived and/or modified sequence opt6 from anti-influenza_Chain
augagugacaggagacaaaacagaaaaacaccagacgaacaaagaaaagcaaacgcacuaauaauaaaugaaaauauugaagcauauauagcaauauguaaagaaguaggucuaaauggugaugagaugcuuauacuagaaaacggcauagcgauagaaaaagcuauaagaaucuguugugauggaaaauaccaagaaaaacgagaaaaaaaagcucgcgaagcacaaagagcagauagcaauuucaaugcagacagcauaggaauaagauuaguaaaaagagcaggaucaggaacuaacauaacuuaccacgcugucguugaauugacaaguagaucaagaauaguccaaauacuuaaaucacauuggggcaacgaacuuaacagagcaaaaauagcagggaaacgauuaggauuuagugcacucuucgcaucgaacuuagaagcaauaauuuaccaaagaggaagaaaugcagcgagaagaaacgggagcgcggaacuguucacauuaacacaaggagcagggaucgaaacaagauauaaauggauaauggaaaaacauauaggaauaggaguacuaauagcagacgcaaaaggacuaauaaauggaaaacgagaaggaaaaagaggaguagaugcaaacguaaaacuuagggcaggaacaacuggaucaccccuugagagagcgaugcaaggaauagaaaaaaaagcauucccggguccgcuaagagcauuagccagaagaguaguuaaagcuaauuauaaugacgccagagaagcauugaauguuauagcagaagcuagcuugcuuuuaaaaccacaaauuacaaauaaaaugacaaugccauggugcaugugguuagcugcaagacuaacauuaaaagacgaauuugcaaauuucugugcauacgcaggaagaagagcauuugaaguauucaauauagcaauggaaaaaaucggaauaugcucauuccagggaacuauaaugaacgacgaugaaauagaaaguauugaagacaaagcacaaguucuaaugauggcauguuuugguuuagcguacgaagauuuuagccuaguaagugcuaugguaagucauccauuaaaacuaagaaacaggaugaaaauaggcaacuucagaguaggggaaaaaguaagcacaguauuaagcccuuuacucagauucacaagaugggcagaauuugcacaaagauucgcacuccaagcaaacacaaguagggaaggagcccaaauaagcaauucagcgguauucgcaguagaaagaaaaauaacaacagacguucaaagaguagaagaacugcuaaacaaaguacaagcccacgaggaugagccauuacaaacacuauauaaaaaaguaagagaacaaauaaguauaauaggacgaaacaaaagugaaauaaaagaauucuuagggaguucaauguaugauuuaaacgaucaagaaaaacaaaacccgauaaauuucaggucaggggcccauccauucuucuuugaauuugacccagacuauaaccccauaagaguaaaacgaccaaaaaaacccauagccaaaagaaauaguaauauaaguagguuagaagaagaaggaauggaugaaaauagcgaaauaggacaagcaaaaaaaaugaagccacuagaccaacuaacuuccacaucaucaaacauuccaggaaaaaau

SEQ ID NO: 51269 - RNA, 1695 nt, Artificial Sequence
  derived and/or modified sequence opt6 from anti-influenza_Chain
auggaaaaaauaguuuuauuauuugcaauaguaucccugguaaaaucagaccaaauaugcauuggcuaccacgcaaacaauaguaccgaacaaguagauaccauuauggaaaaaaauguaacaguaacacacgcacaagacauacuagaaaaaaaacacaauggaaaacuaugcgacuuagacggaguaaaaccacucauacuaagagauuguuccguagcaggauggcuccuuggcaacccaaugugcgaugaauucauaaacguaccagaauggucuuacaucguagaaaaagcaaauccaguaaacgacuuauguuauccuggagacuucaaugacuacgaagaauuaaaacaucuauuaaguagaauaaaucacuucgaaaaaauacaaauaauaccaaaaagcagcuggucuucacaugaagcuucacuaggagucucaagcgcaugcccauaucaaggaaaaaguucuuucuuuagaaacguagucugguuaauaaaaaaaaacucuaccuacccuacaauaaaaagaucauacaauaauacaaaccaagaagaucuuuuaguacucuggggaauucaucacccaaaugaugcggcagaacaaacaaaacuauaucaaaauccaacaacauauauaucaguaggaacaucaacauuaaaccaacgauuaguaccaagaauugccacuagaagcaaaguaaacggacaaagcggacgaauggaauuuuucuggacaaucuuaaaaccaaacgacgccauaaacuucgaaucaaacggaaacuucauagcaccagaauaugcguauaaaauagucaaaaaaggugacucaacaauaaugaaaucugaauuagaauacggaaacuguaauacaaaaugucaaacaccgaugggagcaauaaacagcucaaugccuuuucauaauauacauccacuaacaauaggagaauguccuaaauacguaaaaagcaacagacuagucuuagcuacaggauuaagaaacucaccacaaagagaaagaagacgaaaaaaaagaggacuauuuggagcaauagccggauucauagaaggaggauggcaaggaaugguagacgggugguauggauaccaucauaguaacgaacaaggcucaggauacgcagcagacaaggaaagcacacaaaaagccauagacggaguaaccaauaaaguaaacucaauaauagacaaaaugaauacacaauucgaagccguaggcagagaauuuaacaacuuagaaagaagaauagaaaacuuaaacaagaaaauggaagauggauucuuagacguguggacauauaaugcagaauuacucguacucauggaaaacgaacgaacauuagauuuccacgauagcaacguaaaaaaccuauaugacaaaguuagacuccaacuaagagauaacgcaaaagaauuaggaaauggaugcuuugaauuuuaccauaaaugcgacaacgaaugcauggaaucuguacgaaauggcacauacgacuauccacaauacagcgaagaagcaagacuaaaaagagaagaaauaucaggaguaaaauuagaaagcaucggaauuuaccaaauacuaucaaucuacucaacuguagcaucaucauuagcuuuagcaauaaugguagcaggacuaagccuauggauguguagcaacggaucauuacaaugcaga

SEQ ID NO: 51270 - RNA, 1695 nt, Artificial Sequence
  derived and/or modified sequence opt6 from anti-influenza_Chain
auggaaaaaauaguacuauuauucgcaaucgucucacuaguaaaaucagaccaaauauguaucggauaccaugcaaacaacucaacagaacaaguagacacaaucauggaaaaaaauguaacaguuacacaugcccaagacauacuagaaaaaacacauaacggaaaacuaugugaccuagauggcguuaaaccucuaauauuacgagacugcucaguagcaggauggcuauuagguaauccaaugugcgacgaauuuauaaacguaccagaauggagcuacaucguagaaaaagcaaaccccgugaacgaccuaugcuacccaggagauuucaacgacuaugaagaauuaaaacaucuguuaucaagaauaaaucauuuugaaaaaauacaaauaauaccaaaaucaucauggucaagccacgaagcaagcuuaggcguaagcucagccugccccuaccaaggaaagucaucauucuuccgaaacguaguauggcugauaaaaaaaaacucaacauauccaacaaucaagcgcucauacaacaacacaaaccaagaagaccuauuaguauuauggggaauacaucacccaaaugacgcagccgaacaaacaaaauuauaccaaaacccaacaaccuauauaagcguagguacaagcacauuaaaccaacgacuaguacccagaauugcaacaagaagcaaagucaacggacaaucaggaagaauggaauuuuucuggacaauacuaaagcccaaugacgcaauaaacuucgaauccaacggaaauuuuauagccccagaauacgcauacaaaauaguaaaaaaaggagacucuacuauaaugaaaucagaauuggaauacggaaauuguaauacaaaaugccaaacaccaaugggugcaaucaacucaagcaugccauuccauaacauccacccauuaacaauaggagaaugccccaaauacguuaagaguaacagauuaguacuagccacuggacuaaggaacucaccucaaagagaaagacgaagaaaaaaacgaggauuauuuggagcaauagcaggauucauagaaggaggauggcaaggaaugguagacggaugguauggauaccaccacagcaacgaacaaggaucaggcuacgccgcagacaaagaaucaacacaaaaagcaauagacgguguaaccaauaaaguaaauucuauuauagauaaaaugaacacacaauuugaagccguagguagagaauucaacaaucucgaacgaaggauagaaaacuugaauaaaaaaauggaagacggauuucuagauguuuggacauauaacgcagaacuauuaguucuuauggaaaaugaaagaaccuuagacuuccacgauucaaacguaaaaaaccuauacgacaaaguaagacuacaacuacgagacaacgccaaagaacuaggaaacggaugcuucgaauuuuaucacaaaugugauaaugaauguauggaaucaguaagaaauggaacauacgauuauccacaauauagugaagaagcgagauuaaaaagagaagaaauaucaggagucaaacuagaaucaaucggaaucuaccaaauacuaaguaucuauucaacagucgcaucaucacuagcacuagccauuaugguagcaggacuaucacuauggaugugcucuaauggaucacugcaauguaga

SEQ ID NO: 51271 - RNA, 1695 nt, Artificial Sequence
  derived and/or modified sequence opt6 from anti-influenza_Chain
auggaaaaaaucguauuauuauuagcaauaguaaguuuaguaaaaagugaccagauaugcauaggauaccaugccaacaacagcacugaacaaguagacacaauaauggaaaaaaacguaacuguaacacaugcacaagauauacuagaaaaaacacacaauggaaaacuaugugaccuagacggaguuaaaccacuaauauuacgagauugcucaguagcgggaugguuacuaggaaacccaaugugugaugaauucauaaaugucccagaauggaguuacauaguagaaaaagcaaaccccgcaaacgaucuaugcuacccaggaaauuucaaugacuaugaagaauuaaaacaucuucuauccagaauuaaccauuucgaaaaaauacaaauaauaccaaaaucaucaugguccgaucacgaagcaagcaguggaguaagcucagcuuguccuuaucaagguaaaaguucauuuuuuagaaaugucguaugguuaauaaaaaaaaauucaucauacccaacaauaaaaagaucauauaauaauacaaaucaagaagacuugcuaguauuaugggguauacaccacccaaacgacgcugcagaacaaaccagacucuaccaaaacccaacaacauacauaagcguagguacaucaacucuaaaccaacgacucgugccaaagauagcaacaagaucaaaaguaaauggccagucaggaagaauggaauucuucuggacaauacucaaaccaaacgacgccauaaacuuugaaucaaacggaaacuucauagcaccagaauaugcuuacaaaauuguaaaaaaaggagauagcgcaauaaugaaaagcgaacuagaauauggaaacuguaacacaaaaugucaaacacccaugggagcaauuaauagcagcaugccauuccacaacauacauccacucacaauaggagaauguccaaaauauguaaaaucaaacagauuaguacuagccacaggacucagaaacucaccacagagagaaaggagaagaaaaaaaagaggucuauuuggugcaauagcaggauucauagaaggcggauggcaaggaaugguugacggaugguauggauaccaucacucaaacgaacaaggaucaggauacgcugcagacaaagaaucaacacaaaaagccauagauggaguaacaaauaaaguaaacucuauaauagauaagaugaauacacaauuugaagcaguaggacgagaauuuaacaaucuagagagaagaauagaaaaccuaaacaaaaaaauggaagauggcuucuuagauguauggacuuacaacgcugaacuacuaguauuaauggaaaaugaaagaacauuagauuuucaugacucaaacgucaaaaacuuauacgacaaagugagacuucaacuaagagauaacgccaaagaacuaggaaauggauguuucgaauucuaucacaaaugcgacaacgaaugcauggaaucaguaagaaacggaacauaugacuacccacaauauucagaagaagcaagacuaaaaagagaagaaauuucuggaguaaaauuagaaagcauaggcaucuaccaaauauugucuauauauucaacaguugcaucaagcuuggcauuagcuauaaugguagcaggacuuagcuuauggaugugcucgaacgguagucuacaaugucga

SEQ ID NO: 51272 - RNA, 1695 nt, Artificial Sequence
  derived and/or modified sequence opt6 from anti-influenza_Chain
augaaaguaaaauuacuaguacuccucuguacauucaccgcaaccuacgcagacaccauaugcauaggcuaucaugcaaacaacucaacugauacaguagacacaguacuagaaaaaaacguaaccguaacacauucaguaaacuuacuagaaaacagccacaacggaaaacuaugccuacuaaaaggcauagcaccacuucaauuaggaaacuguagcguagccggauggauucuaggaaauccggaaugcgaauugcuaaucagcaaagaauccuggaguuauauagucgaaaaaccaaacccagaaaauggaacaugcuauccaggacauuucgcagacuaugaagaacuaagagaacaacuaaguaguguaucaucauucgaaagauuugaaauauucccaaaagaaucaucuuggcccaaccacacaguaacaggcgugagcgcaagcugcucccauaacggagaaucuucauuuuacagaaaucuacuauggcuaacaggaaaaaauggauuauaccccaacuuaaguaaaucauaugcaaacaauaaagaaaaagaaguacucguauuauggggaguacaccauccacccaacaucggagaucaaaaagcucuauaucacacggaaaaugcauacguaucaguuguaagcucacauuacucaagaaaauucaccccagaaaucgcaaaacgaccaaaaguaagagaccaagaaggaagaaucaauuaucacuggacauuauuagaacccggagacacaauaauauuugaagccaacggcaaccuaauagccccccgauacgcauuuacacuaucaagaggauuuggcucaggcauaauaaauagcaaugcaccuauggauaaaugcgaugcaaaaugucaaacaccccaaggagcaauaaauucaagccuaccauuccaaaacguccacccuguaacaauuggugaaugucccaaguauguacgaucagcaaaauuacgaaugguuacaggacuuagaaacaucccaagcauacaaucgagaggacuuuuuggagcaauagcaggcuucauagaaggaggauggacaggaaugguagacggaugguacggauaccaucaucaaaacgaacaaggaaguggauaugccgcagaucaaaaaaguacgcaaaacgcaauaaauggaaucacaaacaaaguaaauucaguaauugaaaaaaugaauacacaauucacugcaguaggcaaagaauucaacaaacuagaacguagaauggaaaacuuaaacaaaaaagucgacgacggauucauagacauauggacauacaaugcagaacuacuaguacuacuagaaaacgaaagaacacuugacuuucacgacagcaacguaaaaaauuuauacgaaaaaguaaaaucacaacuaaaaaacaaugcaaaagaaauaggaaacggcugcuucgaauuuuaccacaaaugcaacgaugaauguauggaaucaguaaaaaauggcacauacgauuauccaaaguauuccgaagaaagcaaacuaaauagagagaaaauugacggaguaaaauuagaaaguaugggaguauaccaaauacuagcaauauacuccacaguugcaucaucacuaguauuacucguaagccuaggggcaauaagcuucuggauguguagcaacgguucauugcaauguagaaucugcaua

SEQ ID NO: 51273 - RNA, 1695 nt, Artificial Sequence
  derived and/or modified sequence opt6 from anti-influenza_Chain
augaaaguuaaacuccuaguauuauuauguacuuucacagcaacauacgcagacacaauauguauaggauaccaugccaacaauucaacagacacagucgacaccguccuagaaaaaaacguaaccguaacacacucaguaaaccuauuagaaaacucacacaacgguaaacuaugucuacuaaaaggaauagccccauuacaauuaggaaacugcuccguagcaggauggauacuaggcaauccagaaugugaacuauuaauauccaaagaaucauggucauacauaguagaaaaaccaaaucccgaaaacggaacaugcuaucccggacacuucgcagauuacgaagaauuacgagaacaauuaucuuccguaaguagcuucgaaagauuugaaauauucccuaaagaaucauccuggccaaaccacacagucacaggaguaagcgcuucauguagccacaauggagaauccaguuucuaccgaaaccuccuauggcuaacaggaaaaaacggacuauauccaaaccucucaaaaucauacgcgaacaacaaagaaaaagaaguacuaguauuauggggaguacaccaucccccaaacaucggagaccaaaaaacacuauaucacacugaaaaugcauauguaucaguagucucaucccauuacaguagaaaauucacacccgaaauagccaaaagaccaaaaguacgagaucaagaaggaagaauaaauuauuacuggacauuacuagaaccaggagacacaauaauuuuugaagcaaacggaaaucuaaucgcaccaagauaugcuuuugcuuuaagcagaggauuuggaucaggaauaauaaacagcaacgcaccaauggacaaaugcgacgccaaaugucaaacaccacaaggagcaauaaauaguagccuaccauuucaaaauguacaccccguaacaauaggcgaauguccuaaauauguaagaucagcaaaauuacgaaugguaaccggauuacgaaacauaccaucaauccaaagcaggggacuauuuggagcaauagcuggauucauagaaggcggauggacagggauggucgacggaugguacggauaucaccaucaaaacgaacaaggaucaggauacgcagccgaucaaaaaaguacgcaaaacgcaauaaauggaauaacaaacaaagucaauagcguaauagaaaaaaugaacacacaauucacagcaguaggaaaagaauucaauaaauuagaaagaagaauggaaaaccuuaacaaaaaaguugacgacggcuucauagacaucuggacauauaacgccgaacuacuaguccuauuagaaaaugaaagaacuuuagacuuucaugacucaaacgugaaaaacuuauaugaaaaaguaaaaucacaacuaaaaaauaaugcaaaagaaauaggaaauggcugcuucgaauucuaccauaagugcaacgacgaaugcauggaaucaguaaaaaacggaacuuacgauuacccaaaauacucagaagaaucaaaacucaauagagaaaaaaucgacggaguaaaacuagaaucaaugggaguuuaucaaauauuggcaauauacucuacgguagccucaucuuuaguacuacuugugucacuaggagcaaucucauuuuggauguguucaaacggaucauuacaaugcagaauaugcaua

SEQ ID NO: 51274 - RNA, 1695 nt, Artificial Sequence
  derived and/or modified sequence opt6 from anti-influenza_Chain
augaaaguaaaacuuuuagugcuacuaugcacauuuacagcaacauaugcagauacaauaugcauaggcuaucacgccaacaauuccacagacaccguagacacuguacuagaaaaaaacguaaccguaacacacaguguaaacuuauuagaaaacagucauaacgguaaacuaugccuacuaaaaggaauagcuccauuacaauuaggaaacuguucaguagcuggcuggauacuagggaauccagaaugcgaacuacuaauaucaaaagaaucauggucauauauagucgaaaaaccaaauccagaaaacgguacaugcuacccaggacauuuugcagauuaugaagaacuaagagaacaacuaucaucaguaucaaguuuugaaagauucgaaauauucccgaaagaaucaagcuggcccaaccacacaguaacaggcguaagugcaucaugcucacacaacggcgaaucaucauucuaccgaaaccuacuaugguuaacaggcaaaaacggacuuuacccaaacuuaaguaaauccuacgccaauaacaaagaaaaagaaguauuaguacuaugggguguacaucacccuccagauauaggagaucaaaaaacacucuaucauaccgaaaacgcuuacguaucaguaguuucaucacauuacucacgcaaauucaccccugaaauagcaaaaagaccaaaaguaagagaccaagaaggucgaauaaacuacuacuggacuuuacucgaaccaggcgauacaaucauuuucgaagcaaauggaaaccuuaucgcgccaagauacgccuucgcccuaucuagagguuucggaaguggaauaauaaacucaaacgcaccaauggacaaaugugaugcuaaaugccaaacaccacaaggagcaauaaauucuuccuuaccauuucaaaacguucacccaguaacaauaggagaaugcccaaaauacguaagauccgcaaaacuucgaaugguaacaggccuaagaaacauaccaucuauacaaagucgaggauuauuuggugcaauagcaggauuuauagaaggaggauggacaggaaugguagacggaugguaugguuaucaccaccaaaacgaacaaggaucaggcuacgcagcagaccaaaaaagcacccaaaaugccauaaauggaauaacaaacaaaguaaacuccguaauagaaaaaaugaauacacaauucacagccguuggaaaagaauuuaacaaauuagaaagaagaauggaaaacuuaaauaaaaaaguagacgauggauucauagacauauggacauacaacgcagaauuauuaguauuacuagaaaacgaacgaacacuagacuuccacgacucaaauguaaaaaaucuauaugaaaaagucaaaagccaacuaaaaaacaacgccaaagagauaggaaacggauguuucgaauucuaucauaaauguaacgacgaauguauggaaagcguaaaaaauggaacauacgacuacccaaaauacucagaagagucaaaacuuaauagagaaaaaaucgauggaguaaaacuagaaaguaugggaguauaccaaauacuagcuaucuauucaacuguagcaucuaguuuaguauuacuaguaagccugggagcaauaucauucuggaugugcaguaacggcucacuccaaugccgaauaugcaua

SEQ ID NO: 51275 - RNA, 1695 nt, Artificial Sequence
  derived and/or modified sequence opt6 from anti-influenza_Chain
augaaaguaaaacuauuaguacuucuuugcacauuuacagcaacauacgcagacacaauaugcauaggcuaucacgcaaacaauuccacagacacagucgacacaguauuagaaaaaaacguaacuguaacacauucaguaaauuuauuggaaaacagucauaacgguaaauuaugcuuacuaaaaggaauagcaccacuucaauuaggaaacugcaguguagcgggauggauuuuaggaaacccagaaugugaauuacuaauaaguaaagaaucauggucuuauaucguugaaaaaccuaaucccgaaaauggaacauguuaccccggacacuucgcagacuacgaagaauuaagagaacaacuaaguaguguaagcucauucgaaagauucgaaauauuucccaaagaauccaguuggccaaaccacacaguaacuggaguaagcgcuucauguucacauaacggagaaucaagcuuuuauagaaacuuacuauggcuaacaggaaaaaacggauuguaccccaaccucucaaaaucauacgcaaacaauaaagagaaagaaguucugguacuauggggaguacaccacccaccaaacauuggagaccaaaaagcccuauaccacacagaaaaugcauauguaucaguaguaagcucacacuacucaagaaaauucacaccagaaauagcaaaaagaccaaaagucagggaucaagaaggcagaauaaacuacuauuggacccucuuagaaccaggagacacaauaauauuugaagcaaacggaaaccuaauagcacccagauacgcuuucgcacuaucacgaggauucgggaguggaauaauaaauucaaacgcuccuauggauaaaugcgaugcaaaaugucaaacaccccaaggagcaaucaacucaucauuaccauuucaaaauguacacccagucaccauaggcgaaugcccaaaauacgucagaucagcuaaauuaagaaugguaacaggauuacgaaauauaccaucaauacaaucaagaggacuauucggagcaauagccggauucauagaaggaggcuggacugguaugguagacggaugguacggauaccaucaucaaaacgaacaaggcucaggauacgcagcagaccaaaaaucaacacaaaaugcaaucaacggaauaacaaacaaaguaaacaguguaauagaaaaaaugaacacacaauuuacagcugucggaaaagaauucaacaaacuagaaagaagaauggaaaacuuaaacaaaaaaguagaugacggauucauagacauauggacauacaaugcagaauuauuaguauuauuagaaaaugaaagaacacuugacuuccaugacucaaaugucaaaaauuuauacgaaaaaguaaaaagucaacuaaaaaauaacgcaaaagaaauaggaaacggauguuucgaauucuaccacaaaugcaacgacgaaugcauggaaucaguaaaaaauggaacauacgacuauccaaaauacucagaagaaucaaaacuuaauagggaaaaaaucgauggaguaaaauuagaaagcauggguguauaccaaauacuagcaauauacagcaccguagcaucaucacucguacuucuaguuucauuaggugcuauaagcuucuggaugugcaguaauggcagcuuacaaugccgaauauguaua

SEQ ID NO: 51276 - RNA, 1695 nt, Artificial Sequence
  derived and/or modified sequence opt6 from anti-influenza_Chain
augaaggcaaaauuacuuguauuacuaugcacauuuacggcaacauaugccgacaccauuuguauaggauaucaugcaaacaacucaacagauacaguagacacaguacuagaaaaaaacguaacaguaacacauucaguaaaccuucuagaagauucacauaacggaaaacugugcuuacuaaaaggaauagcaccucuccaauuaggaaacugcaguguagcaggauggauauugggaaauccagaaugcgaacuauuaauaagcaaagaaucuuggucauauauaguagaaacaccaaauccagaaaacggcacaugcuauccaggauauuucgcagacuaugaagaauuaagggaacaacuaucauccgucagcucauucgaaagguucgaaaucuucccaaaagaauccagcuggccaaaccacacagucaccggaguuucagcaaguugcagccauaacggaaaaucaucauucuacagaaauuuacuuuggcucacaggaaaaaauggucuauauccaaaccuaagcaaaucauacguaaacaauaaagaaaaagaaguauuagucuuauggggaguacaccauccaccaaauauagguaaccaacgagcauuauaccauacggaaaaugcauacguaagcguaguaucaagucacuauagcagaagauuuacacccgaaauagcaaaaagaccaaaaguaagagaccaagaaggaagaauaaauuacuacuggacccuacuagaaccaggagacacaauaauauuugaagcaaacggaaaccuaauagcaccaugguacgcauucgcauuaagcagaggauucggcaguggaauaauaacauccaaugcaccaauggacgaaugugacgcaaaaugccaaaccccacaaggagcaaucaauucuucucuaccuuuucaaaacguucacccaguaacuaucggagaaugcccaaaauacgucagaucugcuaaacuaagaauggucacaggauuacgaaauauccccucaauccaaucacgaggccuauucggagcaauagcagguuucauagaaggagguuggacaggcaugguagaugguugguacgguuaccaccaccaaaacgaacaaggaucaggguaugcagcagaucaaaaaucaacucaaaacgcaauaaauggaauaacaaauaaaguaaauuccguaauagaaaaaaugaauacacaauucacugcaguggguaaagaauuuaauaaacuagaacgacgaauggaaaaucuaaauaaaaaaguagacgacggauuuuuagacauauggacauacaaugcagaauuacuaguacuacuggaaaacgagagaacacuagacuuccacgauagcaacgucaaaaaucuauacgaaaaaguaaaaucucaacuaaaaaacaacgcaaaggaaauuggaaacggaugcuucgaauucuaccauaaaugcaacaaugaaugcauggaaucaguaaaaaacggcacauacgauuauccaaaauacagugaagaaucaaaacuaaacagggaaaaaauagauggagugaaacucgaaucaaugggcguauaucaaauauuagcaauauacaguacaguagccucuucauuaguauuacuaguaucuuuaggcgcaauaagcuuuuggaugugcucaaaugguucguuacaaugcaggauaugcaua

SEQ ID NO: 51277 - RNA, 1695 nt, Artificial Sequence
  derived and/or modified sequence opt6 from anti-influenza_Chain
augaaaguaaaacuacucguauuacuaugcaccuucacagcaacauacgcggacacaauaugcauaggauaucacgcuaauaacucaacagauacaguagacacgguuuuagaaaaaaauguaacaguaacacacucagucaaccucuuagaagauagccauaauggaaaacuaugcuuacuaaaagguaucgcaccuuuacaacuaggcaacuguuccgucgcagguuggauauuaggaaacccagaaugugaacuucucaucagcagagaauccuggucauacauaguagaaaaaccaaauccagaaaacggaacaugcuauccaggucauuucgcagacuaugaagaauuaagagaacaauuaagcucuguaucaaguuucgagagguuugaaauauuuccaaaagaaaguaguuggccaaaccacacuacuacaggaguaucagcaucaugcucacacaacggggaaaguucauucuacaaaaacuuacuauggcuaacaggaaaaaaugguuuauauccaaacuuaucaaaaucuuacgccaacaacaaagaaaaagaagucuuaguccuauggggaguacaccauccaccaaacauaggagaccaaagagcacuauaccauaaagaaaacgccuauguaagcgucguuucaucacacuacucaagaaaauucacaccagaaauagccaaacgaccuaaaguaagagaucaagaaggacgcauaaacuauuauuggacauuacuagaaccaggagacacaauuauuuuugaggcaaacggaaaucuaauagcaccacgauacgcauucgcacuaaguagaggauucggaaguggaaucauuaacucaaacgcaccuauggacgaaugcgacgcuaaaugccaaaccccacaaggagcuauaaacucaagcuuaccauuccaaaauguucacccaguaacaauaggcgaauguccaaaauacguaagaucagcaaaacuuagaaugguuacaggauuaagaaacauaccaucaauccaaucaagaggacuauuuggagcaauagcaggauuuauugagggcggauggacaggaaugguagauggaugguaugguuaccaccaccaaaaugaacaaggaaguggauacgcagcugaucaaaaaaguacacaaaacgcaauaaacggcauaacaaacaaagucaacucaguuauagaaaaaaugaauacacaauuuacagcaguaggcaaagaauuuaauaaauuagaaagacgaauggaaaaccucaacaaaaaaguagacgauggauuuauagacauauggacguacaacgcagaacuccuaguauuacuugaaaacgaacgaacccuugauuuccacgacaguaauguaaaaaacuuauaugaaaaaguaaaaucacaauuaaaaaacaacgcaaaagaaauagguaacggaugcuucgaauuuuaccauaaaugcaacgacgaaugcauggaaucaguaaaaaauggaaccuaugauuacccaaaauacucagaggaaucaaaauuaaacagagaaaaaauagauggaguaaaacuugaauccaugggaguauaucaaauauuagccauauacucgacaguagcauccucauuaguacuccuaguaucauuaggagcaauauccuucuggaugugcucaaauggauccuuacaaugcagaaucuguaua

SEQ ID NO: 51278 - RNA, 1698 nt, Artificial Sequence
  derived and/or modified sequence opt6 from anti-influenza_Chain
augaaaaccauaauagcacuauccuacauauuauguuuagucuuugcacaaaaauuacccggcaaugacaacaguacagccacacuaugcuuagggcaccacgcaguaccaaauggaaccauaguaaaaacaauaacaaacgaucaaaucgaaguaacaaaugcuacagaacuaguacaaucuucauccacaggaggaauuugugacucaccacaucaaauacucgauggagaaaauugcaccuuaaucgaugcgcuauuaggggacccacaaugcgacggauuccaaaacaaaaaaugggaccuuuuuguagaacggucaaaagcauauaguaacugcuacccauacgacguaccagacuaugcuucauuacguucacuaguagcaagcaguggcacauuagaauucaauaacgaaagcuucaacuggacaggaguaacacaaaacggaacaucaagcgcaugcaaaagaagaaguaacaacucauucuucaguagacugaauuggcucacacaucucaaauucaaauauccagcauuaaauguaaccaugccaaauaacgaaaaauucgacaaacuauauaucuggggcguccaccacccaggcacagacaacgaccaaauaagucuauaugcacaagccaguggaagaaucacaguaaguacaaaacgaucucaacaaacagucauaccuuccauaggauccagaccaagaauaagagacguaccaucaagaauauccauauacuggacuauaguaaaaccaggcgauauauuauuaaucaacagcacaggcaacuuaauagcaccaagaggauacuucaaaaucagaucagguaaaucaucaauaaugagaagcgacgcuccuauaggaaaaugcaauagcgaauguauaacccccaauggaucaauaccaaaugacaaaccuuuccaaaauguaaaucgaauaacauauggcgcaugcccacgauacguuaaacaaaauacacucaaacuagcaaccggaaugagaaauguaccagaaaaacaaacaagaggaauauuuggagccaucgcaggauucauagaaaacggaugggaaggaaugguagauggaugguacggauuccgacaucaaaacucagaaggcacaggacaagcagcagauuuaaaaagcacccaagccgcaauaaaucaaauaaauggaaaauuaaaccgacucauaggaaaaaccaaugaaaaauuucaccaaauagaaaaagaauucuccgaaguagaaggacggauucaagaccuagagaaauacguugaagacacaaaaauagauuuauggucauacaacgcagaacuauuaguagcacucgaaaaccaacacacaauugaucuaacagacuccgaaaugaauaaacuauucgaaagaacaaaaaaacaacuaagagaaaacgcagaagauaugggcaacggauguuuuaaaaucuaccauaaaugcgauaacgcauguauaggaucaauaagaaauggaacauacgaccacgacguuuaucgagaugaagcacuaaauaacagauuccaaaucaaaggaguagaacuaaaaagcggauauaaagacuggauauuauggauaucauucgcaauaaguuguuucuuacucuguguagcacucuuaggcuuuauaaugugggcuugccaaaaaggaaauauaagauguaacauauguauc

SEQ ID NO: 51279 - RNA, 1698 nt, Artificial Sequence
  derived and/or modified sequence opt6 from anti-influenza_Chain
augaaaacaauaaucgcacuaucauauauauuaugccuaguuucagcacaaaaauuuccaggcaacgauaauucaacagcaacacuauguuuaggacaccacgcgguaccaaacgguacaauaguaaaaacaauaaccaaugaccaaauagaaguaacaaacgccacagaauuaguucaaagcucaucaacuggcgaaauaugcgauuccccacaccaaauucuagauggagaaaauugcacacuaauagaugcauuauuaggagauccacaaugugacggauuucaaaauaagaaaugggacuuauucguagaacgauccaaagcauacaguaacuguuacccauacgacguacccgacuaugcauccuuacgaucauuaguugcaagcucuggaacacuagaauuuaacaacgaaucauucaacuggacaggaguaacacagaacggaacauccucagcaugcaucagacgaagcaacaacucauucuucucaagauuaaacugguuaacucaucuaaaauucaaauacccagccuuaaaugucacaaugccaaacaacgaagaauuugauaaacuguacaucugggguguucaucaucccggaacagacaacgaucaaauauuccuauacgcacaagccucaggaagaauuaccguaagcacaaaacgaucacaacaaaccguaauacccaacauaagaagcagacccagaguaagaaacauacccuccagaauaucaauauacuggacaauaguuaaaccuggcgauauauuacuaaucaauucaacugguaacuuaauagcaccacgaggauauuucaaaauaagaucaggcaaauccucaaucaugagauccgacgcaccaauaggaaaaugcaacagcgaaugcauaacaccaaacggaucuauaccaaacgauaaacccuuccaaaacguaaaccgaauaacauauggagccuguccaagauauguaaaacaaaacacauuaaaacuagcaacaggaaugcgcaaugucccagaaaaacaaaccaggggaauauuuggagccauugcaggauuuauagaaaacggaugggaaggaaugguagacggaugguacggauuccgacaccaaaacucagaaggaaucggccaagcagcagaucucaaaaguacacaagcagcaauagaccagaucaacggaaaacuaaaucgacuaauugguaaaacaaacgaaaaauuccaccaaauugaaaaagaauuuucagaaguugaaggaagaauacaagaccuagaaaaauaugucgaagauacaaaaauagacuuauggagcuacaacgccgaacuccuagucgcccucgaaaaucaacauacgauagaucucacagauucagaaaugaauaaacuauucgagaaaacuaagaaacaauuaagggaaaacgcagaagauaugggcaacggcugcuuuaaaauauaccacaaaugugacaaugcaugcauaggaucaauaagaaauggaacauacgaccacgacguauacagagaugaagcucuaaauaauagauuccaaauaaaaggaguagaauuaaaaaguggauacaaagacuggauccuguggauaaguuucgcaauaagcugcuuccuacuauguguagcacuacuaggauuuaucaugugggcaugucaaaaaggaaacaucagaugcaauauaugcaua

SEQ ID NO: 51280 - RNA, 1698 nt, Artificial Sequence
  derived and/or modified sequence opt6 from anti-influenza_Chain
augaaaacaauaauagcacucucauacauacuaugcuuaguauuugcacaaaagcuaccugguaacgacaacaguacggcaacacucuguuuaggacaucacgcaguaccuaacggaacaauugucaaaaccauaaccaaugaccaaauagaaguaacaaaugcgacagaauuaguacaaucaucaucaacaggagaaauuugcgacucaccccaucaaauacuagacggugaaaacugcacauuaauagacgcauuacuaggagauccacaaugcgacggauuccaaaauaaaaaaugggacuuauucguagaaagaucaaaagcauacucaaauuguuacccauacgauguaccagacuacgcaucacuucguucacuaguagcuucaucaggaacacuagaauucaaaaaugaaucauucaacuggacaggaguaacccaaaacggaacaaguucagcauguauacgaagaucaaauaacaguuuuuucaguagacucaacugguuaacacaucuaaaauuuaaguacccugcacuaaacguaacuaugccaaacaaagaaaaauucgacaaacuauacauauggggaguacaccacccuggaacagacaacgaccaaauauuucuauacgcacaagcaucaggucggauaacaguuagcacaaaaagaucacaacaaacagucauccccaacauagguagcagacuccgaguaagagacauaccuucuagaauauccauauacuggacaauaguaaaaccaggagacauacuacuaauaaacucaaccgguaauuuaauagcaccccgaggauacuucaaaauaagaucaggaaaauccagcaucaugcgaagugacgcaccaaucggaaaaugcaacucagaauguauaacaccuaaugguaguauaccaaacgauaaaccauuucaaaaugucaaccguauaacauacggugcaugcccuagauauguaaaacaaaauacauuaaaacuagcuacugguaugagaaauguuccagaaaaacaaacaagagguauauuuggagcaauugcaggauuuauagaaaacggaugggaaggaaugguagauggaugguacggauuucgacaccaaaacucagaaggaacaggacaagccgcagacuuaaaaucuacacaagcagcaauagaucaaauaaacggaaaacucaaccgacucauaggaaaaacaaacgaaaaauuccaccaaauagaaaaagaauucagugaaguggaagguagaauacaagacuuagaaaaauacguagaagauaccaaaauagaucuauggucuuauaacgcugaauuacuaguagcacuugaaaaucaacauacaauagacuuaacagauucagaaaugaacaaauuauucgaaaaaaccaaaaaacaacuaagagaaaacgcugaagauaugggaaacggaugcuuuaaaauauaccauaaaugcgacaaugcaugcauaggcucaauaagaaacggaacauacgaccacgacguauauagagaugaagcauuaaacaacagauuccaaauuaaaggaguagaacuaaaaaguggauacaaagacuggauacuguggaucaguuucgcaauaaguugcuuucuauuaugcguagcguuacucggauucauaaugugggcaugccaaaaaggaaacauacgauguaauauauguaua

SEQ ID NO: 51281 - RNA, 1698 nt, Artificial Sequence
  derived and/or modified sequence opt6 from anti-influenza_Chain
augaaaacaauaauugcacuaagcuauauauuauguuuaguauuugcccaaaagcuacccggaaacgauaacaguacagccacccuaugucuaggucaccacgccgucccaaacggaacaauaguaaaaacaauaacaaaugaucaaauagaaguuaccaacgcaacagaacuaguacaaucuuccaguacaggcgaaauuugcgacucaccacaccaaauauuagacggagaaaauugcacacuaauagacgcuuuacucggagauccacaaugcgacggauuucaaaacaaaaaaugggaccuauuuguugaacgaagcaaagccuacucaaaauguuacccuuaugacguaccugacuaugccaguuuacgaucccuaguagcaagcuccggaacacuagaauucaacaacgaaucauuuaacuggacagguguaacacaaaauggaacaucaagugcauguauacgaagaucaaacaacucauucuuuuccagauuaaacugguuaacacaccucaaauucaaauaccccgcgcuaaacguaacuaugccaaacaacgaaaaauucgacaaauuauacauaugggguguacaccauccaggaaccgauaacgaccaaauauuccucuacgcacaagcaagcggaaggauaaccguuaguacaaaaaggucacaacaaacgguaauaccaaacauaggaagcagaccaagaguccgagacauaccaucuagaaucucuauauacuggacuauaguaaaaccaggagauauacuacucauuaauagcacaggaaaccuaauagcaccaaggggauacuucaaaauacgaucaggaaaaagcaguauuaugagaagugaugcaccaauaggcaaaugcaacagugaaugcauaacaccaaacggaagcauaccaaacgacaaacccuuccaaaaugucaacagaauaacguauggugcuugcccaagauauguaaaacaaaauacacuaaaacuagcaaccggcaugcgaaacguaccugaaaaacaaacaagaggaauauucggagcaauagcuggcuucauagaaaauggaugggaaggaaugguugacggaugguacggauucagacaucaaaacucagaaggaauaggucaagcagccgaccuaaaaucaacacaagcagccaucgaucaaauaaauggaaaacuaaacaggcucauaggaaaaacaaacgaaaaauuucaucaaauagaaaaagaauucagugaaguagaaggaagaauacaagaccuagaaaaauacguagaagacacaaaaauagacuuauggucauauaacgcagaacuauuaguagcacuagaaaaucaacauacaauagacuuaacagacucagaaaugaauaaauuauucgaaaaaacaaaaaaacaacuacgagaaaacgcagaagauaugggaaauggaugcuuuaaaauauaccacaaaugcgacaaugcaugcauaggaucgauaagaaacggaacauacgaccacgauguauauagagacgaagcacuaaacaauagguuucaaauaaaaggaguggaacugaaaucaggauauaaagacuggauauuauggauauccuucgcuauaucauguuuucuacuaugcguagcacuauuaggguucauaaugugggccugccaaaaagguaauauaagauguaauauaugcaua

SEQ ID NO: 51282 - RNA, 1698 nt, Artificial Sequence
  derived and/or modified sequence opt6 from anti-influenza_Chain
augaaaacaauaaucgcauuaagcuauauacuaugccuaguguuugcacaaaaauuaccaggaaaugacaacaguacagcaacauuaugccucggacaccacgcuguaccaaauggaacaauaguaaaaacaauaacaaaugaccaaauagaaguaacaaacgcaacagaacuaguucaaucaucaagcacaggagaaauaugugacaguccacaccaaauauuagacggagaaaauuguacucucauugacgcacuauuaggagauccucaaugugacgguuuccaaaauaaaaagugggaccuauucgucgaaagaaguaaagcauacaguaacuguuacccauaugacguaccagacuacgcaucauuaagaagucuaguagcaucauccgguacacucgaauuuaauaaugaaucauucaauuggacaggaguaacacaaaacggaacaagcagcgcaugcauaagaagaagcaacaacucauucuuuucaagauuaaacuggcuaacacaucuaaaauucaaauacccagcccuaaauguaacaaugccaaauaacgaaaaauucgacaaauuauacaucuggggaguccaccauccagguacagacaacgaucaaaucuucuuauaugcacaagcaucuggcagaauaacaguaaguacaaaaagaucacaacaaaccguaauacccaauauaggaaguagaccaagaguaagaaacauaccaucaagaauuaguauauauuggacaauaguaaaaccuggagauauacuuuuaauaaacucaacaggaaauuuaaucgcaccacgaggauacuucaaaauacgaagcggaaaaucuagcauaaugagaucagacgcaccaauaggaaaaugcaacagcgaaugcauaacaccaaauggaucaauaccuaaugacaaacccuuccaaaacguaaacagaauaaccuacggagcauguccaagauacgugaaacaaaacacauuaaaacuugccacagguaugagaaacguaccagaaaaacaaacucgaggaaucuucggagcaauagcaggauucauagaaaauggaugggaaggaaugguagauggcugguacggauuccgccaccaaaacucagaagguauaggacaggcagcagacuuaaaaucuacgcaagcagcaauagaccaaauaaauggaaaacuaaauagacuaauagguaaaacuaacgaaaaauuccaccaaauagaaaaagaauuuucagaaguagaaggaaggauacaagaccuagaaaaauaugucgaagauacuaaaauagacuuauggucauauaacgccgaauuauuaguagcauuagaaaaccaacauacaauagacuuaacagacucagaaaugaacaaauuauucgaaaaaacaaaaaaacaauuaagagaaaaugcugaggacaugggaaacggauguuucaaaauauaucacaaaugcgacaaugccugcauaggaucaauaagaaauggaacauacgaccaugacguauacagagaugaagcccucaauaauagauuccaaauaaaaggaguagaacuaaaaucagguuauaaagauuggauacuauggauuucguucgcaauuaguuguuucuuauuaugcguagccuuacuaggauuuauuaugugggcaugccaaaaaggaaacauaagaugcaauauauguaua

SEQ ID NO: 51283 - RNA, 1698 nt, Artificial Sequence
  derived and/or modified sequence opt6 from anti-influenza_Chain
augaaaacaauaauagcacucucauauauauuaugccuaguauucucacaaaaacuacccggaaacgauaacaguaccgcgacauuaugcuuaggacaucacgcaguaccaaacggaacgauaguaaaaacaauaacaaaugaccaaauagaaguaacaaacgccacagaauuaguucaaucaaguucaacaggcggaauuugcgacucaccacaccaaauacuagacggagaaaacugcacccuaauagacgcacuauuaggugacccccaaugugacggauuucaaaauaagaaaugggaccuauucguagaaagauccaaagcauauucuaauugcuacccauacgacguaccagacuacgcaucccuaagaucgcuaguagcaucaaguggaacacuagaauuuaauaacgaaaguuucaauugggcugguguaacacaaaacggaacuagcagugcgugcaaaagaagaucaaauaagagcuucuucuccagacuuaauugguuaacccaucuaaaauauaaauauccugcacuuaacguaacaaugccaaacaacgaaaaauucgauaaauuauacauauggggcguacaccauccaguaacugauucagaccaaaucucacuauaugcacaagcaagcggaagaauaacagucucaacaaaaagaagccaacaaacaguaauaccaaauauaggauauagaccaagaguaagagacauuaguucaagaauuucuauauacuggacuauaguuaaaccaggagacaucuuacuaauaaacucaacaggaaaccucauagcaccccgaggauacuucaaaauacgaucaggaaaaagcucuauaaugagaagugacgcaccuauaggaaaaugcaauagcgaauguauaaccccuaacggaucaauaccaaacgauaaaccauuucaaaacguuaauagaauaaccuauggagccugccccagauaugucaaacaaaauacacuaaaauuagcaaccggaaugagaaacgucccagaaaaacaaacacgaggaauauucggagcuauugcagguuucauagaaaacggaugggaagguaugguagaugguugguacggguuuagacaccaaaacucugaagggacaggccaggccgccgaucuaaaaucaacacaagcagcaauaaaccaaauaaacggcaaauuaaaccgacuaauaggaaaaacaaacgaaaaauuccaucaaauagaaaaagaauuuagugaaguagaagguagaauacaagaccucgaaaaauauguagaagauacaaaaauagacuuauggucauauaacgcagaauuacucguagcacuagaaaaccaacacacaauagaucuaacagacucagaaaugaacaaacuauuugaaagaacaaagaaacaacuaagagaaaacgcagaagauauggguaacggaugcuuuaaaauauaucacaaaugugacaaugcaugcauagaaucaauuagaaacggaacauaugaccacgauguauacagagacgaagcauuaaauaacagauuccaaauaaaaggaguagaauuaaaaucuggauacaaagauuggauauuauggauuagcuucgccauaucauguuuucuacugugcguugcacuauuaggauuuauaaugugggcuugccagaaaggaaacauaagaugcaauauauguaua

SEQ ID NO: 51284 - RNA, 1698 nt, Artificial Sequence
  derived and/or modified sequence opt6 from anti-influenza_Chain
augaaaaccauaauagcacuaucuuacauacuaugccuaguauucgcacaaaaacuaccaggaaacgacaauagcacugcaacacuauguuugggucaccacgcuguaccaaacggaaccauagugaaaacgauaacuaaugaccaaauagaaguaacaaaugcuacagaauuaguacaauccucaaguacaggaggcauaugcgauagcccacaucaaauacuagacggcgaaaacugcacccuaauagacgcacuacuaggggacccacaaugcgacggauuccaaaauaagaaaugggauuuauucguagaaagaucaaaagcauauucaaacugcuacccguaugacguaccagacuaugcauccuuacgaucauuagucgcaucaucaggaaccuuagaauuuaaugacgaaucauucaacuggaccggaguaacacaaaacggaacaagcaguaguugcaaacgacgauccaacaacucauucuucucuagacucaacuggcuaacacaucuaaaauucaaauauccagccuuaaacguaacaaugccaaacaacgaaaaauucgacaaauuauacauauggggaguacaccacccagugacagacaaugaccaaauauuuuuauacgcacaagccucaggacgaauaacaguaucaaccaaaagaagccaacaaacgguaauaccaaacauuggaagcagaccaagaauaagaaacauacccucaagaauaagcauauauuggaccauaguaaaaccaggagacauccuauuaauaaacucaacaggaaaccuaauagccccaagaggauacuuuaaaauuagaucaggcaaaagcaguauaaugagaucugaugcaccaauagguaaauguaacagcgaaugcaucacaccaaacggaucuaucccaaaugauaaacccuuccaaaacguaaauagaauaacauacggagcaugcccaagauauguaaaacaaaauaccuuaaaacuagcaacaggaaugcgaaauguacccgaaaaacaaacaagaggaauauuuggagcaauagcaggauucauagaaaacggaugggaaggaaugguagauggcugguacggcuuccgacaccaaaacucugaaggaauaggacaagcagccgauuuaaagagcacucaagcggcaauuaaccaaauuaauggaaaacucaaccgacuaauaggaaaaacaaacgaaaaauuccaccaaaucgaaaaagaauuuucagaaguagaaggucgaauacaagacuuagaaaaauacguagaagauacaaaaauugacuuauggucauauaaugccgaacuauuagucgcacuagaaaaccaacauacaauagaccucaccgauucagaaaugaacaaauuauucgaacgaaccaagaaacaacucagagaaaacgcagaagacaugggcaacggcuguuucaaaaucuaccacaaaugugacaacgcaugcauaggaucaauaagaaauggaaccuacgaucaugacguuuacagagaugaagcauuaaacaacagauuccaaauaaaagggguagaacuaaaaagcggauauaaagacuggauacuauggauuagcuuugcaauaaguugcuuuuuauuaugcguugcacuacucgguuuuauuaugugggcuugccaaaaaggaaacauacgcuguaacaucuguaua

SEQ ID NO: 51285 - RNA, 1698 nt, Artificial Sequence
  derived and/or modified sequence opt6 from anti-influenza_Chain
auggaaaaaaucguacucuuauuagcuauaguaucacuagucaaaucagaccaaauaugcauaggauaccaugcaaauaacucaacugaacaaguugauacaaucauggaaaaaaauguaacaguaacacacgcacaagauauauuagaaaaaacacauaauggcaaacucugcgaucucgacggaguaaaacccuuaauucuaagagacuguagcguagcaggauggcuacuaggaaacccaaugugcgacgaauucaucaauguaccagaauggaguuacauaguagaaaaagcaaacccaacuaaugauuuaugcuacccgggaucauucaaugacuaugaagaacucaaacaucuucuaucaagaauaaaccacuuugaaaaaauacaaauaauaccaaaaucaucaugguccgaucacgaagcaagcucaggagucuccucagcuugcccauaccuaggauccccaaguuucuuuagaaacgucguauggcuaauuaaaaaaaauucaacauaccccacaauaaaaaaaucauauaacaacacuaaucaagaagacuuacuaguauuauggggaauccaucacccaaaugacgcagcagaacaaacaagacuauaucaaaacccaacaacauacauaucuauaggaacaucaacccuaaaccaaagacuaguacccaaaauagcuacuagaaguaagguaaacggacaaucuggaagaauggaauuuuuuugggcaauacuaaaaccaaacgaugcaauaaacuucgaaaguaacggaaacuucauagcacccgaauacgcauauaaaauaguaaaaaaaggagauagugccauaaugaaaagcgaacuagaauauggcaacuguaauacaaaaugccaaacaccaaugggagccauaaauucaucaaugccauuccacaacauacacccacuaacaauaggagaaugcccaaaauacguaaaaucaaacagacuaguacuagcaacaggacuaagaaauagcccacaaagagaaagcagaagaaaaaaaagaggauuauucggagccauagcaggauuuauagaaggaggauggcaagguaugguagauggaugguaugguuaucaucacucaaacgaacaaggaagcggauaugcagccgacaaagaaucaacucaaaaagcaauaggagucaccaacaaaguaaacucaauaauagacaaaaugaacacacaauucgaagcagucggaagagaauucaacaauuuggaaagacgaauagaaaacuuaaacaaaaagauggaagacggauuucuagauguauggacauauaacgcagaauuacuaguccuaauggaaaacgaaagaacucuagacuuccacgacuccaacgucaaaaauuuauacgacaaagugagacuacaacuacgagacaacgcaaaagaauuaggaaacgguugcuuugaauucuaccauaaaugugacaaugaauguauggaaagcauaagaaauggcacauacaacccacaauauuccgaagaagcuagauuaaaaagagaagaaauaucaggcgucaaacuagaaucaauaggaacauaucaaauucuaagcauauacaguacuguugcgaguagucuagcauuagcaauaaugaucgcaggcuuaagccuauggaugugcucaaacggaucacuucaaugccgcauauguaua

SEQ ID NO: 51286 - RNA, 1698 nt, Artificial Sequence
  derived and/or modified sequence opt6 from anti-influenza_Chain
augaaagcaauauuaguaguacuacuuuacacauucgcaacagcaaaugcagacacacuaugcauuggcuaccaugcaaauaacucaacagacacuguagacacaguccuagaaaaaaauguaacaguaacacacucagucaacuuguuagaagacaaacacaauggaaaauuauguaaauuaagaggaguagccccacuacauuuaggcaaauguaauauagcaggauggauauuagguaauccagaaugcgaaagucuuagcacugcaucaagcuggaguuacaucguagaaacaagcuccucagacaacggaacauguuauccaggugacuucauagauuacgaagaacuaagagaacaauuaucaagcguauccaguuuugaaagauucgaaauauucccaaaaacaaguucauggcccaaccaugauucuaauaaaggaguaaccgcagcaugcccucacgcaggagcaaagucauucuauaaaaaucucauauggcucguaaaaaaaggaaacagcuacccuaaacuaagcaaaucauacauaaaugacaaaggaaaagaaguucuaguccuauggggaauacaucacccuucaacaagugcugaucaacaaagccuauaucaaaacgcagaugccuauguauuuguaggaacuucaagauauaguaaaaaauuuaaaccagaaauagcuauaagaccaaaaguacgagaccaagaaggaagaaugaauuacuacuggacucuaguagaaccaggagacaaaauaacauuugaagcaacaggcaaccuaguagucccacgauacgcauucgccauggaaagaaacgcaggaagcgguauaauuaucagugacacucccguucacgauugcaacacaacgugucaaacuccaaaaggagcaaucaauacaucacuaccauuccaaaacauccacccaauaacaauaggaaaaugcccuaaauacguaaaaucaacaaaacuucgacuagcaaccggucuaagaaauguaccaucaauacaaaguagaggacuauuuggagcaauagcaggauucauagaaggaggauggacaggaaugguagacggaugguaugguuaccaccaucaaaaugaacaaggaucaggauacgccgcagaccuaaaaagcacacaaaacgcaauagacgaaauuaccaacaaaguaaauucaguaauagaaaaaaugaacacacaauuuacagcaguaggaaaagaauucaaucaucuagaaaaaagaauagaaaacuuaaacaaaaaaguagacgacggauuccuagacauauggacguacaaugcugaacuacuuguacuauuagaaaaugaaagaacacucgacuaccacgacucaaauguaaaaaauuuauaugaaaaaguuagaagucaauuaaaaaacaaugcaaaggaaauaggaaacggaugcuucgaauucuaccacaaaugcgacaauacauguauggaaaguguaaaaaauggaacuuacgacuauccaaaauauagugaagaagcaaaacuaaaccgagaagaaauagacggaguaaaauuagaaucgacccggauauaccaaauacuugcaauuuauagcacaguagccucaagcuuaguacuaguaguaagcuuaggagcuauaucauucuggaugugcuccaauggcucacuacaaugucggauuuguaua

SEQ ID NO: 51287 - RNA, 1698 nt, Artificial Sequence
  derived and/or modified sequence opt6 from anti-influenza_Chain
augaaagcaauucuagucgucuuacuauacacauucgcaacagcuaacgcagacacucuaugcauaggauaccacgcaaauaacucuaccgauacuguagauaccguacuugaaaaaaacgucaccguaacccauaguguaaaucuacuagaagacaaacacaauggaaaacuaugcaaauuacgaggaguugccccauuacacuuaggaaaaugcaacauagcaggauggauacuagguaauccagaaugcgaaucacuaucaacagcaucaagcuggaguuacauaguagaaacaagcucaagugauaauggaacauguuauccaggagauuucaucgacuaugaagaacuaagagaacaacugucaucaguaaguuccuucgaaagauuugaaauauuuccaaaaacauccaguuggccuaaucaugacucaaauaaaggaguaacagcggcaugcccucaugcaggcgcuaaaaguuucuauaaaaaccuuauauggcuaguaaaaaaaggaaacucauacccaaaauuauccaaauccuauauaaacgauaaaggaaaagaaguacuaguacuauggggaauacaccacccaccaacaucagcagaccaacaaucacuauaccaaaaugcagacgcauacguauuuguagguucaucaagauauucaaaaaaauuuaaaccugaaaucgcaauaagaccaaaaguaagagaccaagaaggaagaaugaauuacuauuggacacuaguagaacccggagauaaaauaacuuuugaagcuacaggcaacuuaguuguaccacgcuacgccuucgcuauggaaagaaacgcaggcagcggaaucauaaucucugacacaccuguccaugacuguaauaccacaugccaaacaccaaaaggagcaauuaacacuucauuaccuuuccaaaacauccauccaauaacaauaggcaaaugcccaaaauacguaaaauccacaaaauugagacuugcaacagguuuaagaaacauaccaucuauacaauccagaggacucuucggugcaaucgcaggauucauagaaggaggauggacaggaaugguugacggaugguacggauaucaccaccaaaacgaacagggaucuggauacgcagccgacuuaaaaucaacacaaaacgcaauagacgaaauaacgaacaaaguaaacucaguaauugaaaaaaugaauacacaauucaccgcaguaggaaaagaauucaaucaccuagaaaaaagaauugaaaaccugaacaaaaaaguugaugacggcuucuuagauauauggacauacaaugccgaacuucuaguacucuuagaaaaugaacgaacucuagacuaccacgacucaaauguaaaaaaccuauaugaaaaaguacgaagccaacucaagaacaaugcaaaagaaauaggcaacggaugcuuugaauucuaucauaaaugcgauaacacaugcauggaaucugucaaaaacggaacauacgauuacccaaaguauucagaagaagcuaaacuuaauagagaagaaauagacggaguaaaacuugaaagcacaagaaucuaucaaauacuagccauauauucaacaguagcaucaucauuaguacuaguaguaagucuaggagcaauaucauuuuggauguguaguaacggaucccuacaaugcagaaucugcaua

SEQ ID NO: 51288 - RNA, 1698 nt, Artificial Sequence
  derived and/or modified sequence opt6 from anti-influenza_Chain
auggaaaaaaucguacuauuauuagcaauaguaucacuaguaaaaagugaccaaauauguauaggauaucacgcaaauaauucaacagaacaaguagauacaaucauggaaaaaaacguaacaguaacccacgcacaagacauacuagaaaaaacgcacaauggcaaacuaugugaucuagacggaguaaaaccccuaauauuaagagacugcuccguugcaggaugguuacuaggaaacccaaugugcgacgaauucauaaacgugccagaguggagcuacauaguagaaaaagcaaacccaaccaacgauuuaugcuacccaggaucuuuuaaugacuacgaagaauuaaaacaccuauuaucaagaaucaaucacuucgaaaaaauucaaaucauaccaaaaagcagcuggucugaccacgaagcuagcucaggagugucaucugcaugcccauaucucggaucaccaaguuucuuccguaacguaguaugguuaauaaaaaaaaacucaacauaucccacaauaaaaaaauccuauaacaacacaaaccaagaggaucuauuaguucuauggggaauacaccacccaaacgacgccgcagaacaaacaaggcuauaccaaaacccaaccaccuacauaaguaucggaacaucaacucuaaaccagcgauuaguaccaaaaauagcaacuagaagcaaaguaaacggccaaaguggaaggauggaauucuucugggcuauacuaaaaccaaaugacgcaaucaauuucgaaucaaacggcaauuucauagccccagaauacgcuuauaaaauaguaaaaaaaggagacucugcaaucaugaaauccgaacuagaauauggaaacuguaauacaaaaugccaaacaccaaugggagcaaucaauagcucgaugccauuccacaacauccauccauuaacaauaggugaaugcccaaaauacguaaaaaguaaccgauuaguauuagcaacaggucuaagaaacaguccacaaagagaaucaagaagaaaaaaacgaggacuauucggcgcaauagcaggauuuauagaagguggauggcaaggaauggucgauggaugguacggcuaccaccacucaaaugaacaagguucaggauaugccgcagauaaagaaucaacacaaaaagcaauaggagucacaaauaaaguuaauagcauaauagacaaaaugaauacacaauucgaagcaguaggaagagaauucaacaaucuugaaagaagaauagaaaaccuaaacaaaaaaauggaagacggauucuuagacguauggaccuacaaugcugaauuacuagugcuaauggaaaacgaaagaacacuagacuuucaugacucaaauguaaaaaacuuauacgacaaaguacgacuccaauuacgagacaaugcuaaagaacuaggaaacggaugcuuugaauucuaccacaaaugcgacaacgaaugcauggaaucaauaagaaacggaacguacaacccacaauacucagaagaagcaagacuaaaaagggaagaaauaaguggaguaaaacuagaauccaucggaacauaucaaauacuaucaaucuauuccacuguagcaucuuccuuagcacuagcaauaaugauagcaggacuaagcuuauggauguguucuaacggaucauuacaaugcagaauaugcaua

SEQ ID NO: 51289 - RNA, 1698 nt, Artificial Sequence
  derived and/or modified sequence opt6 from anti-influenza_Chain
augaaaacaauaauugcucuaucauacauacuauguuuaguauuugcacaaaaacucccaggaaaugacaauucaacagccacacuaugccuaggacaucacgcaguaccaaacggcacuauaguaaaaaccauaacaaacgaccaaaucgaaguaaccaacgcaacagaauuaguacaaagcucaagcacuggaggaaucugugacucaccccaucaaauacuagauggagaaaauugcaccuuaauagacgcacuuuuaggagacccccaaugcgacggauuccaaaacaaaaaaugggaccuauuuguugaacgaucaaaagcuuacagcaacugcuauccauacgacguaccagauuacgccuccuuacgcucacuuguagcaucauccggcacacuagaauuuaacaaugaaagcuucaacuggaccgguguaacccaaaacggaaccuccucagccuguaaacgacgaaguaauaauucauucuucagcagauuaaauuggcuaacacaucuuaaauucaaauauccagcauuaaacguaacaaugccaaacaacgaaaaauucgacaaauuauacauauggggaguccaucacccaggaacugacaacgaucaaauauccuuauaugcacaggcaagcggccgcauaacaguuagcacaaaaagaagucaacaaaccguaauaccaucaauaggcucacgaccaagaauaagagaugucccaucaagaauaagcaucuacuggacuauaguaaaaccaggagauauacuacuaauaaauucaacaggaaaccuuaucgcaccacgagguuauuucaaaauaagaucaggaaaaucaucaauaaugaggucagacgcuccaauaggaaaaugcaauucagaaugcauaacaccaaaugguuccauaccuaacgacaaaccauuccaaaauguaaauagaauaacauacggagcaugcccaagauacguuaaacaaaauacacuaaaacucgcaacaggaaugagaaauguaccagaaaaacaaaccagaggaaucuuuggagcaauagcaggcuucauugaaaacggaugggaaggaaugguggacggcugguacggauuuaggcaucaaaacucagaaggcacaggccaagcagcagaccuaaaaucaacacaagcagcuaucaaccaaauaaacggaaaacucaacagacuaaucggaaaaacaaacgaaaaauuccaccaaauagaaaaagaauucagugaaguagaaggacgcauucaagacuuagaaaaauauguagaagauacaaaaauagaucuuugguccuacaacgcagaacuuuuaguagcacuagaaaaucaacacacaauagaccugacugacucagaaaugaauaaacucuuugaaagaacaaaaaaacaauuaagagaaaaugcagaagacaugggaaaugguuguuucaaaauauaucacaaaugugacaacgcaugcauaggauccaucagaaacggaaccuacgaccacgacguauacagagacgaagcauuaaauaacagauuccaaauaaaaggaguugaauuaaaaucuggauauaaagacuggauacuuuggauaucauucgcaauaucaugcuuccuacucuguguagcauuacuaggauucaucaugugggccugucaaaaaggaaacauacgaugcaacauaugcauc

SEQ ID NO: 51290 - RNA, 1698 nt, Artificial Sequence
  derived and/or modified sequence opt6 from anti-influenza_Chain
augaaagcaauacuaguaguucuacuauacacauucgcaacggcaaaugcagacacauuaugcaucggcuaucaugccaacaauucaacagauacaguagacacgguucuugaaaaaaacguaacaguuacccacagcguaaauuuacuagaagauaaacacaauggaaaauuaugcaaacucagaggcguagcacccuuacaccuaggaaaaugcaacauagcgggauggauacuaggcaacccagaaugcgaaagucuaagcacagcaucaucauggucauacauaguagaaacaucaagcuccgacaauggaaccuguuaucccggugacuuuauagacuaugaagaauuaagagaacaauuaagcuccguaucaucauuugaaagauucgaaauauuuccaaagacauccaguuggccuaaucaugacucuaacaaaggugucacugcagcaugcccucacgcaggcgccaaaucuuucuauaaaaaucuuaucuggcuaguaaaaaaaggcaacucauaucccaaacuaaguaaaaguuacauaaacgauaaaggcaaagaaguccuaguauuauggggaauacaccacccaucaacaucagcagaccaacaaucucuauaccaaaacgcagaugccuacguauucguuggaaccucaagauauaguaaaaaauucaaaccugaaauagcaauaagaccaaaaguucgcgaucaagaagguagaaugaacuacuauuggacacuuguagaaccaggagauaaaauaacauucgaagcuacuggaaacuuaguaguaccaagauaugcauucgcaauggaaagaaacgcaggaaguggcauaaucauuucugacacaccaguacacgauugcaauacaacaugccaaacacccaaaggagcaauaaacacaaguuuaccauuucaaaacauacacccuauaacaauaggcaaauguccaaaauacguuaaaagcacaaaauuaagauuagcaacaggauuaagaaacguacccucaauacaaucaagaggacuauucggagccaucgccggauuuauagaaggaggauggacaggaaugguagauggaugguauggauaucaccaccaaaaugaacaaggaagcggauacgcggcagacuuaaaaucaacacaaaaugcaauagacgaaauaacgaauaaaguaaacucuguaauagaaaaaaugaacacacaauuuacagcaguaggaaaagaauucaaccacuuagaaaaaagaauagaaaauuuaaacaaaaaaguagacgacggauuuuuagacaucuggacauacaacgcagaacuacuaguacuacuagaaaaugaacgaacauuagacuaccaugauucuaacguuaaaaaccuauaugaaaaaguacgaucccaacuaaaaaacaaugcaaaagaaauaggaaauggaugcuucgaauucuaccauaaaugugacaacacaugcauggaaucaguaaaaaauggaacauacgauuacccaaaauacagugaagaagcaaaacuaaaccgagaagaaauagacggagucaaacucgaaucaacaagaauauaccaaauacuugcaauauacucaacaguggcuagcucuuuaguacuuguaguaucacuaggcgcaauuuccuuuuggaugugcucaaacggaucacuacagugcagaauaugcaua

SEQ ID NO: 51291 - RNA, 1698 nt, Artificial Sequence
  derived and/or modified sequence opt6 from anti-influenza_Chain
augaaagccauacuugucguacuacuauacacauuugcaacagcuaaugcagacacacuuugcaucggauaccacgccaauaacucaacagacaccguagauacaguauuagaaaaaaauguaacaguaacucacaguguaaaccuacuagaagauaaacauaacggcaaauuauguaaacuaaggggagucgcaccauugcaccuaggaaaaugcaacauagcaggauggauucuaggaaaucccgaaugugaaucauuaagcacagcauccucauggucauauauuguagaaacaucaucuucagacaacggaacauguuacccaggagacuucauagacuacgaagaacuaagagaacaacuaucaucgguaagcuccuucgaaagauuugagauauuucccaaaacaagcucauggccuaaccaugacucaaacaaaggaguaacagcugcaugcccccacgcaggagccaaauccuucuauaaaaaccuaauauggcuaguaaaaaagggaaacagcuacccaaaacuaucaaaauccuacauaaacgacaaaggaaaagaaguacuaguuuuauggggaauacaucauccuccaaccucagccgaucaacaaucauuauaccaaaaugcagacgccuacguuuucguuggaagcuccagauauucaaaaaaauucaaaccagaaauagccauaagaccgaaagugagagaccaagaaggaagaaugaauuacuauuggacacuuguagaaccaggagacaaaauaaccuucgaagcaacaggaaacuuaguaguaccacgauaugcauucgccauggaaagaaacgcaggaucaggaauaauaaucucagacacaccaguucaugacugcaacacaacaugccaaacaccaaaaggagccauaaacacaagucuaccauuccaaaauauccauccuauaacaauaggaaaauguccaaaauacguaaaaucaacaaaauuaagacuagccacaggacuaagaaauaucccuucaauacaaucacgcggccuuuuuggcgcaauagcaggauuuauagaaggaggauggaccggaaugguagauggcugguauggauaccaccaccaaaacgaacaaggaagcggauacgccgcagaucuuaaaaguacacaaaaugccauagacgaaauaacuaauaaaguaaacagcguaauagaaaaaaugaacacacaauucacagccguaggaaaagaauucaaccaucuugaaaaaagaauagaaaaccuaaacaaaaaagucgacgauggauuuuuagacauauggacauacaaugccgaacuccuugucuuauuagaaaaugaacgaacacucgacuaucaugacucaaacguaaaaaaccuauacgaaaaaguuagaucucaauuaaaaaacaacgccaaagaaauaggcaauggauguuucgaauuuuaccauaaaugugacaauacaugcauggaaucuguaaaaaauggcaccuacgacuauccaaaauauucagaagaagcaaaauuaaauagagaagaaauagacggcguaaaacuagaaucaacacgcauauaccaaaucuuagccaucuauaguacaguagcaucaagucuaguuuuaguaguaucuuuaggagccauauccuuuuggaugugcagcaacggaucauuacaaugcagaauaugcauc

SEQ ID NO: 51292 - RNA, 1698 nt, Artificial Sequence
  derived and/or modified sequence opt6 from anti-influenza_Chain
augaaaacaauaauagcacucaguuacauauuauguuuaguaucagcacaaaaauucccaggaaacgauaacagcacagcaacacuaugccuaggccaccacgccguaccaaacgggacaauaguaaaaacaauaacaaaugaccaaauagaaguaacaaaugccacagaacucguacaaucaagcagcacaggagaaauaugugacucaccccaccaaauacuagacggugaaaauugcacacuaauagacgcauuacucggugauccacaaugcgacggcuuccaaaacaaaaaaugggaucuauucguagaaagaucaaaagcauacucaaauugcuacccuuacgacguuccagauuacgcuucuuuaagaagucuaguagcuuccucaggaacauuagaauucaacaacgaaucauucaauuggacuggaguaacacaaaacggaacuagcucagccugcauaagaagaucaaacaacuccuuuuucucuaggcuaaacuggcucacacaucuaaaauucaaauacccagcuuuaaacguaaccaugccaaacaaugaagaauucgacaaacuauauaucuggggcguacaucaucccggaacagauaaugaccaaauauucuuauaugcccaagcaucuggaagaauuacuguaucaacaaaaagaagccaacaaacaguaauaccaaacauaagaagccguccacgcguaagaaauauaccaucacgaauaucuauuuacuggacaaucguaaaacccggcgacauauuacuaauaaauucaacaggaaaucuaauugccccacgaggauacuucaaaauaagaucugguaaaagcucaauaaugcgaucagaugcaccuauaggaaaaugcaacuccgaauguauaacaccaaacggaucaauaccaaacgauaaaccauuccaaaacguaaacagaauaacauacggagcaugcccacguuauguaaaacaaaauacauuaaaauuagccacaggaaugagaaacguaccagaaaaacaaacacgaggaauauuuggagcaauagcaggauuuauagaaaacggcugggaaggaaugguagacggaugguacggauuucgccaucaaaacagcgaaggaauaggccaagcugcagacuuaaaaucuacacaagcugcaauagaucaaauaaauggaaaauuaaacagacuaauaggaaaaaccaacgaaaaguuucaccaaaucgaaaaagaauucagcgaaguagaaggaagaauucaagaccuagaaaaauauguagaagacacaaaaauagacuuauggucauauaacgccgaacuacuugucgcacuagaaaaucaacacacgauagaucuaaccgacagugaaaugaauaaacuauuugaaaaaacaaaaaaacaacuaagggaaaaugcagaagacaugggaaauggaugcuucaaaauauaccacaaaugugacaacgcaugcauaggauccauaagaaacggaacauaugaucacgacguauacagagaugaagcacucaacaacagauuccaaauaaaagggguagaauuaaaauccggcuacaaagacuggauacuauggauauccuucgccaucaguugcuuccuauuaugcguagcacuacucggauucauaaugugggcaugccaaaaaggaaacauccgaugcaacauauguaua

SEQ ID NO: 51293 - RNA, 1698 nt, Artificial Sequence
  derived and/or modified sequence opt6 from anti-influenza_Chain
augaaaacaauaauagcacucagcuacaucuuaugccuuguauucgcacaaaaacuuccaggaaaugacaauucaaccgcuacucucugcuuaggucaucacgcaguaccaaacggaacaauaguaaaaacaauaacaaaugaucaaauagaaguaacaaaugccacagaauuaguacagucaucuucaacaggagaaauaugcgauagcccacaucaaauacuagauggagaaaacugcacucuaauagaugcacuucuaggagauccgcaaugcgacggauuccaaaauaagaaaugggaucuauucguagaaagaagcaaagccuacucaaauugcuauccauacgauguaccugacuaugcaucuuuacguagcuuaguagccucaucaggcacauuagaauuuaaaaacgaaucuuucaacuggacaggaguaacacaaaauggcacaucaagcgcaugcauacgcagaucaaauaacucauuuuucucaagauuaaacuggcuaacacaccuaaaauuuaaauaccccgcguuaaacgucacaaugccaaacaaagaaaaauuugacaaacuauauauaugggguguacaucacccaggaacagauaacgaucaaauauuccuauaugcacaagcaucaggaagaauaacuguaaguacaaaaagaucacaacaaacaguaaucccuaacaucgggucaagacucagaguucgagacauaccaagccgaauuucaauuuacuggaccauaguuaaaccaggagacauacuacuaauaaacucaacaggaaaucucauagcaccuagagguuauuucaaaauaagaaguggaaaaagcucaauaaugagaucagaugccccaaucggaaaauguaacagugaauguauuaccccaaacggaucaauaccaaaugacaaacccuuccaaaauguaaaccgaauaacauacggagcauguccaagauaugucaaacaaaauacacuuaaauuagcaacagguaugagaaacguaccagaaaaacaaacacgaggaauauucggagcuauagccgguuucauagaaaacggaugggaagguaugguagauggaugguacggauuccgacaucaaaacucagaaggaacaggacaagcggcggauuugaaaaguacacaagcagcaauagaucaaauaaacggcaaacuaaauagacuaaucgguaaaacaaacgaaaaauuccaccaaauagaaaaagaauuuucagaaguggaaggacgaauacaagaucuagaaaaauacguagaagacacaaaaauagaccuauggucauacaacgcagaacuauuaguagcacuagaaaaccaacacacaauagaccuuacagauucagaaaugaauaaauuauucgagaaaaccaagaaacaauuaagagaaaacgcagaagacaugggaaauggaugcuucaaaauauaccauaaaugugacaacgccugcauuggaucaauaagaaacggaacauaugaccaugacguauaccgagaugaagcacuaaacaacagauuucaaauaaaaggaguagaauuaaaaucaggcuauaaagauuggauauuauggauaucauucgccaucucaugcuuccuacuuugcguagcauuauugggauucauaaugugggcaugccaaaaagguaacauaagauguaacaucuguaua

SEQ ID NO: 51294 - RNA, 1698 nt, Artificial Sequence
  derived and/or modified sequence opt6 from anti-influenza_Chain
augaaaaccauaauagcauuaucauauauccuaugucucguguucgcacaaaaauuaccgggcaaugauaacaguacagcaacauuaugccuaggccaucacgcagucccaaacggaacaauugucaagacaauaacuaacgaccaaauagaaguaacaaacgccacagaauuaguacaaucaagcuccacaggagagauaugcgacucaccacaccaaauacuagacggagaaaauuguacuuuaauugacgcacuauuaggagacccacaaugcgacggauuucaaaacaaaaaaugggauuuauucguagaaagaucaaaagccuauucaaaauguuauccauacgacguaccagacuacgcaagcuuaagaucucuaguagcuucaucaggaacacuagaauucaauaaugaauccuucaauuggacuggagucacacaaaauggaacauccucagcaugcauccguaggaguaacaacucauuuuuuucaagacuaaauuggcuaacucaccuaaaauucaaauacccagcauuaaauguuacaaugccaaacaaugaaaaauucgacaaauuauacauauggggaguacaccacccaggaacagauaaugaucaaauauuccuauacgcacaagccagcggaagaauaacaguguccacaaaaagaucacaacaaacaguaaucccaaacauagguucaagaccaagaguaagagauauaccaagccgaaucucaauauacuggacaauaguaaaaccuggagacauacucuuaauaaauucaacaggaaaccucauagcaccaagaggauacuuuaaaauacgaucaggcaaaucuucaauaaugagaucagacgcacccauagguaaaugcaauucagaauguauuacuccaaacggaucaauaccaaaugauaaaccauuccaaaaugucaaucgaauaacuuacggagccuguccgcgauacguaaaacaaaauacauuaaaacuugccacagguaugagaaacguaccugaaaaacaaaccagaggaauauucggagcaauagcaggauucauagaaaacggaugggaagguaugguagauggaugguacggauuccgacaucaaaauagugaaggaaucggacaagccgcagaccuaaaaagcacacaagcagcaauagaccaaauaaacggaaaacuaaaucgauuaauaggaaaaacaaaugaaaaauuucaccaaauagaaaaagaauucucagaaguagagggaagaauacaagacuuagaaaaauacgucgaagacacaaaaauagaccuuuggucauauaaugcagaauuacuuguagccuuagaaaaucaacacacaauagauuuaacugauagcgaaaugaacaaacuguuugaaaaaacuaaaaaacaacuaagagaaaacgcagaagauaugggcaacggauguuucaaaaucuaccacaaaugugacaacgcaugcauaggcucaauucgaaacggaacauaugaccacgacguauauagagacgaagcacuaaacaaucgauuucaaauaaaaggaguagaacuaaaaagcggauacaaagacuggauccucuggauaucauuugccauaagcuguuuucuauuaugcguagcacucuuaggauucauaaugugggcaugccaaaaaggaaauauacgaugcaauauaugcauc

SEQ ID NO: 51295 - RNA, 1698 nt, Artificial Sequence
  derived and/or modified sequence opt6 from anti-influenza_Chain
augaaaacaauaauagcacuaucauauauauuaugucuaguauucgcacaaaaacuuccuggaaacgacaacaguacagcaacguuaugcuuaggacaccaugccgucccaaauggaacaaucguaaaaacgauaacuaacgaccaaaucgaagucacaaacgcuacagaauuaguccaaucaucaucaaccggagaaauuugugacucuccacaucaaauacuagacggagaaaauugcacucuaauagaugcccuauuaggagauccacaaugugacggcuuccaaaacaaaaaaugggaccuauuuguagaaagaagcaaagccuacucuaauugcuacccauacgauguaccagacuacgcauccuuaagaucucuagucgcaucaucaggaacauuagaauucaacaaugaaucauuuaacuggacaggaguaacccaaaacggcacaucaagcgcaugcauaagacgaucaaacaacucauuuuucucacgauuaaauugguuaacucauuuaaaauucaaauacccagcacucaacguaacaaugccaaauaaugaaaaauucgacaaacuauauauaugggguguacaccacccaggaacugacaaugaucaaauauuuuuauacgcacaagcuaguggcagaauaacaguaagcacaaaaaggucacaacaaacuguaauuccaaauauaggaucaagaccacgaguaagaaacauaccuucucgaauaucaauauacuggacaaucguaaaaccuggugacauacuccuaauaaacucaacaggaaaccuaaucgcuccaagagguuauuucaaaauaagaucaggaaaaucaucaauaaugagaucagacgcaccaauaggaaaauguaacucugaaugcauaacucccaacggaucuauuccuaacgacaaaccauuccaaaacguaaaucgaauaacauacggagcaugccccagauaugucaaacaaaacacauuaaaauuagcaacaggaaugagaaacguaccagaaaaacaaaccagaggaaucuuuggagcaaucgcaggcuuuauugaaaauggaugggaagguauggucgacgguugguacggauucagacaucaaaacucagaaggaaucggccaagcagcagaccuuaaaucaacacaagcagcaaucgaccaaauuaacggaaaacuaaacagauuaaucgggaaaacaaacgaaaaauuccaccaaauagaaaaagaauucucagaaguagaaggccgaauacaagaucuagaaaaauaugucgaagauacaaaaauagaccuuuggucauauaaugcagaauuacuaguagccuuagaaaaccagcacacaauagauuuaacagacucagaaaugaacaaauuauucgaaaaaacaaaaaaacaacuuagagaaaaugcagaagacaugggaaacgguugcuucaaaauauaucauaaaugugacaacgcaugcauaggaucaauaagaaauggaacauacgaccacgacguauacagagacgaagcacuaaauaauagauuccaaauaaaaggagucgaacuaaaauccggauauaaagacuggauauuauggauaucuuucgccauaagcugcuuucuccuaugcguugcauuacuaggauucauaaugugggcaugccaaaaagguaacauaagaugcaacauuugcaua

SEQ ID NO: 51296 - RNA, 1698 nt, Artificial Sequence
  derived and/or modified sequence opt6 from anti-influenza_Chain
augaaaacaauaauagcauuaaguuacauauuaugccuuguauucucacaaaaauuaccaggcaaugauaacuccacagcaacacuauguuuaggacaccaugcagucccaaacgguacgauaguaaaaacaauaacaaacgaucaaaucgaaguaacaaacgcaaccgaauuaguccaaaguucaaguacaggaggaauaugcgacucaccucaccaaauacuggauggagaaaacugcacauuaaucgaugcacuacucggagacccucaaugcgauggauuccaaaacaagaaaugggaccuauuuguagaacgaucaaaagcauauucaaauugcuacccauaugacguuccagauuaugcuagcuuacgaagccuaguagcaucaucaggaaccuuagaguucaacaaugaaucauucaacugggccgguguaacacaaaauggaacaucgucagcaugcaaacgaagaucaaacaagagcuucuucaguagacuaaauuggcuaacacaccuaaaauacaaauacccagcucuaaauguaacaaugccaaacaaugaaaaauuugauaaacuauacaucuggggaguacaucacccuguuacagacucggaccaaauaagccuauaugcccaagcaaguggacgaauaacaguaaguacaaaacgcucacaacaaacagugauacccaauauaggauacagacccagagucagagacauaagcucaagaauaucaauauacuggacaauaguaaaaccaggagacauacuauuaauaaacaguacaggaaacuuaauagcaccuagagguuacuucaaaauuagaucagguaaaagcagcauaaugagaucugacgcgccaauagguaaauguaacagugaaugcauaacaccaaauggaucaauaccaaacgauaaaccauuccaaaacguaaacagaauaacuuacggagcaugcccacgcuaugucaaacaaaacacccuaaaacucgcaacaggaaugagaaauguaccugaaaaacaaacaagaggaauuuuuggagcaauagcaggcuuuauagaaaacggaugggaaggaaugguagauggaugguacggauuuagacaccaaaacucagaaggaacaggacaagcagcagaccuaaaaucaacacaagcagccauaaaucaaauaaauggaaaauuaaauagacuaaucggaaaaacuaaugaaaaauuccaccaaauagaaaaagaauuuucagaaguagaaggacgaauacaagacuuagaaaaauacguagaagauacaaaaauagaccucuggucauacaacgcagaacuccuaguagcccucgaaaaucaacauacaauagaccucacagacagugaaaugaacaaacuauucgaaagaacuaagaaacaacuaagagaaaaugccgaagacaugggaaauggaugcuuuaaaauauaccauaaaugcgacaacgcuugcauagaaucaauuagaaacggcacauacgaucacgauguauauagagacgaagcacuaaauaacagauuccaaauaaaaggagucgaacuaaaaucaggauacaaagauuggaucuuauggauaucauucgcuauaucauguuuccuauuaugcguagcuuuacucggauuuauuaugugggcaugccaaaaaggaaacaucaggugcaauauaugcaua

SEQ ID NO: 51297 - RNA, 1698 nt, Artificial Sequence
  derived and/or modified sequence opt6 from anti-influenza_Chain
augaaaacaauaauagcacugucauacauauuaugccuagucuucgcacaaaaacuaccaggaaacgacaacucaacagcaacauuaugccuaggacaccacgcuguaccaaacggaacuaucguaaaaacaaucacaaacgaccaaauagaaguaacuaaugcaacagaauuaguucaaaguucaaguacagguggaauaugcgacucaccacaccaaauauuagacggcgaaaauugcacucucaucgaugcauuauuaggggacccacaaugugacggauuccaaaacaaaaaaugggauuuauucguagaaagaucaaaagcauacagcaacuguuacccauacgacgugcccgauuacgcuucauuacgaucacuaguagcauccuccggaacacuugaauuuaaugaugaaucauuuaauuggacaggaguaacacaaaauggaacaucaaguucaugcaaaagacgaucaaacaauucauucuucucaagacuuaacuggcugacacauuuaaaauucaaauacccugcacuaaacguuacaaugcccaacaacgaaaaauuugacaaacuauacauauggggaguacaucacccuguuacagacaaugaucaaauauucuuauacgcacaagccucaggccgaauaaccguaucuacaaaaagaucacaacaaacgguuauaccaaacauaggaaguagaccaagaauacgaaauauaccaaguagaauaucaauauauuggaccaucguaaaaccuggugauauauuacucauaaacagcacaggaaaucuaaucgcuccaagagguuacuucaaaauaagaagcggaaaaucaucaauaaugcgaucagacgcaccaauaggcaaaugcaacagcgaauguauaacacccaauggaucaauaccaaacgacaaaccauuccaaaauguuaacagaauaacuuacggcgcaugccccagauacguaaaacaaaauacauuaaaacuagccacaggaaugagaaauguucccgaaaaacaaacacgaggaauauucggagcaaucgcgggcuucauagaaaacggaugggaaggaaugguagacggcugguacggauuuagacaucaaaauucagaaggaauagggcaagcagcagaccucaagucaacacaagcagcaauaaaccaaauuaauggcaaacuaaacagacuaauaggaaaaacaaacgaaaaauuccaccaaauugaaaaagaauucuccgaaguggaaggaagaauccaagaccuagaaaaauacguagaagauacaaaaauagaucuuuggucauauaaugcugaauuacuaguggcuuuagaaaaccaacauacuauugacuuaacagacucagaaaugaacaaacuauucgaacgaacaaaaaaacaauuaagagaaaacgcagaagacaugggaaacggauguuucaaaauauaccacaaaugcgacaaugccugcauaggcucaauacgaaacggaacuuacgaccacgauguauauagagaugaagcacuaaacaacagauuccagauaaaaggaguagaacuaaaaucuggcuauaaagacuggauauuauggauaagcuucgcaaucucaugcuuuuuacuauguguugcauuacucggauucauaaugugggcaugccaaaaaggaaacauaagauguaacauauguaua

SEQ ID NO: 51298 - RNA, 1683 nt, Artificial Sequence
  derived and/or modified sequence opt6 from anti-influenza_Chain
auggaaaaaauaguacuacuauucgcgauaguaucauuaguaaaaagcgaccaaauaugcauaggguaccaugcaaacaacucaacagaacaaguugacacaauuauggaaaaaaauguuacaguaacccaugcacaagauauauuagaaaaaacacacaaugguaaacucugcgaucuagaugguguaaaaccacuaauauuacgagacugcucaguagcaggauggcuacuaggaaauccaaugugcgaugaauucauaaacguaccagaauggucauacauaguggaaaaagcaaauccugucaacgaccuuuguuauccaggagauuuuaaugauuacgaagaauuaaaacaucuauuaagccgaauaaaccauuucgaaaaaauacaaauaauaccaaaaaguaguuggucaagucacgaagcaucacuaggcguuucaucagcauguccauaccaaggaaaaucaucauuuuuccgcaacgucguauggcuaauaaaaaaaaacuccacauacccaacuauaaaacgaucauacaauaacacaaaccaagaggaccuguuagucuuauggggcauacaucacccaaaugacgccgcagaacagacaaaacucuaccaaaauccaacaacauacauaucaguaggaaccucaaccuuaaaccaacgacuaguaccaagaauugcaacuaggagcaaaguaaauggccaaaguggcagaauggaauucuuuuggacuauauuaaaaccuaaugaugcaauaaacuucgaaucaaauggcaauuuuauagccccagaauacgcauauaaaaucgugaaaaaaggagacucaacaauaaugaaaucagaacuugaauacggcaacugcaacacaaagugccaaacaccaaugggugcaauaaauagcuccaugcccuuccacaacauacacccauuaaccauaggagaaugcccuaaauacguaaaaagcaacagauuaguacuagcaacgggacuacguaauagcccacaaagagaaagaagaagaaaaaaaagaggccucuuuggagcaauagcaggcuuuauagaaggaggcuggcaaggaaugguagaugguugguacggguaccaucauucaaaugaacaaggaucaggauaugcagcagauaaagaaagcacacaaaaagccauagacggaguaacaaacaaaguaaacucaauaauagacaaaaugaacacacaauucgaagccguaggaagagaauucaauaaccuagaaagacgaauagaaaaccuaaauaaaaaaauggaagacgguuucuuggacgucuggacauauaacgcagaacuacuagucuuaauggaaaacgagagaacauuagacuuccacgauucgaacguaaaaaaccuauacgacaaaguacgcuuacaauuaagagacaacgcaaaagaacuaggaaacggaugcuucgaauucuaucacaaaugugacaacgaauguauggaauccguaaggaacggaacauacgacuacccacaauauucagaagaagcacgacuuaaaagggaagaaaucucaggaguaaaacuagaaucaaucggcauauaccaaauacaacacaguggaggacgaagcucauuagaaggaccacgauuugaacaaaaacuaauaucagaagaagaucuaaacaugcacacagga

SEQ ID NO: 51299 - RNA, 1683 nt, Artificial Sequence
  derived and/or modified sequence opt6 from anti-influenza_Chain
auggaaaaaauuguauuauuacuagcaauuguaagucucguaaaaucagaccaaauaugcauaggauaccaugcaaacaacucaacagaacaaguagauaccauaauggaaaaaaauguuacuguuacccaugcacaagauauacuagagaaaacacauaaugguaaauuaugugaucuagacgguguaaaaccauuaauauuaagagauuguucaguugcagguuggcuacuaggaaacccaaugugugacgaauucaucaacguaccagaauggucauacauaguagaaaaagcuaacccugcaaaugaucuauguuaucccggcaacuuuaacgacuacgaagaacuaaaacaccuacuaagcaggauaaaccacuucgaaaaaauacaaauaauccccaaaucuucauggagugaccacgaagcaucaucaggcguaucauccgccugcccguaucaagguaaaucaucauuuuucagaaacgucguaugguuaauaaaaaaaaacucaucauacccaacaauaaaaagauccuauaacaacacaaaucaagaagaccuauuaguacuauggggaauacaucacccaaacgaugcagcagaacaaacucgauuauaucaaaacccaacaacuuacauaucuguaggaacaagcacccuaaaccaaagauuagucccaaaaaucgcaacuagaagcaaaguaaacggacaaucaggcagaauggaauucuuuuggacaauccuaaaaccaaacgacgcaauaaacuucgaaagcaacggaaacuucauagcaccagaauacgcauacaaaauuguaaaaaaaggagacucagccauaaugaaaagcgaacuagaauacggaaauuguaacacaaaaugccaaacaccaaugggugccauaaauucaagcaugcccuuccacaacauacauccacuaacuauaggagaaugcccaaaauaugucaaaagcaacagacuaguacuagcaacaggguuaaggaauucaccacaaagagaaagaaggagaaaaaaaagaggauuauucggagcaauagcuggauucauagaaggaggauggcaaggaaugguagacggaugguacggauaucaccacucaaacgaacaaggaagcggguaugcagcagacaaagaaucaacgcaaaaagcaauagacgguguaacaaacaaaguaaauagcauaauagauaaaaugaauacucaauuugaagcaguaggaagagaauucaacaacuuagaaagaagaauagaaaacuuaaacaaaaaaauggaagacggauucuuagacguauggacauacaacgcagaacuacuaguauuaauggaaaacgaaagaacuuuagacuuccacgacucaaacguaaaaaacuuauaugauaaaguaagacuacaacuaagagauaacgcaaaagaauuaggaaacggaugcuucgaauucuaucauaaaugugauaaugaaugcauggaaucaguuagaaacgggaccuaugauuacccacaauauucagaagaagcaagauuaaaacgagaagaaauauccggcguaaaauuagaaaguauagggauauaccaaauacagcauucaggaggaagaucuucuuuagaaggaccaagauucgaacaaaaacuaauaagcgaagaagaccuaaauaugcauacagga

SEQ ID NO: 51300 - RNA, 1701 nt, Artificial Sequence
  derived and/or modified sequence opt6 from anti-influenza_Chain
auggaaaaaauaguauuauuacuagcaaucguaaguuuagucaagucugaucaaauuuguauaggguaccaugcaaacaauucaacagaacaaguagacacaauaauggaaaaaaacguaacuguaacacacgcacaagauauauuagaaaaaacccauaacgguaaacuaugcgacuuagacggcguaaaaccacucauacuaagagauugcucaguagcgggaugguuauuaggcaauccaaugugcgacgaauucauaaauguaccagaauggucuuacauaguagaaaaagcaaauccagcaaaugacuuaugcuauccuggaaauuuuaacgacuacgaagaacuaaaacauuuauuaucaagaauaaaccacuucgaaaagauacaaauaauaagcaaaucaaguuggagugaccacgaagccucauccggcguaagcucagccugcccauaccaagggacaccaucauucuucagaaacgucguuuggcucauaaaaaaaaacaacaccuacccaacaauaaaaagaaguuacaacaacacaaaccaagaagauuuacuaauauuauggggaauacaucacagcaacaacgccgcagaacaaacaaaacucuaccaaaauccaacaacauauauaaguguaggaacauccacauuaaaccuaagacuaguaccaaaaauagcaacaaggaguaaaguaaacggacaaucaggaagaauggacuucuucuggaccauacuaaaaccaaaugaugcuauaaacuucgaaucaaacggaaauuucauagcaccagaauacgcauauaaaauaguaaaaaaaggagacucagcaauaaugaagagugaaguugaguauggaaacuguaacacaaaaugccaaaccccaauaggagcaauaaauucaucaaugccauuccacaacauacacccacuuacaauaggagaauguccaaaauacguaaaaucaaacaaauuagugcuugcaacaggauuaagaaacuccccacugagagaaaggcgacgaaaaaggggacuauuuggagcgauagcaggcuucauagaaggaggauggcaaggaauggucgacggaugguacggguaucaccauucaaaugaacaaggaucaggauaugccgcagacaaagaaucaacucaaaaagcaauagacggagucacaaacaaaguaaacucaauaaucgacaaaaugaacacucaauuugaagcaguaggaagagaauucaacaaccucgaacgaagaauagaaaaccuaaauaaaaagauggaagacggauucuuagacguauggaccuacaaugcagaacuacuaguccuaauggaaaacgaaagaacucuagauuuccacgauagcaacguaaaaaacuuauacgauaaaguaagauuacaacucagagacaacgcaaaagaauuaggaaauggaugcuuugaauuuuaccauaaaugcgacaacgaaugcauggaaagcguacgaaauggaacauaugauuacccucaauacagugaagaagcaagacuaaaacgagaagaaauaucaggagucaaacuagaaaguauaggaacauaucaaauacuaagcauauauaguacugucgcuagcucacuagcacuagcuauaaugguugcuggauuaucacuauggaugugcucaaacggaagcuuacaaugcagaauuugcaua

SEQ ID NO: 51301 - RNA, 1701 nt, Artificial Sequence
  derived and/or modified sequence opt6 from anti-influenza_Chain
auggaaaaaaucguauuacuucuugcaauaguaucauuaguaaaaagugaucaaauauguauaggauaccacgcaaacaauaguacagagcaaguagacacaauaauggagaaaaauguaacagucacccacgcacaagacauccuagaaaaaacacauaacggcaaauuaugugacuuagacggaguaaaaccuuuaauauuacgggacugcucaguagcuggcugguuauuaggaaacccuaugugugaugaauucaucaauguuccggaauggucauacauugucgaaaaagccaacccagccaacgaccuauguuauccaggaaauuucaacgacuacgaagaauuaaaacaucuauuaagucgaauaaaucacuucgaaaaaauacaaaucauaccaaaaagcagcuggagugaccacgaagccaguagcggagucucaagugcuugcccauaucaaggaaccccaucauucuucagaaacguaguauggcucauaaaaaaaaacaacacauaccccacaauaaaacgaagcuacaauaauacuaaccaagaagaccuacuaauccuauggggaauccaccauagcaacgacgcagcugaacaaaccaaacuauaccaaaauccaacaaccuacauaagcguagguacaucaacacuaaaccaaagauuaguuccaaaaauagcaacaagguccaaaguaaauggacaaucuggacgaauggacuucuucuggaccauacucaaaccaaaugacgcaauaaauuucgaaaguaauggaaacuuuauagcaccagaauacgcauacaaaauaguaaaaaaaggagacagcgcaauagucaaaucagaaguagaauauggaaauugcaacacaaaaugucaaacaccaaucggagcaauaaacucaucaaugccauuucauaacauacacccacuaacaauaggugaaugcccaaaauacgucaaaucaaacaaauuaguacuugcaacaggcuuaagaaauucaccacuaagagaaagaagaagaaaaagaggacuuuucggggcaauagcaggauucauagaaggaggcuggcaaggaaugguugauggaugguauggauaccaccacucaaaugaacaaggaaguggcuaugcagcggacaaagaaaguacacaaaaagcaauagaugguguaacaaauaaagucaauagcauaauagauaaaaugaauacacaauucgaagcaguaggaagagaauuuaacaaucuagaacgcagaauagaaaauuuaaauaaaaaaauggaagacggauucuuagacguauggacauauaaugcagaacuacuaguacucauggaaaaugaacgaacacuagauuuucaugacucaaaugucaaaaaccuauaugacaaaguaagauuacaauuaagagacaacgcaaaagaauuaggaaacggcuguuuugaauuuuaccacaaaugcgacaacgaaugcauggaaucaguaagaaacggaacauaugacuacccacaauacucagaagaagcaagacuaaaaagagaagaaauuuccggaguaaaacuagaaucuaucggcacuuaccaaauccuaucaauauacaguacaguagcuucuagucuagcauuagcaauaaugguagcuggacuaaguuuauggaugugcucaaacgggucuuuacaaugcagaauauguaua

SEQ ID NO: 51302 - RNA, 1683 nt, Artificial Sequence
  derived and/or modified sequence opt6 from anti-influenza_Chain
gauaaaauauguuuaggucaccaugcgguaucaaauggaacaaaaguuaauacauuaacagaaagaggcgucgaaguagucaaugcuacagaaacuguagaaagaacaaauguaccaagaauaugcucaaaaggaaaaagaacaguugauuuaggacaauguggauuauuaggaacaauaacugguccaccacaaugugaucaauuucuagaguucagugcagaucugauuauagaaagaagagaaggaucggacguauguuauccuggaaaauuuguaaaugaagaagcauugagacaaauacuaagagaaagcgguggaauugacaaagaaacaaugggauuuacauacucaggaauacgaacaaacgguacaacaagugcaugucggaggaguggcaguucauuuuaugccgaaaugaaaugguuacuaucaaauacugacaaugcagcuuucccacagaugacaaaaucauauaaaaauacacgaaaagauccggcauugauaauauggggaauacaccauucagguaguacaacagaacaaacaaaauuauauggcucaggaaauaaacuuauaacaguaggcagcucaaauuaucaacagaguuucgucccaaguccaggagcaagaccccaaguaaauggacaaucaggaagaauagauuuccacugguuaauauuaaauccaaaugacacugugacauuuucauuuaauggagcauuuaucgcaccagauagagcaaguuucuuaagaggaaagucaauggguauucaaucagaaguacaaguagaugcaaauugugaaggagacuguuaucauagugguggaaccauaauaucaaacuugccauuucaaaauauaaauucaagagcuguaggaaaaugcccaagguaugucaaacaagaaucuuuauuauuagcaacuggaaugaaaaauguaccggaaauaccgaaaagaagaagacgaggacuauucggugcaauagcugguuucauugaaaauggaugggaaggccucaucgauggcugguacgguuucagacaccaaaaugcucaaggugaagguacagcagcagacuauaaaaguacacaauccgcgauagaccaaaucacuggaaaguuaaauagauuaauagagaaaacaaaucagcaauuugaauuaauagauaaugaauuuacagaaguagaaagacaaauaggaaacguaauaaacuggacaagagauucaaugaccgaaguauggaguuauaaugccgaauuauuagucgcaauggaaaaucaacauaccauagaucuagcugacagugaaaugaacaaacuauaugaaagaguuaaaagacaauuaagagaaaacgcagaagaagaugggacaggauguuuugaaauauuccauaaaugugaugaugacuguauggcguccauaagaaauaauacauaugaccauucaaaauacagagaagaagcaauccaaaauagaauacaaauagacccaguaaaauuaucaucaggauacaaagacucaggccgauuagugccaagaggaaguccuggaaguggguacauaccagaagccccacgagacggacaagcauauguucgaaaagauggugaauggguacucuuaagcacuuuccuugguaaaccaauaccaaauccucuucuaggucuagacaguacaggc

SEQ ID NO: 51303 - RNA, 1701 nt, Artificial Sequence
  derived and/or modified sequence opt6 from anti-influenza_Chain
auggagaagauaguucuacuacuagcaauaguaucacuaguaaaaagcgaccaaaucuguauaggauaucacgcaaacaacaguaccgaacaaguagacacaauaauggaaaaaaacgucacaguaacacacgcacaagacauacuagaaaaaacccacaacggaaaauuaugugaccuagauggaguaaaaccccuaauacuaagagacugcagcguagcaggauggcuucuaggcaacccaaugugcgacgaauucauaaauguaccagaauggucauauauaguugaaaaagcaaaucccgcaaaugaccuaugcuacccaggaaacuucaacgauuaugaagaacuaaaacacuuauugucaagaauuaaucacuuugaaaaaauacaaauaauaccuaaaaguucuuggucagaucaugaagccaguagcggcguaagcagugcauguccuuaucaagguacgcccucuuucuucagaaacguaguauggcuaaucaaaaaaaauaauacauacccaacaauaaaaaggucauacaacaacacaaaccaagaagauuuacuaauacuaugggggauacaccacagcaaugacgcagcagaacaaacaaaauuauaucaaaaccccacaacauauauuucaguaggaacaucaacauuaaaucaaagauuaguaccaaaaauagcaacaagaucaaaaguaaacggccaaaacggaagaauggacuuuuucuggacuauauuaaaacccaacgacgcgauaaacuucgaaucaaacggaaacuucauagcaccagaauacgccuacaaaauaguaaaaaaaggagacagcgcaauaguaaaaagcgaaguugaauacggaaauugcaacacaaaaugccaaacaccaauuggugcaauaaacaguagcaugcccuuucacaacauccacccacucacaauuggagaaugcccaaaauacguaaaaucaaauaaauuaguauuagcaacaggauuaagaaacuccccacuaagggaacgacgaagaaaaagaggacuauucggagcaauagcuggguuuaucgaaggagguuggcaaggaaugguagauggaugguauggauaccaucacaguaacgaacaaggaaguggcuaugccgcagacaaagaaaguacucaaaaagcaauagacggaguaacaaacaaaguaaauucaauaaucgauaaaaugaacacacaauuugaagcaguaggaagagaauuuaauaaccuagaacgaagaauagaaaaccuaaacaaaaaaauggaagacggauucuuagacguauggacauacaaugcagaacugcuaguacuuauggaaaacgaacgaacccuagacuuucaugacucaaacguuaaaaaccuauaugacaaaguuagacuacaacuaagagacaacgcaaaagaauuaggaaacggaugcuucgaauuuuaccacaaaugcgauaacgaauguauggaaaguguacgaaacggaacauacgacuauccucaauauucagaagaagcaagacuaaaaagagaagaaauaucuggagugaaauuagaaucaaucggaacuuaccaaauacucucaauauacucaacuguagccucaagccucgcacuagcaauaaugguagccggucuaucauuauggaugugcagcaauggaagucuacaaugcaggauaugcaua

SEQ ID NO: 51304 - RNA, 1683 nt, Artificial Sequence
  derived and/or modified sequence opt6 from anti-influenza_Chain
gauaagauaugucuaggucaccaugcaguaaguaauggaaccaaaguaaacacgcuaaccgaacgaggaguugaaguaguuaacgcaacagaaacgguugaaagaacaaauguaccaagaauauguucaaaaggaaaacgaacaguagauuuaggacaaugcggacuacuagguacaauaacaggaccaccacaaugugaccaauuuuuagaauuuucagcagaucuaauaaucgaaagaagagaaggaagugaugugugcuacccaggaaaguuuguuaaugaagaagcauuaagacaaauauuaagagaaucaggcggaauagauaaagaaacaaugggguuuacuuauucaggaauaaggacuaaugggacaacaucagcauguagacgaucagguaguucauuuuacgcagaaaugaaauggcuauuaucuaacacagacaaugcagcuuuuccacagaugacaaaauccuauaaaaacaccaggaaagauccagcuuuaauaauauggggaauacaucauucaggaucaacaacagaacaaaccaaauuauauggaagcggaaacaaacucauaacaguuggaucaucaaacuaucaacaaucauuuguaccaucaccaggagcuagaccacaaguuaauggucaaucaggacguauagauuuucauugguuaauauugaacccaaaugauacaguaacauuuucauuuaauggagcauucauagcacccgacagagccucauucuuaagaggaaaaaguaugggaauacaaagcgaaguucaaguugaugcgaacugcgaaggagacuguuaccacuccggaggaacaauaauaucaaaccuaccuuuucaaaacauuaauagcagagcaguaggaaaauguccacgcuacguuaaacaagaaucauuauuacuugcaacaggaaugaaaaauguacccgaaauaccgaaaagacgaagaagaggacuauucggagcgauagcaggauucauagaaaauggaugggaaggauuaauagacggaugguauggcuuuagacaucaaaacgcucaaggcgaaggaacugcagcagauuauaaaucaacacaaucagcaauagaucaaauaacaggcaaacuaaauagacuuauagaaaagacaaaucaacaauucgaacuaauugauaaugaauuuacagaaguagaaagacagauugguaacgucauaaacuggacacgagauagcaugacugaaguuuggucauauaacgcagaacuauuaguagcuauggaaaaccagcauacaauagaccuagcagauagcgaaaugaauaaacuauaugaaagaguaaaaagacaacugagagaaaacgcagaagaagacggaacaggaugcuucgaaauauuucauaaaugcgacgacgacuguauggcaucaauaagaaauaacacauaugaucacucaaaauauagagaagaagcaauacaaaacagaauacaaauagaucccguaaaauuguccucaggauauaaagauucaggaagauuaguucccagaggaucaccuggcaguggauauauuccugaagcaccacgagauggacaagccuacguuagaaaagauggagaaugggucuuauuaucgacauuccuaggaaaaccaauaccaaacccacuucuaggccuagacucaaccgga

SEQ ID NO: 51305 - RNA, 1683 nt, Artificial Sequence
  derived and/or modified sequence opt6 from anti-influenza_Chain
auggaaaaaauaguacuauuauuugcaauaguaucacuaguaaaaucagaccaaauaugcauaggauaccacgcuaauaauucuacagaacaaguagacaccauaauggaaaaaaacguaacaguaacacacgcacaagacauucuggaaaaaacacacaacggaaaauuaugugauuuagacggcguaaaaccacuaauauuacgagacugcagcguagcuggcuggcuauuaggaaacccaaugugcgaugaauuuauaaauguacccgaauggucguacauaguugaaaaagcaaacccagucaaugaccuaugcuacccaggagauuuuaaugacuacgaagaacuuaaacauuuauuaagcagaauaaaucacuuugaaaaaauacaaauaaucccaaaaagcucauggucaucacaugaagcuagcuuaggaguaucaucagccugucccuaucaaggaaaaucaucauuuuucagaaauguagucuggcuuauaaaaaaaaacucaacauacccaacaauaaaacgaaguuauaauaauacaaaucaagaagaccuacuuguacuauggggaauccaccaucccaacgacgcagcugaacaaacuaaauuauaucaaaacccaaccacauauauaucuguagguacaaguacacuaaaccaaagauuggucccaagaauugccacaagaucaaaaguaaauggccaaucaggaagaauggaauuuuuuuggaccauacuaaaacccaacgaugcaauaaacuuugaaucuaauggcaauuucauagccccagaauaugcauacaaaauugucaaaaaaggugauucaacaauaaugaaaucagaacuagaauacggaaauugcaauacaaaaugccaaacaccaaugggugcuauuaacucaucaaugccuuuccacaacauacacccacuaacaauuggagagugcccaaaauacguuaaaaguaauagacugguucucgccacaggauuacgaaacaguccacaaagagaaagaagaagaaaaaaaagaggacucuucggagcaauagcaggauuuauagaaggaggauggcaaggcaugguagacggaugguauggauaucaccacucaaacgaacaaggauccgguuacgcagcagacaaagaaucuacacaaaaagcaauagacggaguaacaaauaaagucaacaguauaauugacaaaaugaacacacaauuugaagcuguaggcagagaauucaauaacuuagaaagaagaauagaaaaccuaaacaaaaaaauggaagacggauuuuuagaugucuggacauauaacgcagaacuacuaguucuuauggaaaacgaacgaacauuagacuuucacgacucaaacguaaaaaaucuauacgacaaagucagacuacaauuaagggauaacgccaaagaacuaggcaacggauguuuugaauucuaccauaaaugcgauaacgaaugcauggaaucaguaagaaacggcacauaugacuacccacaauacucagaagaagcaagacuaaaaagagaagaaauauccggaguaaaacuagaaucaauaggcauauaccaaauacaacacagcggcggacgaucaucuuuagaaggaccaagguucgaacaaaaacucauuucagaagaagaccucaacaugcacacagga

SEQ ID NO: 51306 - RNA, 1683 nt, Artificial Sequence
  derived and/or modified sequence opt6 from anti-influenza_Chain
auggaaaaaaucguacuauuacuagcaauugucaguuuaguaaaaagcgaccaaauuuguauaggcuaccaugcuaauaauucaacagaacaaguagacacgauaauggaaaaaaacguaacgguaacccacgcacaagauauacuagaaaaaacccacaacggaaaacuaugugaucuagauggaguaaagccacuaaucuuaagagacugcucagucgcaggcuggcuauugggaaaccccaugugcgaugaauucauuaacgucccagaauggucauacauaguagaaaaagcaaauccagcaaaugaccuauguuacccaggaaacuucaacgauuacgaagaauuaaaacaccuauuaucaagaaucaaucacuuugaaaaaauacaaauaauaccuaaaucgagcuggucugaucaugaagcaagcucaggaguaagcagcgccugcccauaccaaggaaaaaguaguuucuuccgaaacguaguaugguuaauaaaaaaaaauagcagcuacccaacaauaaaaagauccuacaacaacacaaaccaagaagaucuguuaguauuauggggaauacaccaccccaacgacgcggccgaacaaaccagauuauaccaaaacccaacaacauauauaucaguaggaaccucaaccuuaaaccaacgauuaguaccaaaaauagcaacaagaagcaaaguaaacggucaauccgguagaauggaauucuucuggacuauacuaaaaccaaaugacgcuauuaauuucgaaagcaacggcaauuucauagcaccagaauacgccuacaaaauaguaaaaaaaggcgauagugcaauaaugaaaucagaauuagaauacggaaauugcaauacaaaaugccagacaccaaugggagcaauaaacaguucaaugccuuuucacaacauacaucccuuaacuaucggagaaugcccaaaauacguaaaaagcaaucgacuaguacuagcaacugggcuacgaaacaguccacaaagagaaagaagacgaaaaaaacgaggccuguuuggagcaauagcaggauucaucgaaggcggcuggcaaggaaugguagacggcugguauggguaucaccacucaaaugaacaaggcucaggauacgcggcagacaaagaaagcacacaaaaagcaauagauggaguaacuaauaaaguaaacucuauaauagacaaaaugaacacacaauuugaagcaguaggaagagaauucaacaacuuagaacgaagaauagaaaacuuaaacaaaaaaauggaagauggauuccuagaugucuggaccuauaacgcagaacuauuaguacuaauggaaaacgaaagaacauuagacuuucaugacucaaauguaaaaaaccucuacgauaaaguaagacuacaauuaagagauaacgccaaagaauuaggaaauggauguuuugaauucuaucacaaaugcgauaacgaaugcauggaaaguguaaggaauggcacauacgauuacccccaauauagcgaagaagcaagacuaaaacgagaagaaaucucaggaguaaaacuagaaucaauaggaauauaucaaauacaacacucaggaggacgaagcucacucgaagggccuagauucgaacaaaaacuaauaagcgaagaagacuuaaacaugcacacagga

SEQ ID NO: 51307 - RNA, 1701 nt, Artificial Sequence
  derived and/or modified sequence opt6 from anti-influenza_Chain
auggaaaaaauagucuuacuacuagcaauaguaucacuaguaaaaucagaccaaauuugcauagguuaccacgcaaauaacucaacagaacaaguagauacaauaauggaaaaaaauguaacaguaacccaugcacaagacauacuagaaaaaacacacaacggaaaauuaugugaccucgauggaguaaaaccauuaauauuacgagacugcaguguagcaggauggcuacuagguaauccaaugugcgacgaauucauaaauguaccagaauggucguauauaguagaaaaagcaaacccagcuaaugaccucugcuacccagguaauuucaacgacuacgaagaacuaaaacaccucuugucacgaauaaaucacuucgaaaaaauacaaauaauaccaaagagcucauggagugaccacgaagcaucauccggaguaaguucugcaugcccauaccaaggaaccccaucauucuuuagaaacguagugugguuaauaaaaaaaaacaacaccuauccaacaauaaaaagaucauauaauaacacaaaccaagaagaucuccuuauauuauggggcauacaccacucaaaugacgcugcagaacaaacaaaacucuaccaaaacccaaccacuuacauaucaguaggaaccucaacauuaaaccaaagauuaguaccaaaaauagcaacaagaaguaaaguaaacggccaaaauggcagaauggacuuuuucuggaccauacuaaaaccaaaugacgcaauaaauuucgaaucaaauggaaacuucauagcaccagaauacgcauacaaaauaguaaaaaaaggagacagugccauaguaaaaucagaaguagaauauggaaacuguaacacaaaaugccagacucccauaggagcaauaaauagcagcaugccauuucacaauauacacccccuaacaauaggagaaugcccaaaauacguaaaauccaacaaauuaguacuagcuacgggacuaagaaauucaccacuacgagaaagaagaagaaaaagaggauuauuuggagccauugcaggauuuauagaaggaggauggcaaggaaugguagauggaugguacggauaccaccauucaaacgaacaaggaagcggauaugcagcagacaaagagaguacacaaaaagcaaucgauggcguaacaaacaaaguaaacucuauaauagacaaaaugaauacccaauucgaagcagucggaagagaauuuaauaaccuagaaagaagaaucgaaaaccucaacaaaaaaauggaagauggauuccuagacguuuggacauauaacgcagaauuguuaguacuaauggaaaacgaaagaacacuugacuuucaugacuccaauguuaaaaaccuuuacgauaaaguaagacuacaacuaagagauaacgcaaaagaauuaggaaaugguuguuucgaauucuaccauaaaugugauaaugaauguauggaaagcguccggaacggaacauaugacuacccgcaauauagcgaagaagcuagacuaaaaagagaagaaaucucaggaguaaaacucgaaagcaucgguacauaccaaauauuaaguauuuacaguaccguagccucaucauuagcauuagcaauaaugguggcaggauuaagcuuauggaugugcucaaauggaagucuacaauguagaauaugcaua

SEQ ID NO: 51308 - RNA, 1701 nt, Artificial Sequence
  derived and/or modified sequence opt6 from anti-influenza_Chain
auggaaaaaauagucuuacuacuagcaauaguaucacucguaaaaucagaccaaauaugcauaggauaucacgcaaacaauucaacagaacaaguagacacaaucauggaaaaaaacguaacgguaacacaugcacaagacauacuugaaaaaacacacaacggaaaauuaugcgauuuagacggaguaaaaccucuaauauuacgagauuguucaguugcaggauggcuauuaggaaacccaaugugugacgaauucauaaacguaccagaauggucuuauaucguagaaaaagcaaacccagcaaacgacuuaugcuacccaggaaauuucaaugauuaugaggaguuaaaacaccuacuaucaagaauuaaucacuucgaaaaaauacaaauaauaucaaaauccucauggagcgaucacgaagcuucauccggaguuagcucagcaugucccuaucaaggcacaccaucguucuuuagaaacguaguauggcuuauaaaaaaaaacaauacauacccaacaauaaaaaggucauauaacaauacaaaccaagaagaucuauuaauacucuggggaauacaccacucaaauaacgcagcagaacaaacaaaacuauaccaaaacccaacaacguauaucaguguaggaacaucuaccuuaaacuuaagacuagucccaaaaauagcaacuagaaguaaaguaaauggacaaucaggaagaauggacuuuuucuggacaauacucaaaccaaacgacgccauaaacuuugaaucaaacggaaacuucauagcuccugaauaugcguauaaaauaguaaaaaaaggagacagcgcaauaaugaaaucugaaguagaauacgguaacuguaauacuaaaugccaaacaccaauaggugcaaucaacaguucaaugccauuucacaacauacacccacuaacaaucggagaauguccaaaauacgucaagucaaauaaacuaguauuagcaacaggauuaagaaacagcccauuaagagaaagaagaagaaaaagaggacuuuucggagcaauagcaggauucauugaaggaggauggcaaggaaugguagacggaugguauggauaccaccacuccaaugaacaaggcaguggauacgcagcagauaaagaaagcacacaaaaagcaauagacggaguaacaaacaaagucaauucaaucauagacaaaaugaauacacaauucgaagcaguagguagagaauuuaauaauuuagaacgaagaauagaaaaccucaauaaaaaaauggaagacggcuucuuagauguauggacuuauaaugccgaauuauuaguauuaauggaaaacgaaagaacccuugacuuucacgauagcaauguaaaaaaccuauacgacaaaguuagauuacaauuaagagacaacgcuaaagaacugggaaacggaugcuucgaauucuaucacaaaugugauaaugaaugcauggaaucaguaagaaacggaacuuacgacuacccucaauacucagaagaagcaagacuaaaacgcgaagaaauaucaggagugaaauuagaaaguauaggcacauaucagauauuaagcauauauucuacuguugcaaguagccuagcauuagcaauaaugguagccggccuaagcuuauggaugugcucaaauggcucucuacaauguagaauaugcaua

SEQ ID NO: 51309 - RNA, 1701 nt, Artificial Sequence
  derived and/or modified sequence opt6 from anti-influenza_Chain
auggaaaaaauaguacuacuauuagcuaucguaucccuagucaaaucagaccaaauaugcauaggauaucaugcaaacaacuccacagaacaagucgacacaauaauggaaaaaaacguaacaguaacucacgcucaagacauauuagaaaaaacacauaacggcaaacuaugcgaucuagacggaguaaaaccucuaauacuaagagacugcucaguagcaggauggcuacuaggaaacccaaugugcgacgaauucauaaaugucccugaauggaguuauauaguagagaaagccaauccagcaaacgaccuaugcuacccaggaaacuuuaacgacuacgaagaacuuaaacaucuacuaucaagaauaaaccauuucgaaaaaauacaaaucauaccaaaaucaagcuggucagaucacgaagccagcucaggaguaaguagugcaugcccauaucaaggaacaccaagcuucuucagaaauguaguuuggcuaaucaaaaaaaauaauacguauccaacaaucaaaagaucuuacaauaauaccaaccaagaagauuuauuaaucuuauggggaauacaccacucaaacgaugcagcagaacaaaccaaacuauaucaaaacccaacaacauacauaucuguaggaacaucaacauuaaaccaacgauuaguaccaaaaauagccacaagaaguaaaguaaacggacaaagcggaagaauggauuucuucuggacaauauuaaaaccaaacgacgcaauaaacuucgagucaaacggaaacuuuauagccccagaauacgcauacaaaauaguaaaaaagggagacucagcaauaguaaaaucagaagucgaauaugguaacugcaauaccaaaugccaaacaccaauaggcgcaauaaacucuucaaugcccuuucacaauauacacccauuaacaauaggcgaaugcccaaaauacgugaaaucaaacaaauuaguacuggcaaccggauuaagaaacucaccacuaagagaaagacgaagaaaaagaggacucuucggagcaauugcaggauucauagaaggcgguuggcaagguaugguagacggaugguacggauaccaucacucaaacgaacaaggcagcggauacgccgcagacaaagaaaguacacaaaaagcaauagacggaguaacuaauaaaguaaacagcauuaucgacaaaaugaacacacaauucgaagccguaggaagagaauuuaacaauuuagaacgacgaauagaaaaccuaaacaaaaaaauggaagacgguuucuuagauguauggacauacaacgcagagcuacuaguacuaauggaaaacgaaagaacucuagacuuccaugacucaaacguaaaaaacuuauacgauaaaguaagacuacaacuacgagacaaugcaaaggaauuaggaaauggcuguuucgaauuuuaccacaaaugugacaaugaaugcauggaauccguacgaaaugguacguaugacuacccccaauacagugaagaagcacgacuaaaaagagaagagauaagcggaguaaaacuagaaucaauaggaaccuaucaaauccuaaguaucuauucaacaguagcaucaucacuagcacuagcgauaaugguagccgggcuaucauuauggaugugcucaaacggaaguuuacaauguagaaucuguauc

SEQ ID NO: 51310 - RNA, 1704 nt, Artificial Sequence
  derived and/or modified sequence opt6 from anti-influenza_Chain
auggaaaaaauaguauuacuccuagcaauaguaucauuaguaaaaucagaucaaauaugcauaggcuaucacgcaaauaacucaacugaacaaguagauaccauaauggaaaaaaacguaacgguaacacaugcucaagacauccuagaaaaaacacauaacggaaaacuaugcgacuuagacggaguaaaaccauuaauauugagagacugcucaguagcagguugguuauuaggaaacccaaugugugacgaauuuuuaaacguaccggaauggagcuacauuguugaaaaaauaaacccagccaacgauuuauguuauccaggagauuucaaugacuacgaagaacucaaacacuuacuuuccagaauaaaucauuuugaaaaaauacagauaauaccaaaaucaaguuggagugauuacgaagcaucaucaggaguaagcuccgcauguccauaccaagguagaagcucuuucuuuagaaacguaguauggcuaauaaaaaaaaacaacgcauauccaacaauaaaaagaucauacaacaacacaaaucaagaagaucuauuaguacuaugggguauacaccauccaaaugaugcagcugaacaaauaagacuauaucaaaacccuacaacauacauuucaauaggaacuagcacauuaaaucagcgauuaguaccaaaaauagccacaagaaguaaaguaaacggacaaaguggaagaauggaauuuuucuggacaauccuaaaaucaaacgaugcaauaaacuuugaaucgaauggaaacuuuaucgcacccgaauacgcauacaaaauaguaaaaaaaggagacucaaccauuaugaaaucugaacucgaauauggaaauugcaacacaaaaugucaaacacccauaggugcaauaaacucaagcaugccauuucauaacauacauccacuaacaauaggugaaugccccaaauacguaaaaucaaacagacuagucuuagcaacuggacuaagaaacagcccucaaggagaaagacgacgcagaaaaagaggccuauucggagcaauagcaggauucauagaaggaggauggcaaggaaugguagacgguugguacggauaccaucauagcaaugaacaaggaagcggauaugcagcagauaaagaaucaacacaaaaagccauagacggaguaaccaacaaaguaaacucaauuauaaacaaaaugaacacccaauucgaagcaguuggccgagaauucaauaaccuagaaagaaggauugaaaaucucaacaaaaaaauggaagaugguuuuuuagacguauggacuuacaacgcagaacuacuaguucucauggaaaacgaaagaaccuuagacuuccaugacaguaacguaaaaaaccuauaugacaaaguaagacuacaacuuagagauaacgcaaaagaauugggaaauggauguuuugaauuuuaccaucgaugcgacaacgaauguauggaauccgucagaaacggaacauacgacuauccacaauacagcgaagaagcuagacuaaaaagagaagaaauaagcggaguaaaguuagaaaguaugggaauauaucaaauacuaagcauauacucaacaguagcaaguagcuuagcccucgcaaucaugguagcuggauuauuccucuggauguguagcaacggaucacuacaauguagaauaugcaua

SEQ ID NO: 51311 - RNA, 1704 nt, Artificial Sequence
  derived and/or modified sequence opt6 from anti-influenza_Chain
auggaaaaaauuguacuacuauuagcuauaguaagccugguaaaaucagaucaaauaugcauagguuaucacgcaaacaacucaaccgaacaagucgauaccauaauggaaaaaaacgucacagucacacaugcacaagacauuuuagaaaaaacacacaacgguaaacuaugcgaucuagauggcguaaaaccacuaauacuuagagacugcaguguagcugguugguuauuaggaaacccuaugugcgacgaauucaucaacguacccgaauggucauacauaguagaaaaagcaaacccaacaaacgaccuaugcuacccaggaucauucaacgauuacgaagaauuaaaacaccuauuaucaaggauaaaccauuucgaaaaaauacaaauaaucccaaaaagcucauggucagaucacgaagcaagcagcggcgucagcucagcauguccauacuuaggaucaccaagcuucuuuagaaauguagucuggcucauaaaaaaaaacucaacauauccaacaauaaaaaaaucauacaacaacacaaaccaagaagaccuauuagucuuauggggaauacaccauccaaacgacgcagcagaacagacaagauuauaccaaaacccaacuacauauauaucaauagguacaaguacauuaaaccaaagacuagucccaaaaaucgcaacgcgaucaaaaguaaauggacaaucuggaagaauggaauucuucuggacaauuuuaaaacccaacgaugccauaaacuuugaaucaaauggcaacuuuauagcaccagaauaugcauacaaaauaguaaaaaaaggagacagugcaaucaugaaaucagaauuagaauauggaaacuguaacacaaaaugccaaacaccaaugggugcuauaaacucaagcaugccauuccacaacauacaucccuuaacaauaggcgaauguccaaaguacguaaaaucaaacagauuaguacuagcaaccggacuaagaaacagcccacaaagagaaagccguaggaaaaaacgaggucuauuuggagcaauagccggauuuauagaaggaggauggcaaggcaugguggacggcugguacggauaucaccacucaaaugaacaaggaucaggauacgccgcggauaaagaaaguacacaaaaagccauagauggaguaacaaauaaagucaacucuauaauagauaaaaugaacacacaauuugaagcaguaggccgagaauucaauaaucuagaacgaagaauagaaaaccuaaacaaaaaaauggaagacggauuucuagacguauggacauacaacgcggaacuauuaguacuaauggaaaaugaacgaacauuagauuuccaugacucaaacgucaaaaaccuauaugacaaggucagauuacaacuaagagacaacgcaaaagaauuagguaacggcugcuucgaauucuaucacaaaugcgacaaugaaugcauggaaucaauuagaaauggaacauauaacuauccacaauacagcgaagaagccagacuaaaacgagaagaaauaagcggaguaaaacuagagucaauaggcacauaccaaauuuuaucaaucuauucaacaguugccucaagucuagcauuagcaauaaugauggcagguuuaucacuauggauguguucaaacggaucacuacaaugccgaauaugcaua

SEQ ID NO: 51312 - RNA, 1704 nt, Artificial Sequence
  derived and/or modified sequence opt6 from anti-influenza_Chain
auggaaaaaaucguacuacuguucgcaauaguaagcuuagucaaaucagaccaaauauguauaggauaccacgcaaacaacucaacagaacaaguagacacuauaauggaaaaaaauguaacagucacacacgcacaagauauauuagaaaaaacacacaauggaaaacuuugcgaccuagauggaguaaaaccccuaauacucagagacugcucagucgccggcuggcuauuaggcaaucccaugugcgaugaauuuauuaauguaccagaauggagcuacauaguagaaaaagcaaacccagucaacgaccuaugcuaccccggagacuuuaacgacuacgaagaacuuaaacaccuauuaucaagaaucaaucacuucgaaaaaauacaaauaauaccuaaaucaucauggucaucacaugaagcaucauuaggaguaucaagugcauguccauaccaaggaaaaucgucauuuuucaggaacgucguuuggcuaauaaaaaaaaacuccacauauccaacaauaaagcgaucauacaauaacacaaaccaagaagacuuacuaguacuaugggguauccaccauccaaaugacgccgccgaacaaaccaaauuauaucaaaacccaacaacauacauaucaguaggcacauccacacugaaccaaagauuagucccaagaauagcaacaagaaguaaaguaaauggccaaucaggaagaauggaauucuucuggacuauacuaaaaccuaaugaugcaaucaacuuugaaucaaauggcaacuuuauagcaccugaauacgcauauaaaauuguaaaaaaaggagacaguacaauaaugaaaucugaacuagaauauggaaauugcaacacaaaaugccaaacaccaaugggugccauaaacaguucaaugcccuuccauaacauacauccccuaacaauuggugaaugcccaaaguacguaaaaucuaauagacuaguacucgcaacaggacuccgaaacaguccacaacgagaaaggagaagaaaaaaacgaggacuuuucggagcuaucgcaggauucaucgaaggagguuggcaaggcaugguagacggaugguacgguuaucaccacucaaacgaacaaggaucaggauacgcagcagacaaagaaaguacacaaaaagcaauagacggaguaacaaacaaaguaaauucaauaauagacaaaaugaacacccaauuugaagcaguaggacgagaauucaacaacuuagaaaggagaauagaaaaucuaaacaaaaaaauggaagacggauuccuagacguguggacauacaaugccgaguuauuaguacuaauggaaaacgaaagaacacuagauuuccacgacucaaacguaaaaaaccuauaugacaaaguaagauuacaacuacgagacaaugcaaaagaacuaggcaacggaugcuucgaauucuaccacaaaugcgacaacgaaugcauggaaagcguaagaaauggaacauaugacuacccacaauacagugaagaagcaagacuuaaaagagaagaaauaaguggagucaaauuagaauccauagguauauaccaaauacuaucaauuuacaguacaguagcauccagcuuagcacuagcuaucaugguagcaggacuuucacuauggaugugcucaaauggaucacuacaaugcagaauuugcaua

SEQ ID NO: 51313 - RNA, 1704 nt, Artificial Sequence
  derived and/or modified sequence opt6 from anti-influenza_Chain
auggaaaaaauaguacuacuauuagcaauaguaucacuaguaaaaagcgaccaaauaugcauaggauaucaugcaaacaauucaacagaacaaguagacaccauaauggaaaaaaaugugaccguaacacacgcacaagacauauuagaaaaaacacauaacgguaaacuaugugaccuagacgggguaaaaccacuaauauuaagagauuguaguguagcggguuggcuacuuggaaauccaaugugcgacgaauuccucaacguaccagaauggucauauauugucgaaaaaaucaaccccgcaaacgaucuuugcuacccaggcgacuucaaugauuaugaggaacuaaaacacuuacuaucgagaauaaaccacuucgaaaaaauacaaauaauacccaaaucaucuuggucagacuaugaagcauccagcggcgucaguucagcaugcccauaccaaggaagaucaagcuucuuuagaaacgucgucuggcuaauaaaaaaaaacaacgcauacccaacaauaaaaagaucauacaacaacacaaaucaagaagaccuacuaguacuauggggaauacaccacccaaaugacgcagcagaacaaauaagauuauaccaaaacccaacaacuuacauuucaauaggcacguccacauuaaaccaaagauuaguacccaaaauagcaacaaggucgaaagucaauggacaaucaggacgaauggaauuuuucuggacaauacuaaaaucaaaugacgcuauaaacuucgaaagcaacgggaacuucauugcaccagaauacgcauacaaaauaguaaaaaaaggcgauaguacaauaaugaaaagugaacuagaauacggaaacuguaauacaaaaugccaaacaccaauaggcgcaauaaauucaucaaugccauuucauaauauacauccacuaacaauaggagaaugcccuaaauacguaaaaucaaauagacuaguguuagcaacuggauuaagaaacucaccccagggagaaagaagaagacgaaaaagaggucuauuuggagcaauagcaggauucauagaaggaggauggcaaggaaugguagacggaugguacggcuaccaccauucaaaugaacaaggaucaggauacgcagcugacaaagaaaguacccaaaaagcaauagacggcguaacaaacaaaguaaacaguauaauaaacaaaaugaauacacaauuugaagcagucggaagagaauuuaauaaccuagaacgaagaauagaaaaucuaaacaagaaaauggaagacgguuuucuagacguauggacauacaacgcagaacuacuuguuuuaauggaaaacgaaagaacauuagacuuccacgacucaaauguaaaaaaucuauaugauaaaguuagguuacaacuucgagacaacgccaaagaauuaggaaacggauguuucgaauucuaucacagaugcgauaacgaaugcauggaaucaguaagaaauggaacuuacgacuauccacaauacucagaagaagcacgccuaaaacgagaagaaauaucaggaguaaaacuagaaucaaugggaauuuaucaaauacucucaauauacagcacaguagcuucaucacuagcuuuagcuauaaugguagcaggacuauucuuauggaugugcagcaauggaucacuacaaugcagaauauguaua

SEQ ID NO: 51314 - RNA, 1704 nt, Artificial Sequence
  derived and/or modified sequence opt6 from anti-influenza_Chain
auggaaaaaauaguccuacuacuagccauaguuucucucguaaaauccgaucaaauaugcauaggauaccacgcaaacaacucaacagaacaaguagacacaauaauggaaaaaaacguaacaguaacucacgcccaagacauauuagaaaaaacacacaacggaaaacuaugcgacuuagacggaguaaaaccacuaauacuaagagacuguaguguugcuggauggcuacuaggcaaccccaugugcgacgaauucauaaacguccccgagugguccuacauagucgaaaaagcaaaccccaccaaugaccucugcuacccaggauccuucaacgacuacgaagaacuaaaacacuuacuaucaagaauaaaucacuuugaaaaaauacaaauaauaccaaagucaucauggagcgaucacgaagcuucaucaggaguaagcucagcuuguccauaccuaggaucgccaucauucuuuagaaauguaguuugguuaauaaaaaaaaauagcacauauccaacaauaaaaaaaucauacaauaacacaaaucaagaagacuuacuaguauuauggggaauacaccacccaaacgacgcagcagaacaaacaagauuauaccaaaacccaacaaccuacauaaguauaggaacaagcacacuaaaucaaagauuaguaccaaaaauagcaacacgaucaaaaguaaauggacaaucaggacgaauggaauucuucuggacaauacuaaaaccaaacgaugcaaucaauuuugaaucaaauggcaauuucaucgcaccagaauacgcuuacaaaauaguaaaaaaaggagauagcgccauaaugaaaagcgaauuagaauacggaaauugcaacaccaaaugccaaacuccaaugggagcaauaaacagcagcaugccauuccacaacauacauccccucacaauaggcgaaugcccaaaauacguaaaaucaaauagacuaguacuagcaacaggucuaagaaacucaccccaacgagaaagcagacgaaaaaaaagaggacucuucggagcaaucgcaggauucauagaaggaggauggcaaggaaugguagacggaugguauggauaucaccacagcaacgaacaaggcagcggauacgcagcagauaaagaaucaacccaaaaagcaauagacggcguaacaaauaaaguaaacaguauaauugauaaaaugaauacacaauucgaagcaguaggaagggaauuuaauaauuuagaaagaagaauagaaaacuuaaacaaaaaaauggaagauggauucuuagacguauggacauacaacgcagaacuauuaguucucauggaaaaugaaagaacacuagacuuccacgacaguaauguaaaaaacuuauacgacaaaguaagacuccaacuaagagauaacgccaaagaacuaggaaauggaugcuucgaauucuaccauaaaugugacaacgaaugcauggaaagcaucagaaauggaaccuauaacuacccacaauacucagaagaagccaggcuuaaacgagaagagauaucaggaguaaaacuagaaaguauaggaacauaucaaauucuaucaaucuacagcacaguagccucaagucuagcauuagcuauaaugauggcgggacuaagccuauggaugugcuccaauggaucacuacaaugccgaauaugcaua

SEQ ID NO: 51315 - RNA, 1704 nt, Artificial Sequence
  derived and/or modified sequence opt6 from anti-influenza_Chain
auggaaaagauaguauuauuauucgcaauaguaucauuaguaaaaucugaccaaauaugcauaggauaucacgcaaacaacagcacagaacaaguagacacaaucauggaaaaaaauguaacaguaacacaugcacaagacauacucgaaaaaacccacaacggaaaacuaugugaucuugauggaguuaaaccacuuauacuaagagacugcucaguagcaggaugguuauuaggaaacccaaugugcgaugaauucauaaacguaccagaauggagcuacauaguagaaaaggcaaaccccgugaaugacuuauguuacccaggagauuucaacgauuacgaagaauugaaacaccuacucaguagaauaaaccacuuugaaaaaauacaaauaauaccaaaaucaagcuggucaucacacgaagcaucacugggaguaaguagugcaugccccuaccaaggaaaaaguaguuucuucagaaauguaguauggcuaaucaaaaaaaauagcacuuauccaaccauaaaacgaucauacaauaacacaaaucaagaagacuuauuaguacuauggggaauccaccacccaaacgacgcagcagaacaaacgaaauuauaccaaaauccaacaacauauauaaguguaggaacaucaacacuaaaucaaagacuuguacccagaauagcaacaagaucaaaaguaaauggacaaucaggaagaauggaauuuuucuggacaauauugaaaccaaaugacgcuauaaauuuugaaucaaacggaaauuuuauagcaccugaguacgcauauaaaaucguuaaaaagggcgacuccacaauaaugaaaucagaauuagaauacggaaacugcaacacaaaaugccaaacaccaaugggagcaauaaacucaucaaugccauuucacaacauucacccacuuacaaucggcgaaugcccaaaauacguuaaaucuaacagacuaguguuagcuaccggucuaagaaacagcccccaaagagaaagaagaagaaaaaaaagaggacuauucggcgcaauagccggcuuuauagaaggaggauggcaagguaugguagacggaugguaugguuaucaccauaguaaugaacaaggaucaggauacgcagcagacaaagaaucaacacaaaaagcuauagauggagucacaaacaaaguaaauaguauaauugacaagaugaauacacaauuugaagcgguaggaagagaauucaacaaccuagaaagaagaauagaaaaucuaaacaaaaaaauggaagacggauuuuuagacguauggacauacaacgcagaacuucucguauuaauggaaaacgaaagaacacuugacuuucacgacucaaacguaaaaaacuuguacgacaaaguuagauugcaacucagagacaaugcaaaagaacuaggcaacggcuguuucgaauucuaucauaaaugcgacaaugaauguauggaaucuguacguaacggcacauaugacuacccacaauauagcgaagaggcuagacuaaaaagagaagaaaucucaggagugaaacucgaaucaauuggaauauaucaaauauuaaguauauacucaacaguagcuucaucauuagcacuagcaauaaugguagccggacuaucauuauggaugugcagcaacggaagccuacaaugcagaauaugcaua

SEQ ID NO: 51316 - RNA, 1707 nt, Artificial Sequence
  derived and/or modified sequence opt6 from anti-influenza_Chain
aguaaaaguagaggauauaaaaugaacacccaaauucuaguauuugcauuaguagcaagcauaccaacaaaugcagacaaaauauguuuaggacaucacgcaguaagcaauggaacaaaaguaaacacuuuaacagaaagaggaguagaaguaguaaacgcaacagaaaccguagaaagaacaaaugucccaagaauuugcagcaaaggaaaacgaacuguggaccuaggccaaugcggacuacucggcacaauaacaggaccaccacaaugcgaucaauuuuuagaauuuagugcagauuuaauaauagaaaggcgggaaggaucagauguauguuauccaggaaaauuuguaaaugaagaagcacuaagacaaauacuaagagaaucaggaggaauagauaaagaaaccaugggauucacauauagugggauaagaacaaauggaacuaccuccgcauguagaagaucgggaagcagcuuuuaugcagaaaugaaaugguuauuaucaaacacagauaacgcagcauuuccacaaaugacuaaaaguuauaaaaauacaagaaaagacccugcucuaauaaucuggggcauacaccauucaggaagcacuacagaacagacaaaauuauauggaucaggaaauaaacuaauaacaguuggauccaguaauuaucaacaaucauucguaccaucuccaggagcaagaccacaaguuaacggacaaucaggaaggauugauuuucacuggcuaauacuuaauccaaaugauacaguaacuuuuaguuuuaauggcgcauuuauugcuccagauagagcaaguuucuuaagaggaaaaucaauggguauucaaagcgaaguacaagucgacgcaaauugugaaggagacuguuaucacagcggaggaacaauaauaaguaaucuccccuuucaaaauaucaauucaagagcaguaggcaaaugcccaagauacguaaaacaagaaucacuccuauuagcaacaggaaugaagaauguaccagaaauaccaaaaaggagaagaagaggauuauuuggugcaauagcaggauuuauugagaauggaugggaaggucuaauugauggaugguaugguuucaggcaucaaaaugcacaaggcgaaggaacagcagcugauuauaaaucaacacaaagcgcaauagaucaaauaacaggaaaauuaaacaggcuaauagagaaaacaaaucaacaauuugaauuaauagacaaugaguucacagaaguagaaagacaaauaggaaauguaauaaacuggacaagagacucuaugacagaaguauggucauacaacgcugaauuauuaguagcaauggaaaaucaacauacaauagaucuugcggauagcgaaaugaauaaacuauaugaacgaguaaaacgacaauuacgagaaaacgcagaagaagauggaaccggaugcuuugaaauauuucauaaaugcgacgaugacuguauggcaucaaucagaaauaacacauacgaucacucaaaauauagagaagaagcaauacaaaauagaauacaaauagauccaguaaaauuaagcucuggguauaaagaugugauucuaugguucuccuucggagcauccugcuucauacuauuagcaauagcaauggggcuaguauucauaugcgucaaaaauggaaauaugagauguaccauauguaua

SEQ ID NO: 51317 - RNA, 1707 nt, Artificial Sequence
  derived and/or modified sequence opt6 from anti-influenza_Chain
ucaaaaagcagaggauauaaaaugaacacucaaauucuuguauuugcauuaguagcaucaauaccaacuaacgcugauaaaauaugucuuggacaucacgcaguauccaacggaaccaaaguaaacacauuaaccgaacgaggaguagaaguaguaaaugccaccgaaacaguagaacgaacuaauguacccagaauauguucgaaaggaaaaagaacaguagacuuaggucaaugcggauuauuaggcacuauaacaggaccaccccaaugcgaccaauucuuagaguucucagcagaccuaauaauagaaagaagagaaggaagugauguauguuauccaggaaaauuuguaaaugaagaagcauuacgacaaauauuaagagaaucaggaggaauagauaaagaaacaaugggcuuuacuuauucaggaauaagaacaaauggaaccaccucagcauguagaagaagcggauccucuuuuuaugcagaaaugaaauggcuacuuucaaacacugauaaugcagccuuuccacaaaugacaaaauccuacaaaaacacaagaaaagacccagcacuaauaaucugggguauucaccacaguggaucaacaacagaacaaacaaaacuauacggaagcggaaacaaauuaauaacaguaggaucaucaaauuaucaacaaucauucgucccaucaccaggagcaaggccacaaguaaacggacaaagcggaagaauugacuuucacugguuaauauuaaauccaaaugacacagucacuuuuaguuucaacggagcuuucauagcaccagaccgagcaucauuucuuagaggaaaaucaauggguauccaaagcgaaguucaaguagaugcaaauugcgaaggagauuguuaucacucaggagguacaauaaucucaaacuuacccuuucaaaacauaaauucaagagcaguaggcaaaugcccuagauaugugaaacaagaaucauuauuacuugcaacaggaaugaaaaaugugccagaaauuccaaaacgaagacguagaggacuauuuggagccaucgcaggauucauagaaaaugguugggaaggguuaauagauggaugguacgguuuuagacaccaaaacgcccaaggcgaaggaacagcagcagacuauaaaucaacacaaucagcaauagaucaaauaacaggaaaauuaaauagauuaauugaaaagacaaaucaacaauucgaacuaauagacaaugaauuuacagaaguagaaagacaaauaggaaacguaauaaauuggacaagagacucaaugacugaaguauggucauacaaugcugaauuacucguagcaauggaaaaccaacauaccauugaccuagcagacucagaaaugaauaaacuauaugaaagaguaaaacgacaacuacgagaaaacgcggaagaagacggaacaggaugcuuugaaauauuccacaaaugugaugaugauuguauggccucaauaagaaauaacaccuacgaucauucaaaauacagagaagaagcaauacaaaaucguauacaaaucgauccuguuaaacuaucaucuggauauaaagauguaauacuaugguuuucauucggugcaucuuguuucauacuauuagcaauagcaaugggauuagucuucauaugugucaaaaauggaaauaugagauguacaauauguauc

SEQ ID NO: 51318 - RNA, 1692 nt, Artificial Sequence
  derived and/or modified sequence opt6 from anti-influenza_Chain
gaucaaauauguauaggauaucacgcaaauaauaguacagaaaaaguagauacaaaucuagaaagaaacguaacggucacacacgcaaaagauauucuagaaaagacacacaacggaaaacuaugcaaacuaaauggaauaccuccacuagaacuaggagauuguucaauagcagguuggcuacuaggaaauccagaaugugacagguuacuaagcguuccagaauggaguuauauaauggaaaaagaaaacccaagagacggauuaugcuauccaggaucauucaaugauuacgaagaacuaaaacauuuauuaaguucaguaaaacauuuugaaaaaguuaaaauacucccgaaagacagauggacacaacauacaacuacagguggaaguagagcaugcgcaguaaguggcaacccaaguuucuuuagaaacaugguguggcuaacuaaagaagggucagacuaucccguagcaaaaggaucuuacaacaauacaaguggagaacaaaugcugauaaucuggggaguacaucaccccauagacgaaacagaacaaagaacauuauaccaaaacguaggcacauacguaagcgucgggacaucaacucuaaauaaacgaucuacaccagaaauugcaacuagaccaaaaguaaacggacaggguggacgaauggaauuuucauggaccuuacuagacaugugggacaccauaaauuucgaaucuacaggcaauuuaauagccccagaauauggauucaaaauaagcaaaagaggaucuaguggaauaaugaaaacagaaggcacauuagaaaauugugaaacaaaaugucaaacaccuuuaggcgcaauaaauacaacucuacccuuccauaauguacauccauugacuauaggagaaugcccaaaauacguaaaaagugaaaaauuaguacuagcaacaggacuaagaaacguaccccaaauugaaaguagaggacuauuuggagcaauagcaggauucauugaaggaggauggcaaggaaugguagacgguugguauggauaucaucacucaaaugaccaagguucaggcuaugcagcagauaaagaaucaacgcaaaaagcauuugacggcauuacuaacaaaguaaauucagucauagagaaaaugaauacacaauucgaagcaguaggaaaagaauuugguaaucuagaacgaagacucgaaaaucuaaacaaaagaauggaagauggauuccuagauguauggacauauaacgccgaauuauuaguauuaauggaaaacgaacgaacacuagacuuucaugauucaaauguuaaaaauuuauacgauaaaguaagaaugcaauuaagagauaauguaaaagaacuaggaaacggaugcuuugaauuuuaccauaaaugugacgaugaauguaugaacagugugaaaaacggaacauaugauuacccaaaauaugaagaagaaucaaaauuaaauagaaacgaaauuaaaggaguaaaauuaucaaguaugggaguauaucaaaguggaagauuaguaccaagaggaucuccugguaguggauacauaccugaagcaccuagggauggccaagcauacguaagaaaagauggagaauggguucuccugagcacguuccuuggaaaaccaauacccaauccauuacuaggacuagauaguacagga

SEQ ID NO: 51319 - RNA, 1692 nt, Artificial Sequence
  derived and/or modified sequence opt6 from anti-influenza_Chain
caaaaacugccaggcaaugauaauaguacagcaaccuuaugccuaggucaucaugcuguaccaaauggaacaauaguaaaaaccauaaccaacgaccagauagaaguuacaaacgcaacagaacuaguacaaagcaguagcacugguggcauaugugauucaccacaucaaauauuagacggugaaaauugcacacuaauagaugcucuauuaggagacccacaaugugacggauuccaaaauaaaaaaugggaccuauucguagaaagaucaaaagcuuauucaaacuguuauccauacgauguaccagauuacgcaucauuaaggucacuagucgcaucauccgguacauuagaauuuaaugacgaaagcuucaauuggaccggcguaacacaaaacggaacaaguucauccuguaaaagacgaagcaacaacucauuuuucucaagacuaaauuggcuaacccaauuaaaauucaaauacccagcacuuaauguaacaaugccaaauaacgaaaaauucgauaaauuauacauauggggcguacaucauccaguaaccgacaaugaucaaauauuucucuacgcacaagcauccggcagaauaacaguaucaacgaaacgcucacaacaaacaguaauaccuaacauaggcagcagaccaagaauaagaaacauacccucaagaauaagcauauacuggacaauaguaaaaccaggugauauacuacuaaucaacaguacaggaaacuuaauagcaccaagaggauacuuuaaaauaagaagcggaaaaagcucaauaaugcguagugaugcacccauuggcaaauguaauucagaaugcauaacacccaacggaucaauaccaaaugacaaaccauuccaaaacgugaaucgcauaacauacggagcaugcccaagauacguaaaacaaaauacacuaaaauuagcaacaggaaugagaaacguacccgaaaaacaaacaagaggaauauucggagcaauagccggauucauagaaaacggaugggaaggcaugguagacggcugguacggauucagacaccaaaacagcgaaggaauaggacaagcagcagauuuaaaaucaacacaagcagcaauaaaucaaaucaauggaaaauuaaacaggcuaauaggaaaaacuaaugaaaaauuucaccaaaucgaaaaagaauucagcgaaguugaaggaaggauacaagacuuagaaaaauacguagaagacacaaaaauagacuuauggucauacaaugcagaacuacuaguagcauuagaaaaucaacacacuauagaucuaacagacagcgaaaugaacaaacuauuugaaagaacaaaaaaacaauuaagagaaaacgcagaagacaugggcaauggcuguuucaagauauaucauaaaugugacaacgcaugcauaggauccauaagaaauggcacauaugaucaugacguauacagagaugaagcauuaaauaacagauuucaaauuaaaggaguagaacuaaaauccggaucaggaagacuaguaccuagaggaucaccaggaucuggcuauauaccagaagcaccaagagauggacaagccuacguacgaaaagacggugaauggguauuauuaucaacauucuuaggaaaacccauaccaaaucccuugcuuggucuugauagcacagga

SEQ ID NO: 51320 - RNA, 1692 nt, Artificial Sequence
  derived and/or modified sequence opt6 from anti-influenza_Chain
gaucaaauauguaucggauaccacgcaaauaacucaacagaaaaaguugauacaaaucuugaaagaaauguaacaguaacucacgcaaaagauauacuagaaaaaacucacaauggaaaauuauguaaacuaaauggaauaccaccauuagaacuaggugacuguucaauagcgggauggcuuuuaggaaacccagaaugcgacagacuauuaagcguaccugaauggaguuacauuauggaaaaagaaaacccaagagacgguuuaugcuauccaggaucauucaaugauuacgaagaauuaaaacacuuauuaaguucaguaaaacacuuugaaaaaguaaaaauauuacccaaagacagauggacacaacauacaacaacaggcggaucaagagcaugcgcaguaucaggaaaucccaguuucuucagaaauaugguuugguuaacaaaagaaggaucagauuacccagucgcgaaagguagcuauaauaauacaagcggcgaacaaauguuaauaauauggggaguacaccacccaauagacgaaacagaacaaaggaccuuauaccaaaacguaggcacauaugugucaguaggaacaucaacauuaaauaaaagauccacaccagaaaucgcaacaaggccaaaaguaaauggccaaggaggaaggauggaauucaguuggacacucuuagauaugugggauacaauaaauuuugaaagcacaggaaaucuaauagcuccagaauauggauuuaaaauuagcaaaagaggaaguucaggaauaaugaaaacagaagguacauuagagaacugugaaacaaaaugucaaacaccauuaggcgcaauaaauacuacauuaccauuucauaauguacacccacuaacaauuggagaaugcccaaaauacguaaaauccgaaaaauuaguacuagcaacaggacucagaaauguaccacaaauugaaaguagagggcuauuuggagcaauugcuggauucauagaaggcgguuggcaagguaugguagacggaugguauggauaucaccacucaaaugaucaaggaucaggauaugcagccgacaaagaauccacucagaaagcauucgauggaauaacaaauaaaguuaauaguguaauagaaaaaaugaauacacaauuugaagcaguaggcaaagaauuuggaaaccuagaaagaagacuagaaaacuuaaacaaaagaauggaagauggauucuuagacguauggacuuauaacgcagaacuuuuaguacugauggaaaaugaaagaacucuagauuuucacgauagcaauguaaaaaacuuauaugauaaaguaagaaugcaauuacgagacaacguaaaagaauuaggaaauggauguuuugaauuuuaucauaaaugugaugaugaaugcaugaauaguguaaaaaauggaacguaugauuauccaaaauaugaagaagaaagcaaauuaaacagaaacgaaauaaaagguguaaaauuaaguaguaugggaguauaccaaucuggcagauuaguaccacgaggaucaccagggucaggguacauaccagaagcgccaagagauggccaggcuuauguaagaaaagauggagaauggguccuauuaaguacauuuuuaggaaaaccuauaccaaauccacuacuaggacuagauagcacggga

SEQ ID NO: 51321 - RNA, 1692 nt, Artificial Sequence
  derived and/or modified sequence opt6 from anti-influenza_Chain
caaaaacuaccaggaaaugauaacaguacagcaacauuaugucucggacaccaugcaguaccaaauggaacaaucguuaaaaccauaacuaacgaucaaauagaaguaacaaacgccacugaauuaguccagucaucaaguaccggaggcaucugcgauaguccacaccaaauucuagauggagaaaacugcacauuaauugacgcauuauuaggagacccucaaugcgacgguuuccagaacaaaaaaugggacuuauucguagaaaggucaaaagcuuauucuaacugcuauccauacgauguaccagacuaugcgagucuccgaucacuaguagcaucaucaggaacacuagaauuuaaugacgaaucauucaauuggacgggagucacacaaaacggaacaucaaguucaugcaaacgaagguccaauaacucauucuuuaguagauuaaacugguuaacccaacuaaaauuuaaauacccagcacuaaacgucaccaugccaaacaacgaaaaauucgacaaacuauauaucuggggaguacaccauccaguaacugauaacgaccaaauauuccucuacgcacaagcuaguggacgaauaacaguaucaacaaaacgaucacaacaaacaguaauaccaaacauaggaagcagaccuagaauaagaaacauacccagucgaauaaguauauacuggacaaucguuaaaccuggagacauauuacucaucaauagcacaggaaaucuaauagcaccaagaggauauuuuaaaauacgaucagguaagagcucaauaaugcggagcgacgcaccaauaggaaaaugcaauagcgaaugcauaacgccaaauggaucaauaccaaacgauaaaccauuucaaaauguaaauagaauaacauacggagcauguccaagauacgucaaacaaaauacacuaaaacuagccacaggaaugagaaauguaccagaaaaacaaacacgaggcauauucggagcaauagcaggauuuauagaaaauggcugggaaggcaugguagaugguugguauggauucagacaccaaaacucagaaggaauaggacaagcagcagaccuaaaaagcacacaagcagcuauaaaccaaauaaacgguaaacuaaaucgauuaaucggaaaaacuaacgaaaaauuccaucaaauagaaaaagaauuuucagaaguagaaggccgcauacaagaccuagaaaaauacguagaagacacuaaaauagaccuauggagcuacaacgcagaacuucuaguagcacuugaaaaccaacacacaauagacuugacagauagugaaaugaacaaacuauucgaacgaacaaaaaaacaauuaagagaaaaugcagaagacaugggaaauggaugcuuuaaaauauaccauaaaugcgacaaugcaugcauuggauccauaagaaacggaacauaugaccacgauguauauagagacgaagcauuaaacaauagauuucaaauaaaaggaguagaauuaaaaucgggaagcggacgauuagucccucgaggaucuccaggauccggauauauaccugaagcaccaagagacggccaagccuacguuagaaaagacggagaauggguauuacuaagcacauucuuaggaaaacccaucccaaacccguuauuaggcuuggacagcacagga

SEQ ID NO: 51322 - RNA, 1695 nt, Artificial Sequence
  derived and/or modified sequence opt6 from anti-influenza_Chain
gauacaauaugcauaggauaccacgcaaacaacucaaccgacacaguagauaccguacuagaaaaaaacguaacaguaacacacucagucaacuuacuagaagauagccacaacggaaaauuaugcuuauuaaaaggaauugccccucuacaauuaggaaacuguucaguagcaggauggaucuuaggaaacccagaaugugaauuauuaauaucaagggaaucauggucauacauaguugaaaaaccaaacccagagaauggcacuuguuacccaggacacuucgcagauuaugaagaacucagagaacaacuaaguaguguaucaucguuugaaagauucgaaaucuuccccaaagaauccaguuggccaaaccauaccacaacagggguauccgcaaguuguagccacaauggagaaaguucauuuuacaaaaaucuccuauggcuaacaggcaaaaacggucuauacccaaauuuaucaaaaaguuacgccaauaacaaagaaaaagaaguauuagugcuauggggaguacaucauccaccaaauauaggagaucaacgcgcauuauaucacaaagaaaaugcauauguaagcguuguauccucucacuacagucgaaaauucacaccagaaauagcaaaaagacccaaagucagagaccaagaaggaagaauaaauuauuauuggaccuuacuagaaccaggcgacacuauaauuuucgaagccaauggaaacuuaauagcaccacgauacgcauuugccuuaucacgaggauucggauccggaauaauaaacucaaacgcaccaauggacgaaugcgacgcaaaaugccaaacaccacaaggagcaauaaacagcucacuaccauuucaaaacguacauccaguaacaauaggugaaugcccaaaauacgucagauccgcaaaacuacgaaugguuacaggacugcgaaacaucccaucaauacaaucaagaggacuauuuggugccauagcggguuuuauagaaggagguuggacaggaauggucgauggaugguauggcuaucaucaccaaaacgaacaaggaagcggauaugcagccgaucaaaaaaguacacaaaacgcuauaaauggaauaacaaacaaagucaacaguguuauagaaaaaaugaacacacaauuuaccgcaguugggaaagaauucaauaaauuggaaagaagaauggaaaaucuaaauaaaaaagucgaugauggauucauagacauauggacguacaaugcagaacuacuagucuuacuagaaaaugaaagaacauuagacuuucaugauucaaacguaaaaaauuuauaugaaaaaguaaaaagucaacuaaaaaauaaugcaaaagaaauaggaaauggaugcuucgaauucuaccauaagugcaacgacgaaugcauggaaucaguuaaaaacggaacauaugacuacccgaaauauucggaagaaucuaaacuaaauagagaaaaaauagauggaguaaaauuagaaucaaugggaguauaccagagcggaaggcuaguaccaagaggaaguccugguagcggauauaucccagaagcaccacgagacggucaagcauauguuagaaaagauggagaauggguacuucuaucaacuuuccuagguaaaccuauaccaaauccucuauuaggauuagacuccacagga

SEQ ID NO: 51323 - RNA, 1695 nt, Artificial Sequence
  derived and/or modified sequence opt6 from anti-influenza_Chain
caaaauuauacaggaaauccuguaauaugcuuaggacaucaugcaguaucaaacggaacaaugguaaaaacauuaacggacgaucaaauugaaguaguaacagcacaagaauuaguagaaagucaacaucuaccagaacuaugcccaucaccauuaagauuaguagacggacaaacaugcgacauaguaaacggugcauuaggaucaccaggcugugaccaucuaaauggagcagaaugggacguauuuauagaacgacccacagccguagauacaugcuacccauucgacguacccgacuaccaaagucuacgaaguauacuagcaaauaacggcaaauuugaauuuauagcagaagaauuucaauggaacaccgugaaacaaaacggaaaaucaggagcauguaaaagagcaaacgucaacgacuucuucaauagauuaaacuggcuuacaaaaagugacggaaacgccuauccccuacaaaaucuuaccaaaguaaacaauggcgauuacgcaagacuauacauauggggcguacaucacccuaguacagacacagaacaaacaaaccuauacaaaaacaaccccggaagaguaacagucucaacacaaacuagccaaacgucagucguaccaaacauaggaucacgaccaugggugagaggacuaaguucaagaaucucauucuacuggacaauaguagaaccaggagaccuaauaguauucaacaccauaggcaaccuaauagcaccaagaggacacuacaaacuaaauagucaaaagaaaucaacaauacuaaacacagcuguaccaaucggaaguuguguaagcaaaugucacacagacaaaggauccauuaguacuacaaaaccauuccaaaacauaucacgaauaucuauaggagauuguccaaaauacguaaaacaaggaaguuuaaaauuagcaacaggaaugagaucaauauuagaaaaagcuacaagaggccuauuuggcgcaauagcagguuucauagaaaacggauggcaaggucuaauagauggaugguauggauuccgacaccaaaaugcggaaggaaccgggacagcagcugaccuaaaaucaacacaagcagcaauugaucaaauaaauggaaaacuaaacagacuuaucggaaaaccaaaugaaaaauaucaccaaaucgaaaaagaauuugaacaaguagaaggaagaauacaagacuuagaaaaauauguagaagacaccaaaauagaccuaugguccuauaacgcagaacuucuaguugcauuagaaaaccaacacacaauagacguaacagacucagaaaugaauaaauuguucgaaagaguaagacaucaacuaagagaaaaugccgaagacaaaggcaacggauguuucgaaauauuccaccaaugcgauaauuccuguauugaaucaauaagaaacggaacauaugaucacgacauauacagggaugaagcuauaaacaacagauuccaaauacaaggagucaaauuaauacaaggauacaaagacucaggaagauuaguaccaagaggcucaccagguagcggauauauaccagaagcaccaagagacggacaagcauacgucagaaaagauggagaauggguacuacuaucaacauuccuaggaaaaccaauccccaacccucuacuaggacuagacucaacuggu

SEQ ID NO: 51324 - RNA, 1695 nt, Artificial Sequence
  derived and/or modified sequence opt6 from anti-influenza_Chain
gaucaaauauguauaggauaucacgcuaacaauuccacagaacagguugauacaauaauggagaaaaacguaacaguaacacacgcacaagauauauuagaaaaaacacacaauggaaaauuaugcaaccuugacggaguuaaaccucuuauacuaaaagauugcagcguugcaggcuggcuacuaggaaauccaaugugcgacgaauuccuaaaugucucggaauggagcuacauaguagaaaaagcaaguccagcaaacggccuaugcuacccaggagauuuuaacgauuaugaagagcuaaaacauuuacuaucaagaauaaaccauuuaaaaaaaauaaaaauaauaccaaaaaguuauuggucuaaccacgaagcaucaucaggagucucagcagcauguucauaccuaggagaaccaucauuuuuuagaaauguaguaugguuaaucaaaaaaaacaauacauacccccccauaaaaguaaacuauacuaacacaaaccaagaagaccuauuaguuuuauggggaauacaccaccccaaugacgaaaaagaacaaauaagaaucuaccaaaacccaaacacaagcauaaguguaggaacaucgacauuaaaccaaagacuaguaccuaaaauagcaaccaggccaaaaguaaacggacaaucuggaagaauggaauuuuuuuggacaauauuaaaaccaaaugauuccauaaacuuugacuccaauggaaacuucaucgccccagaauaugcauauaaaaucgcaaaaaaaggagauucaguaauaaugaaaagcgaacuagaauaugguaacugcaacaccaaaugucaaacaccaaugggagcaauaaacucuucaaugccuuuucacaacauacauccauuaacaauaggagaaugcccgaaauauguaaaauccaauagauuaguacucgcaacaggcuuaagaaaugcaccacaaacugaaacaagaggauuauucggagcaauagcaggauuuaucgaaggaggauggcaaggaauggucgauggaugguacggauaccaucauucaaaugaacaaggaucaggauaugcagcagacaaagaaaguacacaaaaagcaauagauggaauaacaaauaaaguaaauucaauaauagauaaaaugaacacccaauuugaaauaguaggcagagaauuuaacaaucuagaaagaagaauagaaaaccugaacaaaaaaauggaagacggauuccucgacguguggacauauaacgccgaacuacuuguccuaauggaaaaugaaagaacccucgacuuccacgauucaaauguaaaaaaccuauacgaaaaaguacgauuacaacuacgagacaacgcaaaagagcuaggaaacggaugcuuugaauucuaucacaaaugugauaaugaaugcauggaaagcguacgaaauggaacauacgauuacccacaauacucugaagaagcaagguuaaguagagaagaaauaucaggaguaaaaauggaaagcaugguaacauaccaaagcggccgauuaguuccccgaggaucaccuggaagcggauacauaccugaagcaccucgagacggucaagcauacguaagaaaagacggagaauggguacuacuaucaacauuccuuggaaaaccuauaccgaauccccuacuaggacucgacagcacagga

SEQ ID NO: 51325 - RNA, 1695 nt, Artificial Sequence
  derived and/or modified sequence opt6 from anti-influenza_Chain
gauaccauaugcauagguuaucacgcaaauaauagcacagacacaguagacacaguacuagagaaaaauguaacaguaacccacucaguaaauuuauuagaagacucacacaacggaaaauuaugucuacuaaaaggaauagcaccacuacaacucggaaacuguucaguagcuggauggauauuagguaaccccgaaugcgaacuacuaaucucaagagaaucauggucauauauaguagaaaaaccaaacccagaaaacggaacauguuacccuggacacuuugccgauuacgaagaacuaagagaacaacuuuccaguguaucaucauucgaaagauucgaaauauuuccuaaagaaucaucauggccuaaucacacaacaacaggaguaucagcaucauguucacauaauggcgaaagcucauuuuacaaaaacuuacuauggcuaacaggcaaaaauggauuauaucccaacuuaucaaaaucauacgcuaauaauaaagaaaaagaaguauuaguacuauggggaguacaccacccgccuaauauaggagaccaaagagcgcuauaccauaaagaaaacgcauacguaucaguaguaucaagccauuauucaagaaaauucacaccagaaauagcaaaacgaccaaaaguuagagaccaagaaggacguauaaacuauuauuggacauuauuagaaccaggagauacaauaauauuugaagcaaauggaaaucucauagcaccaagguaugcauuugcguuaucacgaggauucggcagcggaauaauaaacucaaacgcaccaauggacgaaugugaugccaaaugucaaacaccccaaggagcaauuaacagcucauugccauuccaaaauguucaucccguaacaauaggagaaugcccaaaauauguaagauccgcaaaauuaagaauggucacaggauuaaggaauauaccauccauacaaaguagaggacuauuuggcgcaauagcaggauuuauagaaggaggauggaccggcaugguagacggaugguauggauaccaucaccaaaacgaacaaggaucaggcuaugcugcugaucaaaaaucaacacaaaaugcaauaaauggaauaaccaacaaaguaaacucaguaauagagaaaaugaacacacaauuuacagcagucggcaaagaguucaauaaacuagaaagaaggauggaaaaccuaaacaagaaaguagacgacgguuuuauagauauauggacauauaaugcagaauuauuaguauuacuugaaaaugaaaggacuuuagauuuccacgauucaaacguuaaaaacuuauaugaaaaaguaaaaucacaacuaaagaauaaugcaaaagaaaucggaaaugguuguuuugaauuuuaccacaaauguaaugacgaaugcauggaaucagucaaaaacgggacuuacgacuacccaaaauacagugaagaaucaaaacuaaauagagagaaaauagacggaguaaaauuagaaucaaugggaguauaccaaagugguagauuaguaccaagaggaagcccaggcucaggguauauuccagaagcaccacgagacggacaagcguauguaagaaaagauggcgaauggguauuacuaagcaccuuccucggaaaaccaaucccaaacccgcuauuaggauuagauaguaccgga

SEQ ID NO: 51326 - RNA, 1695 nt, Artificial Sequence
  derived and/or modified sequence opt6 from anti-influenza_Chain
caaaauuacacaggaaaccccguaauaugucuaggacaucacgcuguaagcaaugggaccaugguaaaaacacucacagacgaccaaaucgaagucgucaccgcacaagaauuaguagaaagccaacacuuaccagaacuaugcccgaguccguuaagauuaguagauggacaaacaugcgauaucguaaauggagcauuaggaucaccaggcugugaccaccuaaacggagcggagugggacguauuuauagaaagaccaacugcaguagauacauguuacccauucgauguaccagauuaccaaucguuaagaucaauacuagcaaauaauggaaaauuugaguucauagcagaagaauuucaauggaauacagucaaacaaaacggaaaaucaggagcuuguaaaagagcaaacguaaaugacuucuuuaauagacuuaauuggcuaacaaaauccgacggaaaugcuuacccacuacaaaauuuaacuaaaguaaauaacggagacuaugcaagauuauauauauggggaguacaucacccaucaacagacacagaacaaacuaacuuauauaaaaauaacccagguagagucacagucucaacacaaacaagucaaacaucaguuguaccuaacauaggaagcagacccugggugagaggucuuagcagcagaauuucauuuuauuggacuauaguagaaccaggagaccuaauaguauuuaacacaauaggaaaccuaauagcaccaagaggacacuacaaacuuaacagccaaaagaaaagcacaauacuaaacacagccguaccaauagguucaugcguuaguaaaugucauacagacaaaggaucaaucaguacaacaaaaccauuucaaaauaucucaagaauaaguauaggagauugcccaaaauacguaaaacaaggaagucuaaaauuagcaacaggcaugcgaucaauacuagaaaaagcaaccagaggcuuauucggagcaauagcaggcuucauagaaaacggauggcaaggcuuaauagacggaugguacggauucagacaccaaaacgcugaaggcaccggaacagccgcagacuuaaaaaguacucaagcagcgaucgaucaaauaaacgguaaauuaaacagguuaauaggaaaaccaaacgaaaaauaucaccaaauagaaaaagaauuugaacaagucgaaggcagaauccaagacuuagaaaaauauguugaagacaccaaaauagaccuauggucauacaacgcagaacuauuaguagcacuagaaaaucaacauacaauagauguaacugauucugaaaugaauaaacuauuugaaagaguaagacaccaacuaagagaaaaugccgaagacaaaggaaauggcuguuuugaaauauuucaccaaugugacaacagcuguauagaaucaauaaggaauggcaccuaugaccacgacauauauagagacgaagcaauaaacaacagauuccaaauacaaggaguaaaacuaauacaaggauacaaagauucagggaggcuagucccaagaggaucacccggaucagguuacauaccagaagcacccagagaugggcaggcuuacguacgaaaagauggagaauggguccuacuaucaacauucuuaggaaaaccaauaccaaauccacuacuaggacuagacaguaccgga

SEQ ID NO: 51327 - RNA, 1695 nt, Artificial Sequence
  derived and/or modified sequence opt6 from anti-influenza_Chain
gaccagauauguauaggcuaccaugcaaauaauucaaccgaacaaguagauacaaucauggaaaaaaaugugaccguaacccaugcucaagacauuuuagaaaaaacccacaaugggaaauuaugcaaucuagauggaguaaaaccacuaauccuuaaagauugcagcguagcaggauggcuauuagggaacccaaugugcgacgaauuccuaaauguaucugaauggaguuacauaguagaaaaagcaagcccagcaaacgggcuauguuacccaggagacuucaacgacuaugaagaacuaaaacaccuacuaaguagaauuaaucaccuaaaaaaaaucaaaauaauuccgaaaagcuauugguccaaccacgaagcaucaucaggaguaucugcagcaugcucauaucuaggagaaccaucauucuuccgaaacguaguauggcucauaaaaaaaaacaacacauacccaccaauaaaaguaaacuacacaaacaccaaccaagaagaccuacuaguauuauggggaauucaucacccaaaugacgaaaaagaacaaauaagaauauaucaaaaucccaauacaucaauauccguugguacauccacccuaaaucaacgacucguuccaaaaauagccacaagaccaaaaguaaacggacaaagcggaagaauggaauucuuuuggaccauucuaaaaccuaaugauucaaucaacuucgauaguaauggaaauuucauagcaccagaauaugcauacaaaaucgcaaaaaaaggagacucaguaaucaugaaaagugaacucgaauacggaaauuguaacacaaaaugccaaacaccaaugggcgcaauaaacucaagcaugcccuuccacaacauucacccccuaacaauaggagaaugcccaaaauauguaaaaucaaauagacucguacuagccacaggacucagaaacgcaccacaaacagaaaccagaggacucuucggagccaucgcugguuuuauagaaggaggauggcaaggaaugguagacggcugguauggauaccaccauucaaacgaacaagguucaggauacgcagcagauaaagaaucaacacaaaaagcaauagacggaauaacuaauaaaguaaacucaauaauagauaaaaugaacacgcaauucgagauaguaggaagagaauucaauaaccuagagagaagaauagaaaacuuaaauaaaaaaauggaagacggauuccuagacguauggacauacaacgcagaacuccuaguauuaauggaaaacgaaagaacauuagacuuccacgauaguaauguuaaaaaccuauacgaaaaaguaagacuacaauuacgagauaaugcaaaagaacuuggaaacggaugcuuugaauuuuaucacaaaugcgacaacgaaugcauggaaucaguaagaaacggaaccuacgauuauccacaauacucagaagaagcuagauuaaguagagaagaaauaucaggaguaaaaauggaaucaaugguaacauaccaguccggaagauuaguaccacgaggaaguccaggaucaggauacauaccagaagcacccagagacggacaagcauauguaagaaaagacggagaauggguacuacucagcacauuccuaggaaaaccaauaccaaacccuuuauuaggcuuagauaguacaggc

SEQ ID NO: 51328 - RNA, 1698 nt, Artificial Sequence
  derived and/or modified sequence opt6 from anti-influenza_Chain
gacacacuaugcaucggauaccaugcaaacaacucaacagacacaguagauacaguauuagaaaagaacguaacaguaacucacucagucaacuuacuagaagacaaacauaauggaaaacuauguaaacuucguggaguagcaccacuacacuuaggcaaaugcaauauugcuggauggauauuaggaaaccccgaaugcgaaagccuaucaaccgcuucaagcuggaguuacauaguagaaacaccaaguucagacaauggaaccuguuacccaggugacuucauagauuaugaagaacuacgugaacaauuaucgagcguauccaguuucgaacgauucgaaaucuucccaaaaacaaguucauggccaaaccacgacuccaauaaaggaguaacagcagcgugcccacacgcaggagcaaagagcuuuuacaaaaaucuaauaugguuaguaaagaaaggcaauucauauccaaaauuaagcaaaucauacauaaacgauaaagguaaagaaguucuaguacucuggggaauacaccacccaucaacaucagcagaucaacaaucccuuuaccaaaaugcagacaccuacguauuugugggcucaucaagauacucaaagaaauuuaaaccagaaauagcaauacgaccaaaaguaagagaucaggaaggaagaaugaacuacuauuggacacuuguagaaccaggagacaaaauaaccuucgaagcaacuggaaauuuaguaguaccaagauaugcauuugcaauggaaagaaacgcaggaucaggaauaauaauaagcgacacacccguacacgauugcaacacaacaugccaaacaccaaaaggagcaauaaauacaucacucccauuucaaaauauacacccaauaacaauaggaaaaugcccaaaauacguuaaaagcaccaaauuaagauuggccacaggauuaagaaacauaccaucaauccaaucccgaggacucuucggagcaauagcaggcuuuauagaaggaggcuggaccggcaugguagacggaugguauggauaucaccaucaaaacgaacaaggcuccggcuacgcagcagacuuaaaaaguacacaaaacgcaauagaugaaauaacaaacaaaguaaacucaguaauagaaaagaugaauacacaauucacagcaguaggaaaagaauuuaaccacuuagaaaaacgaauagaaaaccuuaauaagaaaguagaugauggauuccuagauauauggacauauaacgcagaauuacuuguacuauuagaaaacgaaagaacacuagacuaccaugacuccaacguuaaaaaccuauacgaaaaaguaagaucacaacuuaaaaauaaugcaaaagaaauaggaaauggaugcuuugaauuuuaccauaaaugcgacaacacauguauggaaucagucaaaaauggaacauaugacuaucccaaauacuccgaagaagcaaaacuaaacagagaagaaauagacggaguaaaacuagaaucaacacgaauauaucaaucaggaagauuaguaccaagaggcuccccaggaaguggauacauuccagaagcaccacgagacggccaagcauacguaagaaaagauggagaauggguacuacuuucaacuuuccuaggaaaaccaaucccaaauccacuacucggacucgacuccacaggc

SEQ ID NO: 51329 - RNA, 1698 nt, Artificial Sequence
  derived and/or modified sequence opt6 from anti-influenza_Chain
gacagaauaugcauaggauaccaaucuaauaacucaaccgacacaguaaacacccuaauagaacaaaaagucccaguaacacaaacaauggaauuaguggaaacagaaaaacauccagcauauugcaacacagaucuaggcgcaccauuagaacuaagagacuguaaaaucgaagcaguaauauauggaaacccaaaaugcgauauacaccucaaagaucaaggauggucauacauaguagaaaggccaucagcuccagaaggcaugugcuacccaggcucaguagaaaauuuagaagaacucagauucguauuuucauccgcagcgagcuacaaaagaauaagacuauucgacuacucaagauggaacgucacaucaagcgguacuagcaaagcauguaaugcaagcacaggaggacaauccuucuaucgaucaaucaacugguuaaccaaaaagaaaccagauacuuaugauuucaaugaaggaacauacguaaacaaugaagacggagauauaauauuucuauggggaauacaucauccaccagauacaaaagaacaaacaacauuauauaaaaacgcaaauacauuaucaagcguuacaaccaacacaaucaaccgaucauuccaaccaaacauagguccaagaccauuaguccgugggcaacaagguagaauggacuacuauuggggcauauuaaaaagaggagaaacacuaaaaauaagaacaaauggaaaccugaucgcaccagaauuugguuaucuauuaaaaggugaaucacacggaagaacuauacaaaacgaagacauaccaauuggcaacugcuacaccaaaugccaaacauacgcaggggcaauaaauaguucaaaaccauuccaaaacgcaucacgacauuacaugggagaauguccuaaauauguaaagaaagccucucuaaggcuagcaguaggauugcgaaacacgccauccgucgaaccgagaggauuauucggagccaucgcaggauuuauagaaggaggauggaguggaaugauagauggaugguacggauuccaccauagcaauucagaagguacggguauggcagcagaccaaaaaucaacacaagaagccauagacaaaauaacaaauaaagucaauaacauaguagacaaaaugaacagagaauuugaaguaguuaaccaugaguucucagaaguagagaaaagaauaaauaugauaaacgauaaaauagacgaucaaauagaagaucucugggcauacaacgcagaacuauuaguauuacuagaaaaccagaaaacacuugaugaacaugacagcaaugucaaaaauuuauucgaugaaguaaaaaggcgacuaucagcaaaugcaauugaugcuggaaacgguugcuucgacaucuuacauaaaugugacaacgaaugcauggaaaccauuaaaaacggaacauaugaucauaaagaauaugaagaagaagcaaaacuagaaagaucaaaaauaaacggaguaaaacucgaagaaaacaccacauacaaaucagguagauuaguaccaagaggauccccaggaucaggauauauaccugaagcuccaagagacgggcaggcuuauguacgaaaagacggagaauggguucuacuaucaacauuccuaggcaaaccaauaccaaauccacuauuaggauuagauagcacagga

SEQ ID NO: 51330 - RNA, 1698 nt, Artificial Sequence
  derived and/or modified sequence opt6 from anti-influenza_Chain
gacaccuuauguauaggauaccaugcaaauaacaguacagauacaguagauacgguacuagaaaaaaacguaacaguaacacacagcguaaaccucuuagaagacaaacauaauggcaaacucugcaaacuucgaggcguagcaccauuacacuugggaaaaugcaauauagcaggauggauauuagguaacccagaaugcgaaucacuuucaacagcaucaaguuggucauacaucguugaaacuccaucaucagacaacggaacauguuacccuggugauuuuauagacuaugaagaacuaagagaacaauuaaguagcgugucaucauuugaaagauuugaaauauuucccaaaacaucaucuuggccaaaccacgacucaaacaaaggcgugacagcagcauguccacaugccggagcaaaaucauucuacaaaaacuugauuugguuagucaaaaaaggaaauagcuaccccaaacuauccaaaucauauauaaacgacaaaggcaaagaaguauuaguauuauggggaauacaccaucccagcacaagcgcugaccaacaaaguuuauaucaaaaugcagacacauauguauucguaggauccagcagauauucaaaaaaauuuaaacccgaaauagcaauacgcccuaaaguaagagaccaagaaggacgaaugaauuacuacuggacacuaguagagccaggagacaaaauuaccuucgaagcaacaggcaacuuaguaguccccagauaugccuucgcuauggagagaaaugcaggaagcggaauaauaauaagcgacacaccuguacaugacugcaauacaacaugccaaacaccaaaaggagcaauuaacacaagcuuaccauuccaaaacauacauccaauaacaauuggaaaaugcccaaaauacgucaaaucaacaaaacuaagauuagcaacaggacuaagaaacauaccaucgauacaaucaagaggacuauucggagcaaucgcagguuuuauagaaggaggcuggacaggaaugguagauggcugguacggcuaucaccaccaaaacgaacaaggaagcgguuacgccgcagacuuaaaauccacacaaaaugcaauagacgaaaucacaaauaaaguaaauucaguuauugaaaagaugaauacacaguuuacagcaguaggaaaagaauuuaaccacuuagaaaaacguauugaaaaucucaauaaaaaaguagacgacgguuuucucgauauauggacauacaaugcagaauuacuaguuuuauuagaaaacgaaagaacauuagacuaccaugauucgaacguaaaaaaucuauaugaaaaaguaagaucacaauuaaaaaacaacgcuaaggaaauaggaaacggcuguuucgaauucuaucacaaaugcgacaauacuugcauggaaagcguaaaaaacgguaccuaugacuauccaaaauacucagaagaagcaaaauuaaauagagaagaaauagacggaguaaaacuagaaucuaccagaauauaucaaucaggaagauuaguaccuagaggcagcccaggaaguggauacaucccagaagcaccaagagauggacaagcuuacguaagaaaagacggggaauggguccuacuaucaaccuuucuaggaaaaccaauaccaaacccacuauuaggauuagauuccacuggc

SEQ ID NO: 51331 - RNA, 1698 nt, Artificial Sequence
  derived and/or modified sequence opt6 from anti-influenza_Chain
gauagaauauguauaggauaccaaucaaauaauuccaccgauacagucaacacauuaauagaacaaaaaguaccagucacacaaacaauggaauuagucgaaaccgaaaaacauccagcauauugcaauacagauuuaggagcuccacuagaacucagagauugcaaaauagaagcaguaaucuauggaaauccaaaaugcgacauacauuuaaaagaucaaggauggaguuauauaguugaaaggcccucagcaccugaaggaauguguuacccaggaagugucgaaaacuuagaagaacuaagauuuguauucucaagugcggcaucauacaaaagaauaagacuauucgauuacagcagauggaaugugacaucaagcggaacaucuaaagcaugcaaugccucaaccgguggccaaaguuucuauagaucaaucaacuggcuaacuaaaaagaaaccagauacauaugauuuuaaugaaggaacauacguaaacaacgaagacggagauauaauuuuucuuuggggaauacaucauccaccagacacaaaagaacaaacuacacuauacaaaaacgcaaacacauuaucaaguguaacaaccaacacuauaaauagaucauuccaaccaaauauaggaccuagaccucuagucagaggacaacaaggaagaauggacuacuauuggggaauccuaaaaagaggagagacauuaaaaauuagaaccaacggaaauuuaauagcaccagaauuugguuacuuguuaaaaggagaaagucacggaagaacaauacaaaaugaagacauaccuauaggaaauugcuauacaaaaugucaaacauacgcaggagcaauaaacucaaguaaaccguuucaaaaugcaucaagacauuauaugggagaaugcccaaaauauguaaagaaagcaagccuuagacuugcaguaggauuaagaaauacaccgucagucgaaccaagaggauuauuuggagcaauagccggcuuuauagaaggaggauggucaggaaugauagauggaugguacggauuccaccacagcaauucagaaggcaccggcauggccgcagaccaaaaaucaacacaagaagcuauagauaaaauaacaaacaaaguaaacaacauaguagacaaaaugaaccgagaguucgaaguaguaaaucacgaguucagcgaaguagagaaaagaauaaacaugauaaaugacaaaauagacgaccaaauagaagauuuaugggcauauaaugcagaacuauuaguacuacuagaaaaucaaaagacauuagaugaacaugacaguaauguuaaaaaucucuucgaugaaguaaaaagaaggcuaucagcaaaugcaauagaugcaggaaauggguguuucgauauacuacauaaaugugacaacgaaugcauggaaacaaucaaaaauggaaccuacgaucauaaagaauaugaagaagaagcuaaacuagaaagaagcaaaauaaacggugucaaacuagaagaaaacacaacauacaaaucaggacgauuaguuccaagagguucaccagguucaggauauauaccagaagcaccaagggacggacaagcguauguacgaaaagacggagaauggguacuucucaguacauuuuuaggaaaacccauaccaaacccauuauugggucuagacucaacagga

SEQ ID NO: 51332 - RNA, 1701 nt, Artificial Sequence
  derived and/or modified sequence opt6 from anti-influenza_Chain
gauaaaauaugcauuggauaccaugcaaacaauucaaccacacaggucgacacaauauuagagaaaaaugucacaguuacacacuccguagaacuauuagaaaaucaaaaagaagaaagauuuugcaaaauacuaaauaaagccccauuagacuuaagaggcuguacaauagaaggauggauacuaggaaacccccaaugugacuuacuacugggagaucaaucauggucauacauuguagaacgaccaacagcgcaaaacggaauauguuauccaggugcauuaaacgaagucgaagaacuuaaagcauuaaucggauccggagaaagaguagaaagauuugaaauguuuccaaaaaguacauggacaggaguugauaccaguaguggaguaacaaaagcaugcccauauaauaguggaucaaguuucuacagaaauuuauuauggauaauaaaaaccaaaucagcugcauacccaguaauaaagggaacauacaauaacacaggaagucaaccuauacuauacuucuggggaguccaucauccaccagacacaaaugaacaaaacacacuauacggaagcggagaccgauacguaagaauggguacugaaagcaugaauuuugcaaaaagucccgaaauugcugcuagaccugcaguaaauggacaaagaggacgaauagauuacuacuggaguguauuaaaaccaggagaaacacucaauguagaaaguaacggaaacuuaaucgcaccaugguaugccuacaaauucguaagcacaaacaauaaaggagcaauauucaaaucgaauuuaccaauagaaaauugcgaugcaacaugccaaacuauagcaggaguacuaagaacuaauaaaacauuucaaaauguaucaccauuauggauaggcgaaugccccaaauauguaaaaucggaaagucuaagauuagcaacaggucuaagaaauguaccacaaauagaaacaagaggacuauucggagcaauagcaggauucauagaagguggauggacagggaugauagacggaugguacggauaccaccaugaaaacagucaagggucagguuacgcagcagacaaagaaaguacacaaaaagcgauugauggaauaacaaauaaaguaaauaguauaaucgauaaaaugaauacacaauucgaagcaguagaucaugaauuuagcaauuuagaaagacgaauagacaaccuaaauaaaaggauggaagacggcuuucuagauguauggacauauaaugcagaacuauuaguacuauuagaaaacgaacgaacacucgacuuacacgacgcaaaugucaaaaauuuauacgaaaaaguaaaaucacaauuacgugauaaugcaaaugauuuaggaaacggaugcuuugaguucuggcacaagugcgauaaugaaugcauagaaucagugaaaaauggaacuuacgacuauccaaaauaucaagaugaaaguaaauuaaacagacaagaaauagaaucaguaaaacuagacaaucuaggaguuuaucaaucgggcaggcuaguacccagaggaucaccagguucaggcuacauaccagaagcuccaagagauggacaagcauauguuagaaaagauggagaauggguauuacucagcacauuucuaggaaaaccuauaccaaacccacuucuaggacuagacucaacagga

SEQ ID NO: 51333 - RNA, 1701 nt, Artificial Sequence
  derived and/or modified sequence opt6 from anti-influenza_Chain
gacaaaauaugcauagguuaccacgcaaauaacagcacaacucaagucgauacaauauuagagaaaaacguaacaguaacacauucaguagaauuauuagaaaaucaaaaagaagaaagguucuguaagauacuaaauaaagcucccuuagaucuaagaggauguacaauagaaggauggauacucggaaacccacaaugugaccuuuuacuaggagaucagucauggucauacauaguagaaagaccaaccgcacaaaauggaaucuguuacccaggagcucuaaaugaggucgaagaauuaaaagcauuaauaggaagcggggaaaggguagaacgcuuugaaauguuuccaaaaaguacauggacaggagucgacacauccaguggaguaacaaaagcaugcccauauaacucugguaguaguuucuauagaaaucuauuauggauaauaaaaacaaaaucagcagcauaccccguaauaaaagggacauacaacaacacaggaucucaaccuauacucuauuucuggggaguacaucauccacccgacacaaacgaacaaaacacauuauaugguaguggagauagauaugucagaaugggaacagaaucaaugaacuuugcaaaaucacccgaaauagcagcaagaccagcaguaaauggacaaagaggaagaauugauuauuauuggucaguacuaaaaccaggagaaacguuaaauguugaaucaaacggaaaucuaauagcacccugguacgcauacaaauuuguaucgacuaauaauaaaggagccauauuuaaaucuaacuuaccaaucgaaaauugcgaugcaacaugucaaacuauagcaggaguucuacgaacaaauaaaacguuucaaaacguaucaccacucuggauaggcgaauguccaaaauauguaaaaagugaaagucuaagacuugccacaggauuaagaaacguaccacaaauagaaacacgaggauuauucggugcaauugcaggauuuauagaaggggguuggacaggaaugauugacggaugguacggguaucaucaugaaaacucacaaggaagugguuaugcagcagauaaagaaaguacacaaaaagcaaucgauggcauaacaaauaaaguuaauucgauaauagacaaaaugaauacacaauuugaagccguagaccaugaauuuucaaacuuagaaagaagaauagauaaucuaaauaaaagaauggaagauggauuccuagauguauggacauacaaugcagaacuauuaguacuacuugaaaacgaaagaacauuagaccuucaugaugcaaacguuaaaaaccuauaugaaaaaguaaagucacaauuaagagauaaugcaaaugaucuaggaaaugguuguuuugaauuuuggcacaaaugcgauaaugaaugcauagaaagcguuaaaaacggaaccuaugauuacccuaaauaucaggacgaaaguaaauuaaauaggcaagaaaucgaaucaguuaaacuugauaacuuaggaguauaccaaucugggagauugguacccaggggaucaccaggaucaggauacauaccagaagcaccacgagacggucaagcauauguaagaaaagauggagaauggguacuauuaagcacauuuuuagguaaaccaauaccaaacccgcuauuaggacuagauagcacaggu

SEQ ID NO: 51334 - RNA, 1704 nt, Artificial Sequence
  derived and/or modified sequence opt6 from anti-influenza_Chain
gaccacauaugcauaggauaccacgcaaacaacucaaccgaacaaguagauaccauaauggaaaaaaacguaacaguaacacaugcacaagauauacuagaaaaaacccacaacggaaaacuaugugaccucaauggaguaaaaccacuaauacuaaaagacugcaguguagccggaugguuacuaggaaacccaaugugcgacgaauuuauaaauguaccagaauggaguuacauaguagaaaaagcaaacccagcaaaugacuuaugcuacccgggaaauuucaaugacuaugaagaacuaaaacaccuauuaucaaggauaaaucauuuugaaaaaauacaaauaauaccaaaagacaguuggucagaccacgaagcaucacuagguguaucaucagcgugcccauaccaaggaaauucaaguuucuuccgcaacguaguauggcuuauaaaaaaaggcaaugcauacccuacaaucaaaaaaucauacaacaacacaaaccaagaagaucuacugguauuauggggaauacaccacccaaacgaugaagcagaacaaacaagacuauaucaaaaccccacuacauauauaucaauaggaacaucaacacuaaaccaaagauuaguaccaaaaauagcuacccgaaguaaaguaaacggacaaaguggaagaauagauuuuuuuuggaccauauuaaaaccaaaugacgcaauaaauuucgaaucaaacggaaauuucauagccccugaauacgcauacaaaauaguuaaaaaaggagauucgacaauaaugaaaagugaaguagaauauggaaacuguaacacaagaugccaaacacccaugggagcaauaaacaguucaaugccauuccacaacauacacccacuaacaauaggagaauguccaaaauacguaaaaucaaacaaauuaguuuuagcuacaggacuaagaaauuccccacaacgggaacgaaggagaaaaagaggauuauucggugcaauagccggguucauagaaggaggauggcaaggaaugguagauggaugguauggauaccaucacaguaacgaacaaggaaguggauacgcagcagacaaagagucaacgcaaaaagcaaucgauggaguaacaaacaaagucaacucaauaauagacaaaaugaacacacaauucgaagcagugggaagagaauucaacaaucucgaaagaagaauagaaaauuuaaacaaaaaaauggaagacggauuccuagacguauggacauauaacgcagaacuauuaguacuaauggaaaaugaaaggacucuagacuuccacgacucaaacguaaaaaacuuauacgacaaaguuagauuacaacuuagagauaacgcaaaagaacuuggcaauggauguuucgaauucuaucauaagugugacaacgaauguauggaaaguguaagaaacggaacauacgacuauccacaauacagcgaagaagcaagacucaaaagagaagaaauaaguggagucaaacuagaaucaauaggaacauaucaaucaggacgcuuaguaccaagaggaaguccaggcucaggauauaucccagaagcaccaagagauggacaagcauacguacgaaaagacggagaauggguauuacuaagcaccuucuuagggaaaccaauaccaaauccguuacuaggacuagauucuacaggu

SEQ ID NO: 51335 - RNA, 1704 nt, Artificial Sequence
  derived and/or modified sequence opt6 from anti-influenza_Chain
gaccagaucuguauaggauaucaugcuaacaauaguacagaacaaguagauaccauuauggaaaagaauguaacugucacccacgcacaagauauacuagaaaaaacacacaacgguaaauuaugcgacuuagacggaguaaaaccgcuuauucuacgagacuguucaguugcaggaugguuauuaggaaacccaaugugcgaugaauucauaaauguaccagaauggaguuauauaguagaaaaagccaauccagcaaacgacuuaugcuacccagguaauuucaaugacuacgaggaacuuaaacacuuacuaagcagaauaaaucacuuugaaaaaauacaaauaauaccaaaaucaucauggucugaccaugaagcaucaucaggaguaucaucagcuuguccauaucaagguacaccaaguuucuucagaaauguggucugguuaauaaaaaaaaauaacacauacccaacaauaaaaagaucauauaacaauacaaaccaagaagaccuacuaauccucugggguauacaccacucaaacgacgccgcagaacaaacaaaauuauaucaaaacccuacaacauacauaucuguuggaacaaguacacucaaccaaagauuaguaccaaaaauugcaaccagaucaaaaguaaacggacaaucaggaagaauggauuuuuuuuggacaauauuaaaacccaacgacgcaaucaacuucgaauccaacgguaauuuuauagcaccagaauaugcuuacaaaauugucaaaaaaggcgacucagcaauaguuaaaagcgaaguagaauacggaaacugcaacacaaaaugccaaacaccaauaggagcaauaaacucaagcaugccauuccauaauauacacccgcuaacaauaggcgaaugccccaaauacguaaaaucaaauaaauuaguuuuagcaacaggauuaagaaauucuccacucagagaaagacgucgaaaaagaggacucuuuggagcaauugccggauucauagaaggaggauggcaaggaaugguagauggaugguacggauaucaccauucaaacgaacaaggaucaggauacgcagccgauaaagaaucaacacaaaaagcaauagauggaguaacaaacaaagugaacaguauaauagauaaaaugaacacccaauucgaagcaguaggaagagaauucaacaacuuagaaagaagaauagaaaaccuaaacaaaaaaauggaagacggauuucuggauguauggacguacaacgcagaacuccuaguucuaauggaaaaugaaagaacacuagauuuucaugacuccaauguaaaaaaucuauaugauaaaguuagauugcagcuuagagauaacgcaaaagaauuaggaaacggaugcuuugaauucuaccacaaaugugacaaugaaugcauggaaucaguucgaaauggaacauacgauuacccacaauauagcgaagaagcacgccuaaaaagagaagaaauaagcggaguaaaauuagaaucaauaggaacauaucaaagugggcgacuaguaccacgaggcagcccaggcuccggauacauaccagaagcaccaagagauggacaagcauauguaagaaaagacggagaaugggugcuauuaucaacauuucuagguaaaccaauuccuaauccauuacuaggauuagacucaacugga

SEQ ID NO: 51336 - RNA, 1704 nt, Artificial Sequence
  derived and/or modified sequence opt6 from anti-influenza_Chain
gaucauauauguaucggauaccacgccaacaacucaacagaacaaguagacacaaucauggaaaaaaacguaacaguuacacaugcccaagacauacuagaaaaaacacacaacggaaaauuaugugauuuaaacggagucaaaccacucauacuaaaagacuguucagucgcaggaugguuauuagguaauccaaugugcgaugaauucauaaacguaccagaauggaguuacauaguagaaaaagcuaacccggcaaaugaucuaugcuauccaggaaacuucaaugacuacgaagaauuaaaacaccuguuaaguagaauaaaccacuucgaaaaaauacaaauaauaccaaaagauucauggucagaucacgaagccucgcucgguguuucaagcgcaugcccauaucaaggaaauagcucauucuucaggaacgugguuuggcugaucaaaaaagguaacgcauacccaacaaucaaaaagucauacaacaauacaaaccaagaggaccuacuaguacuguggggaauacaccacccaaacgacgaggcagaacaaacacgacuauaucaaaauccaacaacauacauuucaauaggaacaaguacauuaaaucaaagauuagucccaaaaauagcaacaagaagcaaaguaaauggccaaucuggaagaauagacuuuuucuggacaauacuaaaaccaaacgacgcaauaaauuucgaaaguaauggaaacuuuauagcaccagaauaugcauacaaaauaguaaaaaaaggcgauagcaccauaaugaaaagugaaguagaauacggaaauugcaacacaagaugccaaaccccaaugggagcaauaaauagcucaaugccauuucauaacauacacccacuaacaauaggagaaugcccaaaauauguaaaaagcaacaaacuuguacucgcaacaggacuacgaaacucaccacaacgagaaagacgaagaaaaagaggacuauucggagcaauagcaggauuuauagaaggcggauggcaaggaaugguagauggcugguacggauaucaccauagcaaugaacaaggaucaggcuacgcagcugacaaagaauccacucaaaaagcaauagacggaguaacaaacaaaguaaacucaauaauagacaaaaugaauacccaauuugaagcaguagguagagaguucaauaaucuggaaagaagaaucgaaaaccuaaauaaaaaaauggaagauggguuccucgacguauggacauacaacgcagaauuauuaguacuaauggaaaaugaaagaacuuuagacuuucacgacagcaauguaaaaaacuuauaugauaaaguuagauuacaacucagagacaacgcaaaagaauuaggcaauggauguuucgaauuuuaccacaaaugcgauaacgaauguauggaaucaguaagaaacggaacauaugacuacccacaauauucagaagaagccagacuaaaaagagaagaaauaagcggaguaaaauuagaaagcaucggaacauaucaaagcggaagacuaguaccacgcggaucaccagguucuggauacauuccugaagcaccaagagauggacaagcuuacguaagaaaagauggagaauggguccuacuauccacauuccuaggaaaaccaauaccaaauccacuacuaggucuagacaguacagga

SEQ ID NO: 51337 - RNA, 1704 nt, Artificial Sequence
  derived and/or modified sequence opt6 from anti-influenza_Chain
gaucaaauauguauaggauaccacgccaacaacucaacagaacaaguagacaccaucauggaaaaaaacguaacaguaacacaugcacaagauauacuugaaaaaacacacaauggaaaauuaugugaucuagacggagucaaaccauuaauacuaagagacuguucaguagcaggcuggcuauuaggaaauccaaugugcgacgaauucauaaacguacccgaauggucauauauaguagaaaaagcaaaccccgcaaaugaccuauguuacccaggaaauuucaaugauuaugaagaauuaaaacaucuacuaucaagaauaaaccacuucgaaaaaauacaaauaauaccgaaaagcucauggucugaccaugaagcaucaucagguguaucgucagcauguccauaccaaggaacaccaucauucuucagaaacguaguaugguuaauaaaaaaaaauaacacauacccaacaaucaaaagaagcuauaauaacacuaaccaagaagaccuauuaauuuuauggggaauacaccauucuaaugacgccgcugaacagaccaaacuauaucaaaacccaacaacauacauaucagucggaacuucaacauuaaaucaacgacuaguuccaaaaauagccacaagaagcaaaguaaacgggcaaaguggaagaauggauuuuuucuggacaauauuaaaaccaaacgacgcaauuaauuucgaaaguaacggaaacuuuauagccccagaauaugccuauaaaauaguuaagaaaggagacagcgcuauaguaaaaagcgaaguagaauacggaaacuguaacacaaaaugucaaacaccuauaggagcaauaaacucaucaaugccuuuucauaauauacauccgcuaacaauaggagaaugccccaaauacguuaaaucaaacaaauuaguauuagcaacaggccuaagaaacaguccauuaagagaaagaagacguaaacgaggauuauucggagcaauagcaggauucauugaagguggauggcaaggaaugguagacggaugguacgguuaucaucauaguaaugaacaagguaguggauacgcagcagacaaagagucaacacaaaaagcaauagacggaguaacaaauaaagucaauucaauaauagacaaaaugaacacacaauuugaagccguaggacgagaauucaauaaucuagaaaggagaaucgaaaaccuaaacaaaaaaauggaagacggguucuuagacguauggacauauaacgcagaauuauuaguccucauggaaaaugaaagaacucuagacuuucacgauucaaacguuaagaacuuauaugacaaaguaagauuacaauuacgcgauaaugcaaaagaauugggaaacggcuguuucgaauuuuaccacaaaugcgacaaugaauguauggaaucgguaagaaauggaacauacgacuauccacaauauucugaagaagcccgacuaaaaagagaagaaaucuccggcguaaaauuagaaucaauaggaacauaucaaagcggaagauuaguaccaagaggaucaccaggaaguggauacauaccagaagcaccuagagauggacaagcauacguaagaaaagacggcgaauggguauugcuauccaccuuccuagguaaaccaauaccaaacccauuauuaggccuagacucaacagga

SEQ ID NO: 51338 - RNA, 1707 nt, Artificial Sequence
  derived and/or modified sequence opt6 from anti-influenza_Chain
gaucaaaucuguauaggauaucaugcuaauaauaguacagaacaaguagacacaauaauggaaaaaaauguaacaguaacccacgcacaagacauacuagaaaaaaaacacaauggaaaacucugcgacuuagauggaguaaaaccauuaauauugagggauuguucaguagcaggauggcuccuaggaaauccaaugugcgacgaauuuauaaacguaccagaauggagcuacauuguagaaaaagcaaacccaguaaacgaucuaugcuaccccggagauuucaacgacuacgaagaacuaaaacaccuacuaucaagaauaaaccauuucgaaaaaauccagauaauaccaaaauccagcuggaguagucacgaagcaagccugggaguauccuccgcgugcccauaucaaggcaaaagcaguuucuuccgaaacgucguauggcuaauaaaaaaaaacucaacauauccaacaaucaaacgauccuauaacaacaccaaccaagaagacuuauuaguauuauggggaauacaccauccaaacgaugcagcagaacaaacaaaacuauaucaaaauccaaccacauacauaucggucggaacauccacccuuaaccaaagacuaguaccaagaauagcaacaagaaguaagguuaacggacaaaguggaagaauggaauucuucuggacaauacuaaaaccaaacgaugcaaucaacuuugaaucaaacgguaacuuuauagcaccggaauacgccuauaagaucguaaaaaaaggagauucuacaauaaugaaaucagaacuggaauacggaaauuguaacacaaagugccaaacaccaaugggcgcaaucaacagcagcaugccauuccauaauauacacccacuaacaaucggggaaugcccaaaauauguaaaaucaaacagacuaguauuagccacgggcuuacguaacucaccacaaagagaaagaagaagaaaaaaaagaggacuauuuggugcaauagcagguuuuauagaaggaggauggcaaggaauggucgacggaugguauggauaccaccauucaaacgaacaagggaguggcuaugcugcagacaaagaaaguacucaaaaagcaauagacggaguaacaaacaaaguaaacaguauaauagacaaaaugaacacacaauuugaagcaguuggcagagaauucaacaauuuagaacgaaggauagaaaaucuaaacaaaaaaauggaagacggauuuuuagauguauggacauacaaugcagagcuuuuaguacuaauggaaaaugaaagaacccuagacuuucacgauagcaacguaaaaaaucuauacgauaaaguaagauuacaacuaagagauaacgcaaaagaacuaggaaacggauguuucgaauucuaucauaaaugcgacaacgaaugcauggaauccguaagaaacggaacauaugacuacccacaguacucagaagaagcccgacuaaaaagagaagaaauaucaggcguuaaacuagaaucaaucggaauauaccaaagcggaagacuaguaccaagaggaucaccaggaucaggauacauaccagaagccccaagagacggacaagcauacguacgaaaagacggagaauggguccuacuaucaacauuuuuaggaaaaccaauaccaaauccucuacuaggucuagacucaacagga

SEQ ID NO: 51339 - RNA, 1707 nt, Artificial Sequence
  derived and/or modified sequence opt6 from anti-influenza_Chain
gaccaaauauguauuggauaccacgcaaacaauaguacagaacaaguagacacaauaauggagaaaaauguaacaguaacacacgcccaagacauccucgaaaaaacacauaacggaaaacucugcgacuuagauggaguaaaaccuuuaauacuaagagacugcagcgucgcaggaugguuauuaggcaaucccaugugugaugaauucauaaacguuccagaauggucauauauaguagaaaaagccaauccaacaaacgacuuaugcuacccuggaucuuuuaacgacuaugaagaacuaaaacauuuacuaaguagaauaaaucauuuugaaaaaauacaaauaauacccaaaucaucauggagugaucacgaagccagcucaggcguaucuucagcaugcccauauuugggaucaccaagcuucuuuagaaauguuguauggcuaauuaaaaaaaauaguacauaccccacuauaaaaaaaucauauaacaauacaaaccaagaagaucuacuaguauuauggggaauacaccacccaaacgacgcagcagaacaaacaagauuauaccaaaacccuacaacauacauaucaauagguacaagcaccuuaaaccaacgacuaguaccaaagauagccacaagaagcaaaguaaacggacaaucaggaaggauggaauuuuuuuggacaauacuaaaaccuaaugacgcaauaaacuucgaaucgaacggaaacuuuaucgcaccagaauacgcauacaaaauaguaaaaaaaggagauagcgccauaaugaaauccgaacuagaguauggaaacugcaacacuaaaugccaaacaccaaugggagcaauaaacucaagcaugccauuccacaacauacacccacuaacaauuggagaauguccaaaauauguaaaaucaaacagauuaguacuagcaacaggacuaagaaacaguccacaaagagaaagcagacguaaaaaaagaggacuauucggagccaucgcaggauuuauagaaggaggauggcaaggaaugguagauggaugguacggauaccaucauucaaacgagcaaggaucgggauacgcggcagacaaagaauccacacaaaaagcaauagacggcguaacaaacaaaguaaacaguauaauugauaaaaugaauacacaauucgaagcaguaggaagagaauuuaacaaucuagaaagaagaauagaaaaucuaaauaaaaagauggaagacgguuuccuagacgucuggacauauaacgccgaacuacuaguauuaauggaaaaugaaagaacacuagacuuucaugacucaaauguaaaaaaccuuuacgauaaagucagauuacaauuaagagauaacgccaaagaacuaggaaauggcuguuuugaauuuuaccacaaaugugauaaugaauguauggaaucuauaagaaacggcaccuauaauuauccucaauacucagaagaagcaagacuaaaaagagaagaaauaucaggcguaaaauuagaaaguaucggaacauaccaauccggucgacucguaccuagaggcucaccaggcucagguuauaucccagaagcaccuagagacggacaagcauauguaagaaaagauggagaauggguauugcuauccacauuccuaggaaaaccaauaccaaauccacuuuuaggucucgacagcaccgga

SEQ ID NO: 51340 - RNA, 1707 nt, Artificial Sequence
  derived and/or modified sequence opt6 from anti-influenza_Chain
gaccagauaugcauaggauaucaugcaaacaauagcacagaacaaguagacacaauaauggaaaaaaacguuacagucacacaugcccaagacauauuagaaaaaacacauaacggaaaacuaugugacuuagauggcguaaaaccacuaauauuaagagacugcucuguagcuggauggcuccuuggaaauccaaugugcgaugaauuuuuaaauguuagcgaaugguccuauauaguagaaaaaauaaauccagcuaacgaccuuuguuacccuggaaauuucaacaauuacgaagaacuaaaacauuuauuaucaagaaucaacagauuugaaaaaauccaaauaauaccaaaauccuccuggccagaucaugaagcaucauuaggcguaucaucugcauguccauaccaaggagguccaucauucuacagaaacguaguaugguuaaucaaaaaaaacaauacuuaccccacaauaaaaaaaucauaucacaacacuaaccaagaagaccuauuaguacucuggggaauccaucauccaaacgaugaagcagaacaaacucgaauauacaaaaauccaacaaccuacauuucaguaggaacaucaacacucaaccaaagacuaguaccaaaaauagcaaccagaucaaaaguaaacggacaaagcggaagaguagaauuuuucuggacaauauuaaaaucaaacgauacaauaaacuucgaaaguaacggaaauuuuauugcaccagaaaaugcauacaaaauuguaaaaaaaggagacaguacaauaaugaaauccgaauuagaauauggcaacuguaacacaaaaugccaaacaccaauaggcgcaauaaacucaucaaugccauuucauaacauucacccacuaacaauuggagaaugucccaaauauguaaaaaguaacagauuagugcuagccacagggcuaagaaacagcccucaaggcgaacgaagacgaaaaaaacgaggccuauucggagcaauagcaggauuuauagaaggaggguggcaagguauggucgaugguugguacggauaucaccauucuaacgaacaagguaguggauaugcagcagacaaagaaagcacccaaaaggcaaucgauggcguaacaaacaaaguaaacucaaucauagacaaaaugaacacacaauucgaagccguaggaagagaauucaacaacuuagaaagaagaauagaaaacuuaaauaaaaaaauggaagacggauucuuagauguauggacauacaacgcugaacuucuaguacuaauggaaaacgaaaggacccuagacuuccaugacucaaauguuaaaaaccuauacgacaaaguaagauuacaacuaagagacaacgcaaaagaacuagguaauggauguuucgaauuuuaccacagaugugacaacgaauguauggaauccguaagaaacgguaccuaugauuacccacaauacucagaagaagcaagauuaaaacgagaagaaauaucaggaguaaaauuagaaucaaucggcacguaucaaucgggaagacuaguaccaagaggaaguccaggaagcggauacauaccggaagcuccaagagauggacaagcauauguccgaaaagauggagaauggguacuauuaagcacuuuccuaggaaaacccauucccaacccgcuacuaggacuagacucaacuggg

SEQ ID NO: 51341 - RNA, 1707 nt, Artificial Sequence
  derived and/or modified sequence opt6 from anti-influenza_Chain
gaccaaauaugcauaggauaccacgcaaacaauagcacagaacaaguugacacaauaauggaaaaaaacguuacaguaacacacgcccaagacauacucgaaaaaaaacacaauggaaaacuaugugacuuagauggcguaaaacccuuaauacuacgagacuguucaguagcaggauggcuauuaggaaacccaaugugcgacgaauucauaaauguaccagaauggaguuacauaguagaaaaagcaaacccgguaaacgaccucuguuacccuggagacuucaacgacuaugaagaacuaaaacaccuacucucaagaauaaaucauuuugaaaaaauacaaauuauaccgaaaaguucauggucaucacaugaagcaucucuaggaguaucaagugcaugcccauaccaaggaaaaucaucauucuucagaaacguaguaugguuaauaaaaaaaaacaguacauacccaacaaucaaaagaucauacaauaacacuaaccaagaagaccuccuaguuuuauggggaauacaucaccccaaugaugcagcggaacaaacaaagcuauaccaaaacccaacaacauacauaagcgucggcacaucaacucucaaucaaagacuaguaccaagaauagcaacaagaagcaaaguaaacgggcaaucagguagaauggaauuuuucuggacuauccuuaaaccaaacgaugcaauaaacuucgaaagcaacggcaacuuuauagcaccagaauaugcauauaaaauaguaaaaaaaggagacaguacaauaaugaaaagugaacucgaauacggaaacugcaacacaaagugccaaacaccaaugggcgcgauaaauaguaguaugccauuucacaauauacauccacuaacaauuggcgaauguccaaaauacguaaaaaguaauagacuaguauuagccacaggauuaagaaauucaccacaacgagaacgaagacgaaaaaagagaggacucuucggagcuauagcagguuucauagaaggcggauggcaaggaaugguagauggaugguacgguuaucaccacaguaacgaacaaggcucaggauacgcagccgacaaagaaucaacacaaaaagcaauagauggggucacuaacaaaguaaauucaauaauagacaaaaugaauacacaauuugaggcaguaggaagagaauucaauaaccuagaaagacguauagaaaauuuaaauaaaaaaauggaagacggauuuuuagauguauggacauacaacgcagaguuacuaguacuaauggaaaaugaaagaacacuagauuuccaugacucaaacguaaaaaauuuauaugacaaaguaagacuucaauuaagagauaacgcaaaagaauuaggcaauggauguuucgaauuuuaccacaaaugcgacaacgaauguauggaaagcguaagaaacggcaccuacgacuauccacaauauucagaagaagcacgacuaaaaagggaagaaauaucaggagucaaauuagaaaguauaggaauauaccaaaguggcagacuuguaccccgagguucaccaggaucaggauauauaccagaagcaccaagagacggacaagcauauguaagaaaagacggagaauggguacuucuaucaacauuucuaggcaaacccauaccaaacccacuacuaggauuagauucaacagga

SEQ ID NO: 51342 - RNA, 1707 nt, Artificial Sequence
  derived and/or modified sequence opt6 from anti-influenza_Chain
gaucaaauaugcaucggauaccacgccaacaacaguacagaacaaguagacacaauaauggaaaaaaacgucacaguaacacacgcacaagacauauuagaaaaaacucacaauggaaaauuaugcgaucuagacgguguaaaaccgcuaauauuacgagacugcaguguagcuggauggcuacuaggaaacccaaugugugacgaauucauaaacguaccagaauggucauacaucguagaaaaagccaauccaacaaaugaucucugcuauccaggaucauucaacgacuaugaagaacuaaaacauuuauuaagcagaauaaaucauuuugaaaaaauacaaauaauucccaaaaguuccuggagugaccaugaagcaucuagcggcguauccucugcaugcccauaccuaggaucgccaagcuucuucagaaacguugucuggcucauaaaaaaaaauuccaccuacccaacuauaaaaaaaagcuacaauaacacaaaccaagaagaccuuuuaguauuauggggaauacaccacccgaacgacgcagcagaacaaacaaggcuuuaucaaaauccaaccacauacauaagcauaggaacaucaacacuaaaucaaagauuaguacccaaaauugcuacaagaaguaaaguaaacggacaaucaggaagaauggaauuuuucuggacaauccuaaaaccaaaugaugcaauaaacuucgaaagcaacggaaacuuuauagcacccgaauaugcuuacaagauaguaaaaaaaggagacagugcaauaaugaaaucagaauuagaauacggaaauugcaacacaaaaugccaaacaccaaugggagccauaaacucauccaugccauuccauaauauccacccacuaacaauaggagaaugcccaaaauacguaaaaucaaaucgacuaguccuagccacaggccuaagaaauucuccacaaagagaaagucgaagaaaaaaacgaggacuauuuggagcaauagcgggguucauagaaggaggauggcaaggaaugguagacggaugguacggcuaccaccacaguaaugaacaaggauccggauaugccgcagacaaagaaucaacgcaaaaagccauagacggaguaacaaacaaaguaaauucaauaauagacaaaaugaacacacaauucgaagcaguaggaagagaauucaauaacuuagaaagaagaauugaaaauuuaaacaaaaaaauggaagaugguuuccuagacguauggacauauaacgcagaacuacuaguacuaauggaaaaugaaagaaccuuagauuuccaugacaguaacguuaaaaacuuauacgauaagguaagacuacaacuaagagauaacgcaaaagaacuugguaacggcuguuucgaauuuuaucauaaaugugauaaugaaugcauggaaaguauaaggaacggcaccuauaacuacccucaguauucagaagaagccagauuaaaaagagaagaaauaucaggaguaaaacuagaaaguauaggaacauaccaaagcggaagauuaguaccacgaggcucacccggaucaggcuacauaccagaagcaccaagagacggacaagcauaugucagaaaagauggagaauggguccuacuaucuaccuuccuaggaaaaccaauaccaaacccacuacuaggcuuagauucaacaggc

SEQ ID NO: 51343 - RNA, 1707 nt, Artificial Sequence
  derived and/or modified sequence opt6 from anti-influenza_Chain
gaucaaauaugcauaggguaccacgcaaauaauucaacagaacaaguagacacaauaauggaaaagaauguaacggucacucacgcacaagacauauuagaaaaaacacacaauggaaaacucugcgacuuagacggaguaaaaccuuuaauacuaagagauuguagcguagcagguuggcucuuaggaaacccuaugugugaugaauuccuaaacgucucagaauggagcuacaucguagaaaaaaucaacccagcaaacgaccuaugcuacccaggaaacuucaauaacuacgaagaacuaaaacaccuacucucacgaaucaacagauucgaaaaaauacaaauaauaccgaaaucaucauggccagaccaugaagcaagccuaggugucucaagcgcaugcccauaucaaggcggaccaucauucuacagaaacguaguauggcuaauaaaaaaaaacaauacguacccaacaauaaaaaaaaguuaucauaauacaaaccaagaagacuuauuaguacucuggggaauacaucacccaaacgacgaagcagaacaaacaagaauauacaaaaauccaacaacauacauaagugucggaaccucaacacuaaaccaaagauuaguaccaaaaauagcgacuagauccaaaguaaacggacaaucaggacgcguagaauucuuuuggacaauauuaaaaagcaacgauacaauaaauuuugaaucaaacggcaacuuuauagcaccagaaaaugcauacaaaauaguaaagaaaggagauucaacaaucaugaaaucagaauuagaauauggaaacuguaauacaaaaugucaaacuccaauaggcgcaauuaacucaagcaugccauuucauaacauacauccacuaacgauaggagaauguccaaaauacguaaaaucaaacagauuaguacuagcgacaggauuaagaaauucuccgcaaggagaaagaagaaggaaaaaacgaggauuauuuggagcaauagccggauucauagaaggaggauggcaaggaauggucgaugggugguauggauaucaccauagcaacgaacaaggcagcggauaugcagcugauaaagaaucaacacaaaaagcaaucgauggagugacaaauaaaguaaauagcauaauagacaaaaugaacacacaauucgaagcagugggccgagaauucaauaaucuagaaagaagaauagaaaaucuaaacaaaaaaauggaagacggauuuuuagauguuuggacauauaaugcagaauuacucguacuaauggaaaaugaaagaaccuuagacuuccacgacagcaauguaaaaaacuuauacgauaaaguccgacuucaacuaagagauaacgcaaaagaauuaggaaacgguugcuuugaauuuuaccacagaugugauaaugaaugcauggaauccguaagaaacggaacguacgacuauccucaauauucagaagaagcaagauuaaaaagagaagaaauaucaggaguaaaacuagaauccauaggaacuuaucaaaguggacggcuaguaccaagaggcagccccggcaguggauacauuccagaagcaccgagagauggacaggcauacguaagaaaagauggagaauggguacuguuaaguaccuuuuuaggaaaaccuaucccaaacccacuauuaggacuugacucaacagga

SEQ ID NO: 51344 - RNA, 1728 nt, Artificial Sequence
  derived and/or modified sequence opt6 from anti-influenza_Chain
aucugcauaggauaccacgcaaauaacucaacagaacaaguagauacuauaauggaaaaaaauguaaccguaacacaugcacaagacauccuagaaaaaacacacaacggcaaacucugcgaucuagauggaguaaaaccauuaauacuaagagacugcucaguagcuggauggcuacucggaaaucccaugugugacgaauucauaaacguaccagaauggucauacauuguugaaaaagcaaauccagcaaaugaccuaugcuacccaggaaacuucaacgacuacgaagaguuaaaacacuuauuauccagaaucaaucacuuugaaaaaauacaaauaauaccaaaaucaaguuggucagaccacgaagcauccagcggagucucuucagcaugcccauaccaaggaacacccucguucuuucgaaacguuguauggcuaauaaaaaaaaacaauaccuauccaacaauaaaacgaucauacaauaacacaaaucaagaagauuuacucauauuauggggcauacaccacuccaacgaugcugcagaacaaacaaaauuauaccaaaacccaacaaccuauauaaguguuggaaccucaaccuuaaaccaaagacuaguaccuaaaauagcaaccagauccaaaguuaauggacaaaacggcagaauggacuucuuuuggacaauacuaaaaccaaacgacgcuauaaacuuugaaucaaacggcaacuuuauagcaccagaauaugcauacaaaauaguaaaaaaaggugacagcgccauaguaaaaucagaagucgaauaugguaacuguaauaccaaaugucaaacuccaaucggagcaauaaacucaucaaugccauuucauaauauccacccacucaccauaggugaauguccaaaauauguaaaaucuaacaaauuaguacuagcaacaggucuacguaauucacccuuaggauacauaccagaagccccaagagacggacaagcauacguaagaaaagacggagaauggguauuauuaucaacauuuuuacgaucagacaaaacacacacuuguccaccauguccagcuccagaacuacuuggaggcccauccguauuccuauucccaccaaaaccuaaagauacauugaugauaucucgaaccccugaaguaaccuguguuguaguggacguaucccaugaagacccugaagucaaauucaacugguacguagacgguguugaaguacacaaugcaaaaacaaaaccuagagaagaacaauacaacucuacauacagagucguauccguacuaaccguccuacaucaagacuggcuaaauggaaaagaauacaaaugcaaaguaucaaacaaagcacuaccagcaccaauagaaaaaacaauaucaaaggcuaaaggccaaccgagagaaccacaaguuuacacccuaccaccuaguagagaagagaugaccaaaaaccaaguaucuuuaacaugucuaguaaaaggauucuauccuucagauaucgcuguagaaugggagucuaauggacaacccgaaaacaacuacaaaacaacaccaccaguccuagacucagauggaucauuuuucuuauauucgaaacucaccguagauaaaucaagauggcaacaaggcaacgucuuuucaugcucuguaaugcaugaagcacuccauaaccauuauacacaaaaaucauuaucauuaucacccggaaaa

SEQ ID NO: 51345 - RNA, 1728 nt, Artificial Sequence
  derived and/or modified sequence opt6 from anti-influenza_Chain
augguaguaacauccaacgcagacaggauauguacaggcaucacaucaucaaauuccccacacguagugaaaacagcaacacaaggagaaguaaauguaacaggagucauaccacuaacaacaaccccaacaaaaagucauuucgcaaacuuaaaagggaccgaaacacgaggcaaauuaugcccuaaaugcuuaaacuguacugacuuagaugucgcauuaggaagaccuaagugcacaggaaauauacccucagcaagaguaucuauccuccacgaagucagaccaguaacuucgggaugcuuuccuauuaugcacgauagaacaaaaauucgacaacuaccuaauuugcuaagaggauaugaacauauaagacuaucaacacauaauguaauaaaugccgaaaacgcaccaggaggaccuuauaaaauaggaaccucaggaucaugcccaaacguaacaaauggaaacgguuuuuuugcaacaauggcaugggcaguuccaaaaaacgacaauaauaaaacagcaacuaacagccuaacaaucgaaguaccauacauaugcacagaaggagaagaccaaauaacaguauggggcuuucacagcgauaacgaaacacaaauggcaaaauuauauggcgacuccaaaccacaaaaauuuacaaguucagcaaacggcgucacaacacacuauguaucccaaauaggcggauucccaaaccaaaccgaagaugggggacuaccacaaagugguagaauagucguagacuauaugguacaaaaaaguggaaaaacaggaacaauaacauaccaacgaggcauacuacucccacaaaaaguuuggugcgcaaguggcaaaagcaaaguaauaaaaggaucccuaccacucauaggcgaagcagauuguuuacaugaaaaauauggcggacuaaacaaaagcaaaccuuacuacacaggagaacacgcaaaagcaauaggaaauugcccuauauggguaaaaaccccacuaaaauuagcaaacgguacaaaauacagaccaccagcuaaacuucuaaaagaaaggggcuuuuuuggcgcaaucgcaggauuccuagaaggagggugggaagguaugauagcgggauggcauggauacacaagucauggagcacaugguguugcaguagcagcugaucuaaaaucuacucaagaagccauaaauaaaauaacaaaaaaucuaaacucacuaagcgaacuagaaguaaaaaauuuacaaagacuaucaggagcaauggacgaacuucacaaugaaauacuagaauuagaugaaaaaguagaugaccuacgagcagacacuaucucaucacaaauagaacuagcagucuuauuaucaaacgaaggaauaauaaacagcgaagacgaacaccuacuggcauuagaaagaaaauuaaaaaaaauguuaggaccauccgcaguugaaauaggaaauggauguuucgaaacaaaacacaaaugcaaucaaacaugcuuagaccgaauagcagcgggaaccuucgacgcaggcgaauuuucccuaccaacauuugacucucucaauauaacagcagcgucauuaaacgacgaugguuuagacaaucauaccauacuauuauauuauucaaccgcagcaucaagccuagcaguaacacuaaugauagcaauauucguaguauauaugguaagcagagacaacgucagcuguuuccauagc

SEQ ID NO: 51346 - RNA, 1728 nt, Artificial Sequence
  derived and/or modified sequence opt6 from anti-influenza_Chain
auggucgucacaucaaaugcagaccgaauaugcacagguauaacaaguuccaacucaccacacguuguaaaaacugcaacacaaggagaagucaauguaacaggagucauaccacuaacaacuacaccuacaaaaagccauuucgcuaacuuaaaagggaccgaaaccagaggcaaauuauguccaaaaugucuaaauuguacagacuuagauguagcacuaggaagaccaaaauguacaggaaacaucccuucagcccgaguaucuauacuacacgaagucaggccaguaacaucaggauguuucccaauaaugcacgauagaacaaaaauaagacaacucccaaauuuauuaagaggauaugaacauauuagauuaucuacccauaacguuaucaacgcugaaaacgcuccaggaggaccauauaaaaucggaacaucuggaagcugcccaaacgugacuaauggcaauggauuuuucgcaacaauggcaugggcuguaccuaaaaacgauaauaauaaaaccgcaacaaauagccuaaccauagaaguaccguauauauguacagaaggagaagaccaaauaacaguuuggggauuccauagugacaacgaaacacaaauggcuaaacuauauggagauuccaaaccacaaaaauuuacaagcucagccaauggaguaacaacacacuauguaucucaaauaggcggauuuccaaaccaaacagaagacggaggacuuccccaaagcggccgaauuguaguagacuacaugguccaaaaaucaggaaaaacaggaacaauaacauaccaaagaggaaucuuacuaccacaaaaaguauggugcgcaagugggaaaaguaaaguuauaaaaggcucgcuaccacuaauuggagaagccgauugccuccacgagaaauauggcgggcuaaacaaauccaaaccauacuauacaggugaacaugcaaaagccauuggaaacugcccaauauggguaaaaacaccauuaaaauuagcaaaugguacaaaauacagaccaccagccaaauuauuaaaagaaagaggauucuucggagcaauagcugguuuucucgaaggagguugggaaggcaugaucgcuggcuggcacggauauacaagucauggagcacacggaguagcaguagcagcagaccucaaaagcacacaagaagcaauaaacaaaauaacaaaaaaucucaauucacuaucagaacuagaaguaaaaaaucuacaaagacuaucaggagcaauggacgaacuacauaaugaaauauuagaacucgacgaaaaaguagaugaccuacgagcugacacaauaucuucacaaauagaauuagcaguauuacuaucaaacgaaggaauuauaaauagugaagacgaacauuuacuagcacucgagagaaaauuaaaaaaaauguuaggaccuucugcaguagaaaucggcaauggaugcuucgaaacaaaacauaaaugcaaucaaacaugcuuggauagaaucgcagcagggaccuuugacgcaggcgaauuuucacuacccacguuugacucacucaacauaacagcagcaagucucaacgaugauggacuagauaaucauaccauauuacuauacuacucuacagcugcuuccucccuugcaguaacuuuaaugauagcuauuuuuguaguauacaugguaaguagagacaauguaucauguuuucacagu

SEQ ID NO: 51347 - RNA, 1728 nt, Artificial Sequence
  derived and/or modified sequence opt6 from anti-influenza_Chain
auauguauaggcuaucaugcaaacaauucaacagaacaaguagacacaauaauggaaaaaaacgucacaguaacccacgcacaagacaucuuagaaaaaacccacaauggaaaacuaugugaucuagauggaguaaaaccacucauacuccgagacuguaguguagcaggaugguuauuaggaaacccaaugugcgaugaauucauaaacguaccagaaugguccuacauaguagaaaaagccaacccagcgaacgauuuaugcuaccccggaaauuucaaugacuacgaagaacucaaacacuuacuaucacgcauaaaccauuucgaaaaaauacaaaucauacccaaaucaucauggucugaucaugaagcaucuucaggaguaagcucagcauguccauaccaagguacaccauccuuuuucagaaacguaguaugguuaauaaaaaaaaauaacacauacccaacaauaaaacgaucauauaauaacacaaaucaagaagaucuacucauauuaugggguauacaucacuccaacgacgccgcagaacaaacaaaauuauaccaaaaucccacaacauauauaucaguagguacaucaacccuuaaucaacgacuaguaccaaaaauagcuacaagauccaaagugaacggccaaaacgguagaauggacuuuuucuggaccauacuaaaaccaaacgaugccauaaauuucgaaaguaacggaaacuuuauugcaccagaauacgcauauaaaaucguaaaaaaaggugauucagcaauaguaaaaucugaaguugaauacggaaauugcaauaccaaaugccaaacaccaaucggagcaaucaacucaagcaugccuuuccacaacauacacccacucacaauaggagaaugccccaaauaugucaaaagcaacaaacuaguacucgcuacaggacuucgaaacuccccacuaggcuacauaccagaagcaccaagagauggacaagcauauguucgaaaagacggagaauggguacuauuaucaacauuccuacgaucugauaaaacacacacaugcccaccaugccccgcuccagaacuccuuggaggcccaucaguauuccuauucccacccaaaccaaaagacacucuaaugauauccagaacacccgaagucacaugcguaguaguagauguaucacacgaagacccugaaguaaaauucaauugguaugucgacggcguugaaguacacaacgcaaaaacaaaaccaagagaagaacaauauaacuccacauaccggguaguaucaguacucacaguuuuacaccaagacugguuaaauggaaaagaauacaagugcaaaguaagcaacaaagcuuuaccagcaccaaucgaaaaaacaauaucuaaagccaaaggacaaccaagagaaccacaagucuauaccuuaccaccaucaagagaagaaaugacaaaaaaccaaguuucgcucacuuguuuaguaaaaggauucuaccccucagacauagcugucgaaugggaaucaaauggacaaccagaaaauaacuacaaaacaacaccuccaguuuuagacucagacggaucauucuuucuauauucuaaacuaacaguugacaaaucacgauggcaacaaggaaacguauuuucuugcagcguaaugcacgaagcacuucacaaccauuacacacaaaagucacuaucccuaucaccaggcaaa

SEQ ID NO: 51348 - RNA, 1731 nt, Artificial Sequence
  derived and/or modified sequence opt6 from anti-influenza_Chain
gcaaaagcuggaguacaaaguguaaaaauggaaaaaauaguauuauuauuugcuauuguuucacuagugaaaucagaucaaauauguauaggcuaccacgcaaacaacucaacagaacaaguugacacaauaauggaaaaaaacguaacaguuacacacgcacaagacauauuagaaaaaacccauaacgguaagcucugcgauuuagauggaguaaaaccauuaauacuaagagauugcagcguagcaggcuggcuacuaggaaacccaaugugcgacgaauucauaaauguaccagaauggagcuauauaguagaaaaagcaaaccccguaaaugauuuaugcuacccuggagacuuuaacgacuaugaagaacuaaaacacuuacuaucaagaauuaaucacuuugaaaaaauacaaaucauaccaaaaaguagcuggagcucacaugaagcaucacuaggaguaucaagugcauguccauaucaaggaaaaagcuccuucuuuagaaacguaguaugguuaauaaaaaaaaauaguacauacccuacaauuaaacgaaguuacaacaacacaaaucaagaagaucuacuaguacuauggggcauacaccacccaaacgaugcagcugaacaaacaaaauuauaccaaaauccuacaacguacauauccguaggcacuucaacacuaaaccaaagacuaguuccaagaauugcaacaagaaguaaaguuaacggacaaucaggcaggauggaauuuuucuggacaauauuaaaaccaaaugacgcaauaaauuucgaaaguaacgguaauuucauagcucccgaauacgcauacaaaauaguaaaaaaaggagauucuacaauaaugaaaucagaacuagaauacggaaacuguaauacaaaaugucaaacaccuaugggcgcaaucaauagcucaaugccauuccacaacauacauccacucacaauaggggaaugcccaaaauacguaaaaucaaauagacuaguacuugcaacaggauuaagaaauucaccacaaagagaaagacgccgaaaaaaaagaggucuauuuggagcuauugcaggauucauagaaggcggauggcaaggaaugguagacgguugguacggauaucaccacagcaacgaacaaggaucaggauaugcagcugacaaagaaucuacacaaaaagcaauagauggaguaacuaacaaaguaaacagcauaauagacaaaaugaacacacaauucgaagccguaggaagagaauuuaacaacuuagaaagacgaauagaaaaucuaaacaaaaaaauggaagacggcuuccuagauguauggacauacaacgcagagcuucuuguccuaauggaaaacgaaagaacacuagacuuccacgacaguaauguaaaaaacuuauacgacaaaguaagauuacaacugcgcgacaacgcaaaagaauuaggaaacggaugcuucgaauucuaccauaaaugugauaacgaaugcauggaaucaguaagaaacggcacuuacgacuauccacaauauucugaagaagcaaggcucaaaagggaagaaauaucaggagucaaacuagaauccauaggaauauaucaaauacuaaguauauauucaacaguagcguccagccuagcacucgcacucauggucgcuggauuaucacuauggaugugcucaaauggaucauuacaaugccguauauguauu

SEQ ID NO: 51349 - RNA, 1731 nt, Artificial Sequence
  derived and/or modified sequence opt6 from anti-influenza_Chain
gcuaaagccggaguacaaaguguaaaaauggaaaaaauaguauuauuauucgcaauaguaucccuaguaaaaucagaccaaauaugcauaggcuaccaugcaaacaacaguacagaacaaguagauacaauaauggaaaaaaacguaacagugacacacgcccaagacauauuagaaaaaacccacaacggaaaguugugcgacuuagacggaguaaaaccauuaauacuaagagauuguaguguagcaggcugguuacuaggaaauccaaugugugaugaauucauaaauguaccagaauggagcuacauaguagaaaaagcaaacccagucaacgacuuauguuacccuggcgacuuuaacgauuacgaagaauuaaaacaccuauuaagccgaauaaaccauuuugaaaaaauucaaauuauaccaaaaaguucauggucaucacacgaagcaucacuaggaguaagcagugccugcccauaucaaggaaaaucaucauuuuucagaaacguaguaugguuaauaaaaaaaaacucaacuuacccaacaauaaaaagauccuacaacaacacuaaucaagaagacuuacuaguucuaugggguauccaccacccaaaugaugcagcagaacaaacgaaauuauaucaaaacccaaccacauacauaagcguaggaacaucaacacucaaccaaagauuaguuccccgcauagcuacaagaaguaaaguaaacggacaaucaggaagaauggaauucuucuggacuauacuaaaaccaaacgacgcaauaaacuuugaaucaaacggcaacuucauagcaccggaauacgcauauaaaauagucaaaaaaggagacaguacaauaaugaaaucagaacuagaauauggaaacuguaacacgaaaugucaaaccccaaugggagcuauaaauaguucaaugccguuccacaauauacauccacuaacaauaggagaaugcccgaaauaugucaaaucaaacaggcuuguacuagcaacaggacuacgaaacuccccacaacgagaacgaagacgaaaaaaaagaggcuuauucggagcaauugcaggguucauagaaggaggauggcaagguaugguagacggaugguaugguuaccaccauucaaaugaacaagggagcggcuacgcagcugauaaagaaucaacacaaaaagcuauagacggaguuaccaacaaaguaaacaguauaauagacaaaaugaacacucaguuugaagcaguaggaagagaauuuaacaaccuagaaagaagaauagaaaacuuaaacaaaaaaauggaagacggauucuuagauguauggacauauaaugcagaauuacucguacuaauggaaaacgaaagaacucuagauuuucaugauucaaacguaaaaaacuuauacgauaaaguacguuuacaacuaagagauaacgcaaaagaacucggaaauggaugcuucgaauucuaucacaaaugugacaacgaauguauggaaagcguuagaaauggaacauacgauuacccacaauauucagaagaagcaagauuaaaaagagaagaaauaucagggguaaaacuagaaaguauagguauauaccaaauacuaucaauauauucaacaguagccagcucccuagcauuagcacuaaugguagcaggccuuucacuauggauguguucaaacggaucauuacaaugucgcauauguauu

SEQ ID NO: 51350 - RNA, 1737 nt, Artificial Sequence
  derived and/or modified sequence opt6 from anti-influenza_Chain
augguuguaacaaguaaugcagauagaauaugcacaggaauaacaucauccaauagcccacacguaguuaagacagcgacccaaggugaaguaaacguuacaggugugauaccacucacaacuacuccaacaaaaucucauuucgcuaaucuaaaagguacccaaacaagaggcaaacuaugcccaaacugucuuaauugcacagauuuggauguagcucuaggaagaccuaaauguaugggaacaauaccauccgcgaaagcaaguauacuucaugaaguuaaaccaguaacaagcggauguuuuccaauaaugcacgauagaacaaaaauaagacagcuacccaaucuucuuagaggauaugaaaacauacgauuaucagcaagaaacguaauaaacgcagaaacggcaccaggcggaccauacaucguaggcacuucaggaagcuguccaaacgucacaaacgggaaaggauucuuugcaaccauggcuugggcaguaccuaaaaacaaaaauaaaacagcaacaaauccauuaacagucgaaguuccauacauaugcacuaaaggagaagaccaaauaaccguauggggauuucacagcgacaacgaagcacaaaugguaacauuauauggagauagcaaaccacaaaaauucacuucaucagcaaacggugugacaacacauuauguaucgcaaauuggagguuucccaaaccagacugaagacgaaggacuucaacaaucaggaagaauagucguagacuauaugguacaaaaaccuggaaaaacggguacaauuguauaccaaagaggaguuuuacuuccacaaaaaguauggugugcaagcgggagaucaaaaguaaucaaaggaucauuaccacuaauaggagaagccgacugcuuacaugaaaaauauggaggacucaauaaaucuaaaccauacuauaccggagaacaugcaaaagcaauugguaauugcccaauauggguaaaaaccccucuaaaacuugcaaacggaacaaaauauagaccaccagccaaauuauuaaaagaaagaggauuuuucggagcaauugcaggauuucuagaaggcgggugggaaggcaugauagcaggauggcauggauauacaucccauggcgcacacggaguagcaguugcagcagaucuuaaaagcacacaagaagccauaaacaaaauaacuaaaaaucuaaacucauugagugaauuagaaguuaaaaaucuacaaaggcuaucaggagcaauggacgaauuacauaaugaaauauuagaauuagaugaaaaaguagaugacuuaagagccgacacaaucucaagucaaauagaacuagcaguacuacuuucaaacgaaggaauaauaaauagugaagacgaacaccuacuagcacucgaacguaaacuuaagaaaaugcuaggaccaucagcaguagacauaggaaauggcuguuucgaaacaaaacauaagugcaaccaaacaugcuuagacagaauugcagcaggaacauucaacgcaggagaauuuucauuaccaaccuucgacucacuaaauauaacggcagccagucuaaaugacgacggucuagauaaccauacaauacuauuauacuauaguacugcagcaagcucacuugcaguaacucuaaugauagcuaucuucauaguauacaugguaucucgagauaacguauuucuacuacaucuuucuauaagaaaa

SEQ ID NO: 51351 - RNA, 1737 nt, Artificial Sequence
  derived and/or modified sequence opt6 from anti-influenza_Chain
augguagucacuagcaaugccgacagaauaugcacaggcauaacuagcucaaauaguccccacguaguaaaaaccgcgacacaaggagaaguaaauguaacuggaguuauaccgcuaacaacaacgccaacaaaaucucacuuugcaaauuuaaaaggaacucaaaccagagggaaacuuuguccuaauuguuuaaauuguacagaccuagacguagcauugggaagacccaaaugcaugggaacaauaccgagcgcaaaagcauccauacuacacgaaguaaaaccggucacaucuggaugcuuuccaauaaugcaugauagaacaaaaaucagacaacuaccuaaccucuuacgaggauaugaaaauauaagacuaucugcccgaaauguaaucaaugcagaaaccgccccaggaggaccauauauagugggcacgucaggaucaugcccaaauguuaccaacggaaaaggauucuuugcaacaauggcaugggcuguacccaaaaauaaaaauaaaacagcaacaaacccacuaacuguagaagucccauacauaugcacaaaaggagaagaucaaauaacaguauggggcuuucauagugauaaugaagcccaaaugguaacacuauacggagacagcaaaccacaaaaauucaccuccucagcaaauggaguaacuacacacuacguaucacaaaucggaggauuccccaaccaaacagaagaugaaggauuacaacaaaguggucgaaucguaguagauuacaugguacaaaaaccaggaaaaacuggaacuauaguauaccaaagaggaguccuacucccgcaaaaaguauggugugcuaguggacguaguaaaguaaucaaaggaucacuuccacuuauaggcgaagcagacuguuuacacgagaaauauggaggacuuaauaaaucgaaaccauauuauacaggagaacaugcaaaagcaauaggcaacuguccaauuuggguuaaaaccccacuaaaacuagcaaaugguacuaaauauaggccuccagccaaauuacucaaagaacgagguuucuuuggugcaauagcgggauuuuuagaaggaggaugggaaggaaugauagcuggcuggcauggguacacaucccacggagcucauggaguagcaguagcagcugauuuaaaaagcacacaagaagccauaaauaaaaucacgaaaaaucuaaauagucuuuccgaacucgaagucaaaaacuuacaacgacuaucaggagcaauggaugaacuccacaacgaaauacuagaauuagaugaaaaaguagaugauuuacgagcagacacaauuucuucccaaauagaauuagcggucuuacuaucaaacgaaggaauaauaaauagcgaagacgaacacuuacuagcacuagaaagaaaacuaaagaaaauguuagguccaagugcaguagauaucggaaacggauguuuugagacgaaacauaaaugcaaccaaacuuguuuggacagaauagcagccggaacauuuaacgcaggcgaauuuucauuaccaaccuucgauucacucaacauaacagccgccagcuuaaaugaugauggacuagauaaucauacuauauuacuauauuauucaacugcagcgagcucccuugcaguaacauuaaugaucgcaauauuuauuguauauaugguaucaagagauaacguauucuuauuacacuuaaguauaagaaaa

SEQ ID NO: 51352 - RNA, 1731 nt, Artificial Sequence
  derived and/or modified sequence opt6 from anti-influenza_Chain
auggaaaccauaucacuaauaacaauacuucuaguaguaacagcaagcaaugccgauaaaaucugcauaggucaucaaucaacaaacucaacugaaacgguagacacauuaacagaaacaaacguuccaguaacacaugcuaaagagcuauuacacacagaacauaauggcaugcucugcgcaacaucgcuaggacauccauuaauacuugacacauguacaauagaaggauuaguauacggcaacccaaguugugauuuacuauuagggggcagagaauggaguuauauaguagaaagaucaucagcaguaaauggaacuuguuauccaggaaacguugaaaauuuagaagaauuaagaacucucuucucauccgcaucaucauaucaacgaauacaaauauuuccagauacaacuuggaacguaacauauacaggaacaaguagggcaugcaguggaucauucuauagaucaaugagauggcuaacccaaaaaucaggcuucuauccaguacaagaugcccaauauacaaacaauagaggaaaaaguauauuauucguauggggaauacaccacccaccaacauacacagaacaaacaaaucuauauauaagaaaugauacaacaacaucaguuacuaccgaagacuuaaacagaacauuuaaaccaguaauaggaccaagaccucucguaaauggucuacaaggcagaauagauuauuauuggucagucuuaaaaccaggacaaacauuaagaguaagaaguaacggaaacuuaaucgcucccugguacggccacguauuaucaggaggaucucaugguagaauauuaaaaacagaccugaaaggaggaaacugcguagugcaaugucaaaccgaaaaaggaggauuaaacaguacccuucccuuucacaauauauccaaauaugcauuuggaacuuguccuaaauacguaagaguaaauagccuaaaacuagccguaggacugagaaaugucccagcuagauccucuagaggacuauuuggcgcaaucgcaggauuuauugaaggaggauggccaggacuuguagcagguugguacggauuucaacauucaaaugaucaaggaguaggaauggcagcagacagagauagcacacaaaaagccauagacaaaauaacaucaaaaguaaacaacauuguagauaaaaugaacaaacaauaugaaauaauagaucaugaguucagcgaaguagaaacacgacuaaacaugauaaauaacaaaauagaugaccaaauucaagaugucugggcuuacaaugcugaacuucuaguacuacuagaaaaccagaaaacacuggaugaacaugacgccaacguuaauaauuuauauaauaaaguaaaacgagcacuaggaaguaacgccauggaagacggaaagggaugcuuugaauuauaucauaaaugcgaugaucaaugcauggaaacaauucgaaauggaaccuauaacagaagaaaauacagagaagaaagcagacuagaacgccagaaaauagaaggagucaaacuagaaagcgaaggcacauacaaaagcggaagacugguaccacgagggaguccaggaaguggauacaucccagaagcuccaagagauggacaagccuacguccgaaaggacggagaauggguauuauuauccaccuuucuaggcaaaccaauaccuaacccauuauuaggauuagacucaacagga

SEQ ID NO: 51353 - RNA, 1731 nt, Artificial Sequence
  derived and/or modified sequence opt6 from anti-influenza_Chain
auggaaacaauaaguuuaauaacaaucuuauuaguuguaacagcaaguaaugcagauaaaaucuguauuggacaucaaucaacaaauaguacagaaaccguagauacccuuacagaaacaaauguaccaguaacacacgcaaaagaacuacuucauacagaacauaacggcaugcuaugcgcaaccagucuagggcauccauuaauacuagacacauguacaauugaaggauuaguauacggcaacccaucaugcgacuuauuacuaggaggccgugaauggucauacauaguugaaagaaguagcgcuguaaauggaaccuguuauccagguaauguagaaaaccuagaagaauuacgaacauuauuuucaucagcaucgaguuaucaaagaauacaaauauuucccgauaccaccuggaauguaacauacacaggaacauccagagcauguucaggaaguuucuauagaucaaugaggugguuaacucaaaaaucaggguucuauccaguucaagacgcacaauauacaaauaaucgaggaaaaucaauauuauucguauggggaauacaucacccaccaaccuauaccgaacaaaccaacuuauauauacgcaacgauacaacuacaagcguuaccacagaggaccuaaauagaacauuuaaacccguaauaggacccagaccacucguaaacggucuacaaggaagaauagauuacuauuggucuguauuaaaaccaggacaaacauuaagaguaaggucaaacggcaaccuaauagcaccuugguacggucacguacuaaguggaggaagucauggacgaauauuaaaaacagacuuaaaaggaggaaauugcgucguacaaugccaaacagaaaaaggaggacuaaauucuacucuuccuuuucacaauauaucaaaauacgcauuuggaacauguccuaaauaugucagaguaaacucacuaaaacuagcuguaggucuaaggaauguaccagcaagauccucaagaggacucuucggugcaauugcaggauuuauagaaggaggauggccaggucuaguagcaggaugguaugguuuucaacauaguaaugaccaaggaguagguauggcugcagauagagacagcacccaaaaagccauagauaaaauaacaagcaaagucaauaacauaguagacaaaaugaacaaacaauaugaaauaauagaucaugaguucagugaaguugaaacaagacuaaauaugauaaauaacaaaauagacgaucaaauacaagacgucugggcauauaaugcagaauuauuaguacuacuagaaaaucaaaagacauuagacgaacaugaugcaaacguaaacaaccuauauaacaaaguaaaaagagcccuaggaaguaaugcuauggaagacggaaaagguuguuuugaacuauaccacaaaugcgacgaccaaugcauggaaaccauaagaaaugguacauauaacagaagaaaauaccgagaagaaucaagauuagaaagacaaaagauagaaggcguaaaacuagaaagugagggaaccuacaaaucuggaagauuaguaccaagaggaucuccuggaaguggcuauauaccagaagcaccaagagacggucaggcuuacguacgaaaagacggagaauggguacuauuaaguacauuuuuaggaaaaccaauaccaaacccauuacuaggauuagacucaaccgga

SEQ ID NO: 51354 - RNA, 1752 nt, Artificial Sequence
  derived and/or modified sequence opt6 from anti-influenza_Chain
augaaagcaaucauaguacuacuaaugguaguuacaaguaaugcugauagaauaugcacaggcauaacauccucaaauucaccacacguagucaaaacagcaacacaaggagaaguaaauguaacuggagucauaccauugacaaccacuccaacaaaaucucacuuugcuaauuuaaaaggaacucaaacaagaggaaaauuaugcccaaacuguuuuaauugcacagacuuagauguagccuuagguagaccuaaaugcaugggaaauaccccuagcgcaaaaguaagcauauuacaugaagugaaaccggcgaccaguggauguuuuccaaucaugcaugauagaacaaaaauaagacaauuaccaaaccuuuuacgagguuacgaaaauauaagacugucaacaagcaauguaauaaacacagaaacagcuccugguggaccauacaaaguaggaacaucaggaagcugcccaaauguagcaaauggcaacggauucuucaacacaauggcguggguaauaccaaaagacaacaauaaaacagcaauaaauccagucacaguagaaguacccuacauaugcucagaaggagaagaucaaauaacaguauggggauuccauagugacgauaaaacucaaauggaacgacuguacggagauucuaacccccaaaaauucacaucuuccgccaauggaguaacaacacauuacguaucgcaaauaggaggauuuccaaaucaaacagaagaugaaggucuuaaacaaagcggaagaauaguaguugacuauaugguacaaaaacccggaaaaacaggaaccaucgucuaccaacgagguauauuacucccacaaaaaguauggugcgcaucuggaagaucuaaagugauaaaagguucucuaccucuaauuggagaagccgauuguuuacacgaaaaauauggugguuuaaacaaaucuaaaccauacuacacaggagaacaugcaaaggcaauaggaaacugcccaauauggguaaaaacaccacuaaaauuagcaaacggaaccaaauacagaccaccagcaaaacuauuaaaagaacgaggauucuuuggagcuauugcuggauuucuagaaggaggaugggaaggaaugauagcaggauggcauggcuacacaagucauggugcacacggaguagcagucgcagcugauuuaaaaucaacacaagaggcuauaaauaaaaucacgaaaaaucuaaauuauuuaucugaacucgaagucaaaaacuuacaaagacuaucaggugcaaugaacgaauuacacgaugaaauauuagaacucgacgaaaaaguugaugacuugagagcagacacaauaucaucucaaauagaauuagcaguuuuacucaguaaugaaggaauaauuaauagcgaagacgaacaccuacuagcauuagaaagaaaauuaaagaaaaugcuagguccaucagcuguagaaauaggaaauggauguuucgaaacaaaacauaaaugcaaucaaacaugcuuagaucgaauagcagcaggaacauuuaaugccggugauuuuucauuaccaacauucgacucacuaaacaucacagcagcaagucuaaacgacgacggacuagauaaucauacaauauuauuauacuauagcacagcagcaaguucauuagcaguuacguuaaugauagcaauauuuauuguauauaugguaucaagagauaaugucaguuguucaauaugcuug

SEQ ID NO: 51355 - RNA, 1752 nt, Artificial Sequence
  derived and/or modified sequence opt6 from anti-influenza_Chain
augaaagcuaucauaguauuauuaaugguaguaaccucaaaugccgaccgaauuuguacaggcauuacaucaaguaauucaccccacgugguaaaaacagcaacacaaggagaagucaacguaacaggaguuauaccauuaacaacaaccccaacaaaaucauacuuugcaaacuuaaaaggaacaaaaacaagaggaaaacuauguccugauugccuaaacugcacugaucuugacguagcacuaggaagaccaauguguguaggaaccacacccagcgcaaaagcauccauauuacaugaaguacgaccuguuacaucaggcugcuuuccaauaaugcaugacagaacuaaaauaagacaacuagccaaccuauuaagaggcuaugaaaacauaagacuaagcacccaaaauguaauagaugcagaaaaagcaccagguggaccauacagguuaggaacuagcggaaguuguccaaaugcaacaucaaaaucagguuucuucgcaacaauggcuugggcugucccaaaagacaacaacaaaaaugcaacaaacccucucacgguagaaguaccuuauauaugcacagaaggagaagaucaaauaacaguauggggauuccacagugaugacaaaacacaaaugaaaaaccuauauggagacucaaacccacaaaaauucacuaguuccgcaaacggaguaacaacacacuacguuucacaaauaggaggauuuccagaucaaacagaagauggaggauuaccucaaagcggacggauaguaguagacuauaugaugcaaaaaccuggcaaaacuggaacuauaguauaccaaagaggaguauuauuaccacagaaaguauggugcgcgagugggagaagcaaaguuauaaaaggaucacuaccacucauaggagaagcugacuguuuacaugaaaaauacggaggacucaacaaaaguaaaccauauuacacuggcgaacaugccaaagcaauaggcaacugcccaauauggguaaaaacaccacuaaaacuagcaaauggaaccaaauacagacccccugccaaacuauuaaaagaacgaggauucuucggagcaauagccggauuuuuagagggaggaugggaaggaaugauugcaggauggcacggauauacaucccauggagcccacgggguagcagucgcagcagacuuaaaaaguacacaagaagcaauuaacaaaauaacaaaaaaucuuaauuccuugagugaauuagaaguaaaaaaucuacaacgacuaaguggagcaauggaugaacuacauaacgaaauacuagaauuagaugaaaaaguagacgauuuaagagcagauacaauaaguucacaaauagaauuagcaguacuauuaucaaacgaaggaauaauuaauagcgaagaugaacaccuucuagccuuagaaagaaaauuaaaaaaaaugcuaggacccucagcaguagacauaggaaauggaugcuucgaaacaaaacacaaaugcaaucaaacaugcuuagauagaauagcagcaggaacauuuaacgcaggagaauucagccuaccaaccuuugacucacuaaacauaacagcagcaagucuaaaugacgacggucuugauaaccacacuauacuacuauauuauucaacagcugcuagcucacuagcagucacacucauguuagcaauauucauaguauauaugguaucaagagacaacguaucaugcucaauaugucua

SEQ ID NO: 51356 - RNA, 1752 nt, Artificial Sequence
  derived and/or modified sequence opt6 from anti-influenza_Chain
augaaagcaauaauaguacuguuaaugguaguaacuagcaacgcugaucgaaucugcacaggaauaacaucaaguaauagcccacauguaguaaaaacagccacacaaggagaaguaaauguuacaggaguaauaccacucacaacaacaccuacaaaaucauacuucgcaaauuuaaaaggcacaagaacaagaggaaaacuuugcccggauugccucaacugcacagauuuagacguagcacuagggagaccaaugugcguaggaacgaccccaagugcaaaagcaaguauccuacaugaaguaaaaccaguaacaagugguugcuuccccauaaugcacgacagaacaaaaauacggcaauuaccaaaccuauuaagaggauaugaaaacauacgacuaaguacacaaaacguaauagaugcagaaaaagcgccaggaggaccauauagauugggaacaaguggaagcugucccaaugccacaaguaaaagcgguuucuuugcaacaauggcaugggcgguaccuaaagauaacaacaaaaaugcaaccaacccauuaacaguagaaguaccauauaucugcacugaaggagaagaucaaaucaccguaugggguuuucacuccgaugauaaaacccaaaugaaaaaccuauauggagacucaaacccacaaaaauucacaagcagugcuaauggaguaacuacccauuauguaucacaaauaggaucauuuccagaccaaacagaagauggaggauugccucaaaguggcagaauaguaguagacuacaugaugcaaaaaccuggaaaaacuggcacaauaguauaucaaagaggaguauuacuaccacaaaaaguauggugugcaucaggacgaucaaaaguaauaaagggaucgcuaccacuaauaggagaagcugauuguuuacaugaaaaauacggcgguuuaaacaaaucaaaaccuuauuauacaggagaacaugcaaaagccauaggaaauugcccuauauggguaaaaacaccuuuaaaacuagcuaacggaacaaaauacagacccccagcaaaacuauuaaaagaaagaggauucuuuggagcaaucgcaggcuucuuagaaggcggaugggaaggaaugauagcaggauggcauggauacacaucacacggagcacacggaguagcaguagcagcagaucucaaaagcacacaggaagcaauaaauaagaucacuaaaaaucuaaauagcuuaagcgaauuagaaguuaaaaacuuacaaagacuaucaggagcaauggaugaauuacacaaugaaauauuagaacuugaugaaaaaguagaugaccuuagagcugacacaauaaguucacaaauagaacuagcaguuuuacuaucuaaugaaggaauuauaaauucugaagacgaacacuuacuugcuuuagaaagaaaauuaaagaaaaugcuaggaccuucagcaguagaaauaggaaauggcuguuucgaaacaaaacauaaaugcaaucaaaccugccuggacagaaucgcagcaggaacauuuaacgccggugaauuuagcuuaccuacauuugauagccuaaacauuacagcagcaagucuaaacgaugacggauuagauaaucacacaauauuauuauacuauaguacggcagcgucaucauuagcggucacacuaaugcuagcaaucuuuaucguauacaugguaucucgcgauaacguuaguugcuccauauguuua

SEQ ID NO: 51357 - RNA, 1752 nt, Artificial Sequence
  derived and/or modified sequence opt6 from anti-influenza_Chain
augaaagcaauaaucguacucuuaaugguuguuacaaguaacgcagauagaauaugcacaggaauaaccucauccaauucuccacauguaguaaaaacagcaacgcaaggcgaaguaaacguuacuggaguaauuccgcuaacaacaacaccaacgaaaucacauuuugcaaauuuaaaaggcacacaaacaagaggaaaauuaugcccaaacuguuuuaauugcacggaccuagacgucgcacuaggacgaccaaaaugcaugggaaacacaccaagcgcgaaaguaaguauacuacaugaaguaaaaccggccacaucuggaugcuucccaauaaugcacgaucgaacaaaaauuagacaauuaccaaacuuacuaagaggauacgaaaauauaagacuaagcaccucaaauguaaucaacacagaaacagcaccaggaggaccauacaaaguaggaacaagcgguaguugcccaaaugucgcaaacgguaacgguuucuuuaauacaauggcauggguaauaccaaaagacaacaauaaaacagccauaaauccaguaacaguugaaguaccauacauaugcucugaaggugaagaucaaauaacuguuuggggauuucauagugaugauaaaacacaaauggaaagacuauacggggacaguaacccacaaaaauucacaagcucagcuaacggcguaacaacacacuacgucucucaaauagguggauuuccaaaccaaacagaagacgaaggccuaaaacaaucagguagaauaguaguagauuacaugguacaaaaaccaggaaaaacuggcacaauuguauaucaaagagguauauuauuaccgcaaaaaguauggugcgcaucaggaagaucaaaaguaauaaaaggaucauuaccacuuaucggugaagcagauugccuacacgaaaaauauggaggucuuaauaaaucaaaacccuauuauaccggcgaacaugcaaaagccauaggaaauuguccaaucuggguaaaaacaccacucaaauuagcaaauggaacaaaauacaggcccccagcaaaacuauuaaaagaaagagguuucuuuggcgcaaucgcaggauuccuagaaggaggaugggaagguaugauagcaggcuggcacggauauacgucacauggagcacacggaguagcaguagcagcagaucuaaaaucaacacaagaagcaauuaacaaaauaacuaaaaaucuaaauuacuuaagugaacuagaaguuaaaaacuuacaaagauuaagcggagcaaugaaugaacuucaugaugaaauauuagaauuagaugaaaaaguagaugauuuaagagcggacacaauaucaagucaaauagagcuagcaguauuauuaucaaacgaaggaauaauaaauagugaggacgaacaucuacucgcacuagaacgaaaacuaaagaaaaugcucgguccaucagcaguagaaauaggaaauggaugcuuugaaacaaaacauaaaugcaaucaaacaugccuagacagaauagcagccggaacauuuaacgcgggugauuucaguuuacccacauucgacucacuaaacauaacggcagcaagccuaaaugaugacggacuugauaaccauaccauacuauuauauuacaguacagcagcaagcucauuagcaguuacacuaaugauagcaauauucaucguauacaugguaucgagagauaauguaucauguagcauauguuug

SEQ ID NO: 51358 - RNA, 1752 nt, Artificial Sequence
  derived and/or modified sequence opt6 from anti-influenza_Chain
augaaagccauaauuguucuauuaaugguaguaacaaguaaugcagacagaauuuguacaggaauaacaucaagcaauaguccucacguuguaaaaaccgcaacccaaggcgaaguaaacguaacaggcguaauaccgcucacuacaacgccuacaaaaucauacuucgcaaaucuaaaaggaacaaaaacuagagguaaacuaugcccagacugucuuaauugcacagaccuagacguagccuuaggcaggccuaugugcguaggaacaacaccaagugcgaaagcaucaauauuacaugaaguaaggccgguaacuuccggcugcuuuccaauuaugcacgauagaacaaaaauaagacaacuagcaaauuuacuacgagguuacgaaaacauaagacuaaguacacaaaauguuauugaugcugaaaaagcaccuggaggaccauauagauuaggaacaucuggcaguugucccaaugcaacaagcaaaucuggauucuucgcaacaauggcaugggcaguccccaaagauaacaauaaaaaugcaacgaauccuuugacaguagaaguaccauacauauguacagaaggugaagaucaaauaacaguguggggauuucauagugacgauaaaacccaaaugaaaaaucuauacggagacucgaacccacagaaauucacauccucagcaaauggaguaacaacccacuauguaagucaaauaggaggauuuccagaucaaacagaagacggaggauuaccacaaucaggacguaucguaguagauuacaugaugcaaaaaccaggaaaaacaggcacaaucguauaccaaagaggaguccuacuaccacaaaaaguauggugugcaaguggacgaucaaaaguaaucaaaggaucucuaccacuuauuggagaagcagauugucuacaugaaaaauauggaggacuaaacaaaucaaaaccauacuauacuggagaacacgcuaaagcuauaggcaauuguccaaucuggguaaaaacaccacuuaaacuagcgaacggaacaaaauacaggcccccagcaaaauuacuaaaagaacgaggauucuucggagcaauagcaggauuucuugaaggaggaugggaaggaaugauagcaggcuggcauggauauacaagucauggagcacacggaguugccgucgcagcagaucuaaaaagcacccaggaagcaauaaacaaaaucacaaaaaaucucaacagucuaagugaacucgaaguuaaaaaucuacaaagauuaucaggagcaauggaugaauuacacaaugaaauauuagaguuagaugaaaaaguagaugacuuaagagcagacacuauuagcucccaaauugaacucgcaguauuacuaucuaacgaaggaauaauaaacucagaagacgaacauuuacuagcacuugaaagaaaacuaaaaaaaaugcucgguccaucagccguagacauaggaaauggauguuucgaaacaaaacacaaauguaaucaaacaugcuuagauagaaucgcagccggaaccuuuaacgcaggagaauuuucguuaccaaccuuugacucacucaacauaaccgcagcaagucuaaaugaugacggacuagauaaucauacaauucuucuauacuauaguacggcagcuaguucgcuagcaguaacauuaaugcuagccauauuuauaguauauauggucucaagagauaauguauccuguagcauaugcuua

SEQ ID NO: 51359 - RNA, 1752 nt, Artificial Sequence
  derived and/or modified sequence opt6 from anti-influenza_Chain
augaaagcuauaaucguauuauuaaugguagucacuagcaaugccgacagaauaugcacaggaauaacaucuagcaauucaccacacguaguaaaaacagcuacacaaggagaaguaaaugucacaggaguaaucccacucacaacaacacccacuaaaucauacuucgcaaaucuaaaaggaacaagaacacguggaaaauuaugcccugauugcuuaaauugcacugaucuugaugucgcacuagguagaccuaugugcguagguaccacaccuucagcaaaagcaucaauauuacaugaaguaaaaccagucacaagcggauguuucccaauaaugcacgacagaaccaaaauuagacaacugccaaauuuauuaagaggauaugaaaauauucgauuaagcacacaaaacguuauagacgcugaaaaagcaccaggaggcccauauagacuaggcacaaguggaagcuguccaaaugcaacaucaaaaaguggcuuuuuugcaacaauggcaugggccguacccaaagacaauaauaaaaaugcuacaaacccguuaacaguugaaguaccauacauaugcacugaaggugaagaucaaauuacaguauggggauuucacagcgaugauaaaacucaaaugaaaaaccuauacggugauucaaacccgcaaaaauucacgaguucagcuaauggaguaaccacacacuacguaucacaaauaggaucauucccggaucaaacagaagacggaggauuaccacagagcggcagaauaguaguagauuacaugaugcaaaaaccagguaaaacaggaacaaucguguaccaaagaggaguacuacuaccacaaaaaguauggugcgcaaguggaagaucaaaagugauaaaaggaucacuaccauuaauaggagaagcagauugccuacaugaaaaauauggcggacuaaauaaaaguaaaccuuacuauacaggagaacaugcaaaagcaauaggaaauugcccaaucugggucaaaacaccccuaaaacuagcaaacggaaccaaauauagacccccagcaaaauugcugaaagaaagaggauuuuuuggagcgauagcgggcuuccuagaaggaggaugggaaggaaugauagcugguuggcacggcuacacaucacauggagcacauggaguagccguugcagcagaucuaaaaaguacacaagaagcaauaaacaaaauaacaaaaaauuuaaauucauuaagugaacuagaaguaaaaaacuuacaaagacuaucaggagcuauggacgaacuacauaaugaaauacuagaacuagacgaaaaaguagacgaccuaagagcagauacaauaagcagccaaaucgaacuagcaguacuauuauccaaugaaggaauuauuaauagcgaagacgaacaucucuuagcacuagagcgaaaacuaaaaaaaaugcuaggaccaucugcgguagaaauagguaauggaugcuuugaaacaaaacauaaaugcaaucaaacaugccuagaccgaaucgcagcagguacauuuaacgcgggagaauucucauuaccgacuuuugacucauuaaauauaacugcagcaagccuaaaugacgacggauuagauaaccauacaauacuacuauacuacuccacagcugcaaguucacuagcgguaacacuaauguuagcgauauucauaguauacaugguaucuagagacaaugucuccugcagcauuuguuua

SEQ ID NO: 51360 - RNA, 1758 nt, Artificial Sequence
  derived and/or modified sequence opt6 from anti-influenza_Chain
augaaagcuauaauaguacuacuaaugguagucacuucuaacgcagauagaauaauauguacagggauaacaagcaguaacaguccacacguaguaaaaacagccacucaaggugaaguaaacguuaccgggguaauaccauugacaacaaccccaacuaaaagccauuucgcaaacuuaaaagguacagaaacacgaggcaaacuaugcccaaaauguuuaaacuguacagacuuagacgucgcuuuaggaagaccaaaaugcacuggcaacauuccaucagcaagagugucuauauuacacgaaguaagaccaguaacaucaggcuguuucccaaucaugcacgaucgcacaaaaauacgacaacuaccaaaucuccuuagaggauaugaacacauaaggcugagcacucauaacguaauuaacgcagaaaaugcacccggaggaccuuauaaaauaggaacaucaggaagcugcccaaaugugacgaauggcaauggauucuucgcuaccauggcaugggcaguaccuaaaaacgauaacaauaaaacagcuacaaacucccuuacaaucgaaguaccauauauaugcacagaaggagaagaucaaauaacagucuggggauuucacagcgauaaugaaacacaaauggcaaaauuauacggugacucaaaaccacaaaaauuuacaaguuccgcaaauggaguuacaacucauuacguaucacaaauaggaggauucccuaaucaaacagaagacggaggauuaccacaguccggacgaauuguaguagacuauaugguacaaaaaucaggcaaaacaggaacaauaacuuaccaaagaggaauauuauuaccucaaaaaguauggugcgcuucaggcagaucaaaaguaauaaaaggaucacucccacuaauaggagaagcagauugcuuacacgaaaaauauggcggauuaaacaaaucaaaaccauauuauacuggagaacaugccaaagcuauaggcaauugcccuauauggguaaaaacaccuuuaaaauuggcaaacggaacuaaguacagaccaccagccaaauuauuaaaagaacgcggauuuuucggcgcaauagcaggcuuucuagaaggagguugggaaggaaugauagcaggauggcacggauauacaagucacggagcccacggaguagcaguagcugcagauuuaaaaaguacacaagaagcaauuaauaaaauaacuaaaaaucuaaauagucuaucagaacuagaagucaaaaaucuacaaagauuaucaggagcaauggaugaacuacauaaugaaauauuagaacuagacgaaaaagucgaugaccuuagagcugauacuauaucaagccaaauagaauuagcaguuuuacuaucaaacgaaggaauaauaaauagcgaagacgaacacuuacuagcacucgaaagaaaacuaaagaaaauguuaggcccuagcgcagucgaaauaggaaaugguugcuucgaaacaaaacauaaauguaaucaaacuugccuagauagaauagcugccggaacauuugacgcaggagaguucaguuuaccaacauuugacucucuaaauauaacagcggcaucauuaaacgaugacggauuagauaaccauacaaucuuacuauauuauucaacagcagcaaguucauuagcugucacacuuaugauagcaauauuugucguuuacaugguaaguagagauaacguauccuguuccauaugcuua

SEQ ID NO: 51361 - RNA, 1758 nt, Artificial Sequence
  derived and/or modified sequence opt6 from anti-influenza_Chain
augaaagccauaauaguacuacuaauggugguaacaaguaaugccgacagaauuauuuguacaggaauaaccaguucaaacucaccacacguagugaaaacagcuacacaaggagaaguaaauguaacaggaguaauaccacuaacaacaacaccaacaaaaagucacuucgcaaaucucaaaggaacagaaacacgaggaaaacuauguccuaaauguuuaaacugcaccgaccuugauguagcgcuaggaagacccaaaugcaccggaaacauaccuuccgcacgaguauccauauuacacgaaguuagaccaguuacaucggguuguuuucccauuaugcacgacagaacaaaaauaagacaacuaccaaaucuacucagaggcuacgaacacauacgucuaucgacacauaaugucauaaacgcagaaaacgcaccagggggaccauacaaaaucggaacaucuggaucaugcccaaauguaacaaauggaaauggauucuuugcaaccauggcaugggcaguaccuaaaaacgacaacaauaaaacugcuacaaauucacucacaaucgaaguuccauauauauguacagaaggugaagaucaaauaacugucuggggauuucacagugauaacgaaacucaaauggcaaaauuauauggugauucuaaaccacaaaaauuuacuagcucugcaaauggaguaacaacccacuauguaagucaaauuggcggauuuccaaaucaaacagaagacggugguuuaccacaaucaggacgaauaguaguagauuacaugguacaaaaaucaggaaaaaccggcacaaucacauaccaaagagggauacuauuaccccaaaaagucuggugugcaaguggaagaagcaaaguaauaaaaggaucuuuaccacuaauaggagaagcagacugcuugcacgagaaauacggaggacuaaauaaaucuaaaccauacuacaccggagaacaugccaaagccauaggaaacugcccaaucuggguaaaaacaccacucaaacuagcaaacggaaccaaauacagaccuccagcaaaacuccuaaaagaaagaggauucuuuggagcaaucgcagguuuccuagaaggaggaugggaaggaaugauagcaggauggcauggauacacaucucauggagcacacggaguagcaguagcagcagaucuaaaaucaacucaagaagcaauaaacaaaauaacuaaaaaucuaaacaguuuaagcgaacuugaagucaaaaauuuacaaagauuaucaggagcaauggacgaacugcauaacgaaauauuagaauuagaugaaaaaguagaugaccuuagagcagacacaauaucaagccaaauagaacuagcaguauuauuaucaaacgaaggcauaauuaauagugaagacgaacacuuauuagcacuagaaagaaaacucaagaaaaugcuaggcccuucagcugucgaaauaggaaacggauguuuugaaaccaaacacaaaugcaaucaaacaugcuuagacaggauagccgcaggaaccuuugacgcuggagaguuuucucuuccaacauuugauagucuaaauauaacagcagcaagccuuaacgaugacggacuagauaaccauaccauauuacuauauuacagcacagcggcaaguagucuugcaguaacccuaaugauagcuauuuuuguaguauauaugguaagcagagacaacguaagcuguagcauaugcuua

SEQ ID NO: 51362 - RNA, 1749 nt, Artificial Sequence
  derived and/or modified sequence opt6 from anti-influenza_Chain
auggaagcaagauuacuaguauuauuaugugcauuugcagccacaaaugcagacacuauaugcauaggauaucaugcaaauaacuccacagauacaguagauaccguauuagaaaaaaauguaacaguaacacauuccguaaauuugcuagaagacucacauaacggaaaacucuguaaauuaaaaggaauagcaccauuacaauugggaaaaugcaauauagcgggauggcuauuaggaaauccagaaugcgaucuauuacucacagcuucaagcuggagcuauauaguggaaacauccaacagcgaaaacggaacauguuauccaggcgacuuuauagauuaugaagaacuuagagaacaacucucuagcguaagcucauucgaaaaauuugaaauauuuccaaaaacgucaucauggccaaaucacgaaacaacaaaagguguaacugcagcaugcucauaugcaggagcaucauccuuuuacagaaaccuauuaugguuaacaaaaaaagggucaucauauccaaaauuaucuaaaucauacguaaauaauaaaggaaaagaaguauuaguacucuggggaguacaucauccacccacgggcacagaccaacaaucacuauaccaaaaugcugaugcuuauguaaguguaggcucaucuaaauauaaccgaagauucacaccagaaauugcugcacguccgaaaguacgagaucaagcaggacgaaugaauuauuacuggacacuccuggaaccgggagacaccaucacauuugaagcuacgggaaacuuaauugcaccaugguacgcauuugcauuaaaccgaggaagcggaagcggaauaauaaccuccgacgcaccaguacacgauugcaauaccaaaugccaaacaccacacggagcaaucaauucaagcuugccuuuucagaauauccacccaguaacaauaggagaauguccaaaauacgucaggaguacaaaauuaagaauggccacuggcuuaagaaauauaccaagcauacaaagucgcggauuauucggagcaauagcuggauuuauagaaggaggauggacaggaaugauugauggcugguacggauaucaucaccaaaacgagcaagggaguggauacgcagcagaucaaaaaaguacacaaaacgcaauugacggaaucacaaacaaagugaauucaguaauagaaaaaaugaauacucaauucacagcagucggaaaagaauucaauaaccuagaaagaagaauagaaaauuuaaacaaaaaaguugaugacggauuccuagacauuuggacuuauaaugccgagcuuuuaguguuacuagaaaacgaacguacgcucgauuuccaugauucgaauguacgaaaccuuuacgaaaaaguaaaaucacaacuaaaaaacaacgcaaaagaaauaggaaauggauguuucgaauucuaucauaaaugugaugacgcauguauggaauccguaagaaauggaacauaugauuauccuaaauauucagaagaaucaaaauuaaauagagaagaaaucgauggaguaaaauuagaaaguauggguguauaccaaucaggaagacuaguaccaagaggaucaccaggaucaggauauauaccugaagcuccuagagacggacaagcuuacgugagaaaagacggagaauggguauuacuaucaacauuucuuggaaaacccauaccgaauccucuccuuggauuagauucaacugga

SEQ ID NO: 51363 - RNA, 1749 nt, Artificial Sequence
  derived and/or modified sequence opt6 from anti-influenza_Chain
auggaagcacgauuacuaguacuacucugugcauucgcagcaacaaaugcagacacaauauguaucggauaccacgcaaauaauucuacagauaccguagauaccguauuagaaaaaaacguaacaguaacacauagcguaaaccuucuagaagauagucacaacggaaaacuauguaaacugaaaggaauagcaccauuacaauuaggaaaaugcaacauagcaggaugguuauuaggaaacccugaaugcgauuuacuacuaacagcuaguucauggagcuauaucguagaaacaucaaauucggaaaaugguacauguuauccaggcgacuucauagauuaugaagaacuaagagaacaauuaucaagcguaucaucauuugaaaaauuugaaauuuucccaaaaacaucaucauggccaaaccaugaaacuacaaaagguguaacagccgccuguucauacgcaggcgcaucaucauuuuacagaaaccucuuaugguuaacuaaaaaaggaagcagcuacccaaaauuaucaaaaaguuacguaaauaacaaaggaaaagaaguacuaguauuauggggcguccaucauccaccaacaggaaccgaucaacaaucacuauaccaaaaugcagaugccuauguuucaguaggaucuucaaaauauaacagacgauuuacuccugagauagccgcacguccaaaaguaagggaucaagcagguagaaugaacuacuauuggacauuacuugaaccuggagacaccauaacauuugaagcuaccggaaacuuaauagcaccaugguaugcuuucgcauuaaacagaggcagcggaaguggaauuauaacaucagaugcaccagugcacgauugcaauacaaaaugucaaacaccucacggagccauaaacucaucucuuccauuccaaaacauacaucccguaacaauaggugaauguccaaaauaugucagguccacaaaauuaagaauggcaacaggcuuaagaaauauuccaucgauucaaucaaggggacuauucggagcaauagcaggauuuauagaagguggguggaccgguaugauagauggaugguacggcuaccaccaucaaaacgaacaaggaagcggauaugcagccgaucaaaaaucaacacaaaaugcuauagauggaauaaccaacaaaguaaauucaguaauagaaaaaaugaauacacaauuuaccgcuguaggaaaagaauucaauaauuuagaaagaagaauagaaaaccuuaacaaaaaaguagaugauggauuucuagacauauggacauacaacgcagaacuacuaguauuacuagaaaaugaaagaacauuagauuuucaugacucaaacguucgaaaccuauaugaaaaaguaaaaagucaacuaaaaaauaaugcaaaagaaauuggaaaugguugcuuugaauuuuaucacaaaugcgaugaugcauguauggaaaguguaagaaauggaacauaugacuaccccaaauauucagaagaaaguaaacuaaauagagaagaaauagauggagugaaauuagaaaguaugggaguauaucaaagugguagacucguaccaagaggcaguccuggaucaggguauauaccugaagcaccaagggacggacaagcauaugucagaaaagacggugaauggguacuccuaucaacauucuuaggaaaaccaauaccaaacccacuacuaggacuugacaguaccgga

SEQ ID NO: 51364 - RNA, 1755 nt, Artificial Sequence
  derived and/or modified sequence opt6 from anti-influenza_Chain
auggaaagaacaguacuacuacuagcaaccguaagucuuguaaaaucagaucaaauuuguauaggauaccaugcaaauaacucaacagaacaaguagacacaauaauggaaaaaaacguaaccguuacacaugcccaagauauacucgagagaacacacaaugguaaacuaugugaccuaaacggaguuaaaccacuaauauuaagagacuguucagucgcaggauggcuauuaggaaauccaaugugcgaugaauucauaaauguaccagaauggagcuacauaguggaaaaagcaucaccagcaaaugaucuauguuacccaggcaacuucaacgacuacgaagaauuaaaacaccuacuaucaagaauaaaucauuucgaaaaaauacaaauaaucccuaaaucaucauggagcaaucaugaugccaguaguggaguaucuucagccugcccauacuuaggaagaucaucauucuucaggaaugucguaugguuaauaaaaaaaaacucggccuacccaaccauaaaaaggaguuacaauaacacaaaucaagaagauuuauuaguuuuauggggaguccaucacccaaaugaugcagcagaacaaaccaaacuauaccaaaacccaacuaccuacauaaguguaggaacaaguacauuaaaucaaagacuaguacccgaaaucgcaacacgcccaaagguaaauggacaaucaggucgaauggaauuuuucuggacaauauuaaaaccaaaugaugcuauuaauuucgaaagcaauggaaacuucauagcaccagaauacgcauauaaaauaguuaaaaaaggagacaguacaauaaugaaaucagaauuagaauauggaaacuguaacacaaaaugucaaacaccuaugggcgcaauaaacucaucaaugccauuccauaacauacacccacuuacaaucggagaauguccaaaauauguaaaaucaaacagauuaguacucgcuacaggacucagaaauacaccacaaagagaaaggagaaggaaaaaaagaggauuauucggagccaucgcaggauucauagaaggaggcuggcaaggcaugguugacggaugguauggauaucaucacagcaaugaacaaggaaguuguuacucugcagacaaagaaaguacacaaaaagcaauagauggaguuaccaauaaaguaaauaguaucauaaauaaaaugaauacacaguuugaagcaguaggaagggaguucaauaacuuagaaagaagaauagaaaaccuaaauaaaaaaauggaagacggauuccucgacguauggacuuauaaugcagaacuacuaguacuaauggaaaacgaaagaacacuagacuuucacgacagcaacguaaaaaaccuauacgauaaaguaagacuccaacucagagacaacgcaaaggaauuaggaaacgguugcuucgaauucuaccacaaaugugauaaugaaugcauggaaucagugaaaaauggaacauacgacuacccgcaauacucugaagaagcaagacuaaacagagaagaaauaucaggaguuaaauuagaaaguaugggaacauaccaaucaggacgacuaguuccaagaggaucaccaggaaguggauauauuccagaagcgccuagagauggacaagcauauguaagaaaagauggugaaugggucuuacuuaguacauucuuaggaaaaccaauaccaaacccacuccuaggacuagacucaacagga

SEQ ID NO: 51365 - RNA, 1755 nt, Artificial Sequence
  derived and/or modified sequence opt6 from anti-influenza_Chain
auggaaagaacaguacuacuacuugcaacaguaucacuaguaaaaagcgaucaaauaugcauaggauaccacgcaaauaauaguacagagcaaguagacacaauaauggaaaaaaacguaacaguuacacaugcccaagauauauuagaaagaacacauaacggaaaauuaugcgauuuaaacggaguaaaaccacucauacuaagagacugcucaguagcaggauggcuauuaggaaauccaaugugcgacgaauuuauaaacguaccagaauggucauacauaguagaaaaagcaagccccgcaaaugaucuaugcuacccaggaaacuuuaacgacuacgaagaacuuaaacaccuauuaucccgaauaaaccacuucgaaaaaauacaaauaauaccaaaaucaagcuggucaaaccacgaugccagcucagguguauccucagccugcccauauuuaggaagaucaagcuuuuucagaaacguaguaugguuaaucaaaaaaaacuccgcauauccaacaauaaaaagaagcuacaacaauacaaaucaagaagaucuacucguacuauggggaguacaccacccaaaugacgcugcagaacaaaccaaacuauaccaaaaucccacuacauacauuucaguaggaaccagcacacuaaaccaaagacuaguaccugaaauagcaacuagaccaaaagucaacggccaaucagggagaauggaauuuuuuuggacaauacuaaaaccaaaugaugcaauaaacuuugaaagcaacggaaacuuuauagccccagaauacgcauacaaaaucguaaaaaaaggagacaguacuauaaugaagagugaauuagaauacggaaacugcaacacaaaaugucaaacaccaaugggugcaauaaauuccaguaugccauuccacaauauacaucccuuaacaauaggugaauguccaaaauauguaaaaucaaauagauuaguguuagcaacaggauuacgaaacacaccacaaagagaaagaagaagaaaaaaaagaggacuauuuggagcaauugcaggauucauagaaggcggauggcaaggaaugguagacggaugguauggauaccaccauuccaacgaacaaggaucaugcuauuccgcagacaaagaaaguacccaaaaagcaauagauggcguuacaaacaaaguaaauucaauaauuaacaaaaugaacacacaauucgaagcagugggcagagaauuuaacaauuuagaacgacgcauugaaaaccuaaacaaaaaaauggaagacggauucuuagacgucuggacauauaacgcagaacuacuaguacuaauggaaaacgaaaggacucuagauuuucacgacucaaaugugaaaaaccuauaugacaaaguaagacuacaacuaagggauaaugcaaaagaauuaggaaauggcuguuucgaauuuuaccauaaaugcgauaacgaaugcauggaaagcguaaaaaauggcaccuacgacuauccucaauacagcgaagaagcaagacugaacagagaagaaauaucaggcguaaaacuggaaagcaugggaacauaucaaucaggaagacucguaccaagggguucaccagguucaggauacauaccagaagcgccaagagauggccaagcauacgucagaaaagacggagaauggguccuacuaaguacauucuuaggcaaaccaauaccaaauccgcuacuagguuuagacaguacugga

SEQ ID NO: 51366 - RNA, 1947 nt, Artificial Sequence
  derived and/or modified sequence opt6 from anti-influenza_Chain
augggggacaaaauaaauuuuauuuucgguauucauaaccaucaaccauuaggaaauuuuggauggguauuugaagaagcauaugaaaaauguuacuggccauuuuuagaaacauuagaagaauauccgaauaugaaaguagcaauccauacaaguggaccucuaauagaaugguugcaagacaauagaccagaauauauagacuuauuaagaucauuaguaaaaagaggacaaguagaaauaguaguagcaggauuuuaugaaccaguauuagcaaguauaccuaaagaagauagaauugaacaaauaagacuuaugaaagaaugggccaaaaguauuggauucgaugcacgaggaguaugguuaacagaaagagucuggcaaccagaauugguaaaaacauuaaaagaaaguggaauagauuaugugauaguugaugauuaccauuuuaugucagcaggacuuagcaaagaagaacuuuauuggccauacuacacagaagacggaggagagguaauagcaguauuuccaauagacgagaaauuaagauacuuaauaccauuuagaccaguagacaaaguauuggaauaucuacacaguuuaauagauggagaugaaucaaaaguagcaguuuuccacgaugauggagaaaaauuuggaauauggccaggaaccuaugaauggguguacgaaaaaggauggcuaagggaauuuuucgauaggaucagcucagaugaaaagauaaaucucaugcuuuacacagaauaccuagaaaaauauaaaccaagaggacuuguuuacuuaccuauagcaucauacuucgaaaugucggaaugguccuuaccugcgaaacaagcgcggcuuuuuguagaauuuguaaaugaauuaaaaguaaaaggaauauucgaaaaauaucgcguauucguaagaggaggaauuuggaaaaauuucuuuuauaaauauccagaguccaauuacaugcacaaaagaauguuaaugguaucuaaauuaguaagaaacaaucccgaagcaagaaaauauuuauuaagagcacaauguaaugaugcuuauuggcacggauuauuuggaggaguauaccuaccacauuuaagacgagcaauauggaauaaccuaauaaaagcaaauuccuauguaagccuaggaaaaguaauaagagauauagacuaugauggguuugaagaaguacuaauagaaaacgauaacuuuuaugcuguuuuuaaaccaagcuacggagggagucuagucgaguuuagcucuaaaaauagauuaguaaauuacguugauguucuagccagaagaugggaacauuaucacgguuauguagaaagccaauucgacgguguagccagcauacaugaacuagaaaagaaaauuccagaugaaauaagaaaagaaguugcauaugauaaauauagaagauuuauguuacaagaccauguaguaccacuaggaacuacauuagaagacuuuauguuuaguagacaacaagaaauaggugaauuuccucgaguaccauauuccuaugaauuacuagauggaggaauccgacuaaaaagagaacaucuaggaauagaaguagagaaaaccgugaaauuaguuaaugauggauuugaaguagaauacauaguaaauaauaaaaccggaaauccagugcuauuugcagucgaauuaaauguagcaguccaaagcauaauggaaucaccaggaguacuaagaggaaaagaaauaguaguagacgauaaauacgcaguaggcaaauuugcacucaaauuugaagaugaaauggaaguauggaaauacccagucaaaacccuuucacaaucagaaaguggaugggauuuaauacaacaaggaguaucauacauaguuccaauaagacuagaagauaaaauaagauuuaaauugaaauuugaagaagcaagugga

SEQ ID NO: 51367 - RNA, 1947 nt, Artificial Sequence
  derived and/or modified sequence opt6 from anti-influenza_Chain
auguccagaaugacacuaaaaagcaguaugaaaaaaagaguacugaguuuacuaaucgcaguaguauucuuaagucuaacaggaguauucccuucaggacugaucgaaacaaaagucagcgcagccaaaauaacagaaaauuaccaauucgauaguagaaucagauuaaacucaauugguuuuauaccaaaccauaguaaaaaagccacaauagcagcaaauugcucaacauucuacguuguaaaagaagauggaacaauaguauauacaggaaccgcaacaaguauguuugacaacgacacuaaagaaaccguguauauagcagauuucucaucaguaaacgaagaaggaacauauuacuuagcaguaccuggaguaggaaaaagcgucaauuucaaaauugcuaugaauguguacgaagaugcauuuaaaaccgcaaugcuaggaauguauuuacuacguuguggaacaucaguaucagcaaccuauaaugguauccacuacagucacggaccaugucauacaaaugaugcauaucuagacuauauaaauggacaacauacaaaaaaagacucaacaaaaggcuggcaugacgcuggcgauuauaacaaauauguaguaaacgcaggaauaaccguaggaucuauguucuuagccugggaacacuuuaaagaucaauuagaaccuguugccuuagaaauaccagaaaaaaauaauagcauaccagacuuuuuagaugaguuaaaauaugaaauagacuggauauuaacaaugcaauacccagacgguucaggaagaguagcucauaaaguaucaacaagaaauuucgggggauuuauaaugccugaaaaugaacaugaugaacgauucuuuguaccauggucaagcgcagcaacagcagauuucguagccaugacagcuauggcagcaagaauauuuagaccuuaugacccacaauaugcagaaaaauguauuaacgcagcaaaaguaucauacgaauuccuaaaaaacaacccugcaaaugucuuugcaaaucagucaggcuucagcacaggagaauaugcuacuguaucagaugcugaugacagauuaugggcugcagcagaaaugugggaaacucuaggggaugaagaauauuuacgcgacuucgaaaauagagcugcccaguucucaaaaaaaaucgaagcugauuuugacugggauaacguugccaaucuagguauguucacauaucuacuaagugaaagaccaggaaaaaacccugcucuaguacaaagcauaaaagauucacuauuauccacagccgacucaauaguaagaacuagucaaaaccauggauauggaagaacacuaggaacgacauacuauuggggauguaaugguacaguaguacgacaaacaaugauacuacaaguagcaaauaaaauaucaccaaauaaugauuacguaaaugcugcauuagaugcaauaagucacguuuuuggaagaaauuacuauaauagaucauauguaacaggacucggaauaaauccaccaaugaacccacacgauagaagaagcggugcagauggaauaugggaaccauggccaggauaucugguaggcgguggauggccuggaccaaaagacuggguagacauacaagauaguuaccaaacaaaugaaauugcaauaaauuggaaugcugcacuaauuuaugcauuagcaggcuuugucaauuacaauagcccacaaaaugaaguauuauacggagauguaaaugacgauggcaaaguaaacagcacugaucuaacccuacuaaaaagauacguauuaaaagccgucucaacguuaccaucaaguaaagcagaaaaaaaugcugauguuaaccgagauggaagagucaauucaagugauguaacaauacuaucaagauauuuaauuagaguuauugaaaaacuacccaua

SEQ ID NO: 51368 - RNA, 1947 nt, Artificial Sequence
  derived and/or modified sequence opt6 from anti-influenza_Chain
augggagauaaaauaaauuuuauauucggaauacauaaccaccagccauuaggaaacuuuggauggguauuugaagaagccuacgaaaaguguuacuggccuuuucuugaaacacuagaagaauauccuaauaugaaaguagcaauucacacaagcggaccacucauagaaugguuacaagacaaucgaccagaauauauagauuuauuaagaucauuaguuaaaagaggacagguggagauuguaguagcaggauuuuaugaaccaguguuagcaucaauaccuaaagaagacagaauagaacagauaagauuaaugaaagaaugggcuaaaaguauaggauuugaugcaagaggaguauggcuuacagaaaggguauggcaaccagagcuaguaaaaacauuaaaagaaaguggaaucgauuacguaauaguagacgacuaccacuuuaugucagccggacuaagcaaagaagaacuuuauuggccauacuacacagaagacggaggagaaguaauagcaguauuuccaauagaugaaaaauuaagauaucuaauaccauuucgaccaguagauaagguacuagaauacuuacauucauuaauagauggugaugaaucaaaaguugcuguguuucacgacgauggagaaaaauucgguauauggccaggaacauaugaauggguauaugaaaaaggauggcuuagagaguucuucgacaggauaucaagugaugagaaaauaaauuuaauguuauauacagaauaucuagaaaaauauaaacccagaggauuaguauacuuaccaauagcgagcuacuuugaaaugagugaauggagucuaccagcuaaacaagcaagacuguuuguagaguucguaaacgaauugaaaguaaaaggcauauucgaaaaauauaggguguucguccgagggggaauauggaaaaacuuuuucuacaaauacccugaaaguaauuacaugcauaaaaggauguuaaugguaagcaaacucguaaggaauaauccagaagcgagaaaauaccuacuaagagcacaaugcaaugacgcauauuggcauggauuauuuggaggaguauauuuaccucaucuaaggagagcaauauggaauaauuuaauaaaagcaaauaguuaugucagucuagguaagguaauaagagauauagauuacgauggauuugaagaaguguuaauagaaaaugacaauuuuuacgcaguauucaaaccaucauauggaggaucuuuaguggaguucaguaguaaaaacagauuaguuaacuacguugaugucuuagcaagaagaugggaacacuaccauggguauguagaaagucaauucgauggaguagcaagcauacacgaauuagaaaagaaaauacccgaugaaauaagaaaagaaguagcauaugauaaauacagaagguuuauguuacaagaucauguaguaccacuaggaacuacacuagaagauuuuauguucagcagacaacaagaaauaggagaguucccaaggguacccuauucauaugaauuacucgauggaggaauaagguuaaaaagagaacaccuaggaauagaaguagagaaaacaguaaagcuaguuaacgauggcuuugaaguggaauacauaguuaauaauaaaacaggaaauccaguauuauuugcaguagaauuaaacguggcaguacaaagcaucauggaaaguccaggaguauugagaggaaaagaaauagugguagaugauaaauacgcaguaggcaaauuugcuuuaaaauucgaagacgaaauggaagucuggaaauacccuguaaaaacacugucucaaucagaaagcggaugggauuuaauacaacaaggaguaagcuauauaguaccgauaagacuagaagauaaaauuagguucaaacuaaaauucgaagaggcaagugga

SEQ ID NO: 51369 - RNA, 1947 nt, Artificial Sequence
  derived and/or modified sequence opt6 from anti-influenza_Chain
augagucgaaugacacuaaaaucaucuaugaaaaaaagaguauuaagucuacuaauagccguaguauuccuaucacuaacaggcguauuuccaucaggcuuaauagaaaccaaggucucagcagcaaaaauaacagaaaacuaccaauuugauucaagaauaagguugaauaguauaggauuuaucccaaaccacagcaaaaaagcaacaauagccgcuaacugcucaacuuucuauguagucaaagaagaugguaccauaguauauacugguacugcaacaucuauguucgauaaugacacaaaagaaaccguauacauagccgacuucagcucaguaaaugaagaaggaacauacuaucuagcaguaccaggaguuggcaaaucaguaaacuuuaaaauagccaugaauguauaugaagacgcauuuaaaacagcaaugcucggaauguacuuauuaagauguggaacuucaguuucagcaacauacaacgggauccauuacucacacggaccaugucauacaaacgaugcauaucuugacuacauaaacggccaacacacaaaaaaagauagcacuaaaggauggcacgacgcuggagauuauaacaaauaugucguaaacgcuggaauaacaguaggcaguauguuucuagccugggaacacuuuaaagaccaauuagaaccuguugcuuuagaaauacccgaaaaaaacaacucaauaccagauuucuuggacgaacuaaaauaugaaauagauuggauauuaacaaugcaauacccugacggaagcggaaggguugcacacaaagucucuacaagaaacuuuggaggauucauuaugccagaaaaugaacaugacgaaagauucuuuguaccauggaguucagcagccacagcagauuucguagcaaugacagcaauggcagcaagaaucuuuagaccauaugauccacaauaugcagaaaaaugcauaaacgcugcaaaaguaagcuacgaauuucuaaaaaauaauccagcaaacguauucgcaaaucaaucagguuuuucaacaggugaauacgcaacaguaucagaugcagaugauagacuaugggcagcagcugaaaugugggaaacccuuggugacgaagaauauuugagagacuucgagaacagagcugcccaauuuuccaaaaaaauagaagcagauuuugauugggauaauguugcaaacuuaggaauguuuacauaccuacuaagugaaaggccagguaaaaacccagcacucguccaaucuauaaaagacucacuacuuucaacugcugacucaauuguacgaacaagccaaaaucauggcuaugguagaacauuagguacaacauauuacuggggauguaacgguacugucguacgccaaacaaugauacuccaaguagcuaauaaaauaucaccaaacaaugacuacguaaaugcagcacuagaugcaaucagccacguauucggaagaaacuacuauaauagaucauauguaacagguuuaggaauuaauccaccaaugaauccacacgaccgacguagcggagcagaugguauuugggaaccauggccaggauauuuaguaggaggaggauggccuggaccgaaagacuggguagauauacaagauucauaccaaacgaaugaaauagcaauaaacuggaacgcagcgcuaauauaugcacuagcaggcuuuguaaacuacaauucaccacaaaaugaaguacuauacggagauguaaaugacgacggaaaagucaacucuacagaucucacguuauuaaaaagauauguauugaaagcaguuucaacacuaccaagcucaaaagcagaaaaaaaugcggacguuaacagagauggcagagugaauagcagugauguaacaauauuaucaagauaucuaauaagaguaauagaaaaauuaccgaua

SEQ ID NO: 51370 - RNA, 2046 nt, Artificial Sequence
  derived and/or modified sequence opt6 from anti-influenza_Chain
augaaaccaucacacuuuacagagaaaagauucaugaagaaaguauuaggcuuauuucuagucguaguuaugcuagccaguguaggaguacuaccaacaucaaaaguucaagccgcaggaacaaccguuacaaguauggaauauuuuaguccagcagauggaccaguaauaucaaaaucgggcguaggaaaagcaucauauggguuuguaaugccuaaauuuaacggaggaagcgcuacauggaaugaugucuauucagauguaggaguaaauguaaaaguaggaaauaauuggguagauauugaucaagcaggaggauauauuuacaaucaaaauuggggacauuggucagacggugguuuuaauggauauugguuuacauuaagcgcaacaacagaaauacaauuauacaguaaagcaaauggaguuaaauuagaauaucaacuuguauuccaaaacauuaauaaaacaacaaucacagcaaugaacccaacgcaaggaccacaaauaacugcaucauuuacaggaggagcuggauuuaccuauccaacauucaacaacgauagugcaguaacauacgaagcugucgcugacgauuuaaaaguauacguaaaaccaguaaacucaagcagcuggauagauauagacaacaaugcagcaaguggauggaucuaugaccacaacuuuggccaauuuaccgacggaggaggaggauauugguucaauguuacagaaucuauuaauguaaaacucgaguccaaaacuucaucagcaaauuuaguauacacuauaacauuuaacgaacccacaagaaauucauacguaauaacaccauaugaaggaacaacauuuacagcagacgcaaacggaucaauaggaauaccauugccaaaaauagaugguggagcuccaauagcaaaagaauuagguaauuucguauaucaaauaaauauaaacggacaauggguugauuuaucaaauucaucacaaucaaaauuugcuuauagcgcuaaugguuauaauaacaugucagaugcaaaucaauggggauauugggccgacuacauauauggucucugguuccaaccaauacaagaaaauaugcaaaucagaauaggauacccacuaaauggacaggcaggaggaaacauaggaaauaauuuuguuaacuauacuuuuauaggaaauccaaaugcaccaagaccagauguuagcgaucaagaagauauuaguauuggaacaccaacagauccagcaauagccggaaugaaucuaauauggcaagaugaauuuaauggcacgacacuagacacaucaaaauggaauuacgaaacuggauauuaucuaaacaaugacccagcaacguggggauggggaaaugcagaacuacaacauuacacaaauucaacucaaaacguauauguacaagacgguaaacuaaauauaaaagcaaugaaugauuccaaaucauuuccucaagacccaaacagauacgcacaauauucuucugguaaaauaaacacuaaagauaaauuaucguuaaaauauggaagaguugauuuccgagcaaaauuaccaacaggugauggagucuggccagcauuauggauguuaccaaaagauucaguauacggaacaugggcagcuucaggcgaaauagacguaauggaagcaaggggucgacuaccaggaaguguuaguggaacuauacauuuuggaggacaauggccggugaaucaaaguucaggaggagauuaccauuucccagaaggacaaacauuugcaaaugauuaucauguauauucuguaguaugggaagaagacaauauuaaaugguauguagauggaaaauuuuucuauaaaguaacuaaucaacaaugguauucaacagcagcacccaauaauccgaacgcaccauuugacgaaccauuuuauuuaauaaugaacuuagcugugggaggcaacuucgauggaggaagaacaccuaaugcauccgauauaccagcaacuaugcaaguagauuacguaagaguauauaaagaacaa

SEQ ID NO: 51371 - RNA, 2046 nt, Artificial Sequence
  derived and/or modified sequence opt6 from anti-influenza_Chain
augaagccaucacacuucaccgaaaaacgauuuaugaagaaaguucuaggauuauuccuaguaguaguuaugcuagccaguguaggaguccuaccaacaucaaaagugcaagcagcaggaacaacaguaacauccauggaauauuucucaccagcagauggccccguaauaaguaaaagcggaguagguaaagcaucauacggauuuguaaugccaaaauuuaauggcgguagugcaacauggaacgacguauacagugacguugguguaaacguaaaaguaggcaauaacuggguagauauagaccaagcaggaggauauauauauaaccaaaacuggggacacuggucagacggaggauucaauggauauugguuuacauuaucggcaaccacagaaauacaauuauauucuaaagcuaauggaguaaaacuagaauaucagcuaguauuucaaaauaucaacaaaacuacaauaacggcaaugaauccaacacaaggaccacaaauaacugccagcuuuacuggaggagcaggauuuacuuauccaacguuuaauaaugauucagcaguaaccuacgaagcaguagcagacgaccucaaaguuuauguaaaaccaguaaauucaaguaguuggauagauauagauaacaacgcagcaaguggauggauauacgaucauaacuuuggccaauuuacagaugguggaggaggauauugguuuaacguaaccgaaagcauaaauguaaaacuagaaagcaaaaccucguccgcaaaccuaguauacacaauuacuuuuaaugaaccaacacgaaauaguuacguuauaacuccauacgaagguacaacauuuacagcagaugcaaauggaucgauuggaauaccacucccaaaaauagauggaggagcacccauugcaaaagaacuaggaaauuuuguauaucaaauaaauauaaacggacaauggguagauuuaucuaauucuucacaaaguaaauuugcuuacucugcaaauggauauaacaacaugucagaugcaaaccaauggggauacugggcagacuauauauauggccugugguuucaaccaauacaagaaaauaugcaaauaagaauaggauauccauuaaacggacaagcugguggaaauauaggaaauaauuuuguaaauuauacauucauagguaacccaaacgcuccaagaccugauguaagcgaucaagaagauauaucaauaggaacacccacagauccagcaauagcaggaaugaaucuuaucuggcaagaugaauuuaauggaacaacauuagauacaagcaaauggaacuaugaaacaggauauuauuuaaauaaugauccagcgacauggggaugggguaaugcagaacuccaacauuauacaaauucaacacaaaauguuuacguacaagacggaaaacuaaacauaaaagccaugaacgacaguaaaaguuucccacaagacccuaauagauaugcccaauauucaucugguaaaauaaauacaaaagauaaacuaucuuuaaaauauggaagaguugauuuuagagcaaaauuaccuaccggagacggaguauggccagcacuauggaugcuaccaaaagacaguguauauggaacaugggccgcaucaggugaaauagaugucauggaagcaagagguagacuaccaggaagcgucucagguacuauacauuucggcggccaauggcccguaaaucaaucaucaggaggagauuaucacuucccagaaggacaaacuuuugcaaaugauuaucauguauacaguguaguuugggaagaagauaauauaaaaugguacguggacggaaaauucuuuuauaaagucacaaaucaacaaugguacucaacagcagcuccaaauaaccccaaugcaccauucgaugaaccauucuaucuuauaaugaaucuagcgguaggaggaaacuuugauggaggccggacaccuaacgcgagcgauauaccagccacaaugcaaguagauuacguacguguauacaaagaacaa

SEQ ID NO: 51372 - RNA, 2058 nt, Artificial Sequence
  derived and/or modified sequence opt6 from anti-influenza_Chain
augacaaaaucaauuuauuucagccuaggaauacacaaucaucaaccaguaggaaauuuugacuuugugauagaaagagcauacgagaugucuuauaaaccacucauaaacuuuuucuucaaacacccugauuucccuauaaacguacauuuuucugguuuccuuuuacuauggcucgagaaaaaucacccagaauacuucgaaaaauuaaaaauaauggcagaaagaggccaaauagaauucguauccggagguuuuuacgaaccuauacuacccauaauaccagauaaggacaaaguccaacaaaucaaaaaacugaauaaauacauauaugacaaauucggacaaacaccuaaaggaauguggcuagcagagagaguaugggaaccgcauuuaguuaaauacauagcagaagcgggaauagaauacgucgucguagaugaugcacacuuuuucucaguaggacuaaaagaagaagauuuguucggcuacuacuuaauggaagaacaagguuacaaacuagcaguauucccaauaucaaugaaacuaagauacuuaauaccauuugcagacccagaggaaacaauaacauauuuagacaaauuugcaucugaagacaaaucaaaaauagcacuucuauucgacgacggggaaaaauuuggccuauggccagacaccuauagaacagucuacgaagaaggaugguuagaaacauucguaaguaaaauuaaagaaaacuuuuuacuagucacaccaguaaaucuauacaccuacaugcaacgaguaaaaccuaaaggacgcauauauuuaccaacagccuccuacagagaaaugauggaauggguccuauucccagaagcacaaaaagaacuagaagaacuaguagaaaaauuaaaaacagaaaaccuuugggacaaauucucaccauacguaaaaggaggauuuuggcgaaacuuccuagccaaauaugacgaaucaaaccacaugcaaaaaaaaauguuauacgucuggaaaaaaguccaagacucaccaaacgaagaaguaaaagaaaaagccauggaagaaguauuccaagggcaagcaaaugacgcauacuggcacggaauauucggaggauuauaccuaccacacuuacgaacagcaauauacgaacaucucauuaaagcagaaaacuaucuagaaaauucugaaauaagguuuaacauauucgauuucgacugugacggaaaugacgaaauaauaguagaaucucccuuuuuuaaucuuuaccuaucacccaaccacggaggaagcguauuagaaugggacuuuaaaacgaaagcauuuaaucuaacaaauguacuaacacgaagaaaagaagcuuaccauucaaaauugucuuacguaacauccgaagcucaaggaaaaagcauucacgaaagauggacugcuaaagaagaaggacuugaaaacauauuauuuuacgauaaucacagaaggguuagcuucacagaaaaaauauucgaaucagaaccuguucuagaagaucuuuggaaagacucaucgagacuagaaguagauucauuuuacgaaaacuacgauuacgaaauaaacaaagacgaaaauaaaauccgaguacuauucucuggaguauuuagaggcuucgaacuuuguaaaagcuacauacuuuacaaagacaaaucuuucguagauguagucuaugaaauaaaaaacguuagugaaacaccaaucucuuuaaauuucggaugggagauaaaucucaacuuccuggcaccaaaccauccugauuacuacuuccuaauaggugaucaaaaauacccacucagcucuuuugggauugaaaaagucaacaacuggaaaauauucucagguaucggaauagaacuagaauguguauuagauguagaagcaucucuauacagauacccaauagaaacagucucacuuuccgaagaaggcuuugaaagaguauaccaaggauccgcuuuaauacacuuuuauaaaguagacuuaccagucggcucaaccuggcgaaccacuaucagauucuggguaaaa

SEQ ID NO: 51373 - RNA, 2058 nt, Artificial Sequence
  derived and/or modified sequence opt6 from anti-influenza_Chain
augacaaaaagcauauacuucucuuuagggauacacaaucaccaaccuguagguaacuuugacuucguaauugaaagagcuuaugaaaugaguuacaaaccacuaauaaauuucuucuucaaacauccagacuucccaauaaacguccacuucaguggauuucugcuauuauggcuagaaaaaaaucauccugaauauuucgaaaaacuuaaaauaauggcagaaagaggacaaauagaauucguuucagguggauucuacgaacccauacuaccaauaauaccagacaaagacaaaguacagcagauaaaaaaauuaaauaaauauauauaugauaaauucggccaaacaccaaaaggaauguggcuagcagaaagaguaugggaaccgcaucuaguaaaauacauagcagaagccgguaucgaauacguuguuguagacgaugcacacuuuuuuucaguaggguuaaaagaagaagacuuauucgguuauuacuuaauggaagaacaaggauauaaacuugcaguauuuccuaucaguaugaaauuaagauaccuaauaccauuugcggacccagaagaaacaauaacguacuuagauaaauucgcgucagaagacaaaagcaaaauagcacuacuauucgaugacggagaaaaauuuggauuauggccggacacauacagaacaguauaugaagaagguuggcuugaaacuuucguuaguaaaauaaaagaaaacuuccuacuaguaacaccaguaaacuuauauacauauaugcaacgaguaaaaccaaaaggaagaaucuaccuaccgacagcaagcuacagagaaaugauggaauggguacuauucccggaagcacaaaaagaauuagaagaacuaguagagaaacuaaaaacagaaaaccuaugggauaaauucucaccauacguaaaaggaggauuuuggcgaaauuuuuuagccaaauacgacgaaaguaaucacaugcaaaaaaaaauguuauacguuuggaaaaaaguccaagauucaccaaaugaagaaguuaaagaaaaagcuauggaagaaguauuccaaggccaagcaaacgacgcauauuggcacgguauuuucgggggacuauaucuaccacauuuaagaacagcaaucuacgaacaccucauaaaagcagaaaacuauuuagaaaauucagaaauaagauucaacauauuugauuuugauugcgauggaaacgaugaaaucauaguagaaagucccuuuuuuaaucuauaccugagucccaaccauggcggauccguauuagaaugggauuuuaaaacaaaagccuucaaccuaacaaacguauuaacgagaagaaaagaagcauaccauucaaaauuaagcuacgucacuagugaggcacaaggaaaaucuauacacgaaagauggacugcaaaagaagaaggacuagaaaacauacuauucuaugauaaucacagaagaguaucauucacagaaaaaaucuucgaaagugaaccuguccuagaagaccuauggaaggacaguagcagacucgaaguagauaguuuuuacgaaaauuaugacuacgaaauaaacaaagaugaaaacaaaauaagaguacuguuuucaggaguauuucgaggcuuugaauuaugcaaaucuuauauauuauacaaggacaaaagcuuuguagauguaguauacgaaauaaaaaacguaucagaaaccccuauaagccuaaauuuuggaugggaaaucaaucuuaauuucuuagcaccaaaccauccagacuacuacuucuuaauaggagaucaaaaauacccccuaucgagcuucggcauagaaaaaguaaauaacuggaaaaucuucucagguauugggauagaauuagaaugcguccuagacguagaagcaucacuuuacagauauccaauagaaacaguaucacuaucagaagaagguuucgaacgugucuaccaaggaagcgcuuuaauccauuuuuacaaaguagaccuaccuguaggauccacauggagaacaacuauaagauucuggguaaaa

SEQ ID NO: 51374 - RNA, 2115 nt, Artificial Sequence
  derived and/or modified sequence opt6 from anti-influenza_Chain
augcccacaaauuuauuuuucaacgcacaccauucaccaguaggcgcguuugcaucauuuacauuaggauuuccaggaaaauccggaggauuagauuuagaacucgcacguccaccaagacaaaauguacucauaggagucgaaucauuacaugaaucaggucuauaucauguacuaccauuucuagaaacagcugaagaagaugaaaguaaacgauaugauauagaaaauccagacccaaauccucaaaaaccaaauauauuaauaccauuugcaaaagaggaaauacaaagagaauuucauguagcaacugacacauggaaagcuggugauuuaacguuuacaauauauucccccguuaaagcuguaccaaauccagaaacagcugaugaagaagaauuaaaauuagcuuuagugccagcaguaauaguagaaaugacaauagauaauacaaacgguacaagagccagaagagcguuuuucgguuucgaaggcacagauccauauacaucuaugagaagaauugacgauacguguccacaauuaagaggaguaggacaaggaagaauccucucaauagucagcaaagaugaaggaguacguagugcuuuacauuuuaguauggaagacauauuaacugcucaauuggaagaaaauuggacauuuggacuaggaaaaguaggagccuuaauaguagauguuccagcuggagaaaaaaaaacauaucaauuugccguauguuuuuauagaggaggauacguaacagccgguauggacgcuucauauuuuuauacucgauucuuccaaaauauagaagagguaggucuauacgcauuagaacaagcagaagucuugaaagaacaaaguuuuagaucaaauaaauugauugaaaaagaaugguuaucagaugaccaaacauucaugauggcccaugcaauacgauccuauuaugguaauacacaauuauuagaacaugaaggcaaaccaauuuggguagucaacgaaggagaauaccgaaugaugaacacauucgauuuaacaguagaucaacuuuuuuuugaauuaaaauugaauccauggacaguaaaaaacguacuagauuuauacguagaaagauacaguuaugaagacagaguaagauuucccggagaagaaacagaauacccaaguggaauaucauucacacaugauaugggaguugcaaauacauuuucuagaccucauuauaguaguuaugaacucuauggaaucucaggaugcuuuucccauaugacucaugaacaacuagucaauuggguacuaugcgccgcaguauauauagaacaaacaaaagauugggcauggagagauaaaagacuagcaauucuggaacaaugcuuagaaucuaugguaagacgagaccaucccgauccagaacaaagaaauggcguaaugggacuagacaguacacguacaaugggaggggcggaaauaacaaccuaugacaguuuagauguaucacucggccaagccagaaauaaucuauaucuagcaggaaaauguugggcagcauauguagcauuagaaaaacuauuucgagauguuggaaaagaagaguuagcagcauuagcaggcgagcaggcagaaaaaugugcagcaacaauuguuucacauguaacagacgauggauauauaccugcaauaaugggagaaggaaaugacagcaaaauaauaccugcaauagaaggauugguauuuccauauuuuacaaacugucacgaagcauuagacgaaaauggaagauuuggagcauacauacaagcauuaagaaaucacuuacaauacguguuaagagaaggaauauguuuauuuccagacggagguuggaaaauuaguagcacaaguaacaacucaugguuaucaaaaauauaccuaugccaauucaucgcacgacauauauuaggaugggaaugggaugaacaaggaaaaagagcagacgcagcacauguagcgugguuaacccauccaacauuaucaauuuggaguuggucugaucaaauaauugcgggugaaauuacaggaagcaaauauuacccaagggguguuacaaguauacuuuggcuugaagaaggagaa

SEQ ID NO: 51375 - RNA, 2115 nt, Artificial Sequence
  derived and/or modified sequence opt6 from anti-influenza_Chain
augccaacuaauuuauucuuuaaugcacaucauaguccuguuggcgcuuuugcaucauucacuuuaggguuuccuggaaaaucaggaggauuagauuuggaacuagcaagaccuccaaggcagaaugucuuaauuggaguagaaagucuacaugaaagcggauuauaccauguacuaccauuucuugaaacagcugaagaagaugaaagcaaaagauaugauauagaaaacccagaucccaauccccaaaaaccuaauauacuaauaccuuuugcaaaagaagaaauacaaagagaguuucauguagcaacggauaccuggaaagccggagauuuaacauuuacaauauauagcccuguaaaagcaguaccaaauccagaaacagcagaugaagaagaauuaaaguuggccuuaguaccugcaguaauaguagagaugacaauagacaauaccaacggaacaagagcaagacgagcauuuuucggauuugaggguacagacccauauacuucuaugagaagaauagacgauacauguccucaauuaagaggaguugggcaaggaagaauauuaucaauuguaucuaaagaugaaggagucagaagugcuuuacauuucucaauggaagauauacuaacagcccaauuagaagagaauuggacauucggacuagguaagguaggggcacuaaucguagauguaccagcuggugaaaagaaaacauaccaauuugcaguaugcuuuuacagaggaggguacguaaccgcuggcauggacgcaucauauuuuuauacaagauucuuucagaauauagaggaaguaggacuauacgcauuagaacaagcagaaguauuaaaagaacagagcuuucgaucaaacaaauuaauagaaaaagaaugguuaagugaugaccaaacauucaugauggcacaugcgaucaggucauacuauggaaauacccaacucuuagaacaugaagguaaacccauuuggguaguaaaugagggcgaauauagaaugaugaacacauucgauuuaacaguagaccaacuauucuucgaacuuaaacuaaauccauggacagucaaaaacguauuggauuuauacguagaaagauacucauaugaagacagaguaagauuuccaggagaggaaacagaauauccaucaggaauaucauucacccacgacaugggaguagcuaacacuuuuucacgaccucauuacucaucauacgagcuauaugguaucagcggaugcuucucacauaugacucacgaacaauuaguaaauuggguuuuaugugcugcaguauacauagagcaaacaaaagacugggcuuggagagacaaaagauuagcaauauuagaacaaugucuagaaucaaugguaagaagagaucaucccgauccagaacaaagaaauggaguaauggguuuagauucaacaaggacuaugggaggcgccgagauaacaacauaugauagccuagauguaaguuuaggucaagcacgcaacaaucuauauuuagccggaaaaugcugggcagcauauguagcacuagaaaaacuauuuagagauguuggaaaagaagaauuagcagcccuagcaggagaacaagcagaaaaaugugcagcaacuaucguuagucacguuacagaugaugguuacauacccgcuauaaugggagaaggaaaugacucaaaaauaauaccagcuauagaaggccuaguauuuccauacuucacaaacugucaugaagcauuagaugaaaacggaagauuuggugcuuauauucaagccuuaagaaaucauuuacaauauguauuaagagaaggaauaugcuuauuccccgaugggggauggaaaaucagcuccaccaguaauaauucaugguuaucaaaaauauaucuaugccaauucauagcaagacauauauuaggaugggaaugggacgaacaaggaaagagggcugacgcugcacacguggcaugguuaacccauccuacauuaucaauauggucuugguccgaucaaauaauagcaggagaaauaacaggaucuaaauauuacccacgaggaguaacuucaauauuauggcuagaagaaggugaa

SEQ ID NO: 51376 - RNA, 2148 nt, Artificial Sequence
  derived and/or modified sequence opt6 from anti-influenza_Chain
auggaagacuucgucagacaaugcuuuaacccaaugauaguagaacuagcggaaaaagcaaugaaagaauacggagaagaccuaaaaauagaaaccaauaaauucgcagccauuuguacacaucuagaaguaugcuucauguacagugauuuccauuuuauaaaugaacaaggagaaagcauaauuguagaaccagaagacccuaacgccuuacuaaaacacagguuugaaauuaucgaaggaagagaucgcacaauggccuggacuguagugaacucaaucugcaacacaacaggagcugaaaaaccaaaauuuuuaccugaccuauacgauuacaaagaaaaccguuuuaucgaaauuggagucacaagacgagaaguacacauuuacuaucuugaaaaagccaauaaaauaaagagcgagaaaacacauauacacauauucucuuucacaggagaagaaauggcaacaaaagcagauuauacauuagacgaagaaucucgagcaagaauaaaaacgagauuauucaccauaagacaagaaauggcaucaagaggauuaugggauucauuccgccaaagcgaaagaggcgaagaaacuauagaagaaagauucgaaauaacuggaacaaugcgacgacuagcagaucaaucauuaccaccaaauuuuucaugucuagaaaacuuuagagcauacguggacggauuugaaccaaauggauacauagaaggaaaacuuagucaaaugaguaaagaaguaaacgcaagaauugaaccauuccucagaacaaccccacgaccaauaagacuuccugacggaccaccauguuuccaacgaucaaaauuccuuuuaauggacagucuuaaacuaucaauagaagacccaucccaugaaggagaagggauaccgcucuaugacgcaauaaaauguaugagaacauucuuuggauggaaagaacccucaguuguuaaaccacacggaaaaggaauaaauccaaauuacuuacuaucauggaaacaaguacuagcagaacuucaagauauagaaagugaagaaaagaucccacgaaccaaaaauaugaaaaagacaagccaacuaaaaugggcacugggggaaaacauggcaccagaaaaaguagauuucgaugacugcaaagacauauccgauuuaaagcaguaugacucagacgaaccagaacuacgaucacuaucaagcuggauucaaaacgaauuuaauaaagcaugcgaauuaacagauuccaucuggaucgaauuagaugaaaucggagaagaugucgcccccaucgaacacauagcuucaaugagaagaaauuauuucacagcagaaguaucccacugccgagcaacagaguacauaaugaaagguguguacauaaacacagccuuauuaaacgcaucaugcgcagcaauggaugauuuccaacuaauaccuaugaucucaaaauguagaacaaaagaaggaagaagaaaaaccaaucuauauggauuuauaauuaaaggaagaucccauuuaagaaaugauacugauguugucaacuuugucucaauggaauuuagucuaaccgauccaagauuagaaccucauaaaugggaaaaguauuguguccuagaaauaggggauauguuauuaagaucagcaaucggacaaguuaguagaccaauguuccuauaugucagaacaaaugguacaucaaaaauuaaaaugaaauggggaauggaaaugcguagaugcuuauuacagaguuugcaacaaauagaaaguaugaucgaagccgaaucaucagucaaagaaaaagacaugaccaaagaauuuuucgaaaacagaucagaaacauggccuaucggagaaagcccuaaaggugucgaagaagguucaauuggcaaaguaugucgaacacuccucgcuaaaucaguuuuuaauaguuuauacgcuaguccacaauuagaaggauuuagugcagaaucacgaaaacuguuacuaauuguacaagcucucagagacaaucuagaaccuggaaccuucgaccucggagguuuauaugaagcaauagaagaaugucuaaucaacgacccauggguucuacuuaaugcuucaugguuuaacaguuuccuaacccacgcacuacga

SEQ ID NO: 51377 - RNA, 2148 nt, Artificial Sequence
  derived and/or modified sequence opt6 from anti-influenza_Chain
auggaagacuucguacgacaaugcuuuaacccaaugauaguagaacuagcagaaaaagcaaugaaagaauauggugaagauuuaaaaauagaaaccaauaaauuugccgcaauauguacacaucuagaaguauguuucauguacucagacuuucauuuuaucaaugaacaaggagaaucaaucaucguagaaccugaagauccuaaugcuuuauuaaaacacagauucgagauuauagaaggaagagaucguacaauggcauggacaguaguaaacucgauauguaauacgacuggagcggaaaaaccaaaauuuuuaccagaccuauaugacuauaaggaaaauagauuuauagaaauaggcguaacaagaagagaaguacacauauacuacuuagaaaaagcgaacaaaaucaaauccgagaaaacucacauacauauauuuucauucaccggagaagaaauggcaacgaaagcggauuauacauuagacgaagaaaguagagcaagaaucaaaacaagauuauuuacuaucagacaagaaauggcaucaagaggauuaugggauagcuucagacaaucagaacgcggagaagaaacaauagaagaaagauuugaaauaacagggacaaugagaaggcuagcagaccaaucuuuaccucccaauuucagcugucuagaaaacuuuagagcauacguagaugguuuugaaccaaacggcuacaucgaaggaaaauuaagccaaaugagcaaagaaguaaacgcucgaauagaaccauuucuaagaacaacuccgagaccaaucagacuaccugacggaccaccuugcuuccaaagaucaaaguucuuacuaauggauucauugaaacuaucaauugaagacccaagucaugaaggagaaggaauaccacucuaugaugcuauuaaaugcaugcguacguucuuuggcuggaaagaacccuccguaguaaagccacauggaaaaggaauaaaccccaauuaccuauuaucauggaaacaaguacuagccgaacuccaagauauagaaagcgaagagaaaauuccacgcacgaaaaauaugaagaaaacaagucaauuaaaaugggcuuuaggugaaaauauggcaccagaaaaaguugacuuugacgacugcaaagauaucucagacuuaaaacaauaugauagcgaugaaccagaacucagaucauuaucaucauggauucaaaaugaauuuaacaaagccugugaauuaaccgauaguauauggauagaauuagaugagauuggagaagacguugcaccuauagaacacauagcaaguaugcgaagaaacuacuuuacagcagaaguuucgcauugucgagcgacagaauacauuaugaaaggaguuuacauaaacacugcauuauuaaaugcaagcugcgcagcuauggacgauuuccaacucauaccaaugauaucaaaaugcagaacaaaagaaggaaggcgaaaaacaaauuuauacggauucauaaucaaaggaagaagccauuuacgaaacgacacagacguaguaaacuuuguguccauggaauuuagccuaacagaucccagacucgagccucauaaaugggaaaaauauuguguauuagagauaggugauaugcuacucagaucagcuauaggucaaguaucuagaccaauguucuuauacguaagaacaaaugggacaucaaaaauaaaaaugaaaugggguauggaaaugagacgaugcuugcuucagagcuuacaacaaauagaaaguaugaucgaagcagaaagcucuguaaaagaaaaagauaugacaaaagaauuuuucgaaaacagaagugaaacauggccaauaggugaaucaccuaaaggcguagaagaaggaagcauaggcaagguuugcagaacacuccucgccaaaucgguauucaauagcuuauaugcaaguccacaacuagaaggguuuagcgcagaaucccgaaaauuacuauugaucguucaagcauuaagagauaaccuagagcccggaacauuugaccuaggaggauuauacgaagcaauagaagaaugccuaauaaacgacccauggguacuacucaacgcaucgugguucaauucauuccuaacccaugcacuaaga

SEQ ID NO: 51378 - RNA, 2256 nt, Artificial Sequence
  derived and/or modified sequence opt6 from anti-influenza_Chain
augaauauaaauccauacuucuuguuuauagacgucccaauacaagcagcaauaagcacaacauuccccuauacaggugucccaccauacucacacgggaccggaacagguuauaccauagauacaguaauucguacucaugaguacucaaauaagggaaaacaauauaucagugacguaacaggaugcguaaugguagauccaacaaacggaccacuaccagaagauaacgaaccaucagcauacgcacaacuagauugcguguuagaagcuuuagacaggauggaugaagaacauccaggacuauuucaagcaggaagccaaaaugcaauggaagcacuaaugguaacuaccguagacaaacuaacacaaggaagacaaacauucgauuggacuguuugccgaaaucaaccagcagcaacugcucuuaauacuacaauaacgucauuuagguuaaacgaucuaaauggagcugauaaaggaggccuagucccauuuugucaagacauaauugauucucuagauaaaccagaaaugauauucuuuacuguaaaaaacauaaaaaaaaaacuaccagcuaaaaaccgaaaaggauuucucauuaaaagaauaccaaugaaaguuaaagaccgaauaacuagagucgaauauauaaaaagagcauugucuuuaaacacaaugacgaaagaugcagaaagaggaaaacuaaaacgucgugcaauagcaacugcaggaauccaaauaagaggauucguacuaguaguagaaaaccuagccaaaaacaucugcgaaaaucucgaacaaagcggauuaccaguagguggaaacgaaaaaaaagcaaaauuauccaaugcaguugccaaaaugcuaucaaauugcccaccugguggaauaucaaugacaguuacuggagacaauacaaaauggaaugaauguuugaauccuagaauauuucuagcaaugacugaaaggauuacacgagacucaccaauaugguucagagacuucuguucgauagcaccaguacuauucucaaauaaaauagcaagauuaggaaaaggauuuaugauaacaagcaaaacaaaaagauugaaagcacaaauaccaugucccgaccucuucaacauaccauuagaaagauauaaugaagaaacuagagcaaaacuaaaaaaauuaaaaccauuuuucaacgaggagggaacagcaagccuaagucccggaaugaugaugggaauguuuaauaugcuuaguacgguacuaggaguagccgcccuagguauaaaaaacauuggaaauaaagaguaucuaugggacggccuccaaaguuccgaugauuuugcauuauucguaaacgcaaaagaugaagaaacuugcauggaaggcauaaacgauuuuuaucgaacauguaaacuacuaggcauuaauaugagcaaaaaaaaaucauauugcaaugaaacugguauguuugaauucacaucaauguucuauagggacggauuuguaaguaauuuugcaauggaauuaccgucuuucggaguagcgggaguaaaugaaucagcagauauggcaauaggaaugacaauaauaaaaaacaauaugauaaacaacggaaugggcccugcaacagcacaaacagcaauucaauuauuuauagcugacuaucgcuauacauacaaaugccauagaggcgacuccaaaguugaaggaaaaaggaugaaaaucauaaaagaauuaugggaaaauacaaaaggaagagauggauuacuaguagcugacgguggacccaacuuauauaaucuccgaaaccuccacauaccagaaauaauauuaaaauauaauauuauggauccagaauacaaaggcagacuauuacacccccaaaaccccuuuguaggccacuuaucaauagaaggaauaaaagaagcagacauuaccccagcccacggaccaauaaaaaaaauggacuaugaugcuguaaguggcacucauucauggcguacaaaacgcaauagaucgauccuaaauacugaucaaagaaauaugauacuagaagaacaaugcuaugcuaaaugcuguaacuuauucgaagcuuguuuuaauagugcaucauacagaaagccaguaggccaacauucuauguuagaagcaauggcacacagacuaaggauggacgcaaggcuagauuacgaauccggaagaaugucaaaagaggauuucgaaaaagcaauggcgcaccuuggagaaauaggauacaug

SEQ ID NO: 51379 - RNA, 2256 nt, Artificial Sequence
  derived and/or modified sequence opt6 from anti-influenza_Chain
augaauaucaaucccuauuuuuuauucaucgauguuccaauacaagcugccauauccacaacauuucccuauaccggcguaccaccauacagccauggaacaggaacuggauauacaauagacacaguaauaagaacacaugaauacucaaacaagggcaaacaauauauaucagacgucaccggaugcguaaugguagauccaacaaacggaccacuaccugaagauaaugaaccuucugccuaugcacaacuagacuguguacuagaagcauuagacagaauggaugaagaacaccccgguuuauuucaagcaggaucgcaaaaugcuauggaagcauuaaugguaacaaccguugauaaauuaacacagggaagacaaacauucgauuggacaguauguagaaaccaaccagcagcgacagcauuaaauacaacaauaacaagcuucaggcuaaacgaccuuaauggagcagacaaaggaggauuaguaccauucugccaagacauaauagauucguuagauaaaccagagaugauauucuucacaguaaaaaauaucaaaaaaaaacuaccagcaaaaaacagaaaagguuuccucauaaaaagaauaccaaugaaaguuaaagaucggauaacacgaguagaauauauaaaaagagcucuuucacuuaauacuaugacaaaagaugcugaacgaggaaaacugaaaagaagagcuauugcaacagcaggcauacaaauaagaggauucguacucguaguagaaaaccuagccaaaaauauaugugaaaauuuagaacaaucagguuuacccguagguggaaaugaaaaaaaggcuaaauuaucaaacgcaguagcaaagauguuaagcaauugcccgccaggugggauaucaaugacaguaacaggagauaauacaaaauggaaugaaugcuuaaauccacgaauauuccuugcaaugaccgaaagaaucacaagagauucaccaaucugguuucgagacuuuugcuccauagcuccaguacuauucagcaauaaaauagcaagacuaggaaaagguuuuaugauaacaagcaagaccaaacgacuaaaagcacaaauaccauguccagaucuauucaacauuccauuagaacgauauaaugaagaaacaagagcuaaacugaaaaaauuaaaaccauuuuuuaacgaggaaggaacagcaucccuaucaccaggaaugaugaugggcauguucaacauguuaucaaccguauuagguguagcagcccuaggaauaaaaaauauaggcaauaaagaauaccuaugggaugggcuacaaucaucagacgacuuugcguuauucguaaacgccaaagacgaagaaacaugcauggaaggcauaaacgauuucuauagaacaugcaaacuauuaggcauaaauaugucaaaaaaaaaaagcuacuguaaugaaacagggauguucgaauucacaagcauguuuuauagagauggauucguaucaaauuucgcaauggaacugccuucguuuggaguagcuggcguuaacgaaagugcugauauggccauaggaaugaccauaauaaaaaacaauaugauaaauaauggcaugggaccagccacagcucaaaccgcuauucagcuauuuauugcagacuaucgguauacauacaaaugucacagaggugacucaaaaguagaaggaaaaagaaugaaaauaauaaaagaauuaugggaaaacaccaaaggaagagauggguuacucguagcagauggaggaccaaacuuauauaaccuaagaaauuuacacauaccagaaauuauacuaaaauauaacauaauggaccccgaauacaaaggaagacuucuacauccacagaauccguuuguaggacaucuaucaauagaagguauaaaagaagcugauaucacaccagcccaugguccuauaaaaaaaauggacuacgaugcaguaucagguacacauuccuggaggacaaaacgaaaucgaagcauacuaaauacagaccaaagaaauaugauccuagaagaacaauguuaugcaaaaugcugcaauuuauuugaggcauguuuuaauucagcuucauauagaaaaccaguaggacaacacucaaugcuggaagcaauggcacaccgcuuaaggauggaugcuagacuugauuaugaaucugguagaaugagcaaagaagauuucgagaaagcuauggcgcacuugggagaaauaggauauaug

SEQ ID NO: 51380 - RNA, 2265 nt, Artificial Sequence
  derived and/or modified sequence opt6 from anti-influenza_Chain
auggcaguugauauaaaaaaaauaauuaagcagaugacauuagaagaaaaagcaggguuauguagcggauuagacuucuggcauacgaaaccgguagaaagacuuggaauaccaucaaucaugaugacggauggaccucaugggcuacguaaacaaagggaagacgcagaaauagcagauauaaacaauagcguaccagcaacaugcuucccaagcgcagcaggccuagcaugcucaugggacagagaacuuguggaaaggguaggggcagcguuaggggaagaaugucaagcagaaaacguaaguauauuacuggggccgggagcaaauaucaagaggucuccucuauguggaaggaauuuugaauacuuuucggaagauccguaccuaaguagcgaacuugcagcaucacacauaaaaggaguacaaagucaaggcguaggagcguguuuaaagcacuuugcggcaaauaaucaggaacaccgaagaaugacuguagacacuauaguggaugaaagaaccuugagagaaauauauuucgcgagcuuugaaaaugcaguaaaaaaagcacggcccuggguaguaaugugugcguauaauaaacuaaauggagaauauugcucagaaaacagauauuuacucacagaaguacuaaaaaaugaauggaugcaugauggauucguuguaucagauuggggagcaguuaacgauagaguaaguggacuagacgccggguuagauuuagaaaugccgacaagucauggcauaacagauaaaaaaauaguagaagcaguaaaaucaggaaaacuaucggaaaauauacuaaaucgugccguugaaagaauacucaaagugauauuuauggcguuagaaaauaagaaagaaaaugcacaauacgauaaagaugcacaucauagauuagcaagacaagcagcagcugagucgaugguacuauuaaagaaugaagacgauguacucccacugaaaaaaucaggaacaauagcauugauuggagcuuucguaaaaaagccuagguaucaaggaagugguucaagccauauaaccccaacgagauuagaugacaucuaugaagaaauuaaaaaagcaggcggagacaaaguuaaucucguauacagugaaggguauagauuagagaaugauggaauugacgaagaacuuauaaacgaagcuaaaaaagcagcaaguucuucagauguagcaguuguuuuugcaggccuccccgaugaauaugaaagcgaaggauuugauagaacacauaugaguauaccugaaaaucaaaacagauuaauagaagcaguagcggaaguacaaaguaauaucguugugguacuacuaaacggaagcccaguggaaaugccauggauagauaaaguaaagucaguccucgaagcauacuugggaggacaagcauuagggggcgcauuagcagacguacuauucggcgaaguaaacccaagcggaaaauuagcagaaacauuuccaguaaaauuaagucacaacccaucauacuuaaacuuuccaggagaagaugauagaguagaauacaaagaaggacucuucguaggauauagauauuaugauacaaaaggaauagaaccuuuauucccauuuggacacggguuaucauacacaaaguuugaguauagugauauaucagucgauaaaaaagauguuagcgauaacagcauuauaaacgugagcguaaaaguaaaaaauguaggaaaaauggcagguaaagagauaguacaauuauacguaaaagauguuaaaaguaguguuaggagaccagagaaagaguuaaaagguuucgaaaaaguauuucuaaauccuggagaagaaaaaacuguaacauucacucuagauaaaagagcauuugcauacuauaacacacaaauaaaagauuggcaugucgaaucuggggaauucuuaauauuaauaggaagaaguucacgagauauaguguuaaaagagucaguacggguaaauaguacaguaaaaauaagaaaaagauuuaccgucaacagugcaguugaagauguaaugucggacucaagugcagcagcaguuuuaggaccaguauuaaaagaaauuacagaugcacuucaaauagacauggacaacgcgcacgacaugauggcagcuaauauaaaaaauaugccacuaaggagccuagucggauacagucaaggaagauuaagugaggaaaugcuagaagaacuaguagauaaaauaaauaacguugaa

SEQ ID NO: 51381 - RNA, 2265 nt, Artificial Sequence
  derived and/or modified sequence opt6 from anti-influenza_Chain
auggcaguagacauuaaaaaaauaauuaaacagaugacauuagaggaaaaagcaggacuauguucaggauuagacuuuuggcacacaaaacccguagaaagacugggcauaccaaguauuaugaugacagaugggccucaugguuugagaaaacaaagagaagacgcagaaauagcagauauaaacaacaguguuccugcaacauguuucccgucggcagccggcuuagcauguaguugggacagagagcuuguagaaagagucggagcagcauuaggagaagagugucaggcagaaaaugucaguauauuguuaggccccggagcaaacauaaaaagaucuccacuauguggaagaaauuuugaguauuuuagugaagacccauauuuaaguagugaacuagcggcuucacacauuaaaggaguucaaagucagggaguaggagcauguuugaaacauuucgcggcaaauaaccaagaacauagaagaaugacaguagauacaauaguagaugaaagaacacuaagagaaauauacuuugcaucauuugaaaacgcagugaaaaaagcgagaccauggguaguaaugugugcauacaacaaauuaaauggagaauacuguagugaaaacagguauuuacuuacagaaguauuaaaaaaugaauggaugcaugacgguuucguagucagugauuggggagcaguaaaugauagaguaucaggauuggaugcaggauuagauuuagaaaugccaacaucccaugguauaacagauaaaaaaauuguagaggcagugaaaucgggaaaacuaagugaaaauauauuaaauagagcuguagaaaggauucuaaaaguaauauuuauggcgcuugaaaauaaaaaagaaaaugcacaauacgacaaagacgcucaccauagauuagcaagacaggcagcagcagaaaguaugguauuacuaaaaaaugaagaugacguuuuaccguuaaaaaaaaguggaacaaucgcucuaauaggagcauuuguaaaaaaaccaagguaucaaggaaguggaaguagucauauaacaccaacacgacuagacgauauauaugaagaaauuaaaaaagcaggcggagauaaaguaaacuuaguuuauucagaagguuacagauuagagaacgauggaauagaugaagagcuaauuaacgaagcaaaaaaagcagcaagcagcagcgauguagcggugguauucgcaggauuaccagaugaauacgagagcgaaggguucgacagaacgcacaugucaauaccagaaaaccaaaacagguugauagaagcuguugccgaaguacaaaguaacauugucguaguguuacuaaacgguaguccaguagaaaugccauggauagauaaaguaaaaucaguauuagaagcauauuuaggaggacaagcauugggaggggcauuagcagauguacuauucggagagguaaauccuucaggaaaauuagcagaaacauucccugugaaguuaagucacaacccaaguuauuuaaauuuuccaggagaagaugaccgagucgaauacaaagaaggacuuuuugugggcuauagguauuaugauaccaaaggaauugaaccauuauuuccauuuggacauggauuaaguuauacaaaguucgaauacucagauauaucgguagacaaaaaggauguaagugacaauucaauaauuaacguaaguguaaaaguaaaaaauguaggaaaaauggcaggaaaagaaauaguacaacuauaugugaaagauguuaaaucaucaguaaggaggccggaaaaagaacuaaaagguuuugaaaagguauuuuuaaaucccggagaagaaaaaacagugacauucacauuagacaaaagagccuuugccuauuauaauacgcaaaucaaagauuggcauguagaaucaggugaauucuuaauuuuaauaggaagaaguagccgagauauaguuuuaaaagaaaguguaagaguaaauucaacaguaaaaauacguaaaagauucacaguaaauagugcaguggaagauguaaugagugacucaucagcggcugcagugcucggcccuguauuaaaggaaauaacagaugcuuuacaaauagacauggauaacgcacaugauaugauggcagcaaacauaaaaaauaugccuuuaagaaguuuaguaggauauagucaagguagauuaagugaagagaugcuagaagaacuaguagauaaaauaaauaauguagaa

SEQ ID NO: 51382 - RNA, 2277 nt, Artificial Sequence
  derived and/or modified sequence opt6 from anti-influenza_Chain
auggaaagaauaaaagaacuacgaaauuuaaugucgcagucaagaacacgagaaauacugacaaaaacaacaguagaucauauggcaauuauuaagaaauauacaucuggaagacaagagaaaaacccugccuugcggaugaaauggaugauggcaaugaaauauccaauuacugcagauaaaagaauaacugaaaugauaccugaaagaaacgaacaaggccaaacgcuauggagcaaaaugaacgaugcugggucagacagagugauggugucaccacuagcaguuacuugguggaauagaaacggacccaugacaaauacaguucacuauccgaaaauauauaaaaccuauuucgaaagaguugaaaggcuaaaacacggaacguuuggaccuguucauuuccgaaaucaagucaaaauaagaagaagaguagacauuaacccaggacaugcagauuuaagugcaaaagaagcacaagaugugauaauggaaguaguauuuccaaacgaaguaggagcaagaauuuuaacaucagaaucacaauuaacuauaacuaaagaaaagaaagaagaacugcaagacuguaaaauuagcccauuaaugguagcauauaugcuagaaagagagcuaguaagaaaaacacgauuuuugccaguugccggaggaacuagcagcguauauauagaaguacuacacuuaacgcaaggcacuuguugggaacaaauguauacaccaggaggagaagucaaaaaugaugacguagaucagagcuuaauaauagcugcgagaaauauagucagacgagcugccguaucagcagauccauuagccuccuuauuagaaaugugucacagcacucaaauaggugguauaagaaugguagauauucuaaaacaaaaucccacagaagaacaagcaguaggcauauguaaagcagcaaugggauuaagaauuucaagcucauuuucuuucggaggauucaccuuuaaaagaacuucaggaucaucaguuaaacgcgaagaagaaguacuuacaggaaauuuacaaacacuaaaaauuaggguacaugaaggauaugaagaguucacaaugguuggcagacgagcaacagcaauacuacgaaaagcuacaagacgauuaauacaacuaauaguaagcgguagagaugaacaaucaauagcugaagcuaucauaguagcaaugguauuuagccaagaagauugcaugauaaaagcaguuaggggagauuuaaauuucguaaaccgagcaaaucaaagacuaaaucccaugcaccaacuauuacgacacuuccaaaaagacgcuaaaguauuauuucaaaauuggggaguagaaccaauagacaauguaaugggaaugaucggaauacuaccagauaugacaccaagcauagaaaugagcaugagaggaguuagaauauccaaaaugggcguggaugaauacaguuccaccgaacgaguagucguaucaauagacagauuucuaagaguucgggaccaaagaggcaacguauuacuuucaccagaagaaguaagugaaacgcaaggaacagaaaaacuaaccauaaccuauagcucaagcaugaugugggaaauaaauggaccagaaagcguccuaguaaacacuuaucaauggauaaucagaaauugggaaacuguaaaaauucaauggucacaaaacccaacuaugcuguauaauaaaauggaauuugaaccauuucaaucauuaguacccaaagcaauaagaggucaauauucaggcuuuguaagaacucuauuucaacaaaugagagacguacuagguacauuugauacagcccaaauaauaaaacuauuaccuuucgcagcagcaccaccaaaacaaagcaggaugcaauuuagcucauuuacaguaaauguuagaggauccggaaugagaauauuaguccgcggaaacuccccaguauuuaauuauaauaaagccacaaaaagacuaacaguguuaggcaaagacgcuggcacauuaacagaagaccccgaugagggaacagccgguguagagagugcaguacuaagaggauuccucauauuagguaaagaagauagaagauacggaccagcauuaaguaucaaugaauuaucuaauuuagccaaaggagaaaaagcaaacguauuaauaggacagggagauguaguucucguaaugaaaagaaaacgagauaguuccauacuaacagauagccaaacagccaccaaaagaauacguauggcgauuaac

SEQ ID NO: 51383 - RNA, 2277 nt, Artificial Sequence
  derived and/or modified sequence opt6 from anti-influenza_Chain
auggaacgaauaaaagaauugagaaaucucaugucgcaaucaagaacaagagaaauacuuacaaaaacaacaguagaccauauggcaauaauaaagaaauauacaagugguaggcaagagaaaaacccggcacucagaaugaaauggaugauggcaaugaaauacccaaucacagccgauaaaagaauaaccgaaaugauacccgaaagaaaugaacaaggacaaacacucuggucuaaaaugaaugacgcaggaagugacagaguuaugguuuccccacuagcugugacaugguggaaucggaauggaccuaugacaaacacagugcauuauccuaaaauauacaaaacauauuuugagagaguagaaagauuaaaacacgguaccuuuggaccaguacacuuuaggaaucaaguaaaaauaagaagacgaguggauauaaauccaggucaugcagaucuaucagcaaaagaagcacaagaugucauaauggaaguaguauuuccaaaugaaguuggcgcuagaauacuaacaagcgaaucacaacuuacuauuacaaaagaaaagaaagaagaauuacaagacuguaaaauuagcccucuaauggucgcuuauaugcuagaacgagaauuaguacgaaaaacaagauuccuacccguagcugguggaacaagcucaguuuacauagaagugcuucaucuuacacaaggaacguguugggaacaaauguacacaccugguggcgaaguuaaaaaugaugacguugaccaaucacugauaauagcagcaagaaauauagugaggagagcugcagucagugcugacccauuagcaucuuuguuagaaaugugucauucuacacaaauagguggcauaagaaugguagacauauuaaaacaaaacccaacugaagaacaggcaguagguauauguaaagcugcaauggguuuaagaauaucaaguaguuuuucauuuggaggauuuacauuuaaacgaacaucagguucaagcguaaagcgagaagaagaaguacugacugggaaccuacaaacauuaaaaaucagaguucacgaaggauaugaagaguucacaaugguaggacgacgagcaaccgcaauuuuaagaaaagcaacuagaagacuaauucaauuaauaguaagugggagagaugaacaaucaaucgcugaagccauaauaguagcaaugguuuucagucaagaagauuguaugauuaaagcaguaagaggagauuuaaauuuuguaaauagagcaaaccaaagacuaaauccaaugcaucaguuacuaagacacuuccagaaagacgcgaaagucuuauuccaaaauuggggaguagaacccauugauaacguaaugggaaugaucggaauauuacccgacaugacuccaucaauugaaaugaguaugagaggaguuagaauuaguaaaauggguguagacgaauauucgaguacagaacgaguaguuguaaguauugacagauuuuuaagaguaagagaucagagaggaaauguacuucuaucaccagaagaaguuucagaaacucaaggaacagaaaaacuaacaauuacauacaguagcucaaugaugugggaaauaaacggaccagaaucuguccuaguuaauacauaucaauggauuauacgaaauugggaaaccgugaaaauacaauggagccaaaacccaaccaugcuauauaauaaaauggaauuugaaccauuucagagcuuaguucccaaagcaauaagagggcaauacagcggguuugucagaacacuauuucaacaaaugagagauguuuuaggaacauucgauacugcucaaauaauaaaacuacuacccuuugcugcagcgccacccaaacaaucaaggaugcaauucagcucauucacaguaaauguacgcggaucuggaaugaggauucucguuagaggaaauagcccaguauucaacuauaauaaagcuacgaaaagauuaacaguacuggguaaagaugcaggcacuuuaacagaagacccagaugaggguacagcaggaguagaaucagcaguauugagaggcuuucuaauucuuggaaaagaagauagaagauauggaccugcauugucaauaaacgaauuaucaaacuuagcaaaaggagaaaaagcaaacguacucauaggacaaggagacgucguccuaguaaugaaacgaaaacgagauucaagcauacucacagauucgcaaacagccacaaaaagaauuagaauggcaauaaac

SEQ ID NO: 51384 - RNA, 2472 nt, Artificial Sequence
  derived and/or modified sequence opt6 from anti-influenza_Chain
augaugcuuagaaaaaaaacaaaacaacuaauuucuagcauauuaauacuaguauuacuacucaguuuauucccagcugcauuggcagcagaaggcaauacaagagaagacaauuuuaagcaucuacuaggaaacgauaauguaaaacgccccucagaagcaggagcccuacaacuacaagaaguggauggccaaaugacauugguagaccaacacggcgaaaaaauucaauuacgugggaugucgacacauggucuccaaugguuuccagaaauacuuaaugacaaugcauauaaagcauuaucuaaugacugggacucaaauaugauuaggcuagcaauguauguaggugaaaauggauacgcgacaaauccagaacuaauaaaacaaagaguaaucgauggaauagaauuagcaauagaaaacgacauguauguaauuguagauuggcauguacacgcacccggagauccaagagaucccguauaugcaggugcaaaagauuucuuccgagaaauagcugccuuauacccaaacaauccucauauaauauacgaauuagcaaaugaaccaucuucaaauaacaacggaggcgcugggauuccaaacaaugaagaaggauggaaagcaguaaaagaauacgccgauccuaucguagaaaugcuuagaaaaucaggaaaugcugacgacaacauaauaauaguaggaucaccaaauuggagccaaagacccgaccuagcagcagacaauccaauagaugaucaccauacaauguacacuguccauuuuuacacuggaucacaugcagcaagcacagaaucauauccaucugaaacaccaaauucugaacgaggaaacguuauguccaacacaagauaugcacuggaaaauggcguagcaguuuuugcaacagaauggggaacaucacaagcaucaggugauggcggaccauauuucgaugaagcugauguauggauagaauuccuaaaugaaaauaauauaucaugggccaauuggucacuuacaaacaaaaaugaagucucaggagcuuucacgccauucgaacuaggcaaaucaaaugcaacaaauuuggaccccggaccagaccauguaugggcaccagaagaacuuucccuuaguggagaauauguccgcgcaagaauaaaaggagucaauuaugaaccaauugacagaacgaaauauacaaagguucuaugggauuuuaacgauggaaccaaacaaggauucgguguaaauagugauucaccaaauaaagaacugauugcaguugauaacgaaaauaacacacuaaaaguauccggauuagacgucucuaacgacguuucagaugguaauuuuugggcuaaugcacgacuaagcgcaaauggauggggaaaaagcguagacauucuaggagccgaaaaauuaacaauggacguaaucguugaugaaccgacuacuguagcuauagcugcaauaccacaaaguucaaaaucaggaugggcaaauccagaaagggcaguaagaguaaaugcagaagauuuuguacaacaaacugacggaaaauauaaagcaggauuaacaauuacaggagaagacgcgccaaauuuaaaaaauauagcauuucaugaagaagauaauaauaugaauaauauaauauuauucguaggaacugaugcugcagauguaauauacuuagacaauauaaaaguuauagguacggaagucgaaauaccaguaguacaugacccgaaaggggaagcaguauugccaucuguauuugaagacggaacaagacaagguugggauugggcaggugaaucaggaguaaaaacugcacuaacaauagaagaggccaauggaucaaaugcucugucaugggaguuuggauauccagaggugaaaccaucugacaacugggccacagcgcccagauuagauuuuuggaaauccgaucucguuagaggagaaaaugauuacgucgccuucgauuucuacuuagauccuguaagagcaacagaaggagcaaugaauauaaaucuaguuuuccagccaccaacaaacggauauuggguacaagcaccaaaaacauauacaauuaauuuugacgaguuggaagaagcaaaccaagucaacggccuauaccauuaugaaguaaaaaucaacguacgagacauaaccaacauacaagaugacacacuuuuacguaauaugaugauaaucuucgcugacguugagucagauuuugcaggccgaguauuuguagauaacguaagauuugaaggugcagcuacaacugaaccaguagaacccgaaccaguggauccaggugaagaaacuccuccaguugaugagaaagaagcaaaaaaggagcaaaaagaagcagaaaaagaggaaaaagaagcagucaaagaagaaaaaaaagaagcuaaagaagaaaaaaaagcaguaaaaaaugaagcaaagaaaaaa

SEQ ID NO: 51385 - RNA, 2472 nt, Artificial Sequence
  derived and/or modified sequence opt6 from anti-influenza_Chain
augaugcuccgaaaaaaaacaaaacaauuaaucucaaguauauuaauauuaguauuacuauuaucguuauuuccagcugcacuagcagcugaaggaaauacaagagaagauaauuucaaacaucuuuuggguaaugacaauguaaaaaggccaucagaagcuggagcacuucaauuacaagagguagaugggcaaaugacuuuaguagaucaacauggagaaaaaauacaacuaagagguaugagcacccauggccuacaaugguucccugaaauauuaaaugacaacgcauauaaggcacuaucaaacgauugggacuccaacaugauuagacuagcaauguauguaggagaaaauggauacgcaacgaacccagaauuaauaaaacaaagaguaauagaugguaucgaauuagcuauagaaaaugauauguauguaauaguugauuggcaugugcacgcaccuggagauccuagagauccuguauaugcaggagcgaaagauuucuucagggaaauagcagccuuauauccaaauaauccccauaucauauaugagcucgccaacgaaccauccagcaauaacaacggaggagcaggaauaccaaauaaugaagaagguuggaaagcgguaaaagaauaugcagacccuauaguagaaaugcucagaaaaucaggcaaugcagacgacaacauaauaauagucggaucuccaaauuggucacagaggccagaccuagcagcugauaauccaauagacgaccaucacacuauguauacagugcacuuuuauacagguagccacgcagcaucaacugaaagcuacccaucagaaaccccaaacagugaaagaggcaacguaaugucaaacacaagauacgcacuagaaaacggaguggcaguauucgcuacagaauggggaacaagucaagcaucaggagauggaggaccauauuucgacgaagcagaugucuggauagaauuucuuaacgaaaacaauauaagcugggcaaauuggucauuaacaaauaaaaacgagguaagcggagcauucacaccauuugaguuaggaaaauccaacgcgacaaacuuagauccaggaccagaccacguaugggcaccagaagagcuaagucucucaggagaauauguucgcgcucgaauaaaaggaguaaauuacgaaccaauagaucgaacaaaauacacgaaaguacuaugggacuuuaacgacggaacuaaacaaggauucggaguaaauucugauagcccaaauaaagaauuaauagcaguagacaacgaaaauaauacucuuaaaguaaguggauuagaugugaguaacgauguuagcgacggcaacuucugggcaaaugcaagguuaucagcaaauggguggggaaaaaguguugauauauuaggagcagaaaaacuaacaauggacguaauugucgaugaaccaacuacaguagcaauagcagcaaucccucaaucaucaaaaagcgggugggcaaacccagaaagggccguaagaguaaaugcagaagacuucguucaacaaaccgaugggaaauauaaagccggacuuacuauaaccggagaagacgcaccuaaccuaaaaaauauagcuuuucacgaagaagauaauaauaugaacaauauaauccuguuuguagggacagaugcagcagauguuauauauuuagauaauaucaaagucauagggacagaaguagaaauaccaguuguacacgacccaaaaggagaagcagucuuacccucaguauuugaggacgggacgcgacaaggaugggacugggcuggugaaaguggcguaaagacagcucuuacaauagaagaagcaaauggcucaaaugcuuuaucaugggaauucggauacccagaaguaaaaccaagcgacaacugggcaacagcgccaagacuagauuuuuggaaaagcgaccuaguaagaggagagaaugauuacguagcauuugauuucuauuuagauccaguaagagcaacagaaggugcaaugaacauaaaccuaguauuucaacccccaaccaacggauacuggguacaagcaccuaaaacauacacaauaaauuucgacgaauuagaagaggcgaaccaaguuaaugguuuauaucauuaugaaguaaaaauaaauguacgcgauauaacaaauauucaagacgacacauuauuaagaaauaugaugauaauauuugccgacguagaguccgacuuugcagguagaguuuucguugacaauguaagguuugaaggugcagcaacuacagaaccuguagagccagaaccagucgauccuggcgaggaaacaccaccaguugaugaaaaagaagcaaaaaaagaacaaaaagaggcagagaaagaagaaaaagaagcaguuaaagaagaaaaaaaagaagcuaaagaagaaaagaaagcaguaaaaaaugaagcaaaaaaaaaa

SEQ ID NO: 51386 - RNA, 3063 nt, Artificial Sequence
  derived and/or modified sequence opt6 from anti-influenza_Chain
auggcagguccgcacagaucaagagccgcaggaccaccucccuucgcaguggacgagcauguagcucuagagauggucgcauucagaggagaaguuuuugcuggacauggacuucuagcagaucagcgcuuaauagcacauaccggaagaccagcacuuaacgcacaacgaauaacacaacaaaaacaacgagaccaguguagaggccaaagacaccgacaucaccaaggggguagaaacuugagaaaagcacauagaacguuucacgaacaucaaucaacucaagaucaagcacaugaugccccacauggucaacaagcuaaaacaggacaugaaggacuaggacacgaacaugcucaagcucaacaccaacaaggacaaagcaacguaguagauaggcaggauggagagccuguagaagcucaacaccaaaaagauggagcacaaagagcuggcaaugcaccagcagguagaguugaacuagagcaacaaccaguugaagcgcaacaucaacagcaagagggugauguaagaauaggaaaaagaagacaaaacgcauuugcuccuccugcucuagaucauguccaugguggaccuggaagacugcaacgucacggauuagcgguagaacgacacgucccagcaguacaacaacaccagcaaaggguccagagaggcagacaacaaauugaucacguguuaggacaugguuugccuggaaggcaaagauuagccuuuagagauggcccacguagaccuguaggaguagccucaccuguuuuaggacaaagaccauguccuggucaucggauuguucaaaaccuuuuuagacacggaaucgacccauguagagugggucgcugucgaagaucuccuucagagcuacauggcauggguugcgcugauguacgagcacgagggcacggaagacauaugagaggacaaagagaugaacacccaggaagaggaagaccgugugcuagaaggagacauguugaugacgaucgagauaggacuccacaagagaaguuauaugauguagcuagaggauuagacgaaccagcgcgaagagugcacuucgacgaugaagccgauagaucagucuuuagaggacucgcucaaccugcaccagaugagccagaagguagacguagagaucgauuaguuuuacaaagacaaaguguaaaucauagaagaggaagauuaagcagacaccgacaacaacaucaaccacaacaacaacgcccucacgguaaucaggccuuuuugggaaaauaugagaaaagaagacguaaaccaacugcuugccugaaaagucucagaagauuuccagacaaggaugcaccgguauuauauuuuguaaaucaacuagagaaaacaaagaggagaaugacacuacuauuaguaugguuaauauuuacuggaguagcaggggaaauaagauuagaagcugaagauggcgaacuacuugguguagcuguugauaguacacuaacagguuacucggguagaggauacguaaccggcuuugaugcaccagaagauucuguaagguuuaguuuugaagcuccacgugguguauauagaguaguauucgggguuaguuuuucaucaagauuugcaucuuacgccuuaagaguugaugauuggcaucaaaccggcucccugauuaaaagaggaggaggauucuuugaagcaucuauaggagaaaucuggcuugacgagggagcacacacaauggcauuucaacugaugaauggagcauuggauuauguacgacuagaaccuguuucauauggaccuccagcaaggccaccagcucaacuaucagauagucaagcaaccgccucugcacaagcacuuuuugcauucuuauuaagcgaauacggacgacauauacuugcaggacaacagcaaaacccauauagaagagauuuugaugcuauaaauuacguuagaaacguaacuggcaaagaacccgcguugguaucguuugauuuaaucgauuauagcccaaccagagaagcucauggcguaguacacuaucagacaccagaagauuggauagcuugggcagguagagauggaauagucucacuuauguggcauuggaaugcuccaacagacuuaaucgaggauccaagucaagacugcuacuggugguaugguuucuauacacggugcacaaccuuugacguugcagcagcauuagcagacacaucaucagaaagauaucgauuauuauugagagauauagauguuauagcagcacagcuccaaaaauuucaacaagcugauauuccagucuuauggcgaccacuacacgaagcagcaggagguugguuuugguggggagcaaaagguccugaaccauucaaacaauuauggagauuacuauaugagaggcuuguucaucaucauggguuacauaauuuaaucuggguauacacacaugaaccuggagcugcggaaugguauccaggggaugcguacguggauaucguagggagggauguauaugcagacgauccugaugcccuaaugcgaucagauuggaaugaauuacaaacauuauuuggaggaagaaaacuuguggcgcuaacagaaacuggaacacuaccagacguggaaguaauaacagauuacggaauaugguggaguugguuuucaauuuggacagaccccuucuugagagauguugacccagaucgacugacucguguuuaucauuccgaaagaguauuaacacgcgaugagcuuccagauuggcguuccuacguauuacaugcaacaacaguacagccugcaggagacuuagcacuagcuguauacccgaauccuggagcuggucgauuacauguagaagucggcuuaccaguagcggcaccaguaguagucgagguauuuaaucuacuuggacaaaggguguuucaauaucaagccgguaugcagccagccgguuuauggagaagggcauucgaauuagcauuagcaccaggaguauaccuuguacaaguaagagcagguaaucuuguagcuagaaggagauggguauccguaaga

SEQ ID NO: 51387 - RNA, 3063 nt, Artificial Sequence
  derived and/or modified sequence opt6 from anti-influenza_Chain
auggcaggaccacacaggucacgagcagcuggaccaccucccuucgcagucgacgaacauguggcauuggaaaugguggccuuucggggagaaguauuugcaggacaugguuuauuagcagaucaaagauuaaucgcucacacaggaagaccugccuuaaacgcacaaagaauuacucaacaaaaacaaagggaccaaugcaggggacaaagacauagacaccaucaaggcggaaggaaucuuagaaaggcccauagaacuuuucacgaacaucaaaguacacaagaucaagcacaugaugcuccgcauggccaacaagcgaaaacaggacacgaaggccuuggacacgaacaugcccaggcccaacaucaacaaggucaaaguaacguaguagaucgccaggauggagagccgguugaggcccagcaucagaaagauggugcucaaagagcugguaaugcgccugcaggacggguagaacuagaacaacaaccagucgaagcucaacaccaacaacaagagggugacguacggaucgguaaaagaaggcaaaaugccuucgccccgccagcacucgaucauguucaugggggaccaggacgcuuacaaagacacggcuuagcuguagaaagacauguacccgcuguacagcaacaucaacaacgaguacaaagaggacgacaacagauagaucauguauugggacauggauuaccaggaaggcaaagauuagcauuuagagaugguccuaggagaccaguagggguagcgucucccgucuuagggcaaagacccuguccagggcacagaauaguacaaaauuuguuucgucacgguauagauccuuguagaguaggacgaugucgaagaucaccaagugaguuacauggaaugggaugcgcugacguaagggcaagaggucacgguagacauaugagaggccaaagagaugaacauccuggcaggggaagaccgugcgcaaggcgacgacacguugaugacgauagagacagaacaccucaagaaaaauuauaugauguugcuagagguuuagaugaaccagcucgaagaguucauuuugaugacgaagcagauagaaguguauuucgaggacucgcacagccugcuccagaugaaccugaaggaagacgaagagaucgccuaguauuacaaagacaaucaguaaaucauaggagaggcagacuaagcagacauagacaacaacaucaaccacagcaacaacgaccacauggaaaucaagcauucuuaggaaaauaugagaaaaggcgcagaaaaccaacagcuuguuugaaaaguuuaagacgauucccagauaaagaugcucccguuuuauauuuugugaaccaacuggagaaaaccaaaagacgaaugacacugcuccuaguuuggcuaauauuuacaggaguugcuggggaaauaagauuggaagcagaagacggagaauugcuagguguagccguagauucaacauuaacggguuacucaggaagaggauacguaacuggauucgaugcaccugaagacucaguaagauuuucuuuugaagcaccacgaggaguuuauagaguaguuuuugggguaaguuucaguucuagauuugccaguuaugcucuccgaguagaugauuggcaucagacugguucucuaauaaaaagaggagguggauucuuugaagcauccaucggggaaauuuggcuugacgaaggagcccacacaauggccuuucagcuaaugaauggggcuuuagauuauguuaggcuagaaccaguaucuuauggacccccagcccgaccgccagcucaacuaucagauucucaagcaacagcaucagcucaggcuuuauuugcauuuuuacucagcgaauauggaagacauauacuagcuggacaacaacaaaauccauauagacgagacuucgaugcuauaaacuauguacguaauguaacuggaaaagaaccagcccuuguguccuucgaucuaauagacuauucaccuaccagagaagcacauggaguuguacauuaucaaacuccggaagauuggauagcaugggcaggaagggauggaauuguaucucucauguggcauuggaacgcaccaacggauuugauugaagauccaagucaagauugcuauuggugguacggcuucuauacaagauguacaacauucgaugucgcagcagcauuagcugacacaucaucugagagauaccggcuuuuacucagagauauagauguaaucgcugcacaauuacaaaaauuucaacaagcugacauaccuguacuuuggcggccucuacaugaggcagcugguggcugguucugguggggugcaaaaggaccagaaccuuucaaacaacuauggagacuacuuuaugaaagguuaguacaccaccacggucuucacaaucuaaucuggguauacacacaugaaccaggagcugcagaaugguauccuggagaugcauacgucgauauugugggccgagauguguacgcagaugauccagacgccuugaugagaucagacuggaaugagcugcaaacgcuauuuggaggaagaaaauugguagccuuaacagagacgggaacauuaccagacguagaaguaauaacggauuacggaaucugguggucaugguuuaguauauggacugaccccuuucuuagagauguagauccagacagacucacuagaguuuaucacagugaacguguauuaaccagagaugaauuaccagacuggagaucauauguacuacaugcaacaaccguucaaccugcgggugaucuagcauuagcuguauacccaaauccaggcgcaggaagauuacauguugaagucggauuaccuguagcggcuccggucguaguagaaguuuuuaaccuuuuaggccagagaguauuccaauaccaggcugguaugcagccagcaggauuauggagacgcgcguuugaguuagcuuuggcaccagguguauauuugguacaaguuagagcagggaauuuaguagcaagacgacgauggguuaguguaaga

SEQ ID NO: 51388 - RNA, 3165 nt, Artificial Sequence
  derived and/or modified sequence opt6 from anti-influenza_Chain
augaggaagaaacgacgggguuuucuaaaugcuucuaccgcuguuuuaguggguauccuugcaggauuccucgggguaguacuagcagcaacaggagcgcuaggauucgcuguacgugaaucauuauuguuaaaacaauucuuauuuuugagcuuugaaggaaacacagacggagccaguccauucgguaaagacguggucguaacagcaagccaagacguugcugcagauggugaauacuccuuaaaaguagagaacagaaccucgguaugggacggaguggaaauagacuuaaccggaaaaguaaacacuggaacagauuaucuauuaucuuuucacguauaucaaacaagcgacagcccacaacuauuuaguguacuugccagaacagaggaugaaaaaggagaacgauauaaaauacuugcugauaaaguggugguaccaaacuacuggaaagaaauauugguaccauuuaguccaacguuugaaggaacaccggcaaaauuuaguuugauaauuacaaguccaaagaaaacagauuuugucuucuacguagauaauguucaaguuuuaacaccgaaagaagccgggccuaaagucguauacgaaacaucauucgagaaaggaauaggugauuggcaaccaagaggaagugacguaaaaauaaguauaagccccaaaguagcacacucuggaaagaaaucuuuauuuguaaguaauagacaaaaaggauggcacggagcacaaauaagucuaaaagguauuuuaaaaacaggcaaaacauacgcauucgaagcgugggucuaccaagaaucagggcaagaccaaacaauaauaaugacuaugcagagaaaauacucaagugacucaucaacuaaauacgaauggauaaaagcagcuaccgucccuucaggacaauggguacaacuaucaggaacuuacacaauuccagcaggaguaaccguagaagaucucacacuauacuuugaaagccaaaacccaacauuagaguucuacguagaugauguuaaagucguggacacaacaucagcagaaauaaaacuagaaaugaauccugaagaagaaauaccagcccuaaaggacguuuuaaaagacuauuuuagaguagggguugcauuaccaucaaaaguuuucauaaaucaaaaagauauagcauuaauaucaaaacacuccaauucaucaacagcagaaaacgaaaugaagccugauaguuuauuagcaggaauagaaaacggaaaauuaaaauucagauucgaaacagcagauaaauauaucgaauuugcucaacaaaaugggaugguaguucgaggucacacccuagucuggcauaaucaaacaccagaaugguuuuucaaggaugaaaauggaaaccuacuuagcaaagaagagaugacagaaagacuucgugaauauauucauacuguuguaggacauuuuaaaggaaaaguuuaugcgugggauguaguaaacgaagcaguagacccaaaccaaccugauggcuuaagacgaagcacaugguaucaaauuauggguccagauuauauagaacucgcauucaaauuugcgagagaagcugauccaaaugccaaauuauucuacaacgauuacaauacauucgaaccaaagaaaagagacauaauauauaacuuaguuaaaaguuuaaaagaaaaaggucuaauagacggcauaggaaugcagugucacauaagccuggcuacggacauacgccaaauugaagaagcaauaaagaaauuuaguacaauuccaggaaucgaaauacauauaacagaauuagauauaaguguauauagagacucuacgucaaacuacagcgaagcaccucgaacagcauuaauugaacaggcucauaaaauggcacagcuauuuaaaauauucaagaaauacucuaauguaauaacaaauguaacguucugggguuuaaaagacgacuacucauggcgugcaacgcgaagaaacgacuggccacuaauauuugacaaagacuaccaagcaaaacuugcauauugggcaauuguagccccugaaguauuaccuccauuaccaaaagaaagcaaaauaagugaaggagaggcaguaguaguaggaaugauggacgauaguuauaugaugucgaaaccuauugaaauuuacgacgaagaaggaaacguaaaagcaacaauaagagcaaucuggaaagauagcacaauauauguauacggagaaguccaagaugcgacgaagaaacccgcagaggauggaguagcaauuuucauaaauccuaauaaugaaagaaccccauaucuucagccagacgauacauauguuguacuuuggacaaacuggaaaucagaagugaauagagaagauguagaaguuaaaaaguucguuggaccaggauucaggagauauagcuuugaaaugucaauaacaaucccuggggucgaauuuaagaaagacaguuauauuggauucgacguagcaguaauagacgauggaaaaugguacucauggucagacacuaccaauucacagaaaacuaauacaaugaacuaugguaccuuaaaacucgaaggagucauggucgcaacugcaaaauacgggacaccagucauagauggggaaauagacgauauauggaacacaacagaagaaauugaaacaaaaucuguugcuaugggaucacucgagaaaaaugcaacagcaaaagucagaguguuaugggaugaggaaaacuuauauguuuuagcaaucgugaaagacccgguccuuaacaaagauaauuccaauccaugggaacaagauucuguagaaaucuuuauagaugagaauaaucauaaaacaggauauuacgaagacgaugaugcccaauuuagaguaaacuacaugaacgaacaaucuuuuggaacaggagcuucugcagcuagauucaaaacagccguaaaauuaauagaagguggauacauuguagaggcagccauuaaauggaaaacaauaaaaccaaguccaaauaccgucauaggauuuaauguccaaguaaaugacgccaaugaaaaaggacaacgcguaggaauaauaagcugguccgauccaacaaauaauucuuggagggaccccucaaaauuuggcaaucuuagguuaaucaaa

SEQ ID NO: 51389 - RNA, 3165 nt, Artificial Sequence
  derived and/or modified sequence opt6 from anti-influenza_Chain
augagaaaaaaacgaagggguuuuuuaaaugcaucaacagcuguacuaguaggaauccucgccggauuucuaggaguaguucuagccgcuacaggagcucucggauucgcaguacgagaaagucuucuacuuaaacaauucuuauuccuaucauuugaaggaaacacagacggagcuucaccuuuuggaaaagauguaguaguaacagcaagccaagacguugccgccgauggagaauauucauuaaaagucgaaaaucgaacaucugucugggauggaguugagauagacuuaacaggaaaaguaaacacaggaacggauuaccuauuaucauuucacguauaccaaacuucagacucuccacaguuauuuaguguacucgccaggacagaagaugaaaaaggagaaagauauaagauauuagcagacaaaguaguaguaccaaauuauuggaaagaaauacuaguaccuuuuaguccuaccuuugaaggaacgccagccaaauucaguuuaauaauaacauccccaaaaaaaacugacuucguauuuuacgucgacaauguacagguuuuaacaccaaaggaagcagggccaaaagucguauacgaaacaucauucgaaaaaggaauaggcgauuggcagccuaggggcagcgacguaaaaauuucaauaagcccuaaaguagcacacucaggaaaaaaaucucucuuuguuucuaacagacaaaaagguuggcauggugcccaaauaucauuaaagggaauacuuaaaacagguaaaacguacgcuuuugaagcuuggguauaucaagagucuggacaagaccaaacaauaauuaugacaaugcaaagaaaauacagcagcgauaguaguacuaaauaugaauggauaaaagcagccacagucccgagcggucaauggguccaauugucagguacauacacaauaccagccggaguaacaguagaagaucuaacauuauacuucgaaucacaaaauccaacuuuagaauucuauguagaugacgugaaaguuguagauacaacaagugcagaaauaaaacuagaaaugaauccagaagaagagauuccugcuuuaaaagauguauuaaaagauuacuucagggucggaguagcgcuuccuucuaaaguuuuuauaaaucaaaaagauauugcauuaauuaguaaacacaguaacucaagcacugccgaaaaugaaaugaaaccugacucauuauuagcaggaauagaaaacggaaaacuaaaauuuagguuugaaacagcagacaaauauauagaauucgcacagcaaaacggaaugguaguuagagggcauaccuuaguauggcacaaucaaacuccggaaugguucuucaaagacgaaaaugguaaucuuuuaucaaaagaggaaaugaccgaaaggcuccgagaauacauacauaccguagucggacauuuuaaaggaaaaguuuaugcaugggacgucguaaacgaagccguagauccaaaucaaccggacggacuacguagaucaacaugguaucaaauaauggguccggacuauaucgaacuagcauuuaaauuugcaagagaagcugauccaaaugcaaaauuguuuuauaacgauuauaauacauucgaaccaaaaaaaagggauauuauauauaacuuaguuaagucauugaaagaaaaaggcuugauagaugguauaggaaugcaaugccauaucaguuuagcuacagauauaagacaaaucgaagaagccauaaaaaaauuuagcacuaucccaggaauagaaauacacauaacagaacuagacauaaguguauacagagacucuacaucuaauuauucagaagcuccacgaacugccuuaauagaacaagcucauaaaauggcacaacuuuuuaaaaucuucaaaaaguauucaaacgucaucacaaauguuacguuuuggggacuaaaagaugacuauuccuggagagcuacaagacgaaaugauuggccuuuaauauuugacaaagauuaccaagcuaaacuugccuauugggccauaguggcaccugaaguacucccaccuuuaccaaaggaaaguaaaauaucugaaggugaagcaguaguaguaggaaugauggaugacucauacaugaugucaaaaccaauagaaaucuaugaugaagaggguaauguuaaagcaacuaucagagccauauggaaagacuccacgauauauguauacggcgaaguacaagaugcaacaaaaaaaccugccgaagauggcgucgcaauauuuauaaauccgaacaaugaaagaacaccuuaucuccaaccagacgauacauauguaguucuguggacaaauuggaaaagugaaguaaauagagaagacguugaaguaaaaaaauucguuggaccggguuucagacguuauucauuugaaauguccauaacuauaccaggaguagaauucaaaaaagauaguuacauaggauuugauguugcggugauugacgauggcaaaugguauaguugguccgacacaacaaacagccaaaaaacaaauacaaugaacuauggaacauuaaaacucgaggguguaaugguugcaacagcaaaauauggaacacccgugauagacggcgaaauagacgacauuuggaauacuaccgaggagaucgaaacaaaaucuguugcaaugggaucucuagagaaaaacgcuacagcaaaaguuaggguucuaugggacgaagaaaauuuauacguuuuagcaaucgucaaagauccaguucuaaauaaagacaacaguaacccaugggaacaggauucgguagaaauauuuauagaugaaaauaaucauaagacaggauauuacgaagaugacgacgcgcaauuuagaguaaauuauaugaacgagcaaucauuuggcacaggagcaucagcagcaagauucaaaacagcagucaaacuaauagagggaggguacauaguagaagcagcaauuaaauggaaaaccauuaaaccaucaccaaauacaguaauagguuucaacguacaaguaaaugaugcaaaugaaaaaggucaacgcguaggaauaaucagcuggagugacccaacaaauaacucauggagagaucccaguaaauuugguaauuuacgauuaauuaaa

SEQ ID NO: 51390 - RNA, 3177 nt, Artificial Sequence
  derived and/or modified sequence opt6 from anti-influenza_Chain
augcaaguacgaaaaagaagaggucuuuuagacguaucaaccgccguauuaguuggaauacuagccggcuuccuuggaguuguacuagcagcauccggaguauuaaguuucggaaaagaagcaucaucgaaaggagacucauccuuagaaacaguauuagcacuaaguuucgaaggaacaacagaaggagucguuccauucggaaaagauguagucuugacagcaucacaagacguagcggcggauggagaauacaguuugaaaguagaaaauagaacaucaccuugggauggcguagaaauagauuuaacaggaaaggucaaaucaggagcggacuaucuucuaaguuuccaaguauaucaauccucagacgcaccacaacuauucaaugucgucgcuagaacagaagacgaaaaaggagaaagauacgacguaauacuggacaaaguaguaguaagugaucauuggaaagaaauucuaguucccuucucuccaacauuugaaggaacucccgcaaaauauucacuaauuaucguugcaucuaaaaauacgaacuucaauuucuacuuagacaaaguacaaguacuagcaccaaaagaaucaggaccuaaaguaauauaugaaacuucauuugaaaauggaguaggagacuggcaaccgcggggugauguaaacauagaggcuucaucugaaguagcacauucuggaaaaaguucacuauucauaaguaacagacaaaaaggauggcaaggagcgcaaauaaaucuaaaagguauuuuaaaaacagguaagacauacgccuuugaggccuggguauaccagaauaguggacaagaccaaaccauaauaaugaccaugcagagaaaauauagcucagaugccagcacacaauacgaauggaucaaaagugcaacaguuccaucuggccaauggguacaacuuuccgguacuuacacaauucccgccgguguaacuguugaagaccuuacuuuguacuuugaaagucaaaacccaacauuagaauuuuaugucgaugauguaaaaauaguagauacaacaucagcagaaauaaaaauugaaauggaaccagaaaaagaaauuccugcacuuaaggaaguucuaaaagauuauuucaaaguagggguugcauuaccuucaaaaguguucuugaauccuaaagauaucgaacuaauaacaaaacauuuuaacucaaucacggcugaaaaugaaaugaaaccagaaucauuauuagcaggaauagagaacggaaaacuaaaauuucgauucgaaacagcagauaaauacauucaauuuguugaagaaaacgguaugguaauuagaggacacacauuagucuggcacaaccaaacuccagacugguuuuucaaggacgaaaauggaaacuuacuaucaaaagaagcgaugacagaacguuugaaagaauauauacauacagugguuggacacuuuaaagguaaaguauacgcgugggaugucguaaacgaagcaguagauccaaaccaacccgauggcuuaaggagaaguacaugguaucagaucaugggaccagacuauauugaacuagcguuuaaauuugcaagagaagcugaucccgacgcaaaacucuuuuauaacgauuauaauacauuugaaccgcgaaaaagagauauaauauacaaucuagugaaagauuuaaaagagaaaggauuaauagacggaauuggaaugcaaugucauaucucuuuggcaaccgauaucaaacaaaucgaagaagcgaucaagaaauucucaacaauaccaggaauugaaauucacauuacugaauuagacaugagcguauaucgagauucaucaaguaauuacccagaagcuccaagaacugcuuugauugaacaagcgcacaaaaugaugcaauuauuugaaauauuuaagaaauauucaaaugugauaacaaacguaacauuuuggggauuaaaagaugacuacucauggcgagcgacaagaagaaaugauuggcccuuaauauuugauaaagaucaucaagcuaaacuagcauauugggcaauaguggcaccggaagugcuaccaccucuaccaaaagaaucacgcauaucugaaggagaagcaguaguuguaggaaugauggacgacucauauuuaaugagcaaaccuauagaaauauuagacgaagaaggaaauguaaaagcaacuauuagagcuguauggaaagauucaacuauauacaucuauggagaggugcaagacaaaacaaagaaaccagccgaagauggaguagcuaucuuuauaaauccaaauaaugagagaacuccauauuuacaaccagaugauacuuacgcuguacuauggacaaacuggaaaaccgaaguaaauagagaagacguacaaguaaagaaauuugugggaccaggcuucagaagauauaguuuugagaugucuauaacuauaccaggaguugaauuuaagaaagauaguuauauugguuuugaugcagcuguaauagaugacggaaaaugguauagcugguccgacaccacaaacagccagaaaacaaacacaaugaauuaugggacuuuaaaauuagaaggaauaaugguggcaacugcaaaauauggaacaccagucauagauggugaaauagaugaaauauggaauacaaccgaagagauugaaacuaaagcuguagcgauggguagccuagauaaaaaugcaaccgcaaaaguacgaguacuaugggaugaaaacuaucuauauguacuugcaaucguaaaagacccaguucucaauaaagacaauagcaauccaugggaacaagauagcgucgaaauuuuuauagaugaaaauaaccacaaaacaggauacuacgaagaugacgaugcacaauuuagaguaaauuauaugaaugaacaaacauuuggcacagguggaagcccagcaagguuuaaaacagcaguaaaacuaauugaaggggguuauauugucgaagcagcaauaaaauggaaaacaauuaaaccaaccccuaauacaguaaucggauuuaauauacaaguaaaugaugcaaacgaaaaaggacaaagaguaggcauuauaaguuggagugaucccacuaacaacucauggcgugauccaucaaaauuuggaaaucuucgucuaaucaaa

SEQ ID NO: 51391 - RNA, 3177 nt, Artificial Sequence
  derived and/or modified sequence opt6 from anti-influenza_Chain
augcaagucagaaaacggagaggacuacuagauguaaguacagcaguuuuagugggaauacuagcuggcuuccuuggaguaguuuuagcagcaucaggaguccuuuccuucggaaaagaagcaucaaguaaaggugacuccagucucgaaacaguucuagcauugucauuugaaggaacaacugaaggaguggucccuuucggaaaagauguaguccuaacagcaagucaagaugucgcagcugauggagaauauagcuuaaaaguagagaacagaacaaguccaugggacggcguagaaaucgauuuaacaggaaaaguaaaaagcggagcagacuacuuauugucauuccaaguauaucaaagcagugaugcaccacaacuauucaauguaguugcaagaacugaagaugagaagggagaaagauacgaugucauauuagacaaagucguugugagcgaccauuggaaagagauacucguaccauuuuccccaacauuugaaggaacacccgcuaaauauucucuaaucauagucgcaucuaaaaauacaaauuuuaacuuuuaucuagauaaaguucaaguacuugccccaaaagaaucagguccaaaagucauuuaugaaacaucauuugaaaauggcgucggagauuggcaaccacgaggugacguaaauauagaagcuaguucagaaguagcacacuccggaaaaucauccuuauuuaucaguaaucggcaaaaaggauggcaaggagcacaaaucaaccuuaagggaauacucaaaaccggaaaaaccuaugcguuugaggcuuggguguaucaaaacucugggcaagaccaaacaauaaucaugaccaugcaaagaaaauauaguucagaugcaucaacgcaauaugaauggauaaaaagugcuacagucccaaguggacaauggguacagcuaagugguacauauaccauaccagcaggcguuacugucgaagauuuaacauuauauuucgaaucacaaaauccaacauuagaauuuuauguagaugacguaaaaauaguagacacaacuucugcugaaauaaaaauagaaauggaaccagaaaaagaaaucccugcacucaaagaagucuugaaagauuacuucaaaguaggaguagcacuaccuucaaaaguauuucuaaacccaaaggauauugaauuaauaacaaaacauuucaacucaauaacugcagaaaaugaaaugaaaccagaaucuuugcuagcaggcauagaaaacggaaaacuuaaauucagauuugaaaccgccgacaaauacauacaguuugucgaagaaaaugguaugguaauaagaggacacacucuaguauggcauaaucaaacaccagauugguuuuucaaagaugaaaauggaaacuuacuaucaaaagaagcaaugacagaaagacuaaaagaauauauacacacaguuguuggccacuucaaaggcaagguauaugcaugggauguagucaaugaagcuguagacccaaaccagcccgacggauuacgaagaagcacaugguaucaaaucaugggaccagauuacauagaguuagcauuuaaauucgcacgagaagcugacccugaugccaaacucuuuuauaaugauuauaauaccuucgaaccuagaaaaagagauauaauauacaacuuagugaaagaucuaaaggaaaaaggauuaaucgacggaauaggaaugcaaugucauauaaguuuagcaacagacauaaaacaaauagaagaagcaauuaagaaauucaguacaauaccgggaaucgaaauucacauuacagaauuggauaugucaguuuauagagauagcagcaguaauuacccagaagcuccgcgaaccgcauuaauagagcaagcacauaaaaugaugcaacuuuucgagauauuuaagaaauauucuaaugucaucacaaaugugacuuuuuggggauuaaaagacgacuauagcuggagagcaaccaggaggaaugauuggccacuaauauucgauaaagaucaucaagcaaaauuagcguauugggcaauagucgcaccugaaguuuuaccaccacuaccaaaagaaaguagaauaagugaaggagaagcuguaguaguuggaaugauggacgauucauaccuuaugucuaaaccaauagaaauuuuggaugaggaaggaaacguaaaagccacaauacgagcuguuuggaaagacucaacuauauauauuuacggagaaguacaagacaaaacuaagaaaccagcagaagaugguguagccauauucauaaacccgaauaaugagagaacaccuuauuugcaaccggaugacacauacgcaguuuuauggacaaauuggaaaacagaggucaauagagaggauguacagguaaagaaauuuguagguccagguuuuagacguuauagcuucgaaaugagcauaacaauaccuggaguugaauuuaagaaagauucauauauaggauuugaugcagcgguaauagaugaugguaaaugguauaguuggucugauacaacuaacucccagaaaacaaauacaaugaacuaugguacuuuaaaacuagaaggaauaaugguagcaacagcuaaauacgguaccccuguaauagacggagaaauagaugaaauuuggaauacaacagaagagauagaaacuaaagcgguagcaaugggcucauuagauaaaaacgcaacagcuaaaguuagaguauuaugggaugaaaauuaccucuauguauuagcaauuguaaaagauccaguacuuaauaaagacaauucaaacccaugggaacaagacaguguagaaauuuuuauagaugaaaacaaucauaaaacaggauauuaugaagaugacgacgcacaauuuagagugaauuauaugaacgagcaaacauuuggaacaggaggaaguccagcacgauucaaaacugcaguaaaacuaauagaaggagguuacauuguagaagcagcuaucaaauggaaaacaauaaaaccuacaccaaauacagucauaggcuuuaauauucaagucaacgaugcaaacgaaaaaggucaaagagucggaauaaucaguuggucagauccaacuaacaauaguuggagggaucccucaaaauuuggaaaucuaagacuaauaaaa

SEQ ID NO: 51392 - RNA, 318 nt, Artificial Sequence
  derived and/or modified sequence opt6 from anti-OX40_LightChain
gaaauaguaguaacacaaucaccagcaacacuaucacuaucaccaggagaaagagcaacacuaucaugcagagcaucacaaucaguaucaucauaccuagcaugguaccaacaaaaaccaggacaagcaccaagacuacuaauauacgacgcaucaaacagagcaacaggaauaccagcaagauucucaggaucaggaucaggaacagacuucacacuaacaauaucaucacuagaaccagaagacuucgcaguauacuacugccaacaaagaucaaacuggccaacauucggacaaggaacaaaaguagaaauaaaa

SEQ ID NO: 51393 - RNA, 321 nt, Artificial Sequence
  derived and/or modified sequence opt6 from anti-OX40_LightChain
gacauacaaaugacacaaucaccaucaucacuaucagcaucaguaggagacagaguaacaauaacaugcagagcaucacaaggaauaucaucauggcuagcaugguaccaacaaaaaccagaaaaagcaccaaaaucacuaauauacgcagcauccucacuacaaucaggaguaccaucaagauucucaggaucaggaucaggaacagacuucacacuaacaauaucaucacuacaaccagaagacuucgcaacauacuacugccaacaauacaacucauacccaccaacauucggaggaggaacaaaaguagaaauaaaa

SEQ ID NO: 51394 - RNA, 321 nt, Artificial Sequence
  derived and/or modified sequence opt6 from anti-OX40_LightChain
gacauacaaaugacacaaucaccaucaucacuaucagcaucaguaggagacagaguaacaauaacaugcagagcaucacaagacauaucaaacuaccuaaacugguaccaacaaaaaccaggaaaagcaccaaaacuacuaauauacuacacaucaagacuaagaucaggaguaccaucaagauucucaggaucaggaucaggaacagacuucacacuaacaauaucaucacuacaaccagaagacuucgcaacauacuacugccaacaaggacacacacuaccaccaacauucggacaaggaacaaaaguagaaauaaaa

SEQ ID NO: 51395 - RNA, 321 nt, Artificial Sequence
  derived and/or modified sequence opt6 from anti-OX40_LightChain
gacauacaaaugacacaaucaccaucaucacuaucagcaucaguaggagacagaguaacaauaacaugcagagcaucacaagacauaucaaacuaccuaaacugguaccaacaaaaaccaggaaaaacaguaaaacuacuaauauacuacacaucaagacuaagaucaggaguaccaucaagauucucaggaucaggaucaggaacagacuucacacuaacaauaucaucacuacaaccagaagacuucgcaacauacuacugccaacaaggacacacacuaccaccaacauucggacaaggaacaaaaguagaaauaaaa

SEQ ID NO: 51396 - RNA, 321 nt, Artificial Sequence
  derived and/or modified sequence opt6 from anti-OX40_LightChain
gacauacaaaugacacaaucaccaucaucacuaucagcaucaguaggagacagaguaacaauaacaugcagagcaucacaagacauaucaaacuaccuaaacugguaccaacaaaaaccaggaaaaacaguaaaauuacuaauauacuacacaucaagacuaagaucaggaguaccaucaagauucucaggaucaggaucaggaaaagacuacacacuaacaauaucaucauuacaaccagaagacuucgcaacauacuucugccaacaaggacacacauuaccaccaacauucggacaaggaacaaaaguagaaauaaaa

SEQ ID NO: 51397 - RNA, 321 nt, Artificial Sequence
  derived and/or modified sequence opt6 from anti-OX40_LightChain
gacauacaaaugacacaaucaccaucaucacuaucagcaucaguaggagacagaguaacaauaacaugcagagcaucacaagacauaucaaacuaccuaaacugguaccaacaaaaaccaggaaaagcaccaaaacuacuaauauacuacacaucaagacuaagaucaggaguacccucaagauucucaggaucaggaucaggaacagacuucacacuaacaauaucaucacuacaaccagaagacuucgcaacauacuacugccaacaaggacacacacuaccagcaacauucggacaaggaacaaaaguagaaauaaaa

SEQ ID NO: 51398 - RNA, 321 nt, Artificial Sequence
  derived and/or modified sequence opt6 from anti-OX40_LightChain
gacauacaaaugacacaaucaccaucaucacuaucagcaucaguaggagacagaguaacaauaacaugcagagcaucacaagacauaucaaacuaccuaaacugguaccaacaaaaaccaggaaaagcaccaaaacuacuaauauacuacacaucaagacuaagaucaggaguaccaucaagauucucaggaucaggaucaggaacagacuucacacuaacaauaucaucacuacaaccagaagacuucgcaacauacuacugccaacaaggacacacagcaccaccaacauucggacaaggaacaaaaguagaaauaaaa

SEQ ID NO: 51399 - RNA, 321 nt, Artificial Sequence
  derived and/or modified sequence opt6 from anti-OX40_LightChain
gacauacaaaugacacaaucaccaucaucacuaucagcaucaguaggagacagaguaacaauaacaugcagagcaucacaagacauaucaaacuacuuaaacugguaccaacaaaaaccaggaaaagcaccaaaacuacuaauauacuacacaucaagacuaagaucaggaguaccaucaagauucucaggaucaggaucaggaacagacuucacacuaacaauaucaucacuacaaccagaagacuucgcaacauacuacugccaacaaggagcaacacuaccaccaacauucggacaaggaacaaaaguagaaauaaaa

SEQ ID NO: 51400 - RNA, 321 nt, Artificial Sequence
  derived and/or modified sequence opt6 from anti-OX40_LightChain
gacauacaaaugacacaaucaccaucaucacuaucagcaucaguaggagacagaguaacaauaacaugcagagcaucacaagacauaucaaacuaccuaaacugguaccaacaaaaaccaggaaaagcaccaaaacuauuaauauacuacacaucaagacuaagaucaggaguaccauccagauucucaggaucaggaucaggaacagacuucacacuaacaauaucaucacuacaaccagaagacuucgcaacauacuacugccaacaaggacacgcacuaccaccaacauucggacaaggaacaaaaguagaaauaaaa

SEQ ID NO: 51401 - RNA, 321 nt, Artificial Sequence
  derived and/or modified sequence opt6 from anti-OX40_LightChain
gacauacaaaugacacaaucaccaucaucacuaucagcaucaguaggagacagaguaacaauaacaugcagagcaucacaagacauaucaaacuaccuaaacugguaccaacaaaaaccaggaaaagcaccaaaacuacuaauauacuacacaucaagacuaagaucaggaguaccaucaagauucucaggaucaggaucaggaacagacuucacacuaacaauaucaucacuacaaccagaagacuucgcaacauacuacugccaacaagcacacacauuaccaccaacauucggacaaggaacaaaaguagaaauaaaa

SEQ ID NO: 51402 - RNA, 321 nt, Artificial Sequence
  derived and/or modified sequence opt6 from anti-OX40_LightChain
gacauacaaaugacacaaucaccaucaucauuaucagcaucaguaggagacagaguaacaauaacaugcagagcaucacaagacauaucaaacuaccuaaacugguaccaacaaaaaccaggaaaagcaccaaaacuacuaauauacuacacaucaagacuaagaucaggaguaccaucaagauucucaggaucaggaucaggaacagacuucacacuaacaauaucaucacuacaaccagaagacuucgcaacauacuacugccaacaaggacacacacuagcaccaacauucggacaaggaacaaaaguagaaauaaaa

SEQ ID NO: 51403 - RNA, 321 nt, Artificial Sequence
  derived and/or modified sequence opt6 from anti-OX40_LightChain
gacauacaaaugacacaaucaccaucaucacuaucagcaucaguaggagacagaguaacaauaacaugcagagcaucacaagacauaucaaacuaccuaaacugguaccaacaaaaaccaggaaaagcaccaaaacuacuaauauacuacacaucaagacuaagaucaggaguaccaucaagauucucaggaucaggaucaggaacagacuucacacuaacaauaucaucacuacaaccagaagacuucgcaacauacuacugccaagcaggacacacacuaccaccaacauuuggacaaggaacaaaaguagaaauaaaa

SEQ ID NO: 51404 - RNA, 321 nt, Artificial Sequence
  derived and/or modified sequence opt6 from anti-OX40_LightChain
gacauacaaaugacacaaucaccaucaucacuaucagcaucaguaggagacagaguaacaauaacaugcagagcaucacaagacauaucaaacuaccuaaacugguaccaacaaaaaccaggaaaagcaccaaaauuacuaauauacuacacaucaaaacuacacucaggaguaccaucaagauucucaggaucaggaucaggaacagacuacacacuaacaauaucaucacuacaaccagaagacuucgcaacauacuacugccaacaaggaucagcacuaccauggacauucggacaaggaacaaaaguagaaauaaaa

SEQ ID NO: 51405 - RNA, 321 nt, Artificial Sequence
  derived and/or modified sequence opt6 from anti-OX40_LightChain
gacauacaaaugacacaaucaccaucaucacuaucagcaucaguaggagacagaguaacaauaacaugcagagcaucacaagacauaucaaacuaccuaaacugguaccaacaaaaaccaggaaaagcaguaaaacuacuaauauacuacacaucaaaacuacacucaggaguaccaucaagauucucaggaucaggaucaagaacagacuacacacuaacaauaucaucacuacaaccagaagacuucgcaacauacuacugccaacaaggaucagcacuaccauggacauucggacaaggaacaaaaguagaaauaaaa

SEQ ID NO: 51406 - RNA, 351 nt, Artificial Sequence
  derived and/or modified sequence opt6 from anti-OX40_HeavyChain
gaaguacaauuaguacaaagcggagcagaaguaaaaaaaccaggagcaagcguaaaaguaagcuguaaagcaagcggauacacauucacagacucauacaugagcuggguaagacaagcaccaggacaaggacuagaauggauaggagauauguauccagauaacggagacucaaguuauaaccaaaaauuuagagaaagaguaacaauaacaagagacacaagcacaagcacagcauaucuagaacuaucaagcuuaagaucagaagauacagcaguauauuacuguguauuagcaccaagaugguacuuuagcguauggggacaaggaacauuaguaacaguaucaagu

SEQ ID NO: 51407 - RNA, 351 nt, Artificial Sequence
  derived and/or modified sequence opt6 from anti-OX40_HeavyChain
gaaguacaauuaguacaaagcggagcagaaguaaaaaaaccaggagcaagcguaaaaguaagcuguaaagcaagcggauacacauucacagacucauacaugagcuggguaagacaagcaccaggacaaggacuagaauggauaggagauauguauccagauaacggagacucaaguuauaaucaaaaauuuagagaaagaguaacaauaacaguagacacaaguacaagcacagcauaucuagaacuaucaagcuuaagaucagaagauacagcaguauauuacuguguauuagcaccaagaugguacuuuaguguauggggacaaggaacauuaguaacaguaucaagc

SEQ ID NO: 51408 - RNA, 351 nt, Artificial Sequence
  derived and/or modified sequence opt6 from anti-OX40_HeavyChain
gaaguacaauuaguacaaagcggagcagaaguaaaaaaaccaggagcaagcguaaaaguaagcuguaaagcaagcggauacacauucacagacucauacaugagcuggguaagacaagcaccaggacaaggacuagaauggauaggagauauguauccagauaacggagacucaagcuauaaccaaaaauuuagagaaagaguaacauuaacaguagacacaagcacaagcacagcauaucuagaacuaucaagcuuaagaucagaagauacagcaguauauuacuguguauuagcaccaagaugguacuuuagcguauggggacaaggaacauuaguaacaguaucaagc

SEQ ID NO: 51409 - RNA, 351 nt, Artificial Sequence
  derived and/or modified sequence opt6 from anti-OX40_HeavyChain
gaaguacaacuaguacaaagcggagcagaaguaaaaaaaccaggagcaagcguaaaaguaagcuguaaagcaagcggauacacauucacagacgcauacaugagcuggguaagacaagcaccaggacaaggacuagaauggauaggagauauguauccagauaacggagacucaagcuauaaccaaaaauuuagagaaagaguaacaauaacaagagacacaaguacaaguacagcauaucuagaacuaucaagcuuaagaucagaagauacagcaguauauuacuguguauuagcaccaagaugguacuuuagcguauggggacaaggaacauuaguaacaguaucaagc

SEQ ID NO: 51410 - RNA, 351 nt, Artificial Sequence
  derived and/or modified sequence opt6 from anti-OX40_HeavyChain
gaaguacaauuaguacaaagcggagcagaaguaaaaaaaccaggagcaagcguaaaaguaagcuguaaagcaagcggauacacauucacagaaucauacaugagcuggguaagacaagcaccaggacaaggacuagaauggauaggagauauguauccagauaacggagacucaagcuauaaccaaaaauuuagagaaagaguaacaauaacaagagacacaagcacaagcacagcauaucuagaacuaucaagcuuaagaucagaagauacagcaguauauuacuguguauuagcaccaagaugguacuuuagcguauggggacaaggaacauuaguaacaguaucaagu

SEQ ID NO: 51411 - RNA, 351 nt, Artificial Sequence
  derived and/or modified sequence opt6 from anti-OX40_HeavyChain
gaaguacaauuaguacaaaguggagcagaaguaaaaaaaccaggagcaagcguaaaaguaagcuguaaagcaagcggauacacauucacagacucguacaugaguuggguaagacaagcaccaggacaaggacuagaauggauaggagauauguauccagauaacgcagacucgaguuauaaccaaaaauuuagagaaagaguaacaauaacaagagacacaagcacaaguacagcauaucuagaacuaucaagcuuaagaucagaagauacagcaguauauuacuguguauuagcaccaagaugguacuuuagcguauggggacaaggaacauuaguaacaguaucaagc

SEQ ID NO: 51412 - RNA, 351 nt, Artificial Sequence
  derived and/or modified sequence opt6 from anti-OX40_HeavyChain
gaaguacaauuaguacaaagcggagcagaaguaaaaaaaccaggagcaagcguaaaaguaagcuguaaagcaagcggauacacauucacagacucauacaugagcuggguaagacaagcaccaggacaaggacuagaauggauaggagauauguauccagauaacgcagacgcaaguuauaaccaaaaauuuagagaaagaguaacaauaacaagagacacaagcacaagcacagcauaucuagaacuaucaagccuaagaucagaagauacagcaguauauuacuguguauuagcaccaagaugguacuuuaguguauggggacaaggaacauuaguaacaguaucaagc

SEQ ID NO: 51413 - RNA, 351 nt, Artificial Sequence
  derived and/or modified sequence opt6 from anti-OX40_HeavyChain
gaaguacaauuaguacaaagcggagcagaaguaaaaaaaccaggagcaagcguaaaaguaagcuguaaagcaagcggauacacauucacagacucauacaugaguuggguaagacaagcaccaggacaaggauuagaauggauaggagauauguauccagauaacggagacgcaagcuauaaccaaaaauuuagagaaagaguaacaauaacaagagacacaagcacaagcacagcauaucuagaacuaucaagcuuaagaucagaagauacagcaguauauuacuguguauuagcaccaagaugguacuuuagcguauggggacaaggaacauuaguaacaguaucaagc

SEQ ID NO: 51414 - RNA, 351 nt, Artificial Sequence
  derived and/or modified sequence opt6 from anti-OX40_HeavyChain
gaaguacaauuaguacaaagcggagcagaaguaaaaaaaccaggagcaagcguaaaaguaagcuguaaagcaagcggauacacauucacagacucauacaugagcuggguaagacaagcaccaggacaaggauuagaauggauaggagauauguauccagauagcggagacucaagcuauaaccaaaaauuuagagaaagaguaacaauaacaagagacacaagcacaagcacagcauaucuagaacuaucaagcuugagaucagaagauacagcaguauauuacuguguauuagcaccaagaugguacuuuagcguauggggacaaggaacauuaguaacaguaucaagc

SEQ ID NO: 51415 - RNA, 351 nt, Artificial Sequence
  derived and/or modified sequence opt6 from anti-OX40_HeavyChain
gaaguacaauuaguacaaagcggagcagaaguaaaaaaaccaggagcaagcguaaaaguaagcuguaaagcaagcggauacacauucacagacucauacaugagcuggguaagacaagcaccaggacaaggacuagaauggauaggagauauguauccagauaacggaagcucaagcuauaaccaaaaauuuagagaaagaguaacaauaacaagggacacaagcacaagcacagcauauuuagaacuaucaagcuuaagaucagaagauacagcaguauauuacuguguauuagcaccaagaugguacuuuagcguauggggacaaggaacauuaguaacaguaucaagc

SEQ ID NO: 51416 - RNA, 351 nt, Artificial Sequence
  derived and/or modified sequence opt6 from anti-OX40_HeavyChain
gaaguacaauuaguacaaagcggagcagaaguaaaaaaaccaggagcaagcguaaaaguaagcuguaaagcaagcggauacacauucacagacgcauacaugagcuggguaagacaagcaccaggacaaggacuagaauggauaggagauauguauccagauaacgcagacgcaagcuauaaccaaaaauuuagagaaagaguaacaauaacaagagacacaagcacaagcacagcauaucuagaacuaucaagcuuaagaucagaagauacagcaguauauuacuguguauuagcaccaagaugguacuuuagcguauggggacaaggaacauuaguaacaguaucaagc

SEQ ID NO: 51417 - RNA, 351 nt, Artificial Sequence
  derived and/or modified sequence opt6 from anti-OX40_HeavyChain
gaaguacaauuaguacaaagcggagcagaaguaaaaaaaccaggagcaagcguaaaaguaagcuguaaagcaagcggauacacauucacagacucauacaugagcuggguaagacaagcaccaggacaaggacuagaauggauaggagauauguauccagauaacggagacucaagcuauaaccaaaaauuuagagaaagaguaacaauaacaagagacacaaguacaagcacagcauaucuagaacuaucaagcuuaagaucagaagauacagcaguauauuacuguguauuagcaccaagaugguacuuuagcgcauggggacaaggaacauuaguaacaguaucaagu

SEQ ID NO: 51418 - RNA, 351 nt, Artificial Sequence
  derived and/or modified sequence opt6 from anti-OX40_HeavyChain
gaaguacaauuaguacaaagcggagcagaaguaaaaaaaccaggagcaagcguaaaaguaagcuguaaagcaagcggauacacauuuacagacucauacaugagcuggguaagacaagcaccaggacaaggacuagaauggauaggagauauguauccagauaacggagacucaagcuauaaucaaaaauuuagagaaagaguaacaauaacaagagacacaagcacaagcacagcauaucuagaacuaaguaguuuaagaucagaagauacagcaguauauuacuguguauuagcaccaagaugguauuuugcaguauggggacaaggaacauuaguaacaguaucaagu

SEQ ID NO: 51419 - RNA, 351 nt, Artificial Sequence
  derived and/or modified sequence opt6 from anti-OX40_HeavyChain
gaaguacaacuaguacaaucaggagcagaaguaaaaaaaccaggagcaucaguaaaaguaucaugcaaagcaucaggauacacauucacagacucauacaugucauggguaagacaagcaccaggacaaggacuagaauggauaggagacauguacccagacaacggagacucaucauacaaccaaaaauucagagaaagaguaacaauaacaagagacacaucaacaucaacagcauacuuagaacuaucaucacuaagaucagaagacacagcaguauacuacugcgcacuagcaccaagaugguacuucucaguauggggacaaggaacacuaguaacaguaucauca

SEQ ID NO: 51420 - RNA, 351 nt, Artificial Sequence
  derived and/or modified sequence opt6 from anti-OX40_HeavyChain
gaaguacaauuaguacaaagcggagcagaaguaaaaaaaccaggagcaagcguaaaaguaagcuguaaagcaagcggauacacauucacagacucauacaugagcuggguaagacaagcaccaggacaaggacuagaauggauaggagauauguauccagauaacggagauucaagcuauaaccaaaaauuuagagaaagaguaacaauaacaagagacacaagcacaagcacagcauauuuagaacuaucaagcuuaagaucagaagauacagcaguauauuacuguguagcagcaccaagaugguacuuuagcguauggggacaaggaacauuaguaacaguaucaagu

SEQ ID NO: 51421 - RNA, 354 nt, Artificial Sequence
  derived and/or modified sequence opt6 from anti-OX40_HeavyChain
gaaguacaauuaguagaaaguggaggaggauuaguacaaccaggagggaguuuaagauuaaguugugcagcaaguggauuuacauuuucaaguuauaguaugaauuggguaagacaagcaccaggaaaaggauuagaauggguaaguuauauaaguaguaguaguucaacaauagauuaugcagauaguguaaaaggaagauuuacaauaagcagagauaaugcaaaaaauaguuuauauuuacaaaugaauaguuuaagagaugaagauacagcaguauauuauugugcaagagaaaguggaugguauuuauuugauuauuggggacaaggaacauuaguaacaguaaguagu

SEQ ID NO: 51422 - RNA, 363 nt, Artificial Sequence
  derived and/or modified sequence opt6 from anti-OX40_HeavyChain
caaguacaacuacaagaaucaggaccaggacuaguaaaaccaucacaaacacuaucacuaacaugcgcaguauacggaggaucauucucaucaggauacuggaacuggauaagacaacacccaggaaaaggacuagaauggauaggauacauaucauacaacggaauaacauaccacaacccaucacuaaaaucaagaauaacaauaaacccagacacaucaaaaaaccaauucucacuacaacuaaacucaguaacaccagaagacacagcaguauacuacugcgcaagauacagauacgacuacgacggaggacacgcaauggacuacuggggacaaggaacacuaguaacaguaucauca

SEQ ID NO: 51423 - RNA, 363 nt, Artificial Sequence
  derived and/or modified sequence opt6 from anti-OX40_HeavyChain
caaguacaacuacaagaaucaggaccaggacuaguaaaaccaagucaaacacuaucacuaacaugcgcaguauacggaggaucauucucaucaggauacuggaacuggauaagaaaacacccaggaaaaggacuagaauggauaggauacauaucauacaacggaauaacauaccacaacccaucacuaaaaucaagaauaacaauaaacagagacacaucaaaaaaccaauucucacuacaacuaaacucaguaacaccagaagacacagcaguauacuacugcgcaagauacagauacgacuacgacggaggacacgcaauggacuacuggggacaaggaacacuaguaacaguaucauca

SEQ ID NO: 51424 - RNA, 363 nt, Artificial Sequence
  derived and/or modified sequence opt6 from anti-OX40_HeavyChain
caaguacaacuacaagaaucaggaccaggacuaguaaaaccaucacaaacacuaucacuaacaugcgcaguauacggagacucauucucaucaggauacuggaacuggauaagaaaacacccaggaaaaggacuagaauacaugggauacauaucauacaacggaauaacauaccacaacccaucacuaaaaucaagaauaacaauaaacagagacacaucaaaaaaccaauacucacuacaacuaaacucaguaacaccagaagacacagcaguauacuucugcgcaagauacagauacgacuacgacggaggacacgcaauggacuacuggggacaaggaacacuaguaacaguaucauca

SEQ ID NO: 51425 - RNA, 363 nt, Artificial Sequence
  derived and/or modified sequence opt6 from anti-OX40_HeavyChain
caaguacaacuacaagaaucaggaccaggacuaguaaaaccaucacaaacacuaucacuaacaugcgcaguauacggagacucauucucaucaggauacuggaacuggauaagaaaacacccaggaaaaggacuagaauacauaggauacauaucauacaacggaauaacauaccacaacccaucacuaaaaucaagaauaacaauaaacagagacacaucaaaaaaccaauacucacuacaacuaaacucaguaacaccagaagacacagcaguauacuucugcgcaagauacagauacgacuacgacggaggacacgcaauggacuacuggggacaaggaacacuaguaacaguaucauca

SEQ ID NO: 51426 - RNA, 363 nt, Artificial Sequence
  derived and/or modified sequence opt6 from anti-OX40_HeavyChain
caaguacaacuacaagaaucaggaccaggacuaguaaaaccaucacaaacacuaucacuaacaugcgcaguauacggagacagcuucucaucaggauacuggaacuggauaagaaaacacccaggaaaaggacuagaauacauaggauacauaucauacaacggaauaacauaccacaacccaucacuaaaaucaagaauaacaauaaacagagacacaucaaaaaaccaauucucacuacaacuaaacucaguaacaccagaagacacagcaguauacuucugcgcaagauacagauacgacuacgacggaggacacgcaauggacuacuggggacaaggaacacuaguaacaguaucauca

SEQ ID NO: 51427 - RNA, 363 nt, Artificial Sequence
  derived and/or modified sequence opt6 from anti-OX40_HeavyChain
caaguacaacuacaagaaucaggaccaggacuaguaaaaccaucacaaacacuaucacuaacaugcgcaguauacggagacucauucucaucaggauacuggaacuggauaagaaaacacccaggaaaaggauuagaauacauaggauacauaucauacaacggaauaacauaccacaacccaucacuaaaaucaagaauaacaauaaacagagacacaucaaaaaaccaauacucacuacaauuaaauucaguaacaccagaagacacagcaguauacuacugcgcaagauacagauacgacuacgacggaggacacgcaauggacuacuggggacaaggaacauuaguaacaguaucauca

SEQ ID NO: 51428 - RNA, 363 nt, Artificial Sequence
  derived and/or modified sequence opt6 from anti-OX40_HeavyChain
caaguacaacuacaagaaucaggaccaggauuaguaaaaccaucacaaacacuaucacuaacaugcgcaguauacggagacucauucucaucaggauacuggaacuggauaagaaaacacccaggaaaaggacuagaauacauaggauacauaucauacaacggaauaacauaccacaacccaucacuaaaaucaagaauaacaauaaacagagacacaagcaaaaaccaauucucacuacaacuaaacucaguaacaccagaagacacagcaguauacuacugcgcaagauacagauacgacuacgacggaggacacgcaauggacuacuggggacaaggaacauuaguaacaguaucauca

SEQ ID NO: 51429 - RNA, 363 nt, Artificial Sequence
  derived and/or modified sequence opt6 from anti-OX40_HeavyChain
caaguacaacuacaagaaucaggaccaggacuaguaaaaccaucacaaacacuaucacuaacaugcgcaguauacggaggaucauucagcucaggauacuggaacuggauaagaaaacacccaggaaaaggauuagaauacauaggauacauaucauacaacggaauaacauaccacaacccaucacuaaaaucaagaauaacaauaaacccagacacaucaaaaaaccaauacucacuacaacuaaacucaguaacaccagaagacacagcaguauacuucugcgcaagauacagauacgacuacgacggaggacacgcaauggacuacuggggacaaggaacacuaguaacaguaucauca

SEQ ID NO: 51430 - RNA, 363 nt, Artificial Sequence
  derived and/or modified sequence opt6 from anti-OX40_HeavyChain
caaguacaacuacaagaaucaggaccaggacuaguaaaaccaagccaaacacuaucacuaacaugcgcaguauacggaggaucauucucaucaggauacuggaacuggauaagaaaacacccaggaaaaggacuagaauacauaggauacauaucauacaacggaauaacauaccacaacccaucacuaaaaucaagaauaacaauaaacagagacacaucaaaaaaccaauacucacuacaacuaaacucaguaacaccagaagacacagcaguauacuucugcgcaagauacagauacgacuacgacggaggacacgcaauggacuacuggggacaaggaacacuaguaacaguaucauca

SEQ ID NO: 51431 - RNA, 363 nt, Artificial Sequence
  derived and/or modified sequence opt6 from anti-OX40_HeavyChain
caaguacaacuacaagaaucaggaccaggacuaguaaaaccaucacaaacacuaucacuaacaugcgcaguauacggcggaucauucucaucaggauacuggaacuggauaagaaaacacccaggaaaaggacuagaauacauaggauacauaucauacaacggaauaacauaccacaacccaucacuaaaaucaagaauaacaauaaacagagacacaucaaaaaaccaauacucacuacaacuaaacucaguaacaccagaagacacagcaguauacuacugcgcaagauacagauacgacuacgacggaggacacgcaauggacuacuggggacaaggaacacuaguaacaguaucauca

SEQ ID NO: 51432 - RNA, 363 nt, Artificial Sequence
  derived and/or modified sequence opt6 from anti-OX40_HeavyChain
caaguacaacuacaagaaucaggaccaggacuaguaaaaccaucacaaacacuaucacuaacaugcgcaguauacggaggaucauucucaucaggauacuggaacuggauaagaaaacacccaggaaaaggacuagaauacauaggauacauaucauacaacggaauaacauaccacaacccaucacuaaaaagcagaauaacaauaaacccagacacaucaaaaaaccaauacucacuacaacuaaacucaguaacaccagaagacacagcaguauacuacugcgcaagauacagauacgacuacgacggaggacacgcaauggacuacuggggacaaggaacacuaguaacaguaucauca

SEQ ID NO: 51433 - RNA, 363 nt, Artificial Sequence
  derived and/or modified sequence opt6 from anti-OX40_HeavyChain
caaguacaacuacaagaaucaggaccaggacuaguaaaaccaucacaaacacuaucauuaacaugcgcaguauacggaggaucauucucaucaggauacuggaacuggauaagaaaacacccaggaaaaggacuagaauacauaggauacauaucauacaacgcaauaacauaccacaacccaucacuaaaaucaagaauaacaauaaacagagacacaucaaaaaaccaauacucacuacaacuaaacucaguaacaccagaagacacagcaguauacuacugcgcaagauacaaauacgacuacgacgcaggacacgcaauggacuacuggggacaaggaacacuaguaacaguaucauca

SEQ ID NO: 51434 - RNA, 363 nt, Artificial Sequence
  derived and/or modified sequence opt6 from anti-OX40_HeavyChain
caaguacaacuacaagaaucaggaccaggccuaguaaaaccaucacaaacacuaucacuaacaugcgcaguauacggaggaucauucucaucaggauacuggaacuggauaagaaaacacccaggaaaaggacuagaauacauaggauacauaucauacaacgcaauaacauaccacaacccaucacuaaaaucaagaauaacaauaaacagagacacaagcaaaaaccaauacucacuacaacuaaacucaguaacaccagaagacacagcaguauacuacugcgcaagauacagauacgacuacgacggaggacacgcaauggacuacuggggacaaggaacauuaguaacaguaucauca

SEQ ID NO: 51435 - RNA, 363 nt, Artificial Sequence
  derived and/or modified sequence opt6 from anti-OX40_HeavyChain
caaguacaacuacaagaaucaggaccaggacuaguaaaaccaucacaaacacuaucacuaacaugcgcaguauacggaggaucauucucaucaggauacuggaacuggauaagaaaacacccaggaaaaggacuagaauacauaggauacauaucauacaacggaauaacauaccacaacccaucacuaaaaucaagaauaacaauaaacagagacacaucaaaaaaccaauacucacuacaacuaaacucaguaacaccagaagacacagcaguauacuacugcgcaagauacaaauacgacuacgacggaggacacgcaauggacuacuggggacaaggaacacuaguaacaguaucauca

SEQ ID NO: 51436 - RNA, 363 nt, Artificial Sequence
  derived and/or modified sequence opt6 from anti-OX40_HeavyChain
caaguacaacuacaagaaucaggaccaggacuaguaaaaccaucacaaacacuaucacuaacaugcgcaguauacggaggaucauucucaucaggauacuggaacuggauaagaaaacacccaggaaaaggacuagaauacauaggauacauaucauacucaggaauaacauaccacaacccaucacuaaaaucaagaauaacaauaaacagagacacaucaaaaaaccaauacucacuacaacuaaacucaguaacaccagaagacacagcaguauacuacugcgcaagauacagauacgacuacgacggaggacacgcaauggacuacuggggacaaggaacacuaguaacaguaucauca

SEQ ID NO: 51437 - RNA, 363 nt, Artificial Sequence
  derived and/or modified sequence opt6 from anti-OX40_HeavyChain
caaguacaacuacaagaaucaggaccaggacuaguaaaaccaucacaaacacuaucacuaacaugcgcaguauacggaggaucauucucaucaggauacuggaacuggauaagaaaacacccaggaaaaggacuagaauacauaggauacauaucauacagcggaauaacauaccacaacccaagccuaaaaucaagaauaacaauaaacagagacacaucaaaaaaccaauacucacuacaacuaaacucaguaacaccagaagacacagcaguauacuacugcgcaagauacaaauacgacuacgacggaggacacgcaauggacuacuggggacaaggaacacuaguaacaguaucauca

SEQ ID NO: 51438 - RNA, 363 nt, Artificial Sequence
  derived and/or modified sequence opt6 from anti-OX40_HeavyChain
gaaguacaacuacaagaaucaggaccaucauuaguaaaaccaucacaaacacuaucacuaacaugcucaguaacaggagacucauucacaucaggauacuggaacuggauaagaaaauucccaggaaacagacuagaauacaugggauacauaucauacaacgcaauaacauaccacaacccaucacuaaaaucaagaauaucaauaacaagagacacaucaaaaaaccacuacuaccuacaacuaaacucaguaacaacagaagacacagcaacauacuucugcgcaagauacagauacgacuacgacggaggacacgcaauggacuacuggggacaaggaacacuaguaacaguuucauca

SEQ ID NO: 51439 - RNA, 363 nt, Artificial Sequence
  derived and/or modified sequence opt6 from anti-OX40_HeavyChain
caaguacaauuacaagaaucaggaccaggacuaguaaaaccaucacaaacacuaucacuaacaugcgcaguauacggaggaucauucucaucaggauacuggaauuggauaagaaaacacccaggaaaaggacuagaauacauaggauacauaucauacaacgcaauaacauaccacaacccaucacuaaaaucaagaauaacaauaaacagagacacaucaaaaaaccaauacucacuacaacuaaacucaguaacaccagaagacacagcaguauacuacugcgcaagauacaaauacgacuacgacggaggacacgcaauggacuacuggggacaaggaacacuaguaacaguaucauca

SEQ ID NO: 51440 - RNA, 372 nt, Artificial Sequence
  derived and/or modified sequence opt6 from anti-OX40_HeavyChain
gaaguacaauuaguagaaaguggaggaggauuaguacaaccaggaagaaguuuaagauuaaguugugcagcaaguggauuuacauuugaugauuaugcaaugcauuggguaagacaagcaccaggaaaaggauuagaauggguaagcggaauaaguuggaauaguggaaguauaggauaugcagauaguguaaaaggaagauuuacaauaaguagagauaaugcaaaaaauagcuuauauuuacaaaugaauaguuuaagggcagaagauacagcauuauauuauugugcaaaagaucaaaguacagcagauuauuauuuuuauuauggaauggauguauggggacaaggaacaacaguaacaguaaguagu

SEQ ID NO: 51441 - RNA, 381 nt, Artificial Sequence
  derived and/or modified sequence opt6 from anti-OX40_LightChain
auggaaacaccagcacaacuacuauuucuacuacuauuaugguuaccagauacaacaggagaaauaguacuaacacaaucaccaggaacauuaaguuuaagcccaggagaaagagcaauauuaagcuguagagcaagucaaagcguaaguucaaguuuucuagcaugguaucaacaaaaaccaggacaagcaccaagauuacuaauauacggagcauuuagcagagcaacaggaauaccagauagauuuagcggaagcggaaguggaacagauuucacacuaacaauaucaagauuagaaccagaagauuucgcaguauauuacugucaacaauacgauaguucaagaacauucggacaaggaacaaaaguagaaauaaaa

SEQ ID NO: 51442 - RNA, 381 nt, Artificial Sequence
  derived and/or modified sequence opt6 from anti-OX40_LightChain
auggaagcaccagcacaacuacuauuucuacuacuacuaugguuaccagacacaacaggagaaauaguacuaacacaaucaccagcaacacuaucacuaucaccaggagaaagagcaacacuaucaugcagagcaucacaaggaguaucaucauaucuagcaugguaccaacaaaaaccaggacaagcaccaagacuacuaauauacgacgcaucaaacagagcaacaggaauaccagcaagauucucaggaucaggaccaggaacagacuuuacacuaacaauaaguucauuagaaccagaagacuucgcaguauacuacugccaacaaagaucaaacuggcacccaacauucggacaaggaacaaaaguagaaauaaaa

SEQ ID NO: 51443 - RNA, 381 nt, Artificial Sequence
  derived and/or modified sequence opt6 from anti-OX40_LightChain
auggaagcaccagcacaacuacuauucuuacuacuacuaugguuaccagacacaacaggagaaauaguacuaacacaaucaccagcaacacuaucauuaucaccaggagaaagagcaacacuaucaugcagagcaucacaaucaguaucaucauaccuagcaugguaccaacaaaaacccggacaagcaccaagacuacuaauauacgacgcaucaaacagagcaacaggaauaccagcaagauucucaggaucaggaucaggaacagacuucacacuaacaauauccucacuagaacccgaagacuucgcaguauacuacugccaacaaagaucaaacuggccaauaacauucggacaaggaaccagacuagaaauaaaa

SEQ ID NO: 51444 - RNA, 387 nt, Artificial Sequence
  derived and/or modified sequence opt6 from anti-OX40_LightChain
auggaaacaccagcacaauuacuauuucuacuacuauuauggcuaccagacacaacaggagaaauaguacuaacacaaucaccaggaacacuaucauuaucaccaggagaaagagcaacauuaucaugcagagcaucacaaucaguaucaucaucauaccuagcaugguaucaacaaaaaccaggacaagcaccaagacuacuaauauacggagcaucaucaagagccacaggaauaccagacagauucucaggaucaggaucaggaacagauuucacauuaacaauaucaagacuagaaccagaagacuucgccguauauuacugucaacaauacgacucaucacuaacauucggaggaggaacaaaaguagaaauaaaacgaaca

SEQ ID NO: 51445 - RNA, 390 nt, Artificial Sequence
  derived and/or modified sequence opt6 from anti-OX40_LightChain
auggacaugagaguacuagcacaacuacuaggacuacuacuacuaugcuucccaggagcaagaugcgacauacaaaugacacaaucaccaucaucacuaucagcaucaguaggaaacagaguaacaauaacaugcagagcaucacaagacauaucaucauggcuagcaugguaccaacaaaaaccagaaaaagcaccaaaaucacuaauauacgcagcaucaucacuacaaucaggaguaccaucaagauucucaggaucaggaucaggaacagacuucacauuaacaauaucaucauuacaaccagaagacuucgccacauacuacugccaacaauacaacucauacccacuaacauucggacaaggaacaagacuagaaauaaaaaga

SEQ ID NO: 51446 - RNA, 408 nt, Artificial Sequence
  derived and/or modified sequence opt6 from anti-OX40_HeavyChain
auggacacacuaugcucaacacuauuacuauuaacaauaccaucauggguacuaucacaaauaacacuaaaagaaucaggaccaacacuaguaaaaccaacacaaacauuaacacuaucaugcacauucucaggauucucacuaucaacaucaggaguaggaguaggauggauaagacaaccaccaggaaaagcacuagaauggcuagcacuaauacacugggacgacgcagaaagauacucaccaucacuaaaaucaagacuaacaauaacaaaagacacaucaaaaaaccaaguaguacuuacaaugacaaacauggaccuaguagacacagcaacauacuacugcgcacacacaagaggagcauucgacauauggggacaaggaacaaugguaacaguaucauca

SEQ ID NO: 51447 - RNA, 408 nt, Artificial Sequence
  derived and/or modified sequence opt6 from anti-OX40_HeavyChain
auggacacacuaugcucaacacuacuacuauuaacaauaccaucauggguacuaucacaaauaacacuaaaagaaucaggaccaacacuaguaaaaccaacacaaacacuaacacuaacaugcacauucucaggauucucauuaucaacaucaggaguaggaguaggauggauaagacaaccaccaggaaaagcauuagaauggcuagcauuaauauacugggaugaccacucaccauacucaccaucacuaaaaucaagacuaacaauaacaaaagacacaucaaaaaaucaaguaguacuaacaaugacaaacauggacccaguagacacagcaacauauuacugcgcaagaacaagaggagcauucgacauauggggacaaggaacaaugguaacaguaucauca

SEQ ID NO: 51448 - RNA, 420 nt, Artificial Sequence
  derived and/or modified sequence opt6 from anti-OX40_HeavyChain
auggaauggggaccauguuggguauuuuuaguaguaauauuagaaggaguacaauguggaguacaauuaguagaaagcggaggaggauuaguacaaccaggaggaaguuuaagauuaaguugugcagcaaguggauuuacauuuaguaguuauaguaugaauuggguaagacaagcaccaggaaaaggauuagaauggguaaguuauauaaguaguagcaguaguacaauauauuaugcagauaguguaaaaggaagauuuacaauaaguagagauaaugcaaaaaauaguuuauauuuacaaaugaauaguuuaagagaugaagauacagcaguauauuauugugcaagaggaguauaucauaauggauggaguuuuuuugauuauuggggacaaggaacauuauuaacaguaaguagu

SEQ ID NO: 51449 - RNA, 423 nt, Artificial Sequence
  derived and/or modified sequence opt6 from anti-OX40_HeavyChain
auggacacacuaugcucaacacuacuacuacuaacaauaccaucauggguauuaucacaaauaacacuaaaagaaucaggaccaacauuaguaaaaccaaaacaaacacuaacacuaacaugcacauucucaggauucucacuaucaacaucaggaaugggaguaggauggauaagacaaccaccaggaaaagcacuagaauggcuagcaguaauauacugggacgaccaccaauuauacucaccaucacuaaaaucaagacuaacaauaacaaaagacacaagcaaaaaccaaguaguacuaacaaugacaaacauggacccaguagacacagcaacauacuacugcgcacacagaagaggagcauuccaacacuggggacaaggaacauuagucacaguaucaucagcaucaacaaaagga

SEQ ID NO: 51450 - RNA, 462 nt, Artificial Sequence
  derived and/or modified sequence opt6 from anti-OX40_HeavyChain
augacaaugauaacgccaucacuaguaccaucaagcgauccauuaguaacagcagcaagcguacuagaauucgcacuauuaauaagacuaacaauaggacaagcaguaguaagcacacaaucaacaggaggaggauuaguacaaccaggaagaagcuuaagauuaagcugugcagcaagcggguucacacuagaugacuauggaaugcacuggguaagacaagcaccaggaaaaggacuagaauggguaagcggaauaucauggaauagcgauagcauaggauauguagauagcguaaaaggaagauuuacaauaagcagagacaaugcaaaaaacucacuauaucuacaaaugaauagcuuaagaguagaagauacagcacuauauuacuguguaaaagacauaagcggaugguauagcuuugacuauuggggacaaggaacauuaguaacaguaucaagc

SEQ ID NO: 51451 - RNA, 639 nt, Artificial Sequence
  derived and/or modified sequence opt6 from anti-OX40_LightChain
gaaauaguaguaacccaaucaccagcaacacuaucacuaucaccaggagaaagagcaacacuaucaugcagagcaucacaaucaguaucaucauaccuagcaugguaccaacaaaaaccaggacaagcaccaagacuacuaauauacgacgcaucaaauagagccaccggcaucccagcacgauucucaggauccggauccggaacagacuucacauuaacaauaucauccuuagaaccagaagacuucgcaguauacuacugccaacaaagaucaaacuggccaacauucggacaaggaacuaaaguagaaauaaaaagaacaguagcagcaccauccguauucauauucccaccaucagacgaacaauuaaaaucaggaacagcauccguaguaugccuacuaaacaacuuuuacccaagagaagcaaaaguacaauggaaaguagacaacgcacuacaauccggaaacucacaagaaucaguaaccgaacaagacucaaaagacuccacauacucacuaucuucaacacuaacacuaucuaaagcagacuacgaaaaacacaaaguauacgcaugcgaaguuacacaccaaggccuaucaucacccguaacaaaaucauucaacagaggagaaugc

SEQ ID NO: 51452 - RNA, 1350 nt, Artificial Sequence
  derived and/or modified sequence opt6 from anti-OX40_HeavyChain
gaaguacaauuaguagaaucaggaggaggucuaguacaaccaggaagaucacuaagacuaucuugcgcagccucaggauuuacauuugaugacuacgcuaugcacuggguccgacaagcaccuggaaaaggucuagaauggguaucaggaauaucuuggaauaguggaucaauaggauacgcagacucaguaaagggaagauuuacaauaagccgagacaaugcuaaaaauaguuuauacuuacaaaugaauaguuuaagagcagaagauacagcauuauacuauugcgcuaaagaucaaucaacugcagauuauuauuuuuacuacggaauggauguauggggacaagguacaacuguaacaguuucaucagcaucaacuaaagguccaucaguauucccauuagcaccuugcucaagaucaacauccgaaucaacagcagcacuaggaugccuaguuaaagacuauuuuccagaaccaguaacagugaguuggaacucaggagcacuaacaagcggaguacauacauuuccagcaguauuacaaucuucuggacuauauagcuuaucaucaguaguaacaguaccgucaucaaacuuugguacacaaacuuauacaugcaacguagaucauaaaccaucaaauacaaaagucgacaaaacaguagaaagaaaaugcuguguagaguguccaccaugucccgcaccaccuguagcagguccaaguguauucuuauucccuccaaaaccuaaagacacauuaaugauaucacguacaccagaagucacuugcguaguaguagacguuucacacgaagauccugaaguacaauucaacugguauguagauggaguagaaguucacaaugccaaaacaaaaccccgagaagaacaauuuaacucaacauuuagaguaguaucaguccuaaccguuguacaccaagacuggcuaaauggaaaagaauauaaaugcaaaguaucaaacaaaggauuacccgcuccaauugagaaaacaauaucaaaaacaaaaggacaaccaagagaaccucaaguauacacacuuccaccaucaagagaagaaaugacuaaaaaccaaguaucgcuaacaugucuugucaaaggcuuuuauccaucagacaucgcaguagaaugggaaucaaauggacaaccagaaaacaauuacaagacaacaccaccaauguuagacucagacggcucuuucuuucuauacucaaaacuaacaguagauaaaaguagauggcaacaaggaaacguauuuucuugcucaguaaugcacgaagcauuacacaaucacuauacacaaaaaucucuuucacucagcccaggaaaa

SEQ ID NO: 51453 - RNA, 21 nt, Artificial Sequence
  derived and/or modified sequence opt6 from anti-HIV_VRC01_VRC02_NIH45-46_LightChain_CDR
ugccagcaauaugaauuuuuc

SEQ ID NO: 51454 - RNA, 42 nt, Artificial Sequence
  derived and/or modified sequence opt6 from anti-HIV_VRC01_HeavyChain_CDR
acaagagggaaaaauugcgauuacaauugggauuucgagcac

SEQ ID NO: 51455 - RNA, 21 nt, Artificial Sequence
  derived and/or modified sequence opt6 from anti-HIV_3BNC60_LightChain_CDR
ugucagguguaugaguuuaua

SEQ ID NO: 51456 - RNA, 36 nt, Artificial Sequence
  derived and/or modified sequence opt6 from anti-HIV_3BNC60_HeavyChain_CDR
gcaagacagagaagugacuuuugggauuuugaugua

SEQ ID NO: 51457 - RNA, 36 nt, Artificial Sequence
  derived and/or modified sequence opt6 from anti-HIV_5H/I1-BMV-D5_HeavyChain_CDR
gcaagagauaacccaacauuacucggaagcgauuac

SEQ ID NO: 51458 - RNA, 33 nt, Artificial Sequence
  derived and/or modified sequence opt6 from anti-HIV_8ANC195_LightChain_CDR
ugucaacaauacgacacauauccaggcacauuu

SEQ ID NO: 51459 - RNA, 33 nt, Artificial Sequence
  derived and/or modified sequence opt6 from anti-HIV_CH01_CH02_CH03_LightChain_CDR
ugucaacaauacggcggaaguccauauacauuu

SEQ ID NO: 51460 - RNA, 78 nt, Artificial Sequence
  derived and/or modified sequence opt6 from anti-HIV_CH01_HeavyChain_CDR
gcaagaggaacagauuacacaauagaugacgcaggaauacacuaucaaggaagcggaacauuuugguauuucgaucua

SEQ ID NO: 51461 - RNA, 78 nt, Artificial Sequence
  derived and/or modified sequence opt6 from anti-HIV_CH02_HeavyChain_CDR
gcaagaggaacagauuacacaauagaugaccaaggaagauucuaucaaggaagcggaacauuuugguauuuugauuuu

SEQ ID NO: 51462 - RNA, 78 nt, Artificial Sequence
  derived and/or modified sequence opt6 from anti-HIV_CH03_HeavyChain_CDR
gcaagaggaacagauuacacaauagaugaccaaggaauauucuauaaaggaagcggaacauuuugguauuucgaucua

SEQ ID NO: 51463 - RNA, 33 nt, Artificial Sequence
  derived and/or modified sequence opt6 from anti-HIV_CH04_LightChain_CDR
ugucaacaauacggcagaucuccauauacauuu

SEQ ID NO: 51464 - RNA, 78 nt, Artificial Sequence
  derived and/or modified sequence opt6 from anti-HIV_CH04_HeavyChain_CDR
gcaagaggaacagauuacacaauagaugaccaaggaauaagauaucaaggaagcggaacauuuugguauuucgaugua

SEQ ID NO: 51465 - RNA, 54 nt, Artificial Sequence
  derived and/or modified sequence opt6 from anti-HIV_NIH45-46_HeavyChain_CDR
acaagaggaaaauacugcacagcaagagacuauuauaacugggacuuugaacau

SEQ ID NO: 51466 - RNA, 90 nt, Artificial Sequence
  derived and/or modified sequence opt6 from anti-HIV_PG16_HeavyChain_CDR
gcaagagaagcaggaggaccaauauggcaugaugacguaaaauauuacgauuuuaaugacggauacuauaauuaucauuauauggaugua

SEQ ID NO: 51467 - RNA, 36 nt, Artificial Sequence
  derived and/or modified sequence opt6 from anti-HIV_PGT122_LightChain_CDR
cauauaugggauagcagaagaccgacaaauugggua

SEQ ID NO: 51468 - RNA, 72 nt, Artificial Sequence
  derived and/or modified sequence opt6 from anti-HIV_PGT122_HeavyChain_CDR
acuaaacauggacguagaauuuacgguguaguugcauuuaaagaaugguuuacauauuucuauauggaugua

SEQ ID NO: 51469 - RNA, 36 nt, Artificial Sequence
  derived and/or modified sequence opt6 from anti-HIV_PGT123_LightChain_CDR
cauauauaugacgcuagagguggaacuaauugggua

SEQ ID NO: 51470 - RNA, 72 nt, Artificial Sequence
  derived and/or modified sequence opt6 from anti-HIV_PGT123_HeavyChain_CDR
gcucuacauggaaaaagaauuuacgguauaguugcauuaggagaacuauuuacauauuucuauauggaugua

SEQ ID NO: 51471 - RNA, 30 nt, Artificial Sequence
  derived and/or modified sequence opt6 from anti-HIV_PGT125_PGT128_LightChain_CDR
gggaguuugguggggaauugggaugugaua

SEQ ID NO: 51472 - RNA, 57 nt, Artificial Sequence
  derived and/or modified sequence opt6 from anti-HIV_PGT125_HeavyChain_CDR
uuugauggagaaguauuaguauauaaucauuggccuaaaccugcauggguagauuua

SEQ ID NO: 51473 - RNA, 30 nt, Artificial Sequence
  derived and/or modified sequence opt6 from anti-HIV_PGT126_PGT127_LightChain_CDR
aguucguuaguggguaauugggauguuaua

SEQ ID NO: 51474 - RNA, 57 nt, Artificial Sequence
  derived and/or modified sequence opt6 from anti-HIV_PGT126_HeavyChain_CDR
uuugauggagaaguauuaguauaucaugauuggccuaaaccugcauggguagauuua

SEQ ID NO: 51475 - RNA, 57 nt, Artificial Sequence
  derived and/or modified sequence opt6 from anti-HIV_PGT127_HeavyChain_CDR
uuugguggagaaguauuaguauauagagauuggccuaaaccugcauggguagauuua

SEQ ID NO: 51476 - RNA, 57 nt, Artificial Sequence
  derived and/or modified sequence opt6 from anti-HIV_PGT128_HeavyChain_CDR
uucgguggagaaguauuaagauauacagauuggccuaaaccugcauggguagauuua

SEQ ID NO: 51477 - RNA, 30 nt, Artificial Sequence
  derived and/or modified sequence opt6 from anti-HIV_PGT130_LightChain_CDR
aguaguuuguuugggaggugggauguggug

SEQ ID NO: 51478 - RNA, 57 nt, Artificial Sequence
  derived and/or modified sequence opt6 from anti-HIV_PGT130_HeavyChain_CDR
ucaggaggagauauauuauacuauuacgaauggcaaaaaccacacugguucucacca

SEQ ID NO: 51479 - RNA, 30 nt, Artificial Sequence
  derived and/or modified sequence opt6 from anti-HIV_PGT131_LightChain_CDR
aguaguuugagugggaggugggauauagug

SEQ ID NO: 51480 - RNA, 57 nt, Artificial Sequence
  derived and/or modified sequence opt6 from anti-HIV_PGT131_HeavyChain_CDR
ucagguggagauauauuauacuauauagaauggcaaaaaccucacugguucuaucca

SEQ ID NO: 51481 - RNA, 27 nt, Artificial Sequence
  derived and/or modified sequence opt6 from anti-HIV_PGT135_PGT136_PGT137_LightChain_CDR
caacaauaugaagaauggccaagaaca

SEQ ID NO: 51482 - RNA, 54 nt, Artificial Sequence
  derived and/or modified sequence opt6 from anti-HIV_PGT135_HeavyChain_CDR
cauagacaucaugauguauuuauguuaguaccuauagcuggaugguuugaugua

SEQ ID NO: 51483 - RNA, 54 nt, Artificial Sequence
  derived and/or modified sequence opt6 from anti-HIV_PGT136_HeavyChain_CDR
cauaaauaucacgauauauuuagaguuguaccuguagcuggaugguucgaucca

SEQ ID NO: 51484 - RNA, 54 nt, Artificial Sequence
  derived and/or modified sequence opt6 from anti-HIV_PGT137_HeavyChain_CDR
cauaaauaucacgauauaguuaugguuguaccuauagcuggaugguucgaucca

SEQ ID NO: 51485 - RNA, 27 nt, Artificial Sequence
  derived and/or modified sequence opt6 from anti-HIV_PGT141_PGT142_PGT143_PGT144_LightChain_CDR
augcaaggacuaaauagaccguggaca

SEQ ID NO: 51486 - RNA, 96 nt, Artificial Sequence
  derived and/or modified sequence opt6 from anti-HIV_PGT141_HeavyChain_CDR
ggaucaaaacauagauuaagagauuacguacuauaugacgauuacggacuaauaaacuaucaagaauggaaugacuaucuagaauucuuagacgua

SEQ ID NO: 51487 - RNA, 96 nt, Artificial Sequence
  derived and/or modified sequence opt6 from anti-HIV_PGT144_HeavyChain_CDR
ggaucaaaacauagauuaagagauuacguacuauaugacgauuacggacuaauaaaccaacaagaauggaaugacuaucuagaauucuuagacgua

SEQ ID NO: 51488 - RNA, 27 nt, Artificial Sequence
  derived and/or modified sequence opt6 from anti-HIV_PGT145_LightChain_CDR
augcaaggacuacauaguccauggaca

SEQ ID NO: 51489 - RNA, 93 nt, Artificial Sequence
  derived and/or modified sequence opt6 from anti-HIV_PGT145_HeavyChain_CDR
ggaucaaaacauagauuaagagauuacuuucuauauaacgaauacggaccaaauuacgaagaauggggagauuacuuagcaacacuagaugua

SEQ ID NO: 51490 - RNA, 21 nt, Artificial Sequence
  derived and/or modified sequence opt6 from anti-HIV_VRC-CH30_VRC-CH31_VRC-CH32_VRC-CH33_VRC-CH34_LightChain _CDR
ugccaacaauacgaaacauuc

SEQ ID NO: 51491 - RNA, 45 nt, Artificial Sequence
  derived and/or modified sequence opt6 from anti-HIV_VRC-CH30_VRC-CH31_VRC-CH32_VRC-CH34_HeavyChain_CDR
gcaagagcacaaaaaagaggaagaagugaaugggcauaugcacau

SEQ ID NO: 51492 - RNA, 45 nt, Artificial Sequence
  derived and/or modified sequence opt6 from anti-HIV_VRC-CH33_HeavyChain_CDR
gcaagagcacaaaaaagagcaagaucagaaugggcauaugcacau

SEQ ID NO: 51493 - RNA, 21 nt, Artificial Sequence
  derived and/or modified sequence opt6 from anti-HIV_VRC-PG04_LightChain_CDR
ugucaacaauuagaauucuuc

SEQ ID NO: 51494 - RNA, 48 nt, Artificial Sequence
  derived and/or modified sequence opt6 from anti-HIV_VRC-PG04_HeavyChain_CDR
gcaagacagaaauuuuauacaggaggacaaggaugguauuucgaucua

SEQ ID NO: 51495 - RNA, 21 nt, Artificial Sequence
  derived and/or modified sequence opt6 from anti-HIV_VRC-PG04b_LightChain_CDR
ugucagcaaguugaauuuuuc

SEQ ID NO: 51496 - RNA, 48 nt, Artificial Sequence
  derived and/or modified sequence opt6 from anti-HIV_VRC-PG04b_HeavyChain_CDR
gcaagacagaaauuugaaagaggaggacaaggaugguauuuugauuua

SEQ ID NO: 51497 - RNA, 21 nt, Artificial Sequence
  derived and/or modified sequence opt6 from anti-HIV_VRC03_LightChain_CDR
ugucaacaauucgaauuuuuc

SEQ ID NO: 51498 - RNA, 48 nt, Artificial Sequence
  derived and/or modified sequence opt6 from anti-HIV_VRC03_HeavyChain_CDR
guaagaagagguaguugugauuauuguggugauuuuccauggcaauau

SEQ ID NO: 51499 - RNA, 21 nt, Artificial Sequence
  derived and/or modified sequence opt6 from anti-HIV_1TJG_P-Chain
gaauuggauaagugggcgagu

SEQ ID NO: 51500 - RNA, 69 nt, Artificial Sequence
  derived and/or modified sequence opt6 from anti-HIV_2B1H_P-Chain
aacaacacaaaaaaaagcauaaaaauaagaccaagacaagcauucuacgcaacaaacggaauaauagga

SEQ ID NO: 51501 - RNA, 69 nt, Artificial Sequence
  derived and/or modified sequence opt6 from anti-HIV_2B1A_P-Chain
aacaauacaagaaaaucaauacaucuaggaccaggaagagcauucuaugcaacaggagacauaauagga

SEQ ID NO: 51502 - RNA, 57 nt, Artificial Sequence
  derived and/or modified sequence opt6 from anti-HIV_2B0S_P-Chain
aaaagaaaaagaauacacauaggaccaggaagagcauucuacacaacaaaaaacgca

SEQ ID NO: 51503 - RNA, 69 nt, Artificial Sequence
  derived and/or modified sequence opt6 from anti-HIV_3UJJ_P-Chain
aauaacacaagaaaaagcauaagaauaggaccaggacaagcauucuacgcaacaggagacauaauagga

SEQ ID NO: 51504 - RNA, 69 nt, Artificial Sequence
  derived and/or modified sequence opt6 from anti-HIV_3UJI_P-Chain
uacaacaaaagaaaaagaauacacauaggaccaggaagagcauucuacacaacaaaaaacauaauagga

SEQ ID NO: 51505 - RNA, 75 nt, Artificial Sequence
  derived and/or modified sequence opt6 from anti-HIV_3MLZ_P-Chain
aguaacaauacaagaaaaggaauacauauaggaccaggaagagcauucuaugcaacaggacaaauaacaggagac

SEQ ID NO: 51506 - RNA, 60 nt, Artificial Sequence
  derived and/or modified sequence opt6 from anti-HIV_3MLV_Q-Chain
aauaacacaagaaaaagaauaagaguaggaccaggacaaacaguauacgcaacaaaugca

SEQ ID NO: 51507 - RNA, 69 nt, Artificial Sequence
  derived and/or modified sequence opt6 from anti-HIV_3MLU_P-Chain
aauaacacaagaaaaagcauaagaauaggaccaggacaagcauuuuacgcaacaggaggaauaauagga

SEQ ID NO: 51508 - RNA, 60 nt, Artificial Sequence
  derived and/or modified sequence opt6 from anti-HIV_3MLR_P-Chain
aacaacacaaaaaaaggaauagcaauaggaccaggaagaacacuauacgcaagagaaaaa

SEQ ID NO: 51509 - RNA, 48 nt, Artificial Sequence
  derived and/or modified sequence opt6 from anti-HIV_4XCF_P-Chain
aacuggugggacauaacaaacuggcuaugguacauaaaaaaaaaaaaa

SEQ ID NO: 51510 - RNA, 45 nt, Artificial Sequence
  derived and/or modified sequence opt6 from anti-HIV_4XBE_P-Chain
aacugguucgacauaacaaacuggcuaugguacauaaaaaaaaaa

SEQ ID NO: 51511 - RNA, 48 nt, Artificial Sequence
  derived and/or modified sequence opt6 from anti-HIV_4XAW_P-Chain
aacugguucgacauaacaaacuggcuaugguacauaaaaaaaaaaaaa

SEQ ID NO: 51512 - RNA, 45 nt, Artificial Sequence
  derived and/or modified sequence opt6 from anti-HIV_2QSC_P-Chain
agaaaaagaauacauauaggaccaggaagagcauucuacacaaca

SEQ ID NO: 51513 - RNA, 60 nt, Artificial Sequence
  derived and/or modified sequence opt6 from anti-HIV_3MLS_S-Chain
gcaugucaagcauucuaugcaucaagcccaagaaaaagcauacacauaggagcaugcgca

SEQ ID NO: 51514 - RNA, 42 nt, Artificial Sequence
  derived and/or modified sequence opt6 from anti-HIV_3GO1_P-Chain
cguaaacguauacauauagguccagguagagcuuucuauaca

SEQ ID NO: 51515 - RNA, 42 nt, Artificial Sequence
  derived and/or modified sequence opt6 from anti-HIV_4M1D_Q-Chain
ugccguauacauauagguccagguagagcuuucuauacaugu

SEQ ID NO: 51516 - RNA, 39 nt, Artificial Sequence
  derived and/or modified sequence opt6 from anti-HIV_3C2A_Q-Chain
aaaucuauacaucuagguccagguagagcuuucuaugca

SEQ ID NO: 51517 - RNA, 12 nt, Artificial Sequence
  derived and/or modified sequence opt6 from anti-HIV_CDR
caauccaaaacc

SEQ ID NO: 51518 - RNA, 12 nt, Artificial Sequence
  derived and/or modified sequence opt6 from anti-HIV_CDR
gauuugauugau

SEQ ID NO: 51519 - RNA, 15 nt, Artificial Sequence
  derived and/or modified sequence opt6 from anti-HIV_CDR
gaucauuauuggucg

SEQ ID NO: 51520 - RNA, 15 nt, Artificial Sequence
  derived and/or modified sequence opt6 from anti-HIV_CDR
gggagguuuuggagu

SEQ ID NO: 51521 - RNA, 15 nt, Artificial Sequence
  derived and/or modified sequence opt6 from anti-HIV_CDR
aauuauuacuggacc

SEQ ID NO: 51522 - RNA, 15 nt, Artificial Sequence
  derived and/or modified sequence opt6 from anti-HIV_CDR
gaugcguauuggagu

SEQ ID NO: 51523 - RNA, 15 nt, Artificial Sequence
  derived and/or modified sequence opt6 from anti-HIV_CDR
gauaguuauuggucu

SEQ ID NO: 51524 - RNA, 15 nt, Artificial Sequence
  derived and/or modified sequence opt6 from anti-HIV_CDR
gauaauuauuggucg

SEQ ID NO: 51525 - RNA, 15 nt, Artificial Sequence
  derived and/or modified sequence opt6 from anti-HIV_CDR
aacaguuacuggaca

SEQ ID NO: 51526 - RNA, 15 nt, Artificial Sequence
  derived and/or modified sequence opt6 from anti-HIV_CDR
ucuuauuacuggucc

SEQ ID NO: 51527 - RNA, 15 nt, Artificial Sequence
  derived and/or modified sequence opt6 from anti-HIV_CDR
aguuuuggcaugcau

SEQ ID NO: 51528 - RNA, 15 nt, Artificial Sequence
  derived and/or modified sequence opt6 from anti-HIV_CDR
gcugcauuucaaugg

SEQ ID NO: 51529 - RNA, 15 nt, Artificial Sequence
  derived and/or modified sequence opt6 from anti-HIV_CDR
caacaauuacgcacc

SEQ ID NO: 51530 - RNA, 15 nt, Artificial Sequence
  derived and/or modified sequence opt6 from anti-HIV_CDR
caacaauacgacagc

SEQ ID NO: 51531 - RNA, 15 nt, Artificial Sequence
  derived and/or modified sequence opt6 from anti-HIV_CDR
caacaacucgccacc

SEQ ID NO: 51532 - RNA, 15 nt, Artificial Sequence
  derived and/or modified sequence opt6 from anti-HIV_CDR
gagaguuuucagugg

SEQ ID NO: 51533 - RNA, 15 nt, Artificial Sequence
  derived and/or modified sequence opt6 from anti-HIV_CDR
gagguguaugaauuu

SEQ ID NO: 51534 - RNA, 15 nt, Artificial Sequence
  derived and/or modified sequence opt6 from anti-HIV_CDR
gccucauuagaauuu

SEQ ID NO: 51535 - RNA, 15 nt, Artificial Sequence
  derived and/or modified sequence opt6 from anti-HIV_CDR
agcguguacgaguuc

SEQ ID NO: 51536 - RNA, 15 nt, Artificial Sequence
  derived and/or modified sequence opt6 from anti-HIV_CDR
gccgcauuagaauuu

SEQ ID NO: 51537 - RNA, 15 nt, Artificial Sequence
  derived and/or modified sequence opt6 from anti-HIV_CDR
gcuguaguugaauuu

SEQ ID NO: 51538 - RNA, 15 nt, Artificial Sequence
  derived and/or modified sequence opt6 from anti-HIV_CDR
caauuguucgaguuc

SEQ ID NO: 51539 - RNA, 15 nt, Artificial Sequence
  derived and/or modified sequence opt6 from anti-HIV_CDR
gcuguauuucaaugg

SEQ ID NO: 51540 - RNA, 15 nt, Artificial Sequence
  derived and/or modified sequence opt6 from anti-HIV_CDR
gccguacuugaauuu

SEQ ID NO: 51541 - RNA, 15 nt, Artificial Sequence
  derived and/or modified sequence opt6 from anti-HIV_CDR
aauggguuugaugug

SEQ ID NO: 51542 - RNA, 15 nt, Artificial Sequence
  derived and/or modified sequence opt6 from anti-HIV_CDR
caacaguacgaauuc

SEQ ID NO: 51543 - RNA, 15 nt, Artificial Sequence
  derived and/or modified sequence opt6 from anti-HIV_CDR
caacauuacgaauuc

SEQ ID NO: 51544 - RNA, 15 nt, Artificial Sequence
  derived and/or modified sequence opt6 from anti-HIV_CDR
caaguguaugaaguc

SEQ ID NO: 51545 - RNA, 15 nt, Artificial Sequence
  derived and/or modified sequence opt6 from anti-HIV_CDR
caaguguacgaauuc

SEQ ID NO: 51546 - RNA, 15 nt, Artificial Sequence
  derived and/or modified sequence opt6 from anti-HIV_CDR
uucaguaaagagagu

SEQ ID NO: 51547 - RNA, 15 nt, Artificial Sequence
  derived and/or modified sequence opt6 from anti-HIV_CDR
cuaaaacuauccucc

SEQ ID NO: 51548 - RNA, 15 nt, Artificial Sequence
  derived and/or modified sequence opt6 from anti-HIV_CDR
uauaaagucagcucu

SEQ ID NO: 51549 - RNA, 15 nt, Artificial Sequence
  derived and/or modified sequence opt6 from anti-HIV_CDR
cccccacaagaauca

SEQ ID NO: 51550 - RNA, 15 nt, Artificial Sequence
  derived and/or modified sequence opt6 from anti-HIV_CDR
accgcacgcgauuac

SEQ ID NO: 51551 - RNA, 15 nt, Artificial Sequence
  derived and/or modified sequence opt6 from anti-HIV_CDR
augcagucaauucag

SEQ ID NO: 51552 - RNA, 15 nt, Artificial Sequence
  derived and/or modified sequence opt6 from anti-HIV_CDR
caccaacucgacacc

SEQ ID NO: 51553 - RNA, 15 nt, Artificial Sequence
  derived and/or modified sequence opt6 from anti-HIV_CDR
caccaacucgacagc

SEQ ID NO: 51554 - RNA, 15 nt, Artificial Sequence
  derived and/or modified sequence opt6 from anti-HIV_CDR
caacaauuaggcacc

SEQ ID NO: 51555 - RNA, 15 nt, Artificial Sequence
  derived and/or modified sequence opt6 from anti-HIV_CDR
caaaaagccacaaca

SEQ ID NO: 51556 - RNA, 15 nt, Artificial Sequence
  derived and/or modified sequence opt6 from anti-HIV_CDR
uuguuugcuggcacu

SEQ ID NO: 51557 - RNA, 18 nt, Artificial Sequence
  derived and/or modified sequence opt6 from anti-HIV_CDR
guaagaggaaguaguccg

SEQ ID NO: 51558 - RNA, 18 nt, Artificial Sequence
  derived and/or modified sequence opt6 from anti-HIV_CDR
gguuuguuguuuguuguu

SEQ ID NO: 51559 - RNA, 18 nt, Artificial Sequence
  derived and/or modified sequence opt6 from anti-HIV_CDR
auggauuggacuuggagu

SEQ ID NO: 51560 - RNA, 18 nt, Artificial Sequence
  derived and/or modified sequence opt6 from anti-HIV_CDR
auggauuggacguggagg

SEQ ID NO: 51561 - RNA, 18 nt, Artificial Sequence
  derived and/or modified sequence opt6 from anti-HIV_CDR
augaaacaucucugguuc

SEQ ID NO: 51562 - RNA, 18 nt, Artificial Sequence
  derived and/or modified sequence opt6 from anti-HIV_CDR
auggacuggauauggaga

SEQ ID NO: 51563 - RNA, 18 nt, Artificial Sequence
  derived and/or modified sequence opt6 from anti-HIV_CDR
auggauuggacguggacg

SEQ ID NO: 51564 - RNA, 18 nt, Artificial Sequence
  derived and/or modified sequence opt6 from anti-HIV_CDR
augaaacaucucuuccuc

SEQ ID NO: 51565 - RNA, 18 nt, Artificial Sequence
  derived and/or modified sequence opt6 from anti-HIV_CDR
caacuccuccaauccaac

SEQ ID NO: 51566 - RNA, 18 nt, Artificial Sequence
  derived and/or modified sequence opt6 from anti-HIV_CDR
ggaggaaguccagaacau

SEQ ID NO: 51567 - RNA, 18 nt, Artificial Sequence
  derived and/or modified sequence opt6 from anti-HIV_CDR
uuagaggggacggauuau

SEQ ID NO: 51568 - RNA, 18 nt, Artificial Sequence
  derived and/or modified sequence opt6 from anti-HIV_CDR
caacaauaccccuccacc

SEQ ID NO: 51569 - RNA, 21 nt, Artificial Sequence
  derived and/or modified sequence opt6 from anti-HIV_CDR
aacaaucacgacagaccaagc

SEQ ID NO: 51570 - RNA, 21 nt, Artificial Sequence
  derived and/or modified sequence opt6 from anti-HIV_CDR
aauaaucaagacagaccagcc

SEQ ID NO: 51571 - RNA, 21 nt, Artificial Sequence
  derived and/or modified sequence opt6 from anti-HIV_CDR
aacaauaacgaucgcccgagc

SEQ ID NO: 51572 - RNA, 21 nt, Artificial Sequence
  derived and/or modified sequence opt6 from anti-HIV_CDR
aacaaucaagaccgaccaagc

SEQ ID NO: 51573 - RNA, 21 nt, Artificial Sequence
  derived and/or modified sequence opt6 from anti-HIV_CDR
gacgauagcgauagaccgagc

SEQ ID NO: 51574 - RNA, 21 nt, Artificial Sequence
  derived and/or modified sequence opt6 from anti-HIV_CDR
ugggcaagcacaagacauaca

SEQ ID NO: 51575 - RNA, 21 nt, Artificial Sequence
  derived and/or modified sequence opt6 from anti-HIV_CDR
ggcgcgacagcaagagauuuu

SEQ ID NO: 51576 - RNA, 21 nt, Artificial Sequence
  derived and/or modified sequence opt6 from anti-HIV_CDR
gccucaauaaaacuagcccua

SEQ ID NO: 51577 - RNA, 21 nt, Artificial Sequence
  derived and/or modified sequence opt6 from anti-HIV_CDR
caacaauacggccgaucacca

SEQ ID NO: 51578 - RNA, 21 nt, Artificial Sequence
  derived and/or modified sequence opt6 from anti-HIV_CDR
caacaauacuacaucuccccc

SEQ ID NO: 51579 - RNA, 21 nt, Artificial Sequence
  derived and/or modified sequence opt6 from anti-HIV_CDR
caacaaucccacuccccaucc

SEQ ID NO: 51580 - RNA, 21 nt, Artificial Sequence
  derived and/or modified sequence opt6 from anti-HIV_CDR
gguaggugugcgagaaggugg

SEQ ID NO: 51581 - RNA, 21 nt, Artificial Sequence
  derived and/or modified sequence opt6 from anti-HIV_CDR
agauuucuguuuguaguugca

SEQ ID NO: 51582 - RNA, 21 nt, Artificial Sequence
  derived and/or modified sequence opt6 from anti-HIV_CDR
auguccgucucuuuucucaua

SEQ ID NO: 51583 - RNA, 21 nt, Artificial Sequence
  derived and/or modified sequence opt6 from anti-HIV_CDR
ggaaguaguaauagauguccg

SEQ ID NO: 51584 - RNA, 21 nt, Artificial Sequence
  derived and/or modified sequence opt6 from anti-HIV_CDR
augaaacaucucugguucuuu

SEQ ID NO: 51585 - RNA, 21 nt, Artificial Sequence
  derived and/or modified sequence opt6 from anti-HIV_CDR
gcuucuugggauuuugauuuu

SEQ ID NO: 51586 - RNA, 21 nt, Artificial Sequence
  derived and/or modified sequence opt6 from anti-HIV_CDR
gaaauaggaguggcagaacau

SEQ ID NO: 51587 - RNA, 21 nt, Artificial Sequence
  derived and/or modified sequence opt6 from anti-HIV_CDR
caaaaauacgacaccgcaccc

SEQ ID NO: 51588 - RNA, 21 nt, Artificial Sequence
  derived and/or modified sequence opt6 from anti-HIV_CDR
caacaauccucauccaccccc

SEQ ID NO: 51589 - RNA, 21 nt, Artificial Sequence
  derived and/or modified sequence opt6 from anti-HIV_CDR
caacaaucagccggcacacca

SEQ ID NO: 51590 - RNA, 21 nt, Artificial Sequence
  derived and/or modified sequence opt6 from anti-HIV_CDR
caacaauccuccuccaaaccc

SEQ ID NO: 51591 - RNA, 21 nt, Artificial Sequence
  derived and/or modified sequence opt6 from anti-HIV_CDR
caagaauacaacaccuauacc

SEQ ID NO: 51592 - RNA, 21 nt, Artificial Sequence
  derived and/or modified sequence opt6 from anti-HIV_CDR
caagaauacaacaacuacaac

SEQ ID NO: 51593 - RNA, 21 nt, Artificial Sequence
  derived and/or modified sequence opt6 from anti-HIV_CDR
cacuaugacgcacuagacuau

SEQ ID NO: 51594 - RNA, 24 nt, Artificial Sequence
  derived and/or modified sequence opt6 from anti-HIV_CDR
gcaauauuuaaaggaguccagugu

SEQ ID NO: 51595 - RNA, 24 nt, Artificial Sequence
  derived and/or modified sequence opt6 from anti-HIV_CDR
gggccguuaggugauuaugauuuu

SEQ ID NO: 51596 - RNA, 24 nt, Artificial Sequence
  derived and/or modified sequence opt6 from anti-HIV_CDR
cagcaauauggcagcucauuaaga

SEQ ID NO: 51597 - RNA, 24 nt, Artificial Sequence
  derived and/or modified sequence opt6 from anti-HIV_CDR
caacaauacucacacuaccgcacc

SEQ ID NO: 51598 - RNA, 24 nt, Artificial Sequence
  derived and/or modified sequence opt6 from anti-HIV_CDR
caauauuauggcauguccguaacu

SEQ ID NO: 51599 - RNA, 24 nt, Artificial Sequence
  derived and/or modified sequence opt6 from anti-HIV_CDR
caacaauacgaaaacuggcuaaca

SEQ ID NO: 51600 - RNA, 24 nt, Artificial Sequence
  derived and/or modified sequence opt6 from anti-HIV_CDR
ucuggaguucauuauauggaugua

SEQ ID NO: 51601 - RNA, 24 nt, Artificial Sequence
  derived and/or modified sequence opt6 from anti-HIV_CDR
caacaauacuccggcccacuaaca

SEQ ID NO: 51602 - RNA, 24 nt, Artificial Sequence
  derived and/or modified sequence opt6 from anti-HIV_CDR
caacaauacuacaccguccccuca

SEQ ID NO: 51603 - RNA, 24 nt, Artificial Sequence
  derived and/or modified sequence opt6 from anti-HIV_CDR
caacaauacggcucaucaauaaca

SEQ ID NO: 51604 - RNA, 24 nt, Artificial Sequence
  derived and/or modified sequence opt6 from anti-HIV_CDR
caucaauauaacaaaugggacaca

SEQ ID NO: 51605 - RNA, 24 nt, Artificial Sequence
  derived and/or modified sequence opt6 from anti-HIV_CDR
caacaauccuacaccaccccccuc

SEQ ID NO: 51606 - RNA, 24 nt, Artificial Sequence
  derived and/or modified sequence opt6 from anti-HIV_CDR
cagagaugggaaacaauagauuac

SEQ ID NO: 51607 - RNA, 24 nt, Artificial Sequence
  derived and/or modified sequence opt6 from anti-HIV_CDR
uguucguaugcggguucguauacg

SEQ ID NO: 51608 - RNA, 24 nt, Artificial Sequence
  derived and/or modified sequence opt6 from anti-HIV_CDR
caacaauacgacaaccuacccaca

SEQ ID NO: 51609 - RNA, 24 nt, Artificial Sequence
  derived and/or modified sequence opt6 from anti-HIV_CDR
caacaaugcacacucccacucaca

SEQ ID NO: 51610 - RNA, 24 nt, Artificial Sequence
  derived and/or modified sequence opt6 from anti-HIV_CDR
caacaaucauacucauccgucacc

SEQ ID NO: 51611 - RNA, 24 nt, Artificial Sequence
  derived and/or modified sequence opt6 from anti-HIV_CDR
caacaaucacacacauccgucacc

SEQ ID NO: 51612 - RNA, 24 nt, Artificial Sequence
  derived and/or modified sequence opt6 from anti-HIV_CDR
caacaaacauacgcauccguaacc

SEQ ID NO: 51613 - RNA, 24 nt, Artificial Sequence
  derived and/or modified sequence opt6 from anti-HIV_CDR
caacaauacaacuccgacuacaca

SEQ ID NO: 51614 - RNA, 24 nt, Artificial Sequence
  derived and/or modified sequence opt6 from anti-HIV_CDR
caucuauauguaucuagaccugua

SEQ ID NO: 51615 - RNA, 24 nt, Artificial Sequence
  derived and/or modified sequence opt6 from anti-HIV_CDR
caacaauacggccgaucaccacua

SEQ ID NO: 51616 - RNA, 24 nt, Artificial Sequence
  derived and/or modified sequence opt6 from anti-HIV_CDR
caacaauacggcucaucaccacua

SEQ ID NO: 51617 - RNA, 24 nt, Artificial Sequence
  derived and/or modified sequence opt6 from anti-HIV_CDR
caacaauauaaugacuggccagca

SEQ ID NO: 51618 - RNA, 24 nt, Artificial Sequence
  derived and/or modified sequence opt6 from anti-HIV_CDR
caucaauauggcucaagccaaaga

SEQ ID NO: 51619 - RNA, 24 nt, Artificial Sequence
  derived and/or modified sequence opt6 from anti-HIV_CDR
caacaaacauacucauccgucacc

SEQ ID NO: 51620 - RNA, 24 nt, Artificial Sequence
  derived and/or modified sequence opt6 from anti-HIV_CDR
caacaaacauacagaucagucaca

SEQ ID NO: 51621 - RNA, 24 nt, Artificial Sequence
  derived and/or modified sequence opt6 from anti-HIV_CDR
caacaguacggaaguucauggaca

SEQ ID NO: 51622 - RNA, 24 nt, Artificial Sequence
  derived and/or modified sequence opt6 from anti-HIV_CDR
agcucguacgcgggaauaaauaau

SEQ ID NO: 51623 - RNA, 24 nt, Artificial Sequence
  derived and/or modified sequence opt6 from anti-HIV_CDR
caaaaauacggcaguucacuaaca

SEQ ID NO: 51624 - RNA, 24 nt, Artificial Sequence
  derived and/or modified sequence opt6 from anti-HIV_CDR
augcaagcacuagaaacauuaggc

SEQ ID NO: 51625 - RNA, 24 nt, Artificial Sequence
  derived and/or modified sequence opt6 from anti-HIV_CDR
caacaauacgccggaucacuaaca

SEQ ID NO: 51626 - RNA, 24 nt, Artificial Sequence
  derived and/or modified sequence opt6 from anti-HIV_CDR
agaaauugggguaauuuugaccau

SEQ ID NO: 51627 - RNA, 27 nt, Artificial Sequence
  derived and/or modified sequence opt6 from anti-HIV_CDR
caacaacacuacacaacacccuggacc

SEQ ID NO: 51628 - RNA, 27 nt, Artificial Sequence
  derived and/or modified sequence opt6 from anti-HIV_CDR
caacaaucauuugccguccccuauaca

SEQ ID NO: 51629 - RNA, 27 nt, Artificial Sequence
  derived and/or modified sequence opt6 from anti-HIV_CDR
caacaauacaaaucauacuccggcacc

SEQ ID NO: 51630 - RNA, 27 nt, Artificial Sequence
  derived and/or modified sequence opt6 from anti-HIV_CDR
caucaauaugccuauucacccagaacc

SEQ ID NO: 51631 - RNA, 27 nt, Artificial Sequence
  derived and/or modified sequence opt6 from anti-HIV_CDR
caacaauacaacuccuucccccccacc

SEQ ID NO: 51632 - RNA, 27 nt, Artificial Sequence
  derived and/or modified sequence opt6 from anti-HIV_CDR
caacaaacauacucaaacccacgcaug

SEQ ID NO: 51633 - RNA, 27 nt, Artificial Sequence
  derived and/or modified sequence opt6 from anti-HIV_CDR
caacaauacgaagacccaccauggaca

SEQ ID NO: 51634 - RNA, 27 nt, Artificial Sequence
  derived and/or modified sequence opt6 from anti-HIV_CDR
caccaauacuucaauaccccccgcacc

SEQ ID NO: 51635 - RNA, 27 nt, Artificial Sequence
  derived and/or modified sequence opt6 from anti-HIV_CDR
caucaauauuucucuaccccccgcacc

SEQ ID NO: 51636 - RNA, 27 nt, Artificial Sequence
  derived and/or modified sequence opt6 from anti-HIV_CDR
caacauagaaguaacuggccauggaca

SEQ ID NO: 51637 - RNA, 27 nt, Artificial Sequence
  derived and/or modified sequence opt6 from anti-HIV_CDR
agagggagaaggcaaauaggagauuac

SEQ ID NO: 51638 - RNA, 27 nt, Artificial Sequence
  derived and/or modified sequence opt6 from anti-HIV_CDR
caacaauacggacuaaguccauggaca

SEQ ID NO: 51639 - RNA, 27 nt, Artificial Sequence
  derived and/or modified sequence opt6 from anti-HIV_CDR
caacaaaccuacaccucccccaucaca

SEQ ID NO: 51640 - RNA, 27 nt, Artificial Sequence
  derived and/or modified sequence opt6 from anti-HIV_CDR
caacaauacggcucaucaccaccaaca

SEQ ID NO: 51641 - RNA, 27 nt, Artificial Sequence
  derived and/or modified sequence opt6 from anti-HIV_CDR
cagcaauauggcacaaguucaugcaca

SEQ ID NO: 51642 - RNA, 27 nt, Artificial Sequence
  derived and/or modified sequence opt6 from anti-HIV_CDR
caacaauacgacgacgcaccaauaaca

SEQ ID NO: 51643 - RNA, 27 nt, Artificial Sequence
  derived and/or modified sequence opt6 from anti-HIV_CDR
ggcccgcuauuaagauaucuagauagc

SEQ ID NO: 51644 - RNA, 27 nt, Artificial Sequence
  derived and/or modified sequence opt6 from anti-HIV_CDR
ugucuaaagaaaacgagcucguacgug

SEQ ID NO: 51645 - RNA, 27 nt, Artificial Sequence
  derived and/or modified sequence opt6 from anti-HIV_CDR
caacaauacaaccacuggccacaaaca

SEQ ID NO: 51646 - RNA, 27 nt, Artificial Sequence
  derived and/or modified sequence opt6 from anti-HIV_CDR
caacaauacuccaaccuccccuacacc

SEQ ID NO: 51647 - RNA, 27 nt, Artificial Sequence
  derived and/or modified sequence opt6 from anti-HIV_CDR
caacaauacgacacauaucccggaacc

SEQ ID NO: 51648 - RNA, 27 nt, Artificial Sequence
  derived and/or modified sequence opt6 from anti-HIV_CDR
caagaauacucaagcacgcccuauaac

SEQ ID NO: 51649 - RNA, 27 nt, Artificial Sequence
  derived and/or modified sequence opt6 from anti-HIV_CDR
ggagcuugggaugauacguuauaugua

SEQ ID NO: 51650 - RNA, 27 nt, Artificial Sequence
  derived and/or modified sequence opt6 from anti-HIV_CDR
gcagccugggaugauacauuauaugua

SEQ ID NO: 51651 - RNA, 27 nt, Artificial Sequence
  derived and/or modified sequence opt6 from anti-HIV_CDR
caacaauacuacuccgacuccauaacc

SEQ ID NO: 51652 - RNA, 27 nt, Artificial Sequence
  derived and/or modified sequence opt6 from anti-HIV_CDR
caacaauacggccgaucaccauauaca

SEQ ID NO: 51653 - RNA, 27 nt, Artificial Sequence
  derived and/or modified sequence opt6 from anti-HIV_CDR
caacaauacacaaacuaccccuggacc

SEQ ID NO: 51654 - RNA, 27 nt, Artificial Sequence
  derived and/or modified sequence opt6 from anti-HIV_CDR
caacaaagacauaacuggccaauaagc

SEQ ID NO: 51655 - RNA, 27 nt, Artificial Sequence
  derived and/or modified sequence opt6 from anti-HIV_CDR
caacaauaccacaacuggccaagaaca

SEQ ID NO: 51656 - RNA, 27 nt, Artificial Sequence
  derived and/or modified sequence opt6 from anti-HIV_CDR
caacaaagaucaaccuggccaccaaca

SEQ ID NO: 51657 - RNA, 27 nt, Artificial Sequence
  derived and/or modified sequence opt6 from anti-HIV_CDR
caacaauacgauagcuuuagcuggacc

SEQ ID NO: 51658 - RNA, 27 nt, Artificial Sequence
  derived and/or modified sequence opt6 from anti-HIV_CDR
caacaauacaacaaccuacccgucacc

SEQ ID NO: 51659 - RNA, 27 nt, Artificial Sequence
  derived and/or modified sequence opt6 from anti-HIV_CDR
caacaauacaaccgcuacuccuacacc

SEQ ID NO: 51660 - RNA, 27 nt, Artificial Sequence
  derived and/or modified sequence opt6 from anti-HIV_CDR
caagaauacuauauauugcccuguagc

SEQ ID NO: 51661 - RNA, 27 nt, Artificial Sequence
  derived and/or modified sequence opt6 from anti-HIV_CDR
caacaauacgacaaccuacucgcacac

SEQ ID NO: 51662 - RNA, 27 nt, Artificial Sequence
  derived and/or modified sequence opt6 from anti-HIV_CDR
caccagugcgauaacuuaaucgcacgc

SEQ ID NO: 51663 - RNA, 27 nt, Artificial Sequence
  derived and/or modified sequence opt6 from anti-HIV_CDR
caacaaucauucucaacucucuggacc

SEQ ID NO: 51664 - RNA, 27 nt, Artificial Sequence
  derived and/or modified sequence opt6 from anti-HIV_CDR
caccaauccuacuccaccccccccacc

SEQ ID NO: 51665 - RNA, 27 nt, Artificial Sequence
  derived and/or modified sequence opt6 from anti-HIV_CDR
caacaaggauauucaacuccauggaca

SEQ ID NO: 51666 - RNA, 27 nt, Artificial Sequence
  derived and/or modified sequence opt6 from anti-HIV_CDR
caacaauacucaaccacaccccgcacc

SEQ ID NO: 51667 - RNA, 27 nt, Artificial Sequence
  derived and/or modified sequence opt6 from anti-HIV_CDR
caacuauacaauuccgucccccaaacc

SEQ ID NO: 51668 - RNA, 27 nt, Artificial Sequence
  derived and/or modified sequence opt6 from anti-HIV_CDR
caacaaagaacaagcuggccacaaaca

SEQ ID NO: 51669 - RNA, 27 nt, Artificial Sequence
  derived and/or modified sequence opt6 from anti-HIV_CDR
caacaauucaacaccuacucccaaacc

SEQ ID NO: 51670 - RNA, 27 nt, Artificial Sequence
  derived and/or modified sequence opt6 from anti-HIV_CDR
augcaaucacuccaaaccccaaucaca

SEQ ID NO: 51671 - RNA, 27 nt, Artificial Sequence
  derived and/or modified sequence opt6 from anti-HIV_CDR
caacaauacaacuccuacccccucacc

SEQ ID NO: 51672 - RNA, 27 nt, Artificial Sequence
  derived and/or modified sequence opt6 from anti-HIV_CDR
caacaauacaacucauacuccggcacc

SEQ ID NO: 51673 - RNA, 27 nt, Artificial Sequence
  derived and/or modified sequence opt6 from anti-HIV_CDR
cagaguuaugacaguaguuuaagcgga

SEQ ID NO: 51674 - RNA, 27 nt, Artificial Sequence
  derived and/or modified sequence opt6 from anti-HIV_CDR
agccaaggcaauacagcaauagauuac

SEQ ID NO: 51675 - RNA, 27 nt, Artificial Sequence
  derived and/or modified sequence opt6 from anti-HIV_CDR
gaggaaccaagagacgcauuugauuua

SEQ ID NO: 51676 - RNA, 27 nt, Artificial Sequence
  derived and/or modified sequence opt6 from anti-HIV_CDR
caacaauccuacaccacacccgucacc

SEQ ID NO: 51677 - RNA, 27 nt, Artificial Sequence
  derived and/or modified sequence opt6 from anti-HIV_CDR
gcaggaagagaaggaugguuugauccg

SEQ ID NO: 51678 - RNA, 27 nt, Artificial Sequence
  derived and/or modified sequence opt6 from anti-HIV_CDR
caacaauacuacuccaccccccacacc

SEQ ID NO: 51679 - RNA, 27 nt, Artificial Sequence
  derived and/or modified sequence opt6 from anti-HIV_CDR
caacaaucauacucaauagccggcaca

SEQ ID NO: 51680 - RNA, 27 nt, Artificial Sequence
  derived and/or modified sequence opt6 from anti-HIV_CDR
caaaacuacaacaaaccaccccgaacc

SEQ ID NO: 51681 - RNA, 27 nt, Artificial Sequence
  derived and/or modified sequence opt6 from anti-HIV_CDR
augcaaucaauccaacucccccucaca

SEQ ID NO: 51682 - RNA, 27 nt, Artificial Sequence
  derived and/or modified sequence opt6 from anti-HIV_CDR
augcaagcacuccagaccucacucaca

SEQ ID NO: 51683 - RNA, 27 nt, Artificial Sequence
  derived and/or modified sequence opt6 from anti-HIV_CDR
caacaauacagcucaagcccaagaaca

SEQ ID NO: 51684 - RNA, 27 nt, Artificial Sequence
  derived and/or modified sequence opt6 from anti-HIV_CDR
caagcaugggauagcucgacagcagua

SEQ ID NO: 51685 - RNA, 27 nt, Artificial Sequence
  derived and/or modified sequence opt6 from anti-HIV_CDR
caacacuacaauaacuggccauacaca

SEQ ID NO: 51686 - RNA, 27 nt, Artificial Sequence
  derived and/or modified sequence opt6 from anti-HIV_CDR
caacaauacgaccgccuacccauaacc

SEQ ID NO: 51687 - RNA, 27 nt, Artificial Sequence
  derived and/or modified sequence opt6 from anti-HIV_CDR
caacaauacggcucaucaccaauaaca

SEQ ID NO: 51688 - RNA, 27 nt, Artificial Sequence
  derived and/or modified sequence opt6 from anti-HIV_CDR
caacaauacgacgucuggccauuaaca

SEQ ID NO: 51689 - RNA, 27 nt, Artificial Sequence
  derived and/or modified sequence opt6 from anti-HIV_CDR
caccaauacgccucaucacccagaacc

SEQ ID NO: 51690 - RNA, 27 nt, Artificial Sequence
  derived and/or modified sequence opt6 from anti-HIV_CDR
augcaaucacuccaccuccccuacaca

SEQ ID NO: 51691 - RNA, 27 nt, Artificial Sequence
  derived and/or modified sequence opt6 from anti-HIV_CDR
caacaauacuacuccuccccccucacc

SEQ ID NO: 51692 - RNA, 27 nt, Artificial Sequence
  derived and/or modified sequence opt6 from anti-HIV_CDR
caacaacacgacaccuuucccuucacc

SEQ ID NO: 51693 - RNA, 27 nt, Artificial Sequence
  derived and/or modified sequence opt6 from anti-HIV_CDR
caacaauccuacuccacccccuacacc

SEQ ID NO: 51694 - RNA, 27 nt, Artificial Sequence
  derived and/or modified sequence opt6 from anti-HIV_CDR
caacaauacaaaaccuaccccgucacc

SEQ ID NO: 51695 - RNA, 27 nt, Artificial Sequence
  derived and/or modified sequence opt6 from anti-HIV_CDR
caacaauacuacuccacacccgucacc

SEQ ID NO: 51696 - RNA, 27 nt, Artificial Sequence
  derived and/or modified sequence opt6 from anti-HIV_CDR
caacaauacaacuggccaccauucaca

SEQ ID NO: 51697 - RNA, 27 nt, Artificial Sequence
  derived and/or modified sequence opt6 from anti-HIV_CDR
augcaaggaacucauuggccauggaca

SEQ ID NO: 51698 - RNA, 27 nt, Artificial Sequence
  derived and/or modified sequence opt6 from anti-HIV_CDR
caucaauguggaucuaguccuagaacu

SEQ ID NO: 51699 - RNA, 27 nt, Artificial Sequence
  derived and/or modified sequence opt6 from anti-HIV_CDR
caacaauacaacucauacuuccgcacc

SEQ ID NO: 51700 - RNA, 27 nt, Artificial Sequence
  derived and/or modified sequence opt6 from anti-HIV_CDR
caacaauaccacaacuggccaccauca

SEQ ID NO: 51701 - RNA, 27 nt, Artificial Sequence
  derived and/or modified sequence opt6 from anti-HIV_CDR
augcaagggacuuauugguuauggaca

SEQ ID NO: 51702 - RNA, 27 nt, Artificial Sequence
  derived and/or modified sequence opt6 from anti-HIV_CDR
caacaaggcuuuucagcuccauuuaca

SEQ ID NO: 51703 - RNA, 27 nt, Artificial Sequence
  derived and/or modified sequence opt6 from anti-HIV_CDR
caacaauacaacaccuacccccucacc

SEQ ID NO: 51704 - RNA, 27 nt, Artificial Sequence
  derived and/or modified sequence opt6 from anti-HIV_CDR
augcaaggaacacauuggccaagaaca

SEQ ID NO: 51705 - RNA, 27 nt, Artificial Sequence
  derived and/or modified sequence opt6 from anti-HIV_CDR
uuuggucguacuccuugguuugauccu

SEQ ID NO: 51706 - RNA, 27 nt, Artificial Sequence
  derived and/or modified sequence opt6 from anti-HIV_CDR
caacaauacuucacauccgucaucaca

SEQ ID NO: 51707 - RNA, 27 nt, Artificial Sequence
  derived and/or modified sequence opt6 from anti-HIV_CDR
caccauuacauguccgaccuccaaacc

SEQ ID NO: 51708 - RNA, 27 nt, Artificial Sequence
  derived and/or modified sequence opt6 from anti-HIV_CDR
caccacuacuccuccuccucccacacc

SEQ ID NO: 51709 - RNA, 27 nt, Artificial Sequence
  derived and/or modified sequence opt6 from anti-HIV_CDR
caccauuacaaauccgacugccaaacc

SEQ ID NO: 51710 - RNA, 27 nt, Artificial Sequence
  derived and/or modified sequence opt6 from anti-HIV_CDR
caacacagaucauccuggccauuaaca

SEQ ID NO: 51711 - RNA, 27 nt, Artificial Sequence
  derived and/or modified sequence opt6 from anti-HIV_CDR
cuacaacaccauucauaucccuggacc

SEQ ID NO: 51712 - RNA, 27 nt, Artificial Sequence
  derived and/or modified sequence opt6 from anti-HIV_CDR
caacaauacggaacaaguccaggaaca

SEQ ID NO: 51713 - RNA, 27 nt, Artificial Sequence
  derived and/or modified sequence opt6 from anti-HIV_CDR
caacaauacggcucaucaccaacaaca

SEQ ID NO: 51714 - RNA, 27 nt, Artificial Sequence
  derived and/or modified sequence opt6 from anti-HIV_CDR
caacaauacggcacaucaccaacaaca

SEQ ID NO: 51715 - RNA, 27 nt, Artificial Sequence
  derived and/or modified sequence opt6 from anti-HIV_CDR
augcaagcaacacauuggccaccagga

SEQ ID NO: 51716 - RNA, 27 nt, Artificial Sequence
  derived and/or modified sequence opt6 from anti-HIV_CDR
caaagauacaauagagacccauacaua

SEQ ID NO: 51717 - RNA, 27 nt, Artificial Sequence
  derived and/or modified sequence opt6 from anti-HIV_CDR
caacaauacgacaaccuaccacuagcc

SEQ ID NO: 51718 - RNA, 27 nt, Artificial Sequence
  derived and/or modified sequence opt6 from anti-HIV_CDR
ucuucauauucagcuacagguguagcu

SEQ ID NO: 51719 - RNA, 27 nt, Artificial Sequence
  derived and/or modified sequence opt6 from anti-HIV_CDR
caacauuacggaaacaguagauggaca

SEQ ID NO: 51720 - RNA, 27 nt, Artificial Sequence
  derived and/or modified sequence opt6 from anti-HIV_CDR
caacaauacgaaacauaucccuggacc

SEQ ID NO: 51721 - RNA, 27 nt, Artificial Sequence
  derived and/or modified sequence opt6 from anti-HIV_CDR
caacaauacggcucaucaccaucaaca

SEQ ID NO: 51722 - RNA, 27 nt, Artificial Sequence
  derived and/or modified sequence opt6 from anti-HIV_CDR
caacaaucccaacgcacaccccacacc

SEQ ID NO: 51723 - RNA, 27 nt, Artificial Sequence
  derived and/or modified sequence opt6 from anti-HIV_CDR
caacaauacgacauccuaccccuaacc

SEQ ID NO: 51724 - RNA, 27 nt, Artificial Sequence
  derived and/or modified sequence opt6 from anti-HIV_CDR
caacaaucaaacucaucacccuggacc

SEQ ID NO: 51725 - RNA, 27 nt, Artificial Sequence
  derived and/or modified sequence opt6 from anti-HIV_CDR
caacaaucauacgacaccccacgcaca

SEQ ID NO: 51726 - RNA, 27 nt, Artificial Sequence
  derived and/or modified sequence opt6 from anti-HIV_CDR
caacaauucggaucaaguccaggaaca

SEQ ID NO: 51727 - RNA, 27 nt, Artificial Sequence
  derived and/or modified sequence opt6 from anti-HIV_CDR
caccaauacggcucaucaccacaaaca

SEQ ID NO: 51728 - RNA, 27 nt, Artificial Sequence
  derived and/or modified sequence opt6 from anti-HIV_CDR
caucaauacggcucaucuccucaaucu

SEQ ID NO: 51729 - RNA, 27 nt, Artificial Sequence
  derived and/or modified sequence opt6 from anti-HIV_CDR
cuccaacacaacuccuacccccucacc

SEQ ID NO: 51730 - RNA, 27 nt, Artificial Sequence
  derived and/or modified sequence opt6 from anti-HIV_CDR
caacaauacaacgacuggccaauaaca

SEQ ID NO: 51731 - RNA, 27 nt, Artificial Sequence
  derived and/or modified sequence opt6 from anti-HIV_CDR
caacaaaccuucaccuuccccuacacc

SEQ ID NO: 51732 - RNA, 27 nt, Artificial Sequence
  derived and/or modified sequence opt6 from anti-HIV_CDR
caacaauccuacaccuuccccuacauc

SEQ ID NO: 51733 - RNA, 27 nt, Artificial Sequence
  derived and/or modified sequence opt6 from anti-HIV_CDR
caauauuacggcucaucaccauacaca

SEQ ID NO: 51734 - RNA, 27 nt, Artificial Sequence
  derived and/or modified sequence opt6 from anti-HIV_CDR
caacaaucauucggaacaccaagaaca

SEQ ID NO: 51735 - RNA, 27 nt, Artificial Sequence
  derived and/or modified sequence opt6 from anti-HIV_CDR
caacaauauaacgacuggccaagaaca

SEQ ID NO: 51736 - RNA, 27 nt, Artificial Sequence
  derived and/or modified sequence opt6 from anti-HIV_CDR
caacaauacggcucaagcccaagaaca

SEQ ID NO: 51737 - RNA, 27 nt, Artificial Sequence
  derived and/or modified sequence opt6 from anti-HIV_CDR
cuacaacacaauagauaucccuggacc

SEQ ID NO: 51738 - RNA, 27 nt, Artificial Sequence
  derived and/or modified sequence opt6 from anti-HIV_CDR
cuacaacacaauaacuaccccuggacc

SEQ ID NO: 51739 - RNA, 27 nt, Artificial Sequence
  derived and/or modified sequence opt6 from anti-HIV_CDR
cuccaauacuccaccuacccccucacc

SEQ ID NO: 51740 - RNA, 27 nt, Artificial Sequence
  derived and/or modified sequence opt6 from anti-HIV_CDR
cuacaauacaacgccuacccacucaca

SEQ ID NO: 51741 - RNA, 27 nt, Artificial Sequence
  derived and/or modified sequence opt6 from anti-HIV_CDR
caacaauacgauuccgcacccguaacc

SEQ ID NO: 51742 - RNA, 27 nt, Artificial Sequence
  derived and/or modified sequence opt6 from anti-HIV_CDR
caacaaaccuacaccuuccccuacucc

SEQ ID NO: 51743 - RNA, 27 nt, Artificial Sequence
  derived and/or modified sequence opt6 from anti-HIV_CDR
ggauaugauaauagugggccggauuau

SEQ ID NO: 51744 - RNA, 27 nt, Artificial Sequence
  derived and/or modified sequence opt6 from anti-HIV_CDR
caacaauacaacaacuggccaccagca

SEQ ID NO: 51745 - RNA, 27 nt, Artificial Sequence
  derived and/or modified sequence opt6 from anti-HIV_CDR
caccaauacgcauuaucacccuggacc

SEQ ID NO: 51746 - RNA, 27 nt, Artificial Sequence
  derived and/or modified sequence opt6 from anti-HIV_CDR
caaaaauacgauaccgaucccaugacc

SEQ ID NO: 51747 - RNA, 27 nt, Artificial Sequence
  derived and/or modified sequence opt6 from anti-HIV_CDR
caacaauacaacuacuaccccaucacc

SEQ ID NO: 51748 - RNA, 27 nt, Artificial Sequence
  derived and/or modified sequence opt6 from anti-HIV_CDR
caacaaaccuuuaccgaccccguaacc

SEQ ID NO: 51749 - RNA, 27 nt, Artificial Sequence
  derived and/or modified sequence opt6 from anti-HIV_CDR
gcggcuugggaugauaguuuacaugua

SEQ ID NO: 51750 - RNA, 27 nt, Artificial Sequence
  derived and/or modified sequence opt6 from anti-HIV_CDR
caacaauacgccuccucacccuucacc

SEQ ID NO: 51751 - RNA, 27 nt, Artificial Sequence
  derived and/or modified sequence opt6 from anti-HIV_CDR
caacaauccuccuccacccccuucacc

SEQ ID NO: 51752 - RNA, 27 nt, Artificial Sequence
  derived and/or modified sequence opt6 from anti-HIV_CDR
caacaaagaaguaacugggcaauaaca

SEQ ID NO: 51753 - RNA, 27 nt, Artificial Sequence
  derived and/or modified sequence opt6 from anti-HIV_CDR
caacaauacggcucaucaccauucaca

SEQ ID NO: 51754 - RNA, 27 nt, Artificial Sequence
  derived and/or modified sequence opt6 from anti-HIV_CDR
caaaaauacaauggagcaccauggaca

SEQ ID NO: 51755 - RNA, 27 nt, Artificial Sequence
  derived and/or modified sequence opt6 from anti-HIV_CDR
caaaaauacaauaacgcacccuggacc

SEQ ID NO: 51756 - RNA, 27 nt, Artificial Sequence
  derived and/or modified sequence opt6 from anti-HIV_CDR
caacaaagaguaaacuggccaccaaac

SEQ ID NO: 51757 - RNA, 27 nt, Artificial Sequence
  derived and/or modified sequence opt6 from anti-HIV_CDR
caacaaagaggacacuggccauuaaca

SEQ ID NO: 51758 - RNA, 27 nt, Artificial Sequence
  derived and/or modified sequence opt6 from anti-HIV_CDR
caacaauaucgcuacagcguaaucaua

SEQ ID NO: 51759 - RNA, 27 nt, Artificial Sequence
  derived and/or modified sequence opt6 from anti-HIV_CDR
caacaauccggcacaucacuacuaaca

SEQ ID NO: 51760 - RNA, 27 nt, Artificial Sequence
  derived and/or modified sequence opt6 from anti-HIV_CDR
augaaaucacaacacagcccacgcaca

SEQ ID NO: 51761 - RNA, 27 nt, Artificial Sequence
  derived and/or modified sequence opt6 from anti-HIV_CDR
augcaaccacuccaaaccccauacaca

SEQ ID NO: 51762 - RNA, 27 nt, Artificial Sequence
  derived and/or modified sequence opt6 from anti-HIV_CDR
caacaauacacagcauacccauggaca

SEQ ID NO: 51763 - RNA, 27 nt, Artificial Sequence
  derived and/or modified sequence opt6 from anti-HIV_CDR
cuacaaaaccacaacuacccccgcacc

SEQ ID NO: 51764 - RNA, 27 nt, Artificial Sequence
  derived and/or modified sequence opt6 from anti-HIV_CDR
cuacaaacacacucauacccccgcacc

SEQ ID NO: 51765 - RNA, 30 nt, Artificial Sequence
  derived and/or modified sequence opt6 from anti-HIV_CDR
gcugcaugggaugauucauuugauuaugua

SEQ ID NO: 51766 - RNA, 30 nt, Artificial Sequence
  derived and/or modified sequence opt6 from anti-HIV_CDR
caacacucauucggaucaccaccauggaca

SEQ ID NO: 51767 - RNA, 30 nt, Artificial Sequence
  derived and/or modified sequence opt6 from anti-HIV_CDR
ucuucauucacacccacaaacacacucguc

SEQ ID NO: 51768 - RNA, 30 nt, Artificial Sequence
  derived and/or modified sequence opt6 from anti-HIV_CDR
caacaauacggaacacuacacccaagaaca

SEQ ID NO: 51769 - RNA, 30 nt, Artificial Sequence
  derived and/or modified sequence opt6 from anti-HIV_CDR
caacaauacaacaacuggccaccaauaaca

SEQ ID NO: 51770 - RNA, 30 nt, Artificial Sequence
  derived and/or modified sequence opt6 from anti-HIV_CDR
caacaauacuaccaauggcuauccuacacc

SEQ ID NO: 51771 - RNA, 30 nt, Artificial Sequence
  derived and/or modified sequence opt6 from anti-HIV_CDR
caacaaagagcaaacuggcgacuacuaaca

SEQ ID NO: 51772 - RNA, 30 nt, Artificial Sequence
  derived and/or modified sequence opt6 from anti-HIV_CDR
cgucauucugauuauugugauuuagauguu

SEQ ID NO: 51773 - RNA, 30 nt, Artificial Sequence
  derived and/or modified sequence opt6 from anti-HIV_CDR
cguaggucugauuauugugauuuugaugua

SEQ ID NO: 51774 - RNA, 30 nt, Artificial Sequence
  derived and/or modified sequence opt6 from anti-HIV_CDR
agacauacagauuacugugauuuugacguu

SEQ ID NO: 51775 - RNA, 30 nt, Artificial Sequence
  derived and/or modified sequence opt6 from anti-HIV_CDR
cagaggucugauuauugggauuuugaugua

SEQ ID NO: 51776 - RNA, 30 nt, Artificial Sequence
  derived and/or modified sequence opt6 from anti-HIV_CDR
cgucauucugauuauugugauuuugauauu

SEQ ID NO: 51777 - RNA, 30 nt, Artificial Sequence
  derived and/or modified sequence opt6 from anti-HIV_CDR
ugcgaaguagaugcagaugaaacaauaaca

SEQ ID NO: 51778 - RNA, 30 nt, Artificial Sequence
  derived and/or modified sequence opt6 from anti-HIV_CDR
ugugaaguagaugcagaagagacaauaaua

SEQ ID NO: 51779 - RNA, 30 nt, Artificial Sequence
  derived and/or modified sequence opt6 from anti-HIV_CDR
cagaggucugauuuuugggauuuugaugua

SEQ ID NO: 51780 - RNA, 30 nt, Artificial Sequence
  derived and/or modified sequence opt6 from anti-HIV_CDR
cgucauucugauuauugugauuuugauguu

SEQ ID NO: 51781 - RNA, 30 nt, Artificial Sequence
  derived and/or modified sequence opt6 from anti-HIV_CDR
uguucguaugcagggggucguacgguugug

SEQ ID NO: 51782 - RNA, 30 nt, Artificial Sequence
  derived and/or modified sequence opt6 from anti-HIV_CDR
gcugcaugggaugauucauuagauuaugua

SEQ ID NO: 51783 - RNA, 30 nt, Artificial Sequence
  derived and/or modified sequence opt6 from anti-HIV_CDR
caacaaagaucaaacuggccaagacuaaca

SEQ ID NO: 51784 - RNA, 30 nt, Artificial Sequence
  derived and/or modified sequence opt6 from anti-HIV_CDR
caacaauacaacaacuggccaccauucaca

SEQ ID NO: 51785 - RNA, 30 nt, Artificial Sequence
  derived and/or modified sequence opt6 from anti-HIV_CDR
augcaaggaacauacuggccaccauuaaca

SEQ ID NO: 51786 - RNA, 30 nt, Artificial Sequence
  derived and/or modified sequence opt6 from anti-HIV_CDR
caacaauacggcucaucacuacuauacaca

SEQ ID NO: 51787 - RNA, 30 nt, Artificial Sequence
  derived and/or modified sequence opt6 from anti-HIV_CDR
caacaaucuuucgguauaccuccauggaca

SEQ ID NO: 51788 - RNA, 30 nt, Artificial Sequence
  derived and/or modified sequence opt6 from anti-HIV_CDR
uguucguaugcgggcucguauucguaugug

SEQ ID NO: 51789 - RNA, 30 nt, Artificial Sequence
  derived and/or modified sequence opt6 from anti-HIV_CDR
uauucguaugcggguaauaguuugggugug

SEQ ID NO: 51790 - RNA, 30 nt, Artificial Sequence
  derived and/or modified sequence opt6 from anti-HIV_CDR
aguucauacacaaucucaagcccgcgcgua

SEQ ID NO: 51791 - RNA, 30 nt, Artificial Sequence
  derived and/or modified sequence opt6 from anti-HIV_CDR
caagaaugggaauuacagccauuugacuau

SEQ ID NO: 51792 - RNA, 30 nt, Artificial Sequence
  derived and/or modified sequence opt6 from anti-HIV_CDR
uuaauaccuguaucuggagcuuuugaugua

SEQ ID NO: 51793 - RNA, 30 nt, Artificial Sequence
  derived and/or modified sequence opt6 from anti-HIV_CDR
gaucgagauuacgaugaagauuucgauuuc

SEQ ID NO: 51794 - RNA, 30 nt, Artificial Sequence
  derived and/or modified sequence opt6 from anti-HIV_CDR
caagaauacggacgaucaccaccauuucca

SEQ ID NO: 51795 - RNA, 30 nt, Artificial Sequence
  derived and/or modified sequence opt6 from anti-HIV_CDR
acuuuagauggcaauuuccauugggauuuc

SEQ ID NO: 51796 - RNA, 30 nt, Artificial Sequence
  derived and/or modified sequence opt6 from anti-HIV_CDR
uuuacacaaagacaaggcggauucgauuac

SEQ ID NO: 51797 - RNA, 30 nt, Artificial Sequence
  derived and/or modified sequence opt6 from anti-HIV_CDR
caacaauacuacaaauggccaccaauaaca

SEQ ID NO: 51798 - RNA, 30 nt, Artificial Sequence
  derived and/or modified sequence opt6 from anti-HIV_CDR
caacaauacggaucaucagcaccauauaca

SEQ ID NO: 51799 - RNA, 30 nt, Artificial Sequence
  derived and/or modified sequence opt6 from anti-HIV_CDR
caacaacuaaacucagacccaccauggaca

SEQ ID NO: 51800 - RNA, 30 nt, Artificial Sequence
  derived and/or modified sequence opt6 from anti-HIV_CDR
caacaccacggaucaucaccaacauggaca

SEQ ID NO: 51801 - RNA, 30 nt, Artificial Sequence
  derived and/or modified sequence opt6 from anti-HIV_CDR
caacaauacaaaaaauggccaccauggaca

SEQ ID NO: 51802 - RNA, 30 nt, Artificial Sequence
  derived and/or modified sequence opt6 from anti-HIV_CDR
caacaauacggcuuuucauuacccgucaca

SEQ ID NO: 51803 - RNA, 30 nt, Artificial Sequence
  derived and/or modified sequence opt6 from anti-HIV_CDR
caaucauacaacggagacccaccaguaaca

SEQ ID NO: 51804 - RNA, 30 nt, Artificial Sequence
  derived and/or modified sequence opt6 from anti-HIV_CDR
caacaguacggaaguucaagaagauggaca

SEQ ID NO: 51805 - RNA, 30 nt, Artificial Sequence
  derived and/or modified sequence opt6 from anti-HIV_CDR
caacaauucaacuccuaccccccccucacc

SEQ ID NO: 51806 - RNA, 30 nt, Artificial Sequence
  derived and/or modified sequence opt6 from anti-HIV_CDR
agagaaggaagucagggagcauuugauaua

SEQ ID NO: 51807 - RNA, 30 nt, Artificial Sequence
  derived and/or modified sequence opt6 from anti-HIV_CDR
ggagauagugggccgacaggauuugauuau

SEQ ID NO: 51808 - RNA, 30 nt, Artificial Sequence
  derived and/or modified sequence opt6 from anti-HIV_CDR
guaagaagaggcucaaguuauccagauuau

SEQ ID NO: 51809 - RNA, 30 nt, Artificial Sequence
  derived and/or modified sequence opt6 from anti-HIV_CDR
ucugcauauuaccguaauugguuugauuca

SEQ ID NO: 51810 - RNA, 30 nt, Artificial Sequence
  derived and/or modified sequence opt6 from anti-HIV_CDR
caaucuuaugauucaucuguaucugucguu

SEQ ID NO: 51811 - RNA, 30 nt, Artificial Sequence
  derived and/or modified sequence opt6 from anti-HIV_CDR
ucuucauacaccuccucacucacccucguc

SEQ ID NO: 51812 - RNA, 30 nt, Artificial Sequence
  derived and/or modified sequence opt6 from anti-HIV_CDR
uaugaggggaagaggagugggauggaugug

SEQ ID NO: 51813 - RNA, 30 nt, Artificial Sequence
  derived and/or modified sequence opt6 from anti-HIV_CDR
caacaauacggaagcucaccagaauacaca

SEQ ID NO: 51814 - RNA, 30 nt, Artificial Sequence
  derived and/or modified sequence opt6 from anti-HIV_CDR
caauacuacgaccacagaccagcaauagca

SEQ ID NO: 51815 - RNA, 30 nt, Artificial Sequence
  derived and/or modified sequence opt6 from anti-HIV_CDR
caacaauacgacaaccuaccaagaguaaca

SEQ ID NO: 51816 - RNA, 30 nt, Artificial Sequence
  derived and/or modified sequence opt6 from anti-HIV_CDR
ggagcauacacaacaacaagcacgcuagua

SEQ ID NO: 51817 - RNA, 30 nt, Artificial Sequence
  derived and/or modified sequence opt6 from anti-HIV_CDR
caacaauacaaauccuacuccccccucacc

SEQ ID NO: 51818 - RNA, 30 nt, Artificial Sequence
  derived and/or modified sequence opt6 from anti-HIV_CDR
caacaaucauacaacacccgcccacucaca

SEQ ID NO: 51819 - RNA, 30 nt, Artificial Sequence
  derived and/or modified sequence opt6 from anti-HIV_CDR
caacaauauggcggaucaccaccagauaca

SEQ ID NO: 51820 - RNA, 30 nt, Artificial Sequence
  derived and/or modified sequence opt6 from anti-HIV_CDR
uguucauauacaucuucagcuacaguugua

SEQ ID NO: 51821 - RNA, 30 nt, Artificial Sequence
  derived and/or modified sequence opt6 from anti-HIV_CDR
uguucacauacgaguucggacacacuugug

SEQ ID NO: 51822 - RNA, 30 nt, Artificial Sequence
  derived and/or modified sequence opt6 from anti-HIV_CDR
caacacuauggcaauagcccaagaguaaca

SEQ ID NO: 51823 - RNA, 30 nt, Artificial Sequence
  derived and/or modified sequence opt6 from anti-HIV_CDR
gaugcauuuguaaguucggcuauggaugua

SEQ ID NO: 51824 - RNA, 30 nt, Artificial Sequence
  derived and/or modified sequence opt6 from anti-HIV_CDR
uuacgugcaacuacacccggauuugauuau

SEQ ID NO: 51825 - RNA, 30 nt, Artificial Sequence
  derived and/or modified sequence opt6 from anti-HIV_CDR
uuacgugcaacuauacccggauuugauuau

SEQ ID NO: 51826 - RNA, 30 nt, Artificial Sequence
  derived and/or modified sequence opt6 from anti-HIV_CDR
uuaagagcaacaauagccggauuugauuau

SEQ ID NO: 51827 - RNA, 30 nt, Artificial Sequence
  derived and/or modified sequence opt6 from anti-HIV_CDR
uguucguaugcggguucguauauaugggug

SEQ ID NO: 51828 - RNA, 30 nt, Artificial Sequence
  derived and/or modified sequence opt6 from anti-HIV_CDR
uguucguaugcggguacguauucguaugug

SEQ ID NO: 51829 - RNA, 30 nt, Artificial Sequence
  derived and/or modified sequence opt6 from anti-HIV_CDR
aguucguacgcgggcucgaauaauuucgug

SEQ ID NO: 51830 - RNA, 30 nt, Artificial Sequence
  derived and/or modified sequence opt6 from anti-HIV_CDR
ggaucuuucacuacaucucuaacucuaguu

SEQ ID NO: 51831 - RNA, 30 nt, Artificial Sequence
  derived and/or modified sequence opt6 from anti-HIV_CDR
caacaauacgccaccucaucacuauacaca

SEQ ID NO: 51832 - RNA, 30 nt, Artificial Sequence
  derived and/or modified sequence opt6 from anti-HIV_CDR
caaugguacggaacacuacauccaagaaca

SEQ ID NO: 51833 - RNA, 30 nt, Artificial Sequence
  derived and/or modified sequence opt6 from anti-HIV_CDR
aguucguacucgagcacgaacacguacgug

SEQ ID NO: 51834 - RNA, 30 nt, Artificial Sequence
  derived and/or modified sequence opt6 from anti-HIV_CDR
acauuuauaacugcaucuugguuugacucu

SEQ ID NO: 51835 - RNA, 30 nt, Artificial Sequence
  derived and/or modified sequence opt6 from anti-HIV_CDR
acaggaggacuauuaagauuuccagaagua

SEQ ID NO: 51836 - RNA, 30 nt, Artificial Sequence
  derived and/or modified sequence opt6 from anti-HIV_CDR
uguucguaugcgggcucguauacguaugug

SEQ ID NO: 51837 - RNA, 30 nt, Artificial Sequence
  derived and/or modified sequence opt6 from anti-HIV_CDR
caacaaagauacagcuggccaucacuaaca

SEQ ID NO: 51838 - RNA, 30 nt, Artificial Sequence
  derived and/or modified sequence opt6 from anti-HIV_CDR
cuucaaugcggaucuucaccuccauauaca

SEQ ID NO: 51839 - RNA, 30 nt, Artificial Sequence
  derived and/or modified sequence opt6 from anti-HIV_CDR
aguucauaugcaggcacaaaucauugggua

SEQ ID NO: 51840 - RNA, 30 nt, Artificial Sequence
  derived and/or modified sequence opt6 from anti-HIV_CDR
ucuaguuaugcagcuacaaaucacugggua

SEQ ID NO: 51841 - RNA, 30 nt, Artificial Sequence
  derived and/or modified sequence opt6 from anti-HIV_CDR
caauacuacggcacaucaccaccaucaaca

SEQ ID NO: 51842 - RNA, 30 nt, Artificial Sequence
  derived and/or modified sequence opt6 from anti-HIV_CDR
caauacuacggcucaucaccaccaucaaca

SEQ ID NO: 51843 - RNA, 30 nt, Artificial Sequence
  derived and/or modified sequence opt6 from anti-HIV_CDR
caagaauucggacgagcaccaccauaucca

SEQ ID NO: 51844 - RNA, 30 nt, Artificial Sequence
  derived and/or modified sequence opt6 from anti-HIV_CDR
caagaauacggacgaucaccaccauaucca

SEQ ID NO: 51845 - RNA, 30 nt, Artificial Sequence
  derived and/or modified sequence opt6 from anti-HIV_CDR
caagaauacggacgugcaccuccauaucca

SEQ ID NO: 51846 - RNA, 30 nt, Artificial Sequence
  derived and/or modified sequence opt6 from anti-HIV_CDR
cauauagcaguaggaggaagugaagaacau

SEQ ID NO: 51847 - RNA, 30 nt, Artificial Sequence
  derived and/or modified sequence opt6 from anti-HIV_CDR
cauauagcaguaggaggaagugaagaucau

SEQ ID NO: 51848 - RNA, 30 nt, Artificial Sequence
  derived and/or modified sequence opt6 from anti-HIV_CDR
cauauagcaguaggaggaagagaagaagaa

SEQ ID NO: 51849 - RNA, 33 nt, Artificial Sequence
  derived and/or modified sequence opt6 from anti-HIV_CDR
ggagaaaaaaguagaggaaguagggcaguacag

SEQ ID NO: 51850 - RNA, 33 nt, Artificial Sequence
  derived and/or modified sequence opt6 from anti-HIV_CDR
ggagaaaaaucauucgcaagcagggcaguacaa

SEQ ID NO: 51851 - RNA, 33 nt, Artificial Sequence
  derived and/or modified sequence opt6 from anti-HIV_CDR
ggaagacaagcauuaggaaguagggcaguacaa

SEQ ID NO: 51852 - RNA, 33 nt, Artificial Sequence
  derived and/or modified sequence opt6 from anti-HIV_CDR
ggggaggagaguuuggggaguaggagugugaua

SEQ ID NO: 51853 - RNA, 33 nt, Artificial Sequence
  derived and/or modified sequence opt6 from anti-HIV_CDR
ggagaaaaaaguuuaggaaguagggcaguacag

SEQ ID NO: 51854 - RNA, 33 nt, Artificial Sequence
  derived and/or modified sequence opt6 from anti-HIV_CDR
ggaaaagaaaguauaggaaguagggcaguacag

SEQ ID NO: 51855 - RNA, 33 nt, Artificial Sequence
  derived and/or modified sequence opt6 from anti-HIV_CDR
ggagggaacaauauagggagcaagagcgugcau

SEQ ID NO: 51856 - RNA, 33 nt, Artificial Sequence
  derived and/or modified sequence opt6 from anti-HIV_CDR
ggagaaaaaaguauaggaagcagggcaguacaa

SEQ ID NO: 51857 - RNA, 33 nt, Artificial Sequence
  derived and/or modified sequence opt6 from anti-HIV_CDR
aaagcaucacaagacguaucaacagcaguagca

SEQ ID NO: 51858 - RNA, 33 nt, Artificial Sequence
  derived and/or modified sequence opt6 from anti-HIV_CDR
ggcucuagaaauuuaucucaccgucuacuuuca

SEQ ID NO: 51859 - RNA, 33 nt, Artificial Sequence
  derived and/or modified sequence opt6 from anti-HIV_CDR
gggacauaugacagucaaggaaguacaagauua

SEQ ID NO: 51860 - RNA, 33 nt, Artificial Sequence
  derived and/or modified sequence opt6 from anti-HIV_CDR
caacaaagaacaauauggccaccaggauguagc

SEQ ID NO: 51861 - RNA, 33 nt, Artificial Sequence
  derived and/or modified sequence opt6 from anti-HIV_CDR
ggaacaugggauaguucauuaucggcaguauua

SEQ ID NO: 51862 - RNA, 33 nt, Artificial Sequence
  derived and/or modified sequence opt6 from anti-HIV_CDR
gcaucuugggauaauucuuuaucuggaccugua

SEQ ID NO: 51863 - RNA, 33 nt, Artificial Sequence
  derived and/or modified sequence opt6 from anti-HIV_CDR
gcgaguugggaugauaguuugagugggugggug

SEQ ID NO: 51864 - RNA, 33 nt, Artificial Sequence
  derived and/or modified sequence opt6 from anti-HIV_CDR
uuauuauuaccuuauuauggcgguccuuggauu

SEQ ID NO: 51865 - RNA, 33 nt, Artificial Sequence
  derived and/or modified sequence opt6 from anti-HIV_CDR
caacacagaacaaacuggccaccaucaauaaca

SEQ ID NO: 51866 - RNA, 33 nt, Artificial Sequence
  derived and/or modified sequence opt6 from anti-HIV_CDR
cagaguuaugacagaaguuuaagaggaagcgua

SEQ ID NO: 51867 - RNA, 33 nt, Artificial Sequence
  derived and/or modified sequence opt6 from anti-HIV_CDR
agcucgggcaauuacgauuucgcguuugauauc

SEQ ID NO: 51868 - RNA, 33 nt, Artificial Sequence
  derived and/or modified sequence opt6 from anti-HIV_CDR
agcucgggcaauuacgauuucgcguacgauaua

SEQ ID NO: 51869 - RNA, 33 nt, Artificial Sequence
  derived and/or modified sequence opt6 from anti-HIV_CDR
agcucgggcaauuucgaguucgcguuugagauc

SEQ ID NO: 51870 - RNA, 33 nt, Artificial Sequence
  derived and/or modified sequence opt6 from anti-HIV_CDR
gcaacauacgacagucacggaucaauaagacua

SEQ ID NO: 51871 - RNA, 33 nt, Artificial Sequence
  derived and/or modified sequence opt6 from anti-HIV_CDR
ggaacuuacgauacaucucuaucucuacgucua

SEQ ID NO: 51872 - RNA, 33 nt, Artificial Sequence
  derived and/or modified sequence opt6 from anti-HIV_CDR
gccgcuuuugauucugcucuuucucuuccucuu

SEQ ID NO: 51873 - RNA, 33 nt, Artificial Sequence
  derived and/or modified sequence opt6 from anti-HIV_CDR
gcaacauacgacagugacggaucaauaagacua

SEQ ID NO: 51874 - RNA, 33 nt, Artificial Sequence
  derived and/or modified sequence opt6 from anti-HIV_CDR
gcgacauaugacaguggauggaguauaagauua

SEQ ID NO: 51875 - RNA, 33 nt, Artificial Sequence
  derived and/or modified sequence opt6 from anti-HIV_CDR
gcaacauaugacacaggacuaucauuaagacua

SEQ ID NO: 51876 - RNA, 33 nt, Artificial Sequence
  derived and/or modified sequence opt6 from anti-HIV_CDR
gcugccuaugacucuacacuuucacuuagacuu

SEQ ID NO: 51877 - RNA, 33 nt, Artificial Sequence
  derived and/or modified sequence opt6 from anti-HIV_CDR
gcagcuuaugauucagcuguaucuuuaccugua

SEQ ID NO: 51878 - RNA, 33 nt, Artificial Sequence
  derived and/or modified sequence opt6 from anti-HIV_CDR
gcaacauacgacacagaccuaucacuaagacua

SEQ ID NO: 51879 - RNA, 33 nt, Artificial Sequence
  derived and/or modified sequence opt6 from anti-HIV_CDR
gccgccuaugacucaucauuaucacucagacua

SEQ ID NO: 51880 - RNA, 33 nt, Artificial Sequence
  derived and/or modified sequence opt6 from anti-HIV_CDR
gcugccuaugacucuacauuuucacuuccaguu

SEQ ID NO: 51881 - RNA, 33 nt, Artificial Sequence
  derived and/or modified sequence opt6 from anti-HIV_CDR
gcgacauaugacagucaaggaaguacaagauua

SEQ ID NO: 51882 - RNA, 33 nt, Artificial Sequence
  derived and/or modified sequence opt6 from anti-HIV_CDR
gcaacauacgacagccaaagaucaauaagacua

SEQ ID NO: 51883 - RNA, 33 nt, Artificial Sequence
  derived and/or modified sequence opt6 from anti-HIV_CDR
gcuguuuaugauucuucucuuucucuuggucuu

SEQ ID NO: 51884 - RNA, 33 nt, Artificial Sequence
  derived and/or modified sequence opt6 from anti-HIV_CDR
caacauagaucuauauggccacuuauguguaca

SEQ ID NO: 51885 - RNA, 33 nt, Artificial Sequence
  derived and/or modified sequence opt6 from anti-HIV_CDR
uuacagccuguauauauauuuagagguacaugg

SEQ ID NO: 51886 - RNA, 33 nt, Artificial Sequence
  derived and/or modified sequence opt6 from anti-HIV_CDR
ugugaaguagaugcagaugaaacaguaacaugu

SEQ ID NO: 51887 - RNA, 33 nt, Artificial Sequence
  derived and/or modified sequence opt6 from anti-HIV_CDR
ugugaaguagacgcagaaguaacaaugacagua

SEQ ID NO: 51888 - RNA, 33 nt, Artificial Sequence
  derived and/or modified sequence opt6 from anti-HIV_CDR
aguucguaugcggauacgaaugauuuugggguc

SEQ ID NO: 51889 - RNA, 33 nt, Artificial Sequence
  derived and/or modified sequence opt6 from anti-HIV_CDR
ugcucauucacauacguaaacccgaccuaucuc

SEQ ID NO: 51890 - RNA, 33 nt, Artificial Sequence
  derived and/or modified sequence opt6 from anti-HIV_CDR
ggaacaugggauggaaguuuaacgacaggagua

SEQ ID NO: 51891 - RNA, 33 nt, Artificial Sequence
  derived and/or modified sequence opt6 from anti-HIV_CDR
cagaguuaugacaauaguuuaaguggaugggua

SEQ ID NO: 51892 - RNA, 33 nt, Artificial Sequence
  derived and/or modified sequence opt6 from anti-HIV_CDR
caacaauauuacuccauaccccccuggacauuc

SEQ ID NO: 51893 - RNA, 33 nt, Artificial Sequence
  derived and/or modified sequence opt6 from anti-HIV_CDR
augcaaggaacauacuggccaccaucaauaaca

SEQ ID NO: 51894 - RNA, 33 nt, Artificial Sequence
  derived and/or modified sequence opt6 from anti-HIV_CDR
cagaguuaugauaguaguuuagggguagaggua

SEQ ID NO: 51895 - RNA, 33 nt, Artificial Sequence
  derived and/or modified sequence opt6 from anti-HIV_CDR
caagugugggauagcgggagagauagcugggua

SEQ ID NO: 51896 - RNA, 33 nt, Artificial Sequence
  derived and/or modified sequence opt6 from anti-HIV_CDR
caaucuuaugauaguucuuuaucuggcuggguc

SEQ ID NO: 51897 - RNA, 33 nt, Artificial Sequence
  derived and/or modified sequence opt6 from anti-HIV_CDR
gggaguugggaugggaguuugaaugcgggagug

SEQ ID NO: 51898 - RNA, 33 nt, Artificial Sequence
  derived and/or modified sequence opt6 from anti-HIV_CDR
cuuuccgcugacucuuccucuacuuaucaaguu

SEQ ID NO: 51899 - RNA, 33 nt, Artificial Sequence
  derived and/or modified sequence opt6 from anti-HIV_CDR
uguaguuaugcggguagggauacgaguuggguu

SEQ ID NO: 51900 - RNA, 33 nt, Artificial Sequence
  derived and/or modified sequence opt6 from anti-HIV_CDR
caacaaagaucaaacuggccaccaggacuaaca

SEQ ID NO: 51901 - RNA, 33 nt, Artificial Sequence
  derived and/or modified sequence opt6 from anti-HIV_CDR
aaggggaggggguauggguauugguuugauagu

SEQ ID NO: 51902 - RNA, 33 nt, Artificial Sequence
  derived and/or modified sequence opt6 from anti-HIV_CDR
gaaauggcagcaacaucagacgcauuugacaua

SEQ ID NO: 51903 - RNA, 33 nt, Artificial Sequence
  derived and/or modified sequence opt6 from anti-HIV_CDR
ucuauauauucaacuggaccugcaccuguauau

SEQ ID NO: 51904 - RNA, 33 nt, Artificial Sequence
  derived and/or modified sequence opt6 from anti-HIV_CDR
cgcgggagcuugcuaauaaaauauuucgauuac

SEQ ID NO: 51905 - RNA, 33 nt, Artificial Sequence
  derived and/or modified sequence opt6 from anti-HIV_CDR
caacaauacgacaacuuacccccacgcguaacc

SEQ ID NO: 51906 - RNA, 33 nt, Artificial Sequence
  derived and/or modified sequence opt6 from anti-HIV_CDR
gauguaagauuaguagcaguaccgggagcagau

SEQ ID NO: 51907 - RNA, 33 nt, Artificial Sequence
  derived and/or modified sequence opt6 from anti-HIV_CDR
caacaaagaacaacauggccaccagaauacaca

SEQ ID NO: 51908 - RNA, 33 nt, Artificial Sequence
  derived and/or modified sequence opt6 from anti-HIV_CDR
gcggcuugggaugauaguuuaaauggaugggua

SEQ ID NO: 51909 - RNA, 33 nt, Artificial Sequence
  derived and/or modified sequence opt6 from anti-HIV_CDR
agaagaagaucagcauggaguccauucgauagc

SEQ ID NO: 51910 - RNA, 33 nt, Artificial Sequence
  derived and/or modified sequence opt6 from anti-HIV_CDR
gcaacaugggacaguucauuaagaacagcacua

SEQ ID NO: 51911 - RNA, 33 nt, Artificial Sequence
  derived and/or modified sequence opt6 from anti-HIV_CDR
ggaacaugggauaguaguuuaagggcagcauua

SEQ ID NO: 51912 - RNA, 33 nt, Artificial Sequence
  derived and/or modified sequence opt6 from anti-HIV_CDR
caacaaagaucaaucuggccaccaucacuaaca

SEQ ID NO: 51913 - RNA, 33 nt, Artificial Sequence
  derived and/or modified sequence opt6 from anti-HIV_CDR
gaauuucagacgagugggguagugagagaggga

SEQ ID NO: 51914 - RNA, 33 nt, Artificial Sequence
  derived and/or modified sequence opt6 from anti-HIV_CDR
cauauaggugcaggcgggccuuauagugaauau

SEQ ID NO: 51915 - RNA, 33 nt, Artificial Sequence
  derived and/or modified sequence opt6 from anti-HIV_CDR
cgcggacacucauucacaaguccguuugauagu

SEQ ID NO: 51916 - RNA, 33 nt, Artificial Sequence
  derived and/or modified sequence opt6 from anti-HIV_CDR
caacaccuaaacucauacccacgcauguacaca

SEQ ID NO: 51917 - RNA, 33 nt, Artificial Sequence
  derived and/or modified sequence opt6 from anti-HIV_CDR
caacaaagaucaaacuggccaccaaaaauaaca

SEQ ID NO: 51918 - RNA, 33 nt, Artificial Sequence
  derived and/or modified sequence opt6 from anti-HIV_CDR
gcggcaugggaugauaguuuaggaggaguagua

SEQ ID NO: 51919 - RNA, 33 nt, Artificial Sequence
  derived and/or modified sequence opt6 from anti-HIV_CDR
gggacaugggauaguaguuuaagugcaguagua

SEQ ID NO: 51920 - RNA, 33 nt, Artificial Sequence
  derived and/or modified sequence opt6 from anti-HIV_CDR
caacaaagagcaaacuggccaccaggaggaaca

SEQ ID NO: 51921 - RNA, 33 nt, Artificial Sequence
  derived and/or modified sequence opt6 from anti-HIV_CDR
ggaggaggauauccgagaggaaauauggaugua

SEQ ID NO: 51922 - RNA, 33 nt, Artificial Sequence
  derived and/or modified sequence opt6 from anti-HIV_CDR
uuauuauuauuauauuauggcgguccuuggauu

SEQ ID NO: 51923 - RNA, 33 nt, Artificial Sequence
  derived and/or modified sequence opt6 from anti-HIV_CDR
caacaaagaggaauauggccacuacaaauaaca

SEQ ID NO: 51924 - RNA, 33 nt, Artificial Sequence
  derived and/or modified sequence opt6 from anti-HIV_CDR
agaucgccaggaggcggauaugcauuugauaua

SEQ ID NO: 51925 - RNA, 33 nt, Artificial Sequence
  derived and/or modified sequence opt6 from anti-HIV_CDR
agugggccuggauuauuacguggauuugauuau

SEQ ID NO: 51926 - RNA, 33 nt, Artificial Sequence
  derived and/or modified sequence opt6 from anti-HIV_CDR
caacaaagaacaacaagaccaccagaauacaca

SEQ ID NO: 51927 - RNA, 33 nt, Artificial Sequence
  derived and/or modified sequence opt6 from anti-HIV_CDR
caacaaagaacaacaagaccaccagacuacaca

SEQ ID NO: 51928 - RNA, 33 nt, Artificial Sequence
  derived and/or modified sequence opt6 from anti-HIV_CDR
caaggcagaacaacaagaccaccagacuacaca

SEQ ID NO: 51929 - RNA, 33 nt, Artificial Sequence
  derived and/or modified sequence opt6 from anti-HIV_CDR
caacaaagaucaacaacaccaccagaauacaca

SEQ ID NO: 51930 - RNA, 33 nt, Artificial Sequence
  derived and/or modified sequence opt6 from anti-HIV_CDR
caacaaagaacaucauggccacuagcacuauca

SEQ ID NO: 51931 - RNA, 33 nt, Artificial Sequence
  derived and/or modified sequence opt6 from anti-HIV_CDR
cgcggucauucuuuuucucuuccuuuugauucu

SEQ ID NO: 51932 - RNA, 36 nt, Artificial Sequence
  derived and/or modified sequence opt6 from anti-HIV_CDR
cauuauugggauaguagaaguccgauaaguugggua

SEQ ID NO: 51933 - RNA, 36 nt, Artificial Sequence
  derived and/or modified sequence opt6 from anti-HIV_CDR
cauaaaugggauaguagaaguccguuaaguugggua

SEQ ID NO: 51934 - RNA, 36 nt, Artificial Sequence
  derived and/or modified sequence opt6 from anti-HIV_CDR
cauaugugggauaguaggaguggguuuaguuggagu

SEQ ID NO: 51935 - RNA, 36 nt, Artificial Sequence
  derived and/or modified sequence opt6 from anti-HIV_CDR
cauauaugggacaguagaguaccaacaaaaugggua

SEQ ID NO: 51936 - RNA, 36 nt, Artificial Sequence
  derived and/or modified sequence opt6 from anti-HIV_CDR
caaguaugggauaguucaagugaucauccgugggua

SEQ ID NO: 51937 - RNA, 36 nt, Artificial Sequence
  derived and/or modified sequence opt6 from anti-HIV_CDR
cauauauaugacgccagaagaccaacaaacugggua

SEQ ID NO: 51938 - RNA, 36 nt, Artificial Sequence
  derived and/or modified sequence opt6 from anti-HIV_CDR
cuagauggagaggcauuuagauauuauuuagacuua

SEQ ID NO: 51939 - RNA, 36 nt, Artificial Sequence
  derived and/or modified sequence opt6 from anti-HIV_CDR
ccacaauacaaucuaggaagagacccauuagacgua

SEQ ID NO: 51940 - RNA, 36 nt, Artificial Sequence
  derived and/or modified sequence opt6 from anti-HIV_CDR
ccugaaccuucuucuauugucgccccucuuuauuau

SEQ ID NO: 51941 - RNA, 36 nt, Artificial Sequence
  derived and/or modified sequence opt6 from anti-HIV_CDR
ggaggaggagauggaagaaauuggcauuuacauccg

SEQ ID NO: 51942 - RNA, 36 nt, Artificial Sequence
  derived and/or modified sequence opt6 from anti-HIV_CDR
ccaaaaagcggaagagauuacuggaguuuugacuua

SEQ ID NO: 51943 - RNA, 36 nt, Artificial Sequence
  derived and/or modified sequence opt6 from anti-HIV_CDR
ccaagaggaggaagagauaauuggaguuuucaugua

SEQ ID NO: 51944 - RNA, 36 nt, Artificial Sequence
  derived and/or modified sequence opt6 from anti-HIV_CDR
ccacauucaccagaugacgcauggucauuagaugua

SEQ ID NO: 51945 - RNA, 36 nt, Artificial Sequence
  derived and/or modified sequence opt6 from anti-HIV_CDR
ccauuaagaggaggagauacauggcauuaucacuca

SEQ ID NO: 51946 - RNA, 36 nt, Artificial Sequence
  derived and/or modified sequence opt6 from anti-HIV_CDR
cuucaacccguauacauacucagaucuauaugucac

SEQ ID NO: 51947 - RNA, 36 nt, Artificial Sequence
  derived and/or modified sequence opt6 from anti-HIV_CDR
cuucaaccuguauauauacuuaaauguaacuggugc

SEQ ID NO: 51948 - RNA, 36 nt, Artificial Sequence
  derived and/or modified sequence opt6 from anti-HIV_CDR
gaauauagauuugaugacuggggaccguuagaucau

SEQ ID NO: 51949 - RNA, 36 nt, Artificial Sequence
  derived and/or modified sequence opt6 from anti-HIV_CDR
gcggcaugggaugauaguuuaaauggacauggagua

SEQ ID NO: 51950 - RNA, 36 nt, Artificial Sequence
  derived and/or modified sequence opt6 from anti-HIV_CDR
uuauauuuugauugggcuccucaugcuuuugauauu

SEQ ID NO: 51951 - RNA, 36 nt, Artificial Sequence
  derived and/or modified sequence opt6 from anti-HIV_CDR
ggguuguaugauaguaguggguauuauuuuggguau

SEQ ID NO: 51952 - RNA, 36 nt, Artificial Sequence
  derived and/or modified sequence opt6 from anti-HIV_CDR
uugggguguaguggggggaguuguuaugaggauagu

SEQ ID NO: 51953 - RNA, 36 nt, Artificial Sequence
  derived and/or modified sequence opt6 from anti-HIV_CDR
gcuucagguucauauauauuaggaacuauggaugua

SEQ ID NO: 51954 - RNA, 36 nt, Artificial Sequence
  derived and/or modified sequence opt6 from anti-HIV_CDR
uacucaacagacaacucaggcaaacaacacugggua

SEQ ID NO: 51955 - RNA, 36 nt, Artificial Sequence
  derived and/or modified sequence opt6 from anti-HIV_CDR
guuaaacaguucuuagaauggcucuauuuagauuau

SEQ ID NO: 51956 - RNA, 36 nt, Artificial Sequence
  derived and/or modified sequence opt6 from anti-HIV_CDR
ggagugagaucaauagugggagcgcacuuugauuau

SEQ ID NO: 51957 - RNA, 36 nt, Artificial Sequence
  derived and/or modified sequence opt6 from anti-HIV_CDR
gguguggguacgcguuauuauguauauuuugauucg

SEQ ID NO: 51958 - RNA, 36 nt, Artificial Sequence
  derived and/or modified sequence opt6 from anti-HIV_CDR
gcuccauauauaucuucaucucaccuugacuauugg

SEQ ID NO: 51959 - RNA, 36 nt, Artificial Sequence
  derived and/or modified sequence opt6 from anti-HIV_CDR
agagguauagcugcagcuggauuuuauuuucaacau

SEQ ID NO: 51960 - RNA, 36 nt, Artificial Sequence
  derived and/or modified sequence opt6 from anti-HIV_CDR
cguggaauugcagcugcagcuuuuuauuuucaaaca

SEQ ID NO: 51961 - RNA, 36 nt, Artificial Sequence
  derived and/or modified sequence opt6 from anti-HIV_CDR
agaggaauagcggcagcaggauuuuauuuucaaaau

SEQ ID NO: 51962 - RNA, 36 nt, Artificial Sequence
  derived and/or modified sequence opt6 from anti-HIV_CDR
caaucauacgacacaucacuaacagacacaggagua

SEQ ID NO: 51963 - RNA, 36 nt, Artificial Sequence
  derived and/or modified sequence opt6 from anti-HIV_CDR
caaucauaugacacuucauuaucagauacaggcguc

SEQ ID NO: 51964 - RNA, 36 nt, Artificial Sequence
  derived and/or modified sequence opt6 from anti-HIV_CDR
agaacuacacuuguaaauuucgguguauuugaccuu

SEQ ID NO: 51965 - RNA, 36 nt, Artificial Sequence
  derived and/or modified sequence opt6 from anti-HIV_CDR
ccuguaguuaacacuauauuaccauauugugauguc

SEQ ID NO: 51966 - RNA, 36 nt, Artificial Sequence
  derived and/or modified sequence opt6 from anti-HIV_CDR
uguuauucuggucguucucguuauuuuuuugauucu

SEQ ID NO: 51967 - RNA, 36 nt, Artificial Sequence
  derived and/or modified sequence opt6 from anti-HIV_CDR
gcggcaugggaugauaguuuagauggauuuugggua

SEQ ID NO: 51968 - RNA, 36 nt, Artificial Sequence
  derived and/or modified sequence opt6 from anti-HIV_CDR
uugaggaggggguauuaugauaguggggaggauuau

SEQ ID NO: 51969 - RNA, 36 nt, Artificial Sequence
  derived and/or modified sequence opt6 from anti-HIV_CDR
uuaagaaggggauauuuugauagcgggggagaucau

SEQ ID NO: 51970 - RNA, 36 nt, Artificial Sequence
  derived and/or modified sequence opt6 from anti-HIV_CDR
ucuucauauacaucuucaucuacacuuggcguuguc

SEQ ID NO: 51971 - RNA, 36 nt, Artificial Sequence
  derived and/or modified sequence opt6 from anti-HIV_CDR
uuagauggagaggcauuuagauauuauuuugacagu

SEQ ID NO: 51972 - RNA, 36 nt, Artificial Sequence
  derived and/or modified sequence opt6 from anti-HIV_CDR
cgcagaggucagagauuauuagcauauuuugacuau

SEQ ID NO: 51973 - RNA, 36 nt, Artificial Sequence
  derived and/or modified sequence opt6 from anti-HIV_CDR
ccacaauacaaucuaggacgagaaccauuaaacgua

SEQ ID NO: 51974 - RNA, 36 nt, Artificial Sequence
  derived and/or modified sequence opt6 from anti-HIV_CDR
gcucaucaugauuuuuggcgugcaccuguagaugua

SEQ ID NO: 51975 - RNA, 36 nt, Artificial Sequence
  derived and/or modified sequence opt6 from anti-HIV_CDR
gggaggagggagggguugaauuuuuuguuggauuau

SEQ ID NO: 51976 - RNA, 36 nt, Artificial Sequence
  derived and/or modified sequence opt6 from anti-HIV_CDR
ccagaaccaucaucaauagucggcgcacuauauuac

SEQ ID NO: 51977 - RNA, 36 nt, Artificial Sequence
  derived and/or modified sequence opt6 from anti-HIV_CDR
ggaccugaugauuuuuggucagguuauccuaaauau

SEQ ID NO: 51978 - RNA, 36 nt, Artificial Sequence
  derived and/or modified sequence opt6 from anti-HIV_CDR
gauuauucagcugcaggcagacauuuauuugacagu

SEQ ID NO: 51979 - RNA, 36 nt, Artificial Sequence
  derived and/or modified sequence opt6 from anti-HIV_CDR
gacuauacagcuagagguagacauuucuuugacuau

SEQ ID NO: 51980 - RNA, 36 nt, Artificial Sequence
  derived and/or modified sequence opt6 from anti-HIV_CDR
gacuauacagcuucagguagacauuuuuuugacuau

SEQ ID NO: 51981 - RNA, 36 nt, Artificial Sequence
  derived and/or modified sequence opt6 from anti-HIV_CDR
caaucguaugauaguucgcuuucggguucgugggua

SEQ ID NO: 51982 - RNA, 36 nt, Artificial Sequence
  derived and/or modified sequence opt6 from anti-HIV_CDR
ccagcacaagcaggaguaggaccaagauuugauuau

SEQ ID NO: 51983 - RNA, 36 nt, Artificial Sequence
  derived and/or modified sequence opt6 from anti-HIV_CDR
ggugcaauuaacucuucaccucuauauuucgauuca

SEQ ID NO: 51984 - RNA, 36 nt, Artificial Sequence
  derived and/or modified sequence opt6 from anti-HIV_CDR
ggugauauuacuucuucuccucuuuauuuugauuuu

SEQ ID NO: 51985 - RNA, 36 nt, Artificial Sequence
  derived and/or modified sequence opt6 from anti-HIV_CDR
ggugcaauuaacucuucaccuucauauuucgauuca

SEQ ID NO: 51986 - RNA, 36 nt, Artificial Sequence
  derived and/or modified sequence opt6 from anti-HIV_CDR
uggguaguaacggcagcagaagaauauuuugauuau

SEQ ID NO: 51987 - RNA, 39 nt, Artificial Sequence
  derived and/or modified sequence opt6 from anti-HIV_CDR
gacccgcaaguagaaguaagaggaaaugcauucgauaua

SEQ ID NO: 51988 - RNA, 39 nt, Artificial Sequence
  derived and/or modified sequence opt6 from anti-HIV_CDR
gaucauggugauccuagaacuggauauuauuuugauuau

SEQ ID NO: 51989 - RNA, 39 nt, Artificial Sequence
  derived and/or modified sequence opt6 from anti-HIV_CDR
gacgaaagcggauacgaucuaaauuggcaucuagauagu

SEQ ID NO: 51990 - RNA, 39 nt, Artificial Sequence
  derived and/or modified sequence opt6 from anti-HIV_CDR
gauggaaguggagaugauagaaauuggcauuuagauccg

SEQ ID NO: 51991 - RNA, 39 nt, Artificial Sequence
  derived and/or modified sequence opt6 from anti-HIV_CDR
gacagaagagaugacggauuagauugguuauuagaucca

SEQ ID NO: 51992 - RNA, 39 nt, Artificial Sequence
  derived and/or modified sequence opt6 from anti-HIV_CDR
gauggaggaggagaugauaggacaugguuauuagaugca

SEQ ID NO: 51993 - RNA, 39 nt, Artificial Sequence
  derived and/or modified sequence opt6 from anti-HIV_CDR
gacggaaguggagaugcaagagauuggcauuuacaucca

SEQ ID NO: 51994 - RNA, 39 nt, Artificial Sequence
  derived and/or modified sequence opt6 from anti-HIV_CDR
gauggaaguggagaugauacaaguugguauuuagauccg

SEQ ID NO: 51995 - RNA, 39 nt, Artificial Sequence
  derived and/or modified sequence opt6 from anti-HIV_CDR
gauggaucaggagaugauacaaguuggcauuuagauccg

SEQ ID NO: 51996 - RNA, 39 nt, Artificial Sequence
  derived and/or modified sequence opt6 from anti-HIV_CDR
gacagaagagaugacgauagagcaugguuacuagaucca

SEQ ID NO: 51997 - RNA, 39 nt, Artificial Sequence
  derived and/or modified sequence opt6 from anti-HIV_CDR
gacggaaguggagaugcaagagauuggcauuuagaucca

SEQ ID NO: 51998 - RNA, 39 nt, Artificial Sequence
  derived and/or modified sequence opt6 from anti-HIV_CDR
gacgguucaggugaugcuacaucuuggcauuuacaucca

SEQ ID NO: 51999 - RNA, 39 nt, Artificial Sequence
  derived and/or modified sequence opt6 from anti-HIV_CDR
gacgaaucaggagacgacuuaaaauggcauuuacaucca

SEQ ID NO: 52000 - RNA, 39 nt, Artificial Sequence
  derived and/or modified sequence opt6 from anti-HIV_CDR
gaugguucaggugaugauacaaguuggcauuuacauccg

SEQ ID NO: 52001 - RNA, 39 nt, Artificial Sequence
  derived and/or modified sequence opt6 from anti-HIV_CDR
gcacaaggagauauauuaacagaaggauauuucgauuac

SEQ ID NO: 52002 - RNA, 39 nt, Artificial Sequence
  derived and/or modified sequence opt6 from anti-HIV_CDR
gauagaauguucuggcaacagcuagcaaaauaugacuca

SEQ ID NO: 52003 - RNA, 39 nt, Artificial Sequence
  derived and/or modified sequence opt6 from anti-HIV_CDR
ucaacuugggauuauucuuuaucugcacaugaagaugua

SEQ ID NO: 52004 - RNA, 39 nt, Artificial Sequence
  derived and/or modified sequence opt6 from anti-HIV_CDR
gcggcuugggaugauaguuuaaguggauuaaauugggua

SEQ ID NO: 52005 - RNA, 39 nt, Artificial Sequence
  derived and/or modified sequence opt6 from anti-HIV_CDR
cuaucaagugauagaauaguaguagucgggccagauuac

SEQ ID NO: 52006 - RNA, 39 nt, Artificial Sequence
  derived and/or modified sequence opt6 from anti-HIV_CDR
gaagcaggaucaguaacagcaacaggaccauuugauagu

SEQ ID NO: 52007 - RNA, 39 nt, Artificial Sequence
  derived and/or modified sequence opt6 from anti-HIV_CDR
gauuuugggcgugcguaugcgauuggguauuuugaauau

SEQ ID NO: 52008 - RNA, 39 nt, Artificial Sequence
  derived and/or modified sequence opt6 from anti-HIV_CDR
gauagagcuccauauggcgcuuuugaaccauuugacuuu

SEQ ID NO: 52009 - RNA, 39 nt, Artificial Sequence
  derived and/or modified sequence opt6 from anti-HIV_CDR
aauggacauucaaguuuagguggagguuauuuuccgcau

SEQ ID NO: 52010 - RNA, 39 nt, Artificial Sequence
  derived and/or modified sequence opt6 from anti-HIV_CDR
aauggacauagcgcacuaggaggagaauacuuucaacau

SEQ ID NO: 52011 - RNA, 39 nt, Artificial Sequence
  derived and/or modified sequence opt6 from anti-HIV_CDR
gcggcuagacgugcauuuuauuauuauuauauggaugua

SEQ ID NO: 52012 - RNA, 39 nt, Artificial Sequence
  derived and/or modified sequence opt6 from anti-HIV_CDR
gcaaauuauuaugacaguucaggauauggauuagacaua

SEQ ID NO: 52013 - RNA, 39 nt, Artificial Sequence
  derived and/or modified sequence opt6 from anti-HIV_CDR
cauucucguccuggcgcuccuccucauuauuuugauuau

SEQ ID NO: 52014 - RNA, 39 nt, Artificial Sequence
  derived and/or modified sequence opt6 from anti-HIV_CDR
ggauuaacaguagcaacauuauaugaugcauuugaugua

SEQ ID NO: 52015 - RNA, 39 nt, Artificial Sequence
  derived and/or modified sequence opt6 from anti-HIV_CDR
agagauagauauaacuggaaauauuacuaucuagaugua

SEQ ID NO: 52016 - RNA, 39 nt, Artificial Sequence
  derived and/or modified sequence opt6 from anti-HIV_CDR
gauagaggaaguaguggaugguauggaugguuagauccg

SEQ ID NO: 52017 - RNA, 39 nt, Artificial Sequence
  derived and/or modified sequence opt6 from anti-HIV_CDR
gauagguuaaguaguuuuuggaguggagggauagaucag

SEQ ID NO: 52018 - RNA, 39 nt, Artificial Sequence
  derived and/or modified sequence opt6 from anti-HIV_CDR
gacgugauagugggagcgcuauugggagcguucgauaua

SEQ ID NO: 52019 - RNA, 39 nt, Artificial Sequence
  derived and/or modified sequence opt6 from anti-HIV_CDR
cacuuaauagccccaacugccggcaacuauuucuaucca

SEQ ID NO: 52020 - RNA, 39 nt, Artificial Sequence
  derived and/or modified sequence opt6 from anti-HIV_CDR
gacucuagaccucaagcucuaguugcagcucuagaugua

SEQ ID NO: 52021 - RNA, 39 nt, Artificial Sequence
  derived and/or modified sequence opt6 from anti-HIV_CDR
gacgagauagugggagcgcuauugggagcguucgauaua

SEQ ID NO: 52022 - RNA, 39 nt, Artificial Sequence
  derived and/or modified sequence opt6 from anti-HIV_CDR
agcgauccagcaauagcagcagcaggaucacuagaucua

SEQ ID NO: 52023 - RNA, 39 nt, Artificial Sequence
  derived and/or modified sequence opt6 from anti-HIV_CDR
ccauauguccaaacagucgcaacuacaacuuucgacuuc

SEQ ID NO: 52024 - RNA, 39 nt, Artificial Sequence
  derived and/or modified sequence opt6 from anti-HIV_CDR
ggcccuaaaucugucgcuucauuaucauauuucgauaaa

SEQ ID NO: 52025 - RNA, 39 nt, Artificial Sequence
  derived and/or modified sequence opt6 from anti-HIV_CDR
ggagcauuaugguucggacaauuaagaggacuagaucca

SEQ ID NO: 52026 - RNA, 39 nt, Artificial Sequence
  derived and/or modified sequence opt6 from anti-HIV_CDR
gauuuaagaccaaugagaggaaacugggcaaugcaugua

SEQ ID NO: 52027 - RNA, 39 nt, Artificial Sequence
  derived and/or modified sequence opt6 from anti-HIV_CDR
gauccacaaguaaauagaagaggaaauuguuuugaccau

SEQ ID NO: 52028 - RNA, 39 nt, Artificial Sequence
  derived and/or modified sequence opt6 from anti-HIV_CDR
gacccacaaauagaaauaagaggaaaugcauucgacaua

SEQ ID NO: 52029 - RNA, 39 nt, Artificial Sequence
  derived and/or modified sequence opt6 from anti-HIV_CDR
guaccaagaacaacagcaacaagaaacgcauucgacaua

SEQ ID NO: 52030 - RNA, 39 nt, Artificial Sequence
  derived and/or modified sequence opt6 from anti-HIV_CDR
cacaagagcgugcucuugugguuucgcgagcucgauuac

SEQ ID NO: 52031 - RNA, 39 nt, Artificial Sequence
  derived and/or modified sequence opt6 from anti-HIV_CDR
gauagugaggacuaugucgauuauuauuauauggacgug

SEQ ID NO: 52032 - RNA, 39 nt, Artificial Sequence
  derived and/or modified sequence opt6 from anti-HIV_CDR
cuaccaagaacaacaggaauaagaaacgcauucgacaua

SEQ ID NO: 52033 - RNA, 39 nt, Artificial Sequence
  derived and/or modified sequence opt6 from anti-HIV_CDR
cuaccaagaacaacaggaauaagaaacgcauucgacuuc

SEQ ID NO: 52034 - RNA, 42 nt, Artificial Sequence
  derived and/or modified sequence opt6 from anti-HIV_CDR
ggaacauuaugguuuggagaaaguggauuaagauuagaucau

SEQ ID NO: 52035 - RNA, 42 nt, Artificial Sequence
  derived and/or modified sequence opt6 from anti-HIV_CDR
guugcauauguacauguaguuacaacuagaucucuagauaac

SEQ ID NO: 52036 - RNA, 42 nt, Artificial Sequence
  derived and/or modified sequence opt6 from anti-HIV_CDR
gccgauuaugaccuucuuacuucuucuuaucauuuugauucu

SEQ ID NO: 52037 - RNA, 42 nt, Artificial Sequence
  derived and/or modified sequence opt6 from anti-HIV_CDR
acuagauguuuuggugcaaauuguuuuaauuuuauggaugua

SEQ ID NO: 52038 - RNA, 42 nt, Artificial Sequence
  derived and/or modified sequence opt6 from anti-HIV_CDR
gggggguuguauuguaguaguauaaguuguauaauggaugug

SEQ ID NO: 52039 - RNA, 42 nt, Artificial Sequence
  derived and/or modified sequence opt6 from anti-HIV_CDR
aacgaaccacaauaucacucacuaccaggaauguucgacuac

SEQ ID NO: 52040 - RNA, 42 nt, Artificial Sequence
  derived and/or modified sequence opt6 from anti-HIV_CDR
gaaccaagagaaaugggaacauuaacagcaggauuugaauau

SEQ ID NO: 52041 - RNA, 42 nt, Artificial Sequence
  derived and/or modified sequence opt6 from anti-HIV_CDR
gcgacuggauauucauauggauauuuagaugcauuugauauu

SEQ ID NO: 52042 - RNA, 42 nt, Artificial Sequence
  derived and/or modified sequence opt6 from anti-HIV_CDR
ggaaguuugugguuuggagagaguggguuaagguuagaucau

SEQ ID NO: 52043 - RNA, 42 nt, Artificial Sequence
  derived and/or modified sequence opt6 from anti-HIV_CDR
gauaauacaauaucaggaguaguaccgagaugguucgauuau

SEQ ID NO: 52044 - RNA, 42 nt, Artificial Sequence
  derived and/or modified sequence opt6 from anti-HIV_CDR
auuuaugacggucgugguuauuauaguuauuuuuuugauuug

SEQ ID NO: 52045 - RNA, 42 nt, Artificial Sequence
  derived and/or modified sequence opt6 from anti-HIV_CDR
gauagguuuaauuggaaugaugggggguauuuuuuugauagu

SEQ ID NO: 52046 - RNA, 42 nt, Artificial Sequence
  derived and/or modified sequence opt6 from anti-HIV_CDR
ggacauucaaguucauggacaaaauuuaauugguuuggacca

SEQ ID NO: 52047 - RNA, 42 nt, Artificial Sequence
  derived and/or modified sequence opt6 from anti-HIV_CDR
ucuauagcugcagaugacuauuacuauuauuauauggaugua

SEQ ID NO: 52048 - RNA, 42 nt, Artificial Sequence
  derived and/or modified sequence opt6 from anti-HIV_CDR
aguuuuuaugauaauggugguuauuauuuggguuuggauuau

SEQ ID NO: 52049 - RNA, 42 nt, Artificial Sequence
  derived and/or modified sequence opt6 from anti-HIV_CDR
gauaaagaugcaucaauauauggauacagaauacuaaaucac

SEQ ID NO: 52050 - RNA, 42 nt, Artificial Sequence
  derived and/or modified sequence opt6 from anti-HIV_CDR
guauuaacagaucuagaucaaggaaacccaagaauggacgua

SEQ ID NO: 52051 - RNA, 42 nt, Artificial Sequence
  derived and/or modified sequence opt6 from anti-HIV_CDR
agggaaauuaaauuuggagagcuaucguucuauuucgauagc

SEQ ID NO: 52052 - RNA, 42 nt, Artificial Sequence
  derived and/or modified sequence opt6 from anti-HIV_CDR
agggagauuagguuuggggaguugaguuuuuauuuugauuau

SEQ ID NO: 52053 - RNA, 42 nt, Artificial Sequence
  derived and/or modified sequence opt6 from anti-HIV_CDR
ccacauucacccacaaacauacccucacgcccacucgacuac

SEQ ID NO: 52054 - RNA, 42 nt, Artificial Sequence
  derived and/or modified sequence opt6 from anti-HIV_CDR
ggcgauuacgauauacuuacaucuucauaucaauuugacuau

SEQ ID NO: 52055 - RNA, 42 nt, Artificial Sequence
  derived and/or modified sequence opt6 from anti-HIV_CDR
ucaacaccacuaguauggccaccagcaaacggacuagaugua

SEQ ID NO: 52056 - RNA, 42 nt, Artificial Sequence
  derived and/or modified sequence opt6 from anti-HIV_CDR
acaagaaauacaggaaacucacuaccauacugguucgaccua

SEQ ID NO: 52057 - RNA, 45 nt, Artificial Sequence
  derived and/or modified sequence opt6 from anti-HIV_CDR
gaaaaaggccaauggcuaacaguaccaccauacuauuuugacuca

SEQ ID NO: 52058 - RNA, 45 nt, Artificial Sequence
  derived and/or modified sequence opt6 from anti-HIV_CDR
ggaaguggaagauggacaauaggggcaagaauauauuuugauaau

SEQ ID NO: 52059 - RNA, 45 nt, Artificial Sequence
  derived and/or modified sequence opt6 from anti-HIV_CDR
cuagaagcagauggagcagacuauagcccaaaaauguucgauuuc

SEQ ID NO: 52060 - RNA, 45 nt, Artificial Sequence
  derived and/or modified sequence opt6 from anti-HIV_CDR
uuagaagcagauggaggagacuauaguccaaaaauguuugauuac

SEQ ID NO: 52061 - RNA, 45 nt, Artificial Sequence
  derived and/or modified sequence opt6 from anti-HIV_CDR
cuagaagcagauggagauaacuauagcccaaaaaugguagauuac

SEQ ID NO: 52062 - RNA, 45 nt, Artificial Sequence
  derived and/or modified sequence opt6 from anti-HIV_CDR
cuagaagcagauggagaugacuauagcccaaaaauguucgauuac

SEQ ID NO: 52063 - RNA, 45 nt, Artificial Sequence
  derived and/or modified sequence opt6 from anti-HIV_CDR
cuagaagcagauggaucagacuauagcccaaaaauguucgauuuc

SEQ ID NO: 52064 - RNA, 45 nt, Artificial Sequence
  derived and/or modified sequence opt6 from anti-HIV_CDR
cuagaagcagauggagaugacuauagcccaaaaauguucgaucac

SEQ ID NO: 52065 - RNA, 45 nt, Artificial Sequence
  derived and/or modified sequence opt6 from anti-HIV_CDR
cuagaagcagauggagaugacuauagcccaaaaaugguagauuac

SEQ ID NO: 52066 - RNA, 45 nt, Artificial Sequence
  derived and/or modified sequence opt6 from anti-HIV_CDR
gcuccucguuuagauuuaggugaauuaucuucugguuuucauuuu

SEQ ID NO: 52067 - RNA, 45 nt, Artificial Sequence
  derived and/or modified sequence opt6 from anti-HIV_CDR
gcgccaagacuagaauuaggagaauuaaguucaggauuucauuau

SEQ ID NO: 52068 - RNA, 45 nt, Artificial Sequence
  derived and/or modified sequence opt6 from anti-HIV_CDR
ggaagauuauuaaugcaauggccaccaagaggaggauuugaccca

SEQ ID NO: 52069 - RNA, 45 nt, Artificial Sequence
  derived and/or modified sequence opt6 from anti-HIV_CDR
ggaagauuauuuaugcaauggccaccaagaggaggauuugaucca

SEQ ID NO: 52070 - RNA, 45 nt, Artificial Sequence
  derived and/or modified sequence opt6 from anti-HIV_CDR
ggaagauuauuuguacaauggccaccacaaggaggauuugaucca

SEQ ID NO: 52071 - RNA, 45 nt, Artificial Sequence
  derived and/or modified sequence opt6 from anti-HIV_CDR
ggaagauuauuuaugcaauggccaccacaaggaggauuugaucca

SEQ ID NO: 52072 - RNA, 45 nt, Artificial Sequence
  derived and/or modified sequence opt6 from anti-HIV_CDR
ggaagauuauuuguacaauggccaccacaaggaggauuugauaca

SEQ ID NO: 52073 - RNA, 45 nt, Artificial Sequence
  derived and/or modified sequence opt6 from anti-HIV_CDR
aauaacaauacaagaaaaucaauaaacauaggaccaggaagagca

SEQ ID NO: 52074 - RNA, 45 nt, Artificial Sequence
  derived and/or modified sequence opt6 from anti-HIV_CDR
cccggauacugcaauaacaauauauguacacacugguuugacacu

SEQ ID NO: 52075 - RNA, 45 nt, Artificial Sequence
  derived and/or modified sequence opt6 from anti-HIV_CDR
gaccuauuaccagauuacccagucucaucagcaccagaagacuuu

SEQ ID NO: 52076 - RNA, 45 nt, Artificial Sequence
  derived and/or modified sequence opt6 from anti-HIV_CDR
gagagcuggcuauauagcaauggagauuacuauuacauggacgug

SEQ ID NO: 52077 - RNA, 45 nt, Artificial Sequence
  derived and/or modified sequence opt6 from anti-HIV_CDR
cguuauuguucaucuacaacuuguuacagaggucauuuugauuau

SEQ ID NO: 52078 - RNA, 45 nt, Artificial Sequence
  derived and/or modified sequence opt6 from anti-HIV_CDR
caaacaacagaugaaggaagacaauggcuaguaggauuucaacau

SEQ ID NO: 52079 - RNA, 45 nt, Artificial Sequence
  derived and/or modified sequence opt6 from anti-HIV_CDR
ccuaguuauggagguuaugaugaucaaggaugguauuuugaauau

SEQ ID NO: 52080 - RNA, 45 nt, Artificial Sequence
  derived and/or modified sequence opt6 from anti-HIV_CDR
gcagcuauaccuauaggugacucuaaauauucauauuucgauuca

SEQ ID NO: 52081 - RNA, 45 nt, Artificial Sequence
  derived and/or modified sequence opt6 from anti-HIV_CDR
gcuccaccuccagguucaacugaaugggcauauuauuuugauuau

SEQ ID NO: 52082 - RNA, 45 nt, Artificial Sequence
  derived and/or modified sequence opt6 from anti-HIV_CDR
gcccaauuucauaauucuggcuauuauuauuccggucuugauuau

SEQ ID NO: 52083 - RNA, 45 nt, Artificial Sequence
  derived and/or modified sequence opt6 from anti-HIV_CDR
ggggguuaugauuauggugaucauuauuauuauuauauggaugug

SEQ ID NO: 52084 - RNA, 45 nt, Artificial Sequence
  derived and/or modified sequence opt6 from anti-HIV_CDR
ggaacucaaucuuauucugcaguugcaccuggaugguuugaucca

SEQ ID NO: 52085 - RNA, 45 nt, Artificial Sequence
  derived and/or modified sequence opt6 from anti-HIV_CDR
auaaaaggaccaccaagaggaaauuuuggaguagcauuuuacuuu

SEQ ID NO: 52086 - RNA, 45 nt, Artificial Sequence
  derived and/or modified sequence opt6 from anti-HIV_CDR
aaaguauauucagauggauggucaccuccaacuggauuuguauau

SEQ ID NO: 52087 - RNA, 45 nt, Artificial Sequence
  derived and/or modified sequence opt6 from anti-HIV_CDR
agauauaaauaucuaccuggagaucaacauaugccuugggauaac

SEQ ID NO: 52088 - RNA, 45 nt, Artificial Sequence
  derived and/or modified sequence opt6 from anti-HIV_CDR
agauauaaauaucuaccuggagaucaacauaugccuugggauuac

SEQ ID NO: 52089 - RNA, 45 nt, Artificial Sequence
  derived and/or modified sequence opt6 from anti-HIV_CDR
ggaggaggauaugcaguaguaggaccgaaauauggauuagaugua

SEQ ID NO: 52090 - RNA, 45 nt, Artificial Sequence
  derived and/or modified sequence opt6 from anti-HIV_CDR
uuagauagcaguagugggugggaggaagugggauauuucgauaga

SEQ ID NO: 52091 - RNA, 45 nt, Artificial Sequence
  derived and/or modified sequence opt6 from anti-HIV_CDR
gagaauuauagugauggaugggaagagguagggcauuuugauuau

SEQ ID NO: 52092 - RNA, 45 nt, Artificial Sequence
  derived and/or modified sequence opt6 from anti-HIV_CDR
gagaauuauagugauggaugggaagagguagggcauuuugauagu

SEQ ID NO: 52093 - RNA, 45 nt, Artificial Sequence
  derived and/or modified sequence opt6 from anti-HIV_CDR
gagaauuauagugauggauggaaugagguagggcauuuugacuuu

SEQ ID NO: 52094 - RNA, 45 nt, Artificial Sequence
  derived and/or modified sequence opt6 from anti-HIV_CDR
gagaauuauagugauggaugguaugagguagggcauuuugacuug

SEQ ID NO: 52095 - RNA, 45 nt, Artificial Sequence
  derived and/or modified sequence opt6 from anti-HIV_CDR
gauagaaggagauuucuagaguggucgcuauauggaauggacgug

SEQ ID NO: 52096 - RNA, 45 nt, Artificial Sequence
  derived and/or modified sequence opt6 from anti-HIV_CDR
gguccacguguauuuuuugaaucaucuggauauuauuuuagagau

SEQ ID NO: 52097 - RNA, 45 nt, Artificial Sequence
  derived and/or modified sequence opt6 from anti-HIV_CDR
ggaccgagaguauuauuugaaaguaguggacauuauuuaagagau

SEQ ID NO: 52098 - RNA, 45 nt, Artificial Sequence
  derived and/or modified sequence opt6 from anti-HIV_CDR
gguccacguguauuuuuugaaucaucuggauauuauuuuagaaau

SEQ ID NO: 52099 - RNA, 45 nt, Artificial Sequence
  derived and/or modified sequence opt6 from anti-HIV_CDR
gaaggaggaaguuuaugguuuggaggagcaaauugguuagaucca

SEQ ID NO: 52100 - RNA, 45 nt, Artificial Sequence
  derived and/or modified sequence opt6 from anti-HIV_CDR
gcggauuaugauaauauaugggauaguagagggggauuugauuug

SEQ ID NO: 52101 - RNA, 45 nt, Artificial Sequence
  derived and/or modified sequence opt6 from anti-HIV_CDR
guaggggggacgguauggaguggguauaguaauuauuuagauuau

SEQ ID NO: 52102 - RNA, 45 nt, Artificial Sequence
  derived and/or modified sequence opt6 from anti-HIV_CDR
gacaauagagaucaauggcuaguacuaagaagcugguucgaucca

SEQ ID NO: 52103 - RNA, 45 nt, Artificial Sequence
  derived and/or modified sequence opt6 from anti-HIV_CDR
gaaaaaggccaauggguaacauuaccaccauacuauuuugacuca

SEQ ID NO: 52104 - RNA, 48 nt, Artificial Sequence
  derived and/or modified sequence opt6 from anti-HIV_CDR
uacuuuuccgauaccgaucgcucugaauauucaccuucacuucgcucu

SEQ ID NO: 52105 - RNA, 48 nt, Artificial Sequence
  derived and/or modified sequence opt6 from anti-HIV_CDR
uacauauccgaccgcgaauccgcaaccuacaacccaucccuaaacuca

SEQ ID NO: 52106 - RNA, 48 nt, Artificial Sequence
  derived and/or modified sequence opt6 from anti-HIV_CDR
uacuucuccgacaccgaaaaaucaaacuacaacccaucacuacgcuca

SEQ ID NO: 52107 - RNA, 48 nt, Artificial Sequence
  derived and/or modified sequence opt6 from anti-HIV_CDR
uacauauccgaccgcgcauccgcaaccuacaacccaucccuaaacuca

SEQ ID NO: 52108 - RNA, 48 nt, Artificial Sequence
  derived and/or modified sequence opt6 from anti-HIV_CDR
uacguacaccacucaggagacacaaacuacaauccaucacuaaaaaga

SEQ ID NO: 52109 - RNA, 48 nt, Artificial Sequence
  derived and/or modified sequence opt6 from anti-HIV_CDR
uacguacacaaauccggagacacaaacuacucaccaucacuaaaauca

SEQ ID NO: 52110 - RNA, 48 nt, Artificial Sequence
  derived and/or modified sequence opt6 from anti-HIV_CDR
uacguacacgacagcggagacacaaacuauaacccaagccuaaaauca

SEQ ID NO: 52111 - RNA, 48 nt, Artificial Sequence
  derived and/or modified sequence opt6 from anti-HIV_CDR
uacauaagcaaaagcgaaagcgcaaacuauaacccgagcuuaaacuca

SEQ ID NO: 52112 - RNA, 48 nt, Artificial Sequence
  derived and/or modified sequence opt6 from anti-HIV_CDR
uacauauacuacuccggcuccacaaacuacaaccccucccucaaauca

SEQ ID NO: 52113 - RNA, 48 nt, Artificial Sequence
  derived and/or modified sequence opt6 from anti-HIV_CDR
uacguacacgacuccggagacauaaacuacaacccaucacuaaaaaac

SEQ ID NO: 52114 - RNA, 48 nt, Artificial Sequence
  derived and/or modified sequence opt6 from anti-HIV_CDR
aguuauuaugauuuuaguauaggagauggaaaugaugcguuugaugua

SEQ ID NO: 52115 - RNA, 48 nt, Artificial Sequence
  derived and/or modified sequence opt6 from anti-HIV_CDR
gguuuucguggaucuccauuuucaucuggaucuuuauauuuugauuca

SEQ ID NO: 52116 - RNA, 48 nt, Artificial Sequence
  derived and/or modified sequence opt6 from anti-HIV_CDR
guuauaucuggccguauaacuauauuuuacuauaacuauauagaugua

SEQ ID NO: 52117 - RNA, 48 nt, Artificial Sequence
  derived and/or modified sequence opt6 from anti-HIV_CDR
gauggauuaggagaaguagcgccagauuauagauauggaauagaugua

SEQ ID NO: 52118 - RNA, 48 nt, Artificial Sequence
  derived and/or modified sequence opt6 from anti-HIV_CDR
gauggauuaggagaacuagcaccagcauaucaauacggaauagaugua

SEQ ID NO: 52119 - RNA, 48 nt, Artificial Sequence
  derived and/or modified sequence opt6 from anti-HIV_CDR
gauggauuaggagaacuagcaccagcauaucauuacggaauagaugua

SEQ ID NO: 52120 - RNA, 48 nt, Artificial Sequence
  derived and/or modified sequence opt6 from anti-HIV_CDR
gauggauuaggagaaguagcaccagcauauuuauauggaauagaugca

SEQ ID NO: 52121 - RNA, 48 nt, Artificial Sequence
  derived and/or modified sequence opt6 from anti-HIV_CDR
gcaguaaaaggauuuugguuugaugaaguauauaauugguuugggcca

SEQ ID NO: 52122 - RNA, 48 nt, Artificial Sequence
  derived and/or modified sequence opt6 from anti-HIV_CDR
gcuguaaaaggauuuugguuugaugauccauauacaugguuuggucca

SEQ ID NO: 52123 - RNA, 48 nt, Artificial Sequence
  derived and/or modified sequence opt6 from anti-HIV_CDR
gcaguaaaaggauuuugguuugaugaaccaaguacaugguuuggacca

SEQ ID NO: 52124 - RNA, 48 nt, Artificial Sequence
  derived and/or modified sequence opt6 from anti-HIV_CDR
gcaguaaaaggauuaugguuugaugaaacauauacaugguucggacca

SEQ ID NO: 52125 - RNA, 48 nt, Artificial Sequence
  derived and/or modified sequence opt6 from anti-HIV_CDR
gcaguagcuggauuaugguuugaagaugcauauaauugguuuggacca

SEQ ID NO: 52126 - RNA, 48 nt, Artificial Sequence
  derived and/or modified sequence opt6 from anti-HIV_CDR
gcagaagcagaaucacaaucacacucaagaccaauaauguucgacuac

SEQ ID NO: 52127 - RNA, 48 nt, Artificial Sequence
  derived and/or modified sequence opt6 from anti-HIV_CDR
gcagaagcagcaucagacucacacucaagaccaauaauguuugaucau

SEQ ID NO: 52128 - RNA, 48 nt, Artificial Sequence
  derived and/or modified sequence opt6 from anti-HIV_CDR
cuagaagcagaaucagacucacacucaagaccaauaauguuugaccau

SEQ ID NO: 52129 - RNA, 48 nt, Artificial Sequence
  derived and/or modified sequence opt6 from anti-HIV_CDR
gcagaagcagaaucacaaucacacucaagaccaauaauguucgacagc

SEQ ID NO: 52130 - RNA, 48 nt, Artificial Sequence
  derived and/or modified sequence opt6 from anti-HIV_CDR
gcagaagcagaaucacaaucacacucaagaccaauaauguucgacuuc

SEQ ID NO: 52131 - RNA, 48 nt, Artificial Sequence
  derived and/or modified sequence opt6 from anti-HIV_CDR
gacaacccacuauuacaaucaggcgaauucucaagcucacuagaaaac

SEQ ID NO: 52132 - RNA, 48 nt, Artificial Sequence
  derived and/or modified sequence opt6 from anti-HIV_CDR
gacaacccacuauuacaaucaggcgaauucucaagcucacuagacaac

SEQ ID NO: 52133 - RNA, 48 nt, Artificial Sequence
  derived and/or modified sequence opt6 from anti-HIV_CDR
ggaagagauuauaauuuuuggggaggaggaggaaaaauaaauuuuccg

SEQ ID NO: 52134 - RNA, 48 nt, Artificial Sequence
  derived and/or modified sequence opt6 from anti-HIV_CDR
acaaauugggcuaacgauuucguuacagguuacuauagauuugacuuu

SEQ ID NO: 52135 - RNA, 48 nt, Artificial Sequence
  derived and/or modified sequence opt6 from anti-HIV_CDR
gcaggacauugcucaagcacaagcucaguauauugcccauucgauaug

SEQ ID NO: 52136 - RNA, 48 nt, Artificial Sequence
  derived and/or modified sequence opt6 from anti-HIV_CDR
cagguaucaaguuauagcucaagcggauacagaagagaauucgauuac

SEQ ID NO: 52137 - RNA, 48 nt, Artificial Sequence
  derived and/or modified sequence opt6 from anti-HIV_CDR
cguauggcuacacuuacagguggauauuauuauuauuauauggaugua

SEQ ID NO: 52138 - RNA, 48 nt, Artificial Sequence
  derived and/or modified sequence opt6 from anti-HIV_CDR
gaggggggguauagugauuuuuggaguggguauaguggguuugauuau

SEQ ID NO: 52139 - RNA, 48 nt, Artificial Sequence
  derived and/or modified sequence opt6 from anti-HIV_CDR
uuauauuauaauuuugguucggguuaugauacggguauaggugaucau

SEQ ID NO: 52140 - RNA, 48 nt, Artificial Sequence
  derived and/or modified sequence opt6 from anti-HIV_CDR
gcgagagagggaaggugguuuagugauaauuauuacgcgauggaugua

SEQ ID NO: 52141 - RNA, 48 nt, Artificial Sequence
  derived and/or modified sequence opt6 from anti-HIV_CDR
gauaggguagggagaagguuaggggaauugagugcgggauuugauuau

SEQ ID NO: 52142 - RNA, 48 nt, Artificial Sequence
  derived and/or modified sequence opt6 from anti-HIV_CDR
gcaagaccaagaaguccaugggauaguacaggauggaguguaggauau

SEQ ID NO: 52143 - RNA, 48 nt, Artificial Sequence
  derived and/or modified sequence opt6 from anti-HIV_CDR
ucuuauuaugauuuuagaucugauucugguaaugaugcuuuugauauu

SEQ ID NO: 52144 - RNA, 48 nt, Artificial Sequence
  derived and/or modified sequence opt6 from anti-HIV_CDR
ucauauuacgauuuccaaacagauucagguaacgaugcauuugacguu

SEQ ID NO: 52145 - RNA, 48 nt, Artificial Sequence
  derived and/or modified sequence opt6 from anti-HIV_CDR
gauaacccaguauuacaauuaggagaacuaucaagcucacuagacuac

SEQ ID NO: 52146 - RNA, 48 nt, Artificial Sequence
  derived and/or modified sequence opt6 from anti-HIV_CDR
gguuuucguggaucuccauuuucaucuggaucuauguauuuugauuca

SEQ ID NO: 52147 - RNA, 48 nt, Artificial Sequence
  derived and/or modified sequence opt6 from anti-HIV_CDR
gguuuucgugguucuccucuuucuucugguucucuuuauuuugauucu

SEQ ID NO: 52148 - RNA, 48 nt, Artificial Sequence
  derived and/or modified sequence opt6 from anti-HIV_CDR
gguuuucguggaaauguauuuucgacuggaugguuuuauuuagauuuu

SEQ ID NO: 52149 - RNA, 48 nt, Artificial Sequence
  derived and/or modified sequence opt6 from anti-HIV_CDR
gaucgacucagcuuuagcguacaaguagaacagggcguauuagauuac

SEQ ID NO: 52150 - RNA, 48 nt, Artificial Sequence
  derived and/or modified sequence opt6 from anti-HIV_CDR
gaucgcuuaaguuuuagcguacaaguagaacaaggcguacuccaauuu

SEQ ID NO: 52151 - RNA, 48 nt, Artificial Sequence
  derived and/or modified sequence opt6 from anti-HIV_CDR
guucuaucuggacguauaacuauauuuuacuauuacuauauggaugua

SEQ ID NO: 52152 - RNA, 51 nt, Artificial Sequence
  derived and/or modified sequence opt6 from anti-HIV_CDR
uauauaucuucagguucaucuacacuucacuaugcagauacaguuaaaggu

SEQ ID NO: 52153 - RNA, 51 nt, Artificial Sequence
  derived and/or modified sequence opt6 from anti-HIV_CDR
agauauuuagauuggaguccaauaggaagagauacauauggaacagaugua

SEQ ID NO: 52154 - RNA, 51 nt, Artificial Sequence
  derived and/or modified sequence opt6 from anti-HIV_CDR
agauauuucgauuggucaccauuuagaagagacacauacggaacagaugua

SEQ ID NO: 52155 - RNA, 51 nt, Artificial Sequence
  derived and/or modified sequence opt6 from anti-HIV_CDR
gggagggauuauaauuuuuggagugggggggggagguauuauuuugauuuu

SEQ ID NO: 52156 - RNA, 51 nt, Artificial Sequence
  derived and/or modified sequence opt6 from anti-HIV_CDR
ggaauacaagaagacuaugauuucuggagagaauacagagaauuagacuau

SEQ ID NO: 52157 - RNA, 51 nt, Artificial Sequence
  derived and/or modified sequence opt6 from anti-HIV_CDR
guacuaaauaacaauacaagaaaaucaauaaacauaggaccaggaagagca

SEQ ID NO: 52158 - RNA, 51 nt, Artificial Sequence
  derived and/or modified sequence opt6 from anti-HIV_CDR
gaucuuaauuucggugucguuacuccuuauuauuauuauuauuuagacguu

SEQ ID NO: 52159 - RNA, 51 nt, Artificial Sequence
  derived and/or modified sequence opt6 from anti-HIV_CDR
caugguagaacuguauuuggaguuguacguaauuauuauuauauggaugua

SEQ ID NO: 52160 - RNA, 51 nt, Artificial Sequence
  derived and/or modified sequence opt6 from anti-HIV_CDR
cacuauuacggcucaggacuaacaaaagacuacuaugaauauauagacgua

SEQ ID NO: 52161 - RNA, 51 nt, Artificial Sequence
  derived and/or modified sequence opt6 from anti-HIV_CDR
acauauuacaauuucuggucagaucaaucucaaggucuagauuucgauuac

SEQ ID NO: 52162 - RNA, 51 nt, Artificial Sequence
  derived and/or modified sequence opt6 from anti-HIV_CDR
ggaguaugggaagcaccagauggaaguaguuauuauuauuauauggcagau

SEQ ID NO: 52163 - RNA, 51 nt, Artificial Sequence
  derived and/or modified sequence opt6 from anti-HIV_CDR
gaucaaggaggauauccaguaaguccaguaggaccaaaaugguuugaucca

SEQ ID NO: 52164 - RNA, 51 nt, Artificial Sequence
  derived and/or modified sequence opt6 from anti-HIV_CDR
agagauaaauaucaauauauagauagcucaggcgauuacccguucgauaga

SEQ ID NO: 52165 - RNA, 51 nt, Artificial Sequence
  derived and/or modified sequence opt6 from anti-HIV_CDR
caacuaagagcaccaacaacaagauucagacacggaggauacuucgaaaau

SEQ ID NO: 52166 - RNA, 51 nt, Artificial Sequence
  derived and/or modified sequence opt6 from anti-HIV_CDR
caaguaagagcaccaacacuaagauucagacacggaggauauuucgaaaca

SEQ ID NO: 52167 - RNA, 51 nt, Artificial Sequence
  derived and/or modified sequence opt6 from anti-HIV_CDR
guaucuauaacuuaugcuggauuaauaguuguaccuggagcuuuugaugua

SEQ ID NO: 52168 - RNA, 51 nt, Artificial Sequence
  derived and/or modified sequence opt6 from anti-HIV_CDR
guagcuauaucuuaugcuggauuaauaguuguaccuggaccuuuugaugua

SEQ ID NO: 52169 - RNA, 51 nt, Artificial Sequence
  derived and/or modified sequence opt6 from anti-HIV_CDR
agcuuaacaggaagauuacacuuaggagaacuaucaagcggaauaggacca

SEQ ID NO: 52170 - RNA, 51 nt, Artificial Sequence
  derived and/or modified sequence opt6 from anti-HIV_CDR
ggaggaagcgcacuaauaacaauauucggaguagauccaaaauucgaucca

SEQ ID NO: 52171 - RNA, 51 nt, Artificial Sequence
  derived and/or modified sequence opt6 from anti-HIV_CDR
auggcauuaacaagcgggccauaugacguaagcggauauuauuuugauuau

SEQ ID NO: 52172 - RNA, 51 nt, Artificial Sequence
  derived and/or modified sequence opt6 from anti-HIV_CDR
auggcauuagcaagcgggccauaugacguaagcggauauuauuuugauuau

SEQ ID NO: 52173 - RNA, 51 nt, Artificial Sequence
  derived and/or modified sequence opt6 from anti-HIV_CDR
auggcauuaccaucaggaccacuagauagaucaggauauuacuuugacgau

SEQ ID NO: 52174 - RNA, 54 nt, Artificial Sequence
  derived and/or modified sequence opt6 from anti-HIV_CDR
guuguuccuauguuuucuauuuuugguguuguuaaagcuaauuauuuugauuau

SEQ ID NO: 52175 - RNA, 54 nt, Artificial Sequence
  derived and/or modified sequence opt6 from anti-HIV_CDR
aauagacguguagcuaugccugaagcuaugauuuuaaguuuuuauauggaugua

SEQ ID NO: 52176 - RNA, 54 nt, Artificial Sequence
  derived and/or modified sequence opt6 from anti-HIV_CDR
ggauuauguagaggaggaaauuguagauuaggaccaaguggaugguuagaucca

SEQ ID NO: 52177 - RNA, 54 nt, Artificial Sequence
  derived and/or modified sequence opt6 from anti-HIV_CDR
acaccuccacauuacgacguacuuacaggcuacccuucaucuguacuugaauuu

SEQ ID NO: 52178 - RNA, 54 nt, Artificial Sequence
  derived and/or modified sequence opt6 from anti-HIV_CDR
auaccauaccauucagaaucauauuacaaaguaguaauaggaggauuugacgua

SEQ ID NO: 52179 - RNA, 54 nt, Artificial Sequence
  derived and/or modified sequence opt6 from anti-HIV_CDR
gcagauccguuuaaaguugcacaagaugaaggauuauuuguaauauuugauuau

SEQ ID NO: 52180 - RNA, 54 nt, Artificial Sequence
  derived and/or modified sequence opt6 from anti-HIV_CDR
gcagauccguuuaaaguagcacaagaugaaggacuauauguaauauuugauuau

SEQ ID NO: 52181 - RNA, 54 nt, Artificial Sequence
  derived and/or modified sequence opt6 from anti-HIV_CDR
gcggauagguuuaagguagcgcaagaugaaggauuauuuguaauauuugauuau

SEQ ID NO: 52182 - RNA, 54 nt, Artificial Sequence
  derived and/or modified sequence opt6 from anti-HIV_CDR
ggaagacaaacauuuagagcaauauggagcggaccaccagcaguauucgauaua

SEQ ID NO: 52183 - RNA, 54 nt, Artificial Sequence
  derived and/or modified sequence opt6 from anti-HIV_CDR
ggaagacaaacauuuagagcaauauggagcggaccaccaguaguauucgauaua

SEQ ID NO: 52184 - RNA, 54 nt, Artificial Sequence
  derived and/or modified sequence opt6 from anti-HIV_CDR
ucuagaggugacuauaacuuuuggucuggauauccagaauaccauuucgauaga

SEQ ID NO: 52185 - RNA, 54 nt, Artificial Sequence
  derived and/or modified sequence opt6 from anti-HIV_CDR
uuaccaaaaucaagaauggucggaggagaucauuuaccauuuuauccagacuuu

SEQ ID NO: 52186 - RNA, 54 nt, Artificial Sequence
  derived and/or modified sequence opt6 from anti-HIV_CDR
uuaacagguccaucuggauauugugauucaucuggauguuacugguuugaucca

SEQ ID NO: 52187 - RNA, 54 nt, Artificial Sequence
  derived and/or modified sequence opt6 from anti-HIV_CDR
gguggaaguaugauuagagguguaccuaguccuuuuuauuaugguauggaugua

SEQ ID NO: 52188 - RNA, 54 nt, Artificial Sequence
  derived and/or modified sequence opt6 from anti-HIV_CDR
uuauuuggagcaaaaagauuaggaguagcgccaaguggauauuauauggaugua

SEQ ID NO: 52189 - RNA, 54 nt, Artificial Sequence
  derived and/or modified sequence opt6 from anti-HIV_CDR
gauagauaugaggcagcaugguuuggagcagauaaaguauauggaauggaugua

SEQ ID NO: 52190 - RNA, 54 nt, Artificial Sequence
  derived and/or modified sequence opt6 from anti-HIV_CDR
gaacacagacuaccaccaccaacaggaagaagaacaagaaacugguucgaccca

SEQ ID NO: 52191 - RNA, 54 nt, Artificial Sequence
  derived and/or modified sequence opt6 from anti-HIV_CDR
ggaagaggaaguuuucaaggauuucagcaauaugaauauuauggaauggaugua

SEQ ID NO: 52192 - RNA, 54 nt, Artificial Sequence
  derived and/or modified sequence opt6 from anti-HIV_CDR
ggaagaggauauagucauggauuucaacaauauaauuauuauggaauggacgua

SEQ ID NO: 52193 - RNA, 54 nt, Artificial Sequence
  derived and/or modified sequence opt6 from anti-HIV_CDR
gguagagguaguuuuacagguuuugaucaauaucauuauuacgguauggaugua

SEQ ID NO: 52194 - RNA, 54 nt, Artificial Sequence
  derived and/or modified sequence opt6 from anti-HIV_CDR
ggucgugguucuacuuuuccuucugcucaauuuucuuauuuuggucuugauguu

SEQ ID NO: 52195 - RNA, 54 nt, Artificial Sequence
  derived and/or modified sequence opt6 from anti-HIV_CDR
gaucuagcaagauauggaguaacaucaauaguaccagaauucggauucgauuuc

SEQ ID NO: 52196 - RNA, 54 nt, Artificial Sequence
  derived and/or modified sequence opt6 from anti-HIV_CDR
cguggacgucuaaauauaccuucaccuucagcuauacuuacagcuuucgaugua

SEQ ID NO: 52197 - RNA, 54 nt, Artificial Sequence
  derived and/or modified sequence opt6 from anti-HIV_CDR
ggaccgggaaguaugguaagaggauuaauaguaacaaguuauggaauggaugua

SEQ ID NO: 52198 - RNA, 54 nt, Artificial Sequence
  derived and/or modified sequence opt6 from anti-HIV_CDR
aaaagaguaacaauauucggaguaguagauacaccaagaggauacuuugacuau

SEQ ID NO: 52199 - RNA, 54 nt, Artificial Sequence
  derived and/or modified sequence opt6 from anti-HIV_CDR
ggacaaagaaauguauuacacuuccuagaaagaaaaaacgacgcauucgacaua

SEQ ID NO: 52200 - RNA, 54 nt, Artificial Sequence
  derived and/or modified sequence opt6 from anti-HIV_CDR
gagcagaaggauuaugauuuuuggaauggauuguauaaguaugggauggaugua

SEQ ID NO: 52201 - RNA, 57 nt, Artificial Sequence
  derived and/or modified sequence opt6 from anti-HIV_CDR
gauacaacaacauuuacaacauuuggaggaggaccaaauaugggaggauuugaccca

SEQ ID NO: 52202 - RNA, 57 nt, Artificial Sequence
  derived and/or modified sequence opt6 from anti-HIV_CDR
gcaggauuagauuauaauuucuggaacggaaaaggaagaaaaggagcauuugaugua

SEQ ID NO: 52203 - RNA, 57 nt, Artificial Sequence
  derived and/or modified sequence opt6 from anti-HIV_CDR
aaugaagcugacuaucaugauggaaauggacauaguuuaagagguauguuugauuau

SEQ ID NO: 52204 - RNA, 57 nt, Artificial Sequence
  derived and/or modified sequence opt6 from anti-HIV_CDR
aacgaaccacaauaucaugacggaaacggacacucacuaccaggaauguucgauagc

SEQ ID NO: 52205 - RNA, 57 nt, Artificial Sequence
  derived and/or modified sequence opt6 from anti-HIV_CDR
aacgaaccacaauaccaugacgacaacggacacucacuaccaggaaugauagauuac

SEQ ID NO: 52206 - RNA, 57 nt, Artificial Sequence
  derived and/or modified sequence opt6 from anti-HIV_CDR
aaugaaccacaauaucaugacggaaacggacacucauuaccaggaauguuugauuuc

SEQ ID NO: 52207 - RNA, 57 nt, Artificial Sequence
  derived and/or modified sequence opt6 from anti-HIV_CDR
aaugaaccucaauauuuugauggaucuggacauucacuuccagguauguuugauuau

SEQ ID NO: 52208 - RNA, 57 nt, Artificial Sequence
  derived and/or modified sequence opt6 from anti-HIV_CDR
cgugaagcugauuaucaugauggaaauggacauacauuaccagguauguuugauuuu

SEQ ID NO: 52209 - RNA, 57 nt, Artificial Sequence
  derived and/or modified sequence opt6 from anti-HIV_CDR
aaugaaccucaauauuaugacggaucuggacauucauuaccagguauguuugauuau

SEQ ID NO: 52210 - RNA, 57 nt, Artificial Sequence
  derived and/or modified sequence opt6 from anti-HIV_CDR
aaugaaccucaauaucaugacggaaauggacauucauuaccaggcauguuugauuau

SEQ ID NO: 52211 - RNA, 57 nt, Artificial Sequence
  derived and/or modified sequence opt6 from anti-HIV_CDR
caagauagugauuuucaugacggacacggacauacauuaagaggaauguuugauagu

SEQ ID NO: 52212 - RNA, 57 nt, Artificial Sequence
  derived and/or modified sequence opt6 from anti-HIV_CDR
uuagauuggguaagaggaguaaugaauuuaguagaaaaucauuacgcaauggaugua

SEQ ID NO: 52213 - RNA, 57 nt, Artificial Sequence
  derived and/or modified sequence opt6 from anti-HIV_CDR
acaaauggaacagaaauauuuagaccaggaggaggagauaugagagauaauuggaga

SEQ ID NO: 52214 - RNA, 57 nt, Artificial Sequence
  derived and/or modified sequence opt6 from anti-HIV_CDR
gacgguagauauucaggugacgaucaauauuauuaucauuauuauuauauggaugua

SEQ ID NO: 52215 - RNA, 57 nt, Artificial Sequence
  derived and/or modified sequence opt6 from anti-HIV_CDR
cuaacaaaaaacccaucacaagacuucuggggaucauaccuauacuacuucgaagac

SEQ ID NO: 52216 - RNA, 57 nt, Artificial Sequence
  derived and/or modified sequence opt6 from anti-HIV_CDR
ggagcaacauauuacuaugacucaagcggacaccaaagcagaagagcauucgauaua

SEQ ID NO: 52217 - RNA, 57 nt, Artificial Sequence
  derived and/or modified sequence opt6 from anti-HIV_CDR
gcauuucaagcaaguaugguaagaggaguaauaguagauccauauggaauggaugua

SEQ ID NO: 52218 - RNA, 57 nt, Artificial Sequence
  derived and/or modified sequence opt6 from anti-HIV_CDR
cacagagcagauuaugauuucuggaacggaaguaauuuaagaggauauuuugaucca

SEQ ID NO: 52219 - RNA, 57 nt, Artificial Sequence
  derived and/or modified sequence opt6 from anti-HIV_CDR
cauagagcaaauuaugauuuuuggggaggaaguaauuuaagaggauauuuugaucca

SEQ ID NO: 52220 - RNA, 57 nt, Artificial Sequence
  derived and/or modified sequence opt6 from anti-HIV_CDR
ggauuucacuuuuggucaggaacaggaacaagaccgagaaauugguauuuugauuua

SEQ ID NO: 52221 - RNA, 57 nt, Artificial Sequence
  derived and/or modified sequence opt6 from anti-HIV_CDR
aacuaucuaauagaaucaagauaugacgaaaaagacuacuauuacgcaauggacgua

SEQ ID NO: 52222 - RNA, 57 nt, Artificial Sequence
  derived and/or modified sequence opt6 from anti-HIV_CDR
ucacguggauaugcauaugauucuggaggucauuauuuuccuacaugguuugaucca

SEQ ID NO: 52223 - RNA, 57 nt, Artificial Sequence
  derived and/or modified sequence opt6 from anti-HIV_CDR
gauacaacaacauuuggagcauuuggaggaaguccaaauaugggaggauuagaucca

SEQ ID NO: 52224 - RNA, 57 nt, Artificial Sequence
  derived and/or modified sequence opt6 from anti-HIV_CDR
cauuuaguaguagcaguagcagcaggaccagauuauuuuaguuauggaauggaugua

SEQ ID NO: 52225 - RNA, 57 nt, Artificial Sequence
  derived and/or modified sequence opt6 from anti-HIV_CDR
gacacaacaacauuuucaucauucggaucaccaccaaauaugggcggacuagaccca

SEQ ID NO: 52226 - RNA, 57 nt, Artificial Sequence
  derived and/or modified sequence opt6 from anti-HIV_CDR
gauacaacaacauuuggagcauuuggaggaggagcaaauaugggaggauuagaucca

SEQ ID NO: 52227 - RNA, 57 nt, Artificial Sequence
  derived and/or modified sequence opt6 from anti-HIV_CDR
gacacaacaacauucacaucauuuggaagcccaccaagaaugggaggacuagaucca

SEQ ID NO: 52228 - RNA, 57 nt, Artificial Sequence
  derived and/or modified sequence opt6 from anti-HIV_CDR
gacacaacaacauuuucaucauucggaucaccaccacauaugggcggacuagaccca

SEQ ID NO: 52229 - RNA, 57 nt, Artificial Sequence
  derived and/or modified sequence opt6 from anti-HIV_CDR
gauagggugagugauuaugauuuuuggagugggaagaggggguaugggauggaugug

SEQ ID NO: 52230 - RNA, 57 nt, Artificial Sequence
  derived and/or modified sequence opt6 from anti-HIV_CDR
gaacuaucaggagaauaccauuucuggagcggaacauauagauauggaguagacgua

SEQ ID NO: 52231 - RNA, 57 nt, Artificial Sequence
  derived and/or modified sequence opt6 from anti-HIV_CDR
cauggagcaucagaaaauuauggaccaggaucauacucagcagaacacuuucaacau

SEQ ID NO: 52232 - RNA, 57 nt, Artificial Sequence
  derived and/or modified sequence opt6 from anti-HIV_CDR
cauggagcaucagcaaauuauggaccaggaucauacucagcagaacacuuucaacau

SEQ ID NO: 52233 - RNA, 60 nt, Artificial Sequence
  derived and/or modified sequence opt6 from anti-HIV_CDR
caugaagcaccuagauauucauaugcauuuagacguuacuaucacuauggacuugacguu

SEQ ID NO: 52234 - RNA, 60 nt, Artificial Sequence
  derived and/or modified sequence opt6 from anti-HIV_CDR
acaagcacauaugaucaauggagcggacuacaucaugauggaguaauggcauucucaagc

SEQ ID NO: 52235 - RNA, 60 nt, Artificial Sequence
  derived and/or modified sequence opt6 from anti-HIV_CDR
ggagaauuugauaguaguggauuugauuaugaaaguugguauccguauuauauggaugua

SEQ ID NO: 52236 - RNA, 60 nt, Artificial Sequence
  derived and/or modified sequence opt6 from anti-HIV_CDR
ggacaaacagaucuaaaugacgauuucuggucagaauacucaacaccaggauuugacuau

SEQ ID NO: 52237 - RNA, 60 nt, Artificial Sequence
  derived and/or modified sequence opt6 from anti-HIV_CDR
ggacaaacagaucuaaaugacgaucuauggucagauuacucuacaccuggauuugacuau

SEQ ID NO: 52238 - RNA, 60 nt, Artificial Sequence
  derived and/or modified sequence opt6 from anti-HIV_CDR
aaccuaauagaagaaagccaaacacaacaagaaauaaacgaaagagaccuacuagcacua

SEQ ID NO: 52239 - RNA, 60 nt, Artificial Sequence
  derived and/or modified sequence opt6 from anti-HIV_CDR
aaccuaauagaagaaagccaaauacaacaagaaaaaaacgaaaaagaacuacuagaacua

SEQ ID NO: 52240 - RNA, 60 nt, Artificial Sequence
  derived and/or modified sequence opt6 from anti-HIV_CDR
agccuaaucgaaaacucacaaauacaacaagaaaaaaacgaacaagaccuacuacaacua

SEQ ID NO: 52241 - RNA, 60 nt, Artificial Sequence
  derived and/or modified sequence opt6 from anti-HIV_CDR
agccuaauagaagaaagccaaauacaacaagaaaaaaacgaaaaagaacuacuagaacua

SEQ ID NO: 52242 - RNA, 60 nt, Artificial Sequence
  derived and/or modified sequence opt6 from anti-HIV_CDR
agacuaauagaagaaagccaaacacaacaagaaaaaaacgaacaagaacuacuagaacua

SEQ ID NO: 52243 - RNA, 60 nt, Artificial Sequence
  derived and/or modified sequence opt6 from anti-HIV_CDR
agccuaauagaagaaagccaaacacaacaagaaaaaaacgaaaaagaacuacuagaacua

SEQ ID NO: 52244 - RNA, 60 nt, Artificial Sequence
  derived and/or modified sequence opt6 from anti-HIV_CDR
aaccuacuagaagaaucacaaaaccaacaagaaaaaaacgaacaagaacuacuagaacua

SEQ ID NO: 52245 - RNA, 60 nt, Artificial Sequence
  derived and/or modified sequence opt6 from anti-HIV_CDR
acacuaauagaagaaagccaaaaccaacaagaaaaaaacgaacuagaacuacuagaacua

SEQ ID NO: 52246 - RNA, 60 nt, Artificial Sequence
  derived and/or modified sequence opt6 from anti-HIV_CDR
acacuacaagaagaaagccaaaaccaacaagaaaaaaacgaacaagaacuacuagaacua

SEQ ID NO: 52247 - RNA, 60 nt, Artificial Sequence
  derived and/or modified sequence opt6 from anti-HIV_CDR
ucacuacuagaagaaagccaaaaccaacaagaaaaaaacgaacaagaacuacuagaacua

SEQ ID NO: 52248 - RNA, 60 nt, Artificial Sequence
  derived and/or modified sequence opt6 from anti-HIV_CDR
acacuaauagaagaaagccaaaaccaacaagaaaaaaaccaacaagaacuacuacaacua

SEQ ID NO: 52249 - RNA, 60 nt, Artificial Sequence
  derived and/or modified sequence opt6 from anti-HIV_CDR
acacuaauagaagaaagccaaaaccaacaagaaaaaaacgaacaagaacuacuaggacua

SEQ ID NO: 52250 - RNA, 60 nt, Artificial Sequence
  derived and/or modified sequence opt6 from anti-HIV_CDR
acacuaauagaagaaagccaaaaccaacaagaaaaaaacgaacaagaacuacuagaacua

SEQ ID NO: 52251 - RNA, 60 nt, Artificial Sequence
  derived and/or modified sequence opt6 from anti-HIV_CDR
agccuaauagaagacagccaaauacaacaagaaaaaaacgaaaaagaacuacuagaacua

SEQ ID NO: 52252 - RNA, 60 nt, Artificial Sequence
  derived and/or modified sequence opt6 from anti-HIV_CDR
agccuacuagaaaaaucacaaacacaacaagaaaaaaacgaacaagaacuacuagaacua

SEQ ID NO: 52253 - RNA, 60 nt, Artificial Sequence
  derived and/or modified sequence opt6 from anti-HIV_CDR
agccuaauagaagaaucacaaaaccaacaagaaaaaaacgaacaagaacuacuagaacua

SEQ ID NO: 52254 - RNA, 60 nt, Artificial Sequence
  derived and/or modified sequence opt6 from anti-HIV_CDR
ggugauuuauuaggcuauacugauaguugguaugaauuugauuauuauuacauggacgua

SEQ ID NO: 52255 - RNA, 60 nt, Artificial Sequence
  derived and/or modified sequence opt6 from anti-HIV_CDR
gauacaaauggaacagaaauauuuagaccaggaggaggagacaugagagauaauuggaga

SEQ ID NO: 52256 - RNA, 60 nt, Artificial Sequence
  derived and/or modified sequence opt6 from anti-HIV_CDR
gauguaguagaaaggccgggauuuggagauuuuagauaugauuauuauggaauggaugua

SEQ ID NO: 52257 - RNA, 60 nt, Artificial Sequence
  derived and/or modified sequence opt6 from anti-HIV_CDR
gaucaaagggauuguaguacgaauagguguuuuggaguguuuggguauuauauggaugua

SEQ ID NO: 52258 - RNA, 60 nt, Artificial Sequence
  derived and/or modified sequence opt6 from anti-HIV_CDR
gauagauggguaagaccacaauucccaucaauggacuuucaauauaacggauuagaugua

SEQ ID NO: 52259 - RNA, 60 nt, Artificial Sequence
  derived and/or modified sequence opt6 from anti-HIV_CDR
gauagcggguucgaucuagauuacuaugacacgaacgagcuauauuucggguucgauuac

SEQ ID NO: 52260 - RNA, 60 nt, Artificial Sequence
  derived and/or modified sequence opt6 from anti-HIV_CDR
aaauacccagccuacuacgacauccuaaccgcaaacuaccgaucauacuacuucgacuac

SEQ ID NO: 52261 - RNA, 60 nt, Artificial Sequence
  derived and/or modified sequence opt6 from anti-HIV_CDR
aaauacccagccuacuacgacauccuaaccggauacuaccgaaacuacuacuucgacuac

SEQ ID NO: 52262 - RNA, 60 nt, Artificial Sequence
  derived and/or modified sequence opt6 from anti-HIV_CDR
cguguaaaauuuccuuuaugguuuggugaaacuacauauuauuauuaugguauggaugua

SEQ ID NO: 52263 - RNA, 60 nt, Artificial Sequence
  derived and/or modified sequence opt6 from anti-HIV_CDR
gaaagaucaacaaaauacucauucuggagcgcaguaaugagaccagacgcauucgaucua

SEQ ID NO: 52264 - RNA, 60 nt, Artificial Sequence
  derived and/or modified sequence opt6 from anti-HIV_CDR
cacgaagcaccuagauauucauaugcauuuagaaauuacuaucacuauggacuugacguu

SEQ ID NO: 52265 - RNA, 60 nt, Artificial Sequence
  derived and/or modified sequence opt6 from anti-HIV_CDR
gaaaauguacuaauggaaucagacgacuacaaugacuauuacuauuacuacauggacgua

SEQ ID NO: 52266 - RNA, 60 nt, Artificial Sequence
  derived and/or modified sequence opt6 from anti-HIV_CDR
gaacguguucuuguuuuuccugaucaagaugcugauuauuauuauuauuuuuuugauguu

SEQ ID NO: 52267 - RNA, 60 nt, Artificial Sequence
  derived and/or modified sequence opt6 from anti-HIV_CDR
gaacguguuuuaguuguuccugaucaagaugcugauuauuauuauuauuuuuuugauguu

SEQ ID NO: 52268 - RNA, 63 nt, Artificial Sequence
  derived and/or modified sequence opt6 from anti-HIV_CDR
gauagaucuucagcuauagguuacuguucaucuauaucuugcuauaaagguucauuugacauu

SEQ ID NO: 52269 - RNA, 63 nt, Artificial Sequence
  derived and/or modified sequence opt6 from anti-HIV_CDR
guaguaaaaauagaaccacuaggaguagcaccaacaaaagcaaaaagaguagcaagagaaaaa

SEQ ID NO: 52270 - RNA, 63 nt, Artificial Sequence
  derived and/or modified sequence opt6 from anti-HIV_CDR
guaguaagaauagaaccacuaggaguagcaccaacaaaagcaaaaagaguagaaagagaaaaa

SEQ ID NO: 52271 - RNA, 63 nt, Artificial Sequence
  derived and/or modified sequence opt6 from anti-HIV_CDR
guaguaagaauagaaccacuaggaauagcaccaacaagagcaaaaagaguagaaagagaaaaa

SEQ ID NO: 52272 - RNA, 63 nt, Artificial Sequence
  derived and/or modified sequence opt6 from anti-HIV_CDR
guaguaaaaauagaaccaauaggaguagcaccaacaaaagcaagaagaguagaaagagaaaaa

SEQ ID NO: 52273 - RNA, 63 nt, Artificial Sequence
  derived and/or modified sequence opt6 from anti-HIV_CDR
guaguaaaaauagaaccacuaggaguagcaccaacaagagcaaaaagaguagaaagagaaaaa

SEQ ID NO: 52274 - RNA, 63 nt, Artificial Sequence
  derived and/or modified sequence opt6 from anti-HIV_CDR
guaguacaaauagaaccacuaggaguagcaccaacaagagcaaaaagaguagaaagagaaaaa

SEQ ID NO: 52275 - RNA, 63 nt, Artificial Sequence
  derived and/or modified sequence opt6 from anti-HIV_CDR
guaguaagaauagaaccacuaggaguagcaccaacaaaagcaaaaagaguacaaagagaaaaa

SEQ ID NO: 52276 - RNA, 63 nt, Artificial Sequence
  derived and/or modified sequence opt6 from anti-HIV_CDR
guaguaaaaauagaaccacuaggaguagcaccaacaaaagcaaaaagaguacaaagaaaaaaa

SEQ ID NO: 52277 - RNA, 63 nt, Artificial Sequence
  derived and/or modified sequence opt6 from anti-HIV_CDR
guaauaaaaauagaaccacuaauaguagcaccaacaaaagcaaaaagaguacaaagagaaaaa

SEQ ID NO: 52278 - RNA, 63 nt, Artificial Sequence
  derived and/or modified sequence opt6 from anti-HIV_CDR
guaguaaaaauagaaccacuaggaguagcaccaacaaaagcaagaagaguacaaagagaaaaa

SEQ ID NO: 52279 - RNA, 63 nt, Artificial Sequence
  derived and/or modified sequence opt6 from anti-HIV_CDR
guaguaaaaauagaacuacuaggaguagcaccaacaaaagcaaaaagaguacaaagagaaaaa

SEQ ID NO: 52280 - RNA, 63 nt, Artificial Sequence
  derived and/or modified sequence opt6 from anti-HIV_CDR
guaguaacaauagaaccacuaggaguagcaccaacaaaagcaaaaagaguacaaagagaaaaa

SEQ ID NO: 52281 - RNA, 63 nt, Artificial Sequence
  derived and/or modified sequence opt6 from anti-HIV_CDR
guaguaaaaauagaaccacuaggaguagcaccaacaaaagcaaaaagaguacaaagagaaaaa

SEQ ID NO: 52282 - RNA, 63 nt, Artificial Sequence
  derived and/or modified sequence opt6 from anti-HIV_CDR
gaucuaguaagcguaagcccaccauauggaaauuacggaccagauaacaauugguuugacuuu

SEQ ID NO: 52283 - RNA, 63 nt, Artificial Sequence
  derived and/or modified sequence opt6 from anti-HIV_CDR
augaauccaccuugguuuagagguggaucuaacaauccauauucauauuacuauauggaugua

SEQ ID NO: 52284 - RNA, 63 nt, Artificial Sequence
  derived and/or modified sequence opt6 from anti-HIV_CDR
gauuggauaggguaugauuaugauggaaguggaagucauuugagagaugaaaguuuugauaua

SEQ ID NO: 52285 - RNA, 63 nt, Artificial Sequence
  derived and/or modified sequence opt6 from anti-HIV_CDR
uguaguauaguaggaaauggagacuuuuuagaagaagauagucauuauccagcaauggaugua

SEQ ID NO: 52286 - RNA, 63 nt, Artificial Sequence
  derived and/or modified sequence opt6 from anti-HIV_CDR
gauuuuguaaguauauauggaguugcauauuuuacuggagguggaccuucaaguccagauaua

SEQ ID NO: 52287 - RNA, 66 nt, Artificial Sequence
  derived and/or modified sequence opt6 from anti-HIV_CDR
aaagcaaaagacuacuacuacgaauccucagacuacuccccauacuacuacuacuacauggacgua

SEQ ID NO: 52288 - RNA, 66 nt, Artificial Sequence
  derived and/or modified sequence opt6 from anti-HIV_CDR
gaucacgguauaaagccagauaacuauuacgauauaucuggauauaacuuagacuauuucgauuac

SEQ ID NO: 52289 - RNA, 66 nt, Artificial Sequence
  derived and/or modified sequence opt6 from anti-HIV_CDR
ggaucacuauaugacuacagagacaacgcagacuuaaaaccaucauauuacuaugcaauggacgua

SEQ ID NO: 52290 - RNA, 66 nt, Artificial Sequence
  derived and/or modified sequence opt6 from anti-HIV_CDR
gaugaagcaaguuggguagaagcagcagaugaaugggaugaacauuuauuuagagaaauggcagua

SEQ ID NO: 52291 - RNA, 66 nt, Artificial Sequence
  derived and/or modified sequence opt6 from anti-HIV_CDR
gaugaaguaaguuggguagaagcagcagaugaaugggaugaacauuuauuuagagaaauggcagua

SEQ ID NO: 52292 - RNA, 66 nt, Artificial Sequence
  derived and/or modified sequence opt6 from anti-HIV_CDR
gaugaaggaaguuggguagaagcagcagaugaaugggaugaacauuuauuuagagaaauggcagua

SEQ ID NO: 52293 - RNA, 66 nt, Artificial Sequence
  derived and/or modified sequence opt6 from anti-HIV_CDR
gaucaaagaggaagauauucauucggauuugugacaggacaaacaaaaguaagugcaauaucagau

SEQ ID NO: 52294 - RNA, 66 nt, Artificial Sequence
  derived and/or modified sequence opt6 from anti-HIV_CDR
gaucaauuaggaagauauucauucggauuugugacaggacaaaauaaaguaagcgcaauaucagac

SEQ ID NO: 52295 - RNA, 66 nt, Artificial Sequence
  derived and/or modified sequence opt6 from anti-HIV_CDR
gaucaaguaggaagauauucauucggauuugcaacaggacaacaaagaguaagcgcaauaucagac

SEQ ID NO: 52296 - RNA, 69 nt, Artificial Sequence
  derived and/or modified sequence opt6 from anti-HIV_CDR
guaguaaaaauagaaccacuaggaguagcaccaacaaaagcaaaaagaagaguaguacaaagagaaaaa

SEQ ID NO: 52297 - RNA, 69 nt, Artificial Sequence
  derived and/or modified sequence opt6 from anti-HIV_CDR
agaauuucaucuucaucuugguauaugguugacaauucacauacacuucacuuuuacuauauggaugua

SEQ ID NO: 52298 - RNA, 69 nt, Artificial Sequence
  derived and/or modified sequence opt6 from anti-HIV_CDR
gacaaaccagcauacgacgaauacgcagaagaaacaauagcaccacacaacuaucacgcaauggaccua

SEQ ID NO: 52299 - RNA, 69 nt, Artificial Sequence
  derived and/or modified sequence opt6 from anti-HIV_CDR
caaaacauagcagcaagagcagcagaaaaauuauacgaaaacgauuacuauuucuauggaauggacgua

SEQ ID NO: 52300 - RNA, 69 nt, Artificial Sequence
  derived and/or modified sequence opt6 from anti-HIV_CDR
caaaacauagcagcaagaacagcagaaagauuauacgaaaacgauuacuauuucuauggaauggacgua

SEQ ID NO: 52301 - RNA, 72 nt, Artificial Sequence
  derived and/or modified sequence opt6 from anti-HIV_CDR
gcacaacaaggaaaaagaauauacggaauaguaagcuuuggagaauucuuuuacuauuacuauauggaugca

SEQ ID NO: 52302 - RNA, 72 nt, Artificial Sequence
  derived and/or modified sequence opt6 from anti-HIV_CDR
acacaacaaggaaaaagaauauacggaguaguaagcuucggagaauucuuucacuauuacuauauggaugca

SEQ ID NO: 52303 - RNA, 72 nt, Artificial Sequence
  derived and/or modified sequence opt6 from anti-HIV_CDR
gcaagaagaggacagagaauauauggaguaguaaguuuuggagaauuuuuuuauuauuauaguauggaugua

SEQ ID NO: 52304 - RNA, 72 nt, Artificial Sequence
  derived and/or modified sequence opt6 from anti-HIV_CDR
acucuacauggacguagaauuuacgguauaguugcauuuaaugaaugguuuacauauuucuauauggaugua

SEQ ID NO: 52305 - RNA, 72 nt, Artificial Sequence
  derived and/or modified sequence opt6 from anti-HIV_CDR
acuaaacauggacguagaauuuacgguauaguugcauuuaaugaaugguuuacauauuucuauauggaugua

SEQ ID NO: 52306 - RNA, 72 nt, Artificial Sequence
  derived and/or modified sequence opt6 from anti-HIV_CDR
gcuagacauggacaaagaauuuacgguguaguuagcuuuggagaauuuuucacauauuacaguauggaugua

SEQ ID NO: 52307 - RNA, 72 nt, Artificial Sequence
  derived and/or modified sequence opt6 from anti-HIV_CDR
acacaacaaggaaaaagaauauacggaguaguaagcuucggagauuacuauuacuauuacuauauggaugua

SEQ ID NO: 52308 - RNA, 72 nt, Artificial Sequence
  derived and/or modified sequence opt6 from anti-HIV_CDR
acuaaacauggacguagaauuuacgguguaguugcauuuggagaaugguuuacauauuuuuauauggaugua

SEQ ID NO: 52309 - RNA, 72 nt, Artificial Sequence
  derived and/or modified sequence opt6 from anti-HIV_CDR
gcuguaauuacagaucuacauacauuuggagauuacgaacuagaagacccuucauauuacuauauggaugua

SEQ ID NO: 52310 - RNA, 72 nt, Artificial Sequence
  derived and/or modified sequence opt6 from anti-HIV_CDR
gauagaggggauacgagauuguuagauuauggggauuaugaagaugaaagguauuauuaugggauggaugua

SEQ ID NO: 52311 - RNA, 72 nt, Artificial Sequence
  derived and/or modified sequence opt6 from anti-HIV_CDR
ggaacaagauaugauuuuuggaguggauuuaguaauagagaugggagagcauuagcaggauauuuugauuau

SEQ ID NO: 52312 - RNA, 72 nt, Artificial Sequence
  derived and/or modified sequence opt6 from anti-HIV_CDR
gauggaaaaggaaaagcauauuaugauuucuggagcggauacagaaaucaaaaauauuacggacuagaugua

SEQ ID NO: 52313 - RNA, 72 nt, Artificial Sequence
  derived and/or modified sequence opt6 from anti-HIV_CDR
gcuguaauuacagaucuacauacauuugcagauuacgaacuaggugacccuucauauuucuauauggaugua

SEQ ID NO: 52314 - RNA, 72 nt, Artificial Sequence
  derived and/or modified sequence opt6 from anti-HIV_CDR
ucuguaauuacagaucuacauacauuuggagauuacgaaucaggugacccuucauauuacuauauggaugua

SEQ ID NO: 52315 - RNA, 81 nt, Artificial Sequence
  derived and/or modified sequence opt6 from anti-HIV_CDR
gacuuuccacguuuucauagacuuguagguaauuaugacuuuuggcguggaacuuuagauagauuuucauauauggauuua

SEQ ID NO: 52316 - RNA, 105 nt, Artificial Sequence
  derived and/or modified sequence opt6 from anti-HIV_CDR
agaauacuagcaguagaaagauaucuaaaagaccaacaauuacuaggaauauggggauguagcggaaaaauaauauguccaacaaugguaccauggaacucaagc

SEQ ID NO: 52317 - RNA, 105 nt, Artificial Sequence
  derived and/or modified sequence opt6 from anti-HIV_CDR
agaguacuagcaguagaaagauaucuacaagaccaaagauuacuaggaauguggggauguagcggaaaacauauauguacaacauucguaccauggaacucaagc

SEQ ID NO: 52318 - RNA, 105 nt, Artificial Sequence
  derived and/or modified sequence opt6 from anti-HIV_CDR
agaguacuagcaguagaaagcuaucuaaaagaccaacaauuacuaggaauauggggauguagcggaaaacauauauguacaacaacaguaccauggaacucaagc

SEQ ID NO: 52319 - RNA, 105 nt, Artificial Sequence
  derived and/or modified sequence opt6 from anti-HIV_CDR
agaguacuagcaguagaaagauaucuaagagaccaacaauuacuaggaauauggggauguagcggaagacauauauguacaacaaacguaccauggaacucaagc

SEQ ID NO: 52320 - RNA, 105 nt, Artificial Sequence
  derived and/or modified sequence opt6 from anti-HIV_CDR
agaauacuagcaguagaaagauaucuaaaagaccaacaauuacuaggaauauggggauguagcggaaaauuaauauguacaacaacaguaccauggaacucaagc

SEQ ID NO: 52321 - RNA, 105 nt, Artificial Sequence
  derived and/or modified sequence opt6 from anti-HIV_CDR
agaauacuagcaguagaaagauaucuaaaagaccaacaauuacuaggaauauggggauguagcggaaaacauauauguacaacaaacguaccauggaacucaagc

SEQ ID NO: 52322 - RNA, 105 nt, Artificial Sequence
  derived and/or modified sequence opt6 from anti-HIV_CDR
agaguacuagcaguagaaagauaucuaagagaccaacaauuacuaggaauauggggauguagcggaaaauuaauauguacaacaacaguaccauggaacgcaagc

SEQ ID NO: 52323 - RNA, 105 nt, Artificial Sequence
  derived and/or modified sequence opt6 from anti-HIV_CDR
agaguacuagcaguagaaagauaucuaagagaccaacaauuacuaggaauauggggauguagcggaaaauuaauauguacaacagcaguaccauggaacgcaagc

SEQ ID NO: 52324 - RNA, 105 nt, Artificial Sequence
  derived and/or modified sequence opt6 from anti-HIV_CDR
agaguacuagcaguagaaagauaucuaaaagaccaacaauuacuaggaauauggggauguagcggaaaauuaauauguacaacaacaguaccauggaacgcaagc

SEQ ID NO: 52325 - RNA, 105 nt, Artificial Sequence
  derived and/or modified sequence opt6 from anti-HIV_CDR
agaauacuagcaguagaaagauaucuaaaagaccaacaauuacuaggauucuggggauguagcggaaaauuaauauguacaacagcaguaccauggaacgcaagc

SEQ ID NO: 52326 - RNA, 105 nt, Artificial Sequence
  derived and/or modified sequence opt6 from anti-HIV_CDR
agaguacuagcaguagaaagauaucuaagagaccaacaauuacuaggaauauggggauguagcggaaaauuaauauguacaacaacaguaccauggaacacaagc

SEQ ID NO: 52327 - RNA, 105 nt, Artificial Sequence
  derived and/or modified sequence opt6 from anti-HIV_CDR
agaguacuagcaguagaaagauaucuaaaagaccaacaauuacuaggaauauggggauguagcggaaaauuaauauguacaacagcaguaccauggaacgcaagc

SEQ ID NO: 52328 - RNA, 105 nt, Artificial Sequence
  derived and/or modified sequence opt6 from anti-HIV_CDR
agaguacuagcaguagaaagauaucuaaaagaccaacaauuacuaggauucuggggauguagcggaaaauuaauauguacaacaacaguaccauggaacgcaagc

SEQ ID NO: 52329 - RNA, 105 nt, Artificial Sequence
  derived and/or modified sequence opt6 from anti-HIV_CDR
agaauacuagcaguagaaagauaucuaaaagaccaacaauuacuaggaauauggggauguagcggaaaauuaauauguacaacagcaguaccauggaacgcaagc

SEQ ID NO: 52330-52355 - skipped (26 entries)

SEQ ID NO: 52356 - RNA, 12 nt, Artificial Sequence
  derived and/or modified sequence opt6 from anti-influenza_CDR
gaugugccggau

SEQ ID NO: 52357 - RNA, 12 nt, Artificial Sequence
  derived and/or modified sequence opt6 from anti-influenza_CDR
agguugaguggg

SEQ ID NO: 52358 - RNA, 12 nt, Artificial Sequence
  derived and/or modified sequence opt6 from anti-influenza_CDR
uuuugggauuug

SEQ ID NO: 52359 - RNA, 15 nt, Artificial Sequence
  derived and/or modified sequence opt6 from anti-influenza_CDR
acaggacuaagaaac

SEQ ID NO: 52360 - RNA, 15 nt, Artificial Sequence
  derived and/or modified sequence opt6 from anti-influenza_CDR
caacaaucccgaacc

SEQ ID NO: 52361 - RNA, 15 nt, Artificial Sequence
  derived and/or modified sequence opt6 from anti-influenza_CDR
caauuaucccgcacc

SEQ ID NO: 52362 - RNA, 15 nt, Artificial Sequence
  derived and/or modified sequence opt6 from anti-influenza_CDR
uccaacuacaucacc

SEQ ID NO: 52363 - RNA, 15 nt, Artificial Sequence
  derived and/or modified sequence opt6 from anti-influenza_CDR
gacuauaguuggaau

SEQ ID NO: 52364 - RNA, 15 nt, Artificial Sequence
  derived and/or modified sequence opt6 from anti-influenza_CDR
aauuacgccuucuca

SEQ ID NO: 52365 - RNA, 15 nt, Artificial Sequence
  derived and/or modified sequence opt6 from anti-influenza_CDR
aagaacgcgaucucg

SEQ ID NO: 52366 - RNA, 15 nt, Artificial Sequence
  derived and/or modified sequence opt6 from anti-influenza_CDR
ucgcauuggaugacg

SEQ ID NO: 52367 - RNA, 15 nt, Artificial Sequence
  derived and/or modified sequence opt6 from anti-influenza_CDR
aauuacgacaucaac

SEQ ID NO: 52368 - RNA, 15 nt, Artificial Sequence
  derived and/or modified sequence opt6 from anti-influenza_CDR
gacuauggaguuaca

SEQ ID NO: 52369 - RNA, 15 nt, Artificial Sequence
  derived and/or modified sequence opt6 from anti-influenza_CDR
aauuacggcauuaac

SEQ ID NO: 52370 - RNA, 15 nt, Artificial Sequence
  derived and/or modified sequence opt6 from anti-influenza_CDR
ggcuauacaauuaca

SEQ ID NO: 52371 - RNA, 15 nt, Artificial Sequence
  derived and/or modified sequence opt6 from anti-influenza_CDR
aauuacggcauuuca

SEQ ID NO: 52372 - RNA, 15 nt, Artificial Sequence
  derived and/or modified sequence opt6 from anti-influenza_CDR
gacgauuacuggaca

SEQ ID NO: 52373 - RNA, 15 nt, Artificial Sequence
  derived and/or modified sequence opt6 from anti-influenza_CDR
acuuacgccaugcac

SEQ ID NO: 52374 - RNA, 15 nt, Artificial Sequence
  derived and/or modified sequence opt6 from anti-influenza_CDR
ucuuacgccaugcau

SEQ ID NO: 52375 - RNA, 15 nt, Artificial Sequence
  derived and/or modified sequence opt6 from anti-influenza_CDR
aguuauuacuggaac

SEQ ID NO: 52376 - RNA, 15 nt, Artificial Sequence
  derived and/or modified sequence opt6 from anti-influenza_CDR
acauauccaguugcc

SEQ ID NO: 52377 - RNA, 15 nt, Artificial Sequence
  derived and/or modified sequence opt6 from anti-influenza_CDR
cauuauuucuggucc

SEQ ID NO: 52378 - RNA, 15 nt, Artificial Sequence
  derived and/or modified sequence opt6 from anti-influenza_CDR
gacuauuacuggaca

SEQ ID NO: 52379 - RNA, 15 nt, Artificial Sequence
  derived and/or modified sequence opt6 from anti-influenza_CDR
gauuauuauuggucg

SEQ ID NO: 52380 - RNA, 15 nt, Artificial Sequence
  derived and/or modified sequence opt6 from anti-influenza_CDR
ggcuauuauaugcau

SEQ ID NO: 52381 - RNA, 15 nt, Artificial Sequence
  derived and/or modified sequence opt6 from anti-influenza_CDR
ucucauuacuggucc

SEQ ID NO: 52382 - RNA, 15 nt, Artificial Sequence
  derived and/or modified sequence opt6 from anti-influenza_CDR
aauuacuggauuggg

SEQ ID NO: 52383 - RNA, 15 nt, Artificial Sequence
  derived and/or modified sequence opt6 from anti-influenza_CDR
aacuacgcaaucaua

SEQ ID NO: 52384 - RNA, 15 nt, Artificial Sequence
  derived and/or modified sequence opt6 from anti-influenza_CDR
gauuacuauauccau

SEQ ID NO: 52385 - RNA, 15 nt, Artificial Sequence
  derived and/or modified sequence opt6 from anti-influenza_CDR
gguuaugauaugcau

SEQ ID NO: 52386 - RNA, 15 nt, Artificial Sequence
  derived and/or modified sequence opt6 from anti-influenza_CDR
ggcuacuauauucau

SEQ ID NO: 52387 - RNA, 15 nt, Artificial Sequence
  derived and/or modified sequence opt6 from anti-influenza_CDR
gguuauuauguucau

SEQ ID NO: 52388 - RNA, 15 nt, Artificial Sequence
  derived and/or modified sequence opt6 from anti-influenza_CDR
aauuacuggaugucg

SEQ ID NO: 52389 - RNA, 15 nt, Artificial Sequence
  derived and/or modified sequence opt6 from anti-influenza_CDR
ggcgagaguacguua

SEQ ID NO: 52390 - RNA, 15 nt, Artificial Sequence
  derived and/or modified sequence opt6 from anti-influenza_CDR
aauuauuacuggucc

SEQ ID NO: 52391 - RNA, 15 nt, Artificial Sequence
  derived and/or modified sequence opt6 from anti-influenza_CDR
agcaauuacaugagc

SEQ ID NO: 52392 - RNA, 15 nt, Artificial Sequence
  derived and/or modified sequence opt6 from anti-influenza_CDR
ucugauuacuggucc

SEQ ID NO: 52393 - RNA, 15 nt, Artificial Sequence
  derived and/or modified sequence opt6 from anti-influenza_CDR
ucauauaacuggauc

SEQ ID NO: 52394 - RNA, 15 nt, Artificial Sequence
  derived and/or modified sequence opt6 from anti-influenza_CDR
agcacauacaugaac

SEQ ID NO: 52395 - RNA, 15 nt, Artificial Sequence
  derived and/or modified sequence opt6 from anti-influenza_CDR
aauuacgccauguca

SEQ ID NO: 52396 - RNA, 15 nt, Artificial Sequence
  derived and/or modified sequence opt6 from anti-influenza_CDR
ucugauuucuggucc

SEQ ID NO: 52397 - RNA, 15 nt, Artificial Sequence
  derived and/or modified sequence opt6 from anti-influenza_CDR
uauuacgccaugucu

SEQ ID NO: 52398 - RNA, 15 nt, Artificial Sequence
  derived and/or modified sequence opt6 from anti-influenza_CDR
ggcuauuauguuuau

SEQ ID NO: 52399 - RNA, 15 nt, Artificial Sequence
  derived and/or modified sequence opt6 from anti-influenza_CDR
ucuuacgccauuucu

SEQ ID NO: 52400 - RNA, 15 nt, Artificial Sequence
  derived and/or modified sequence opt6 from anti-influenza_CDR
agcuauagcuggagc

SEQ ID NO: 52401 - RNA, 15 nt, Artificial Sequence
  derived and/or modified sequence opt6 from anti-influenza_CDR
aauaguuuuuggggg

SEQ ID NO: 52402 - RNA, 15 nt, Artificial Sequence
  derived and/or modified sequence opt6 from anti-influenza_CDR
gcuuaucauugguca

SEQ ID NO: 52403 - RNA, 15 nt, Artificial Sequence
  derived and/or modified sequence opt6 from anti-influenza_CDR
gacaacuauauaaau

SEQ ID NO: 52404 - RNA, 15 nt, Artificial Sequence
  derived and/or modified sequence opt6 from anti-influenza_CDR
ucgggcuuuaguguu

SEQ ID NO: 52405 - RNA, 15 nt, Artificial Sequence
  derived and/or modified sequence opt6 from anti-influenza_CDR
gcguacgcguuuaca

SEQ ID NO: 52406 - RNA, 15 nt, Artificial Sequence
  derived and/or modified sequence opt6 from anti-influenza_CDR
gggucggcaauuagu

SEQ ID NO: 52407 - RNA, 15 nt, Artificial Sequence
  derived and/or modified sequence opt6 from anti-influenza_CDR
ucauacgccaucaca

SEQ ID NO: 52408 - RNA, 15 nt, Artificial Sequence
  derived and/or modified sequence opt6 from anti-influenza_CDR
uccuacuacaugcac

SEQ ID NO: 52409 - RNA, 15 nt, Artificial Sequence
  derived and/or modified sequence opt6 from anti-influenza_CDR
auuuaugccauguca

SEQ ID NO: 52410 - RNA, 15 nt, Artificial Sequence
  derived and/or modified sequence opt6 from anti-influenza_CDR
agcuauagcaugaac

SEQ ID NO: 52411 - RNA, 15 nt, Artificial Sequence
  derived and/or modified sequence opt6 from anti-influenza_CDR
ucuuacggcauuucu

SEQ ID NO: 52412 - RNA, 15 nt, Artificial Sequence
  derived and/or modified sequence opt6 from anti-influenza_CDR
uucuauuccaugucc

SEQ ID NO: 52413 - RNA, 15 nt, Artificial Sequence
  derived and/or modified sequence opt6 from anti-influenza_CDR
acucacgccaucuca

SEQ ID NO: 52414 - RNA, 15 nt, Artificial Sequence
  derived and/or modified sequence opt6 from anti-influenza_CDR
ggguaugcgauuagu

SEQ ID NO: 52415 - RNA, 15 nt, Artificial Sequence
  derived and/or modified sequence opt6 from anti-influenza_CDR
agcaauagcauaagc

SEQ ID NO: 52416 - RNA, 15 nt, Artificial Sequence
  derived and/or modified sequence opt6 from anti-influenza_CDR
aauuucgccaucaau

SEQ ID NO: 52417 - RNA, 15 nt, Artificial Sequence
  derived and/or modified sequence opt6 from anti-influenza_CDR
ucuaaugccgucucu

SEQ ID NO: 52418 - RNA, 15 nt, Artificial Sequence
  derived and/or modified sequence opt6 from anti-influenza_CDR
gauaacgcgaucucg

SEQ ID NO: 52419 - RNA, 15 nt, Artificial Sequence
  derived and/or modified sequence opt6 from anti-influenza_CDR
uuuagugaggucgag

SEQ ID NO: 52420 - RNA, 15 nt, Artificial Sequence
  derived and/or modified sequence opt6 from anti-influenza_CDR
gcucaccauaugcau

SEQ ID NO: 52421 - RNA, 15 nt, Artificial Sequence
  derived and/or modified sequence opt6 from anti-influenza_CDR
agucaauggauaggg

SEQ ID NO: 52422 - RNA, 15 nt, Artificial Sequence
  derived and/or modified sequence opt6 from anti-influenza_CDR
gacuacgcaaugaau

SEQ ID NO: 52423 - RNA, 15 nt, Artificial Sequence
  derived and/or modified sequence opt6 from anti-influenza_CDR
aaugcauggaugagu

SEQ ID NO: 52424 - RNA, 15 nt, Artificial Sequence
  derived and/or modified sequence opt6 from anti-influenza_CDR
gacuacgcaaucaau

SEQ ID NO: 52425 - RNA, 15 nt, Artificial Sequence
  derived and/or modified sequence opt6 from anti-influenza_CDR
agacauggcauaagc

SEQ ID NO: 52426 - RNA, 15 nt, Artificial Sequence
  derived and/or modified sequence opt6 from anti-influenza_CDR
gaacuaucuauccau

SEQ ID NO: 52427 - RNA, 15 nt, Artificial Sequence
  derived and/or modified sequence opt6 from anti-influenza_CDR
uccuccaacuacuac

SEQ ID NO: 52428 - RNA, 15 nt, Artificial Sequence
  derived and/or modified sequence opt6 from anti-influenza_CDR
acuuaugccauguca

SEQ ID NO: 52429 - RNA, 15 nt, Artificial Sequence
  derived and/or modified sequence opt6 from anti-influenza_CDR
aauuacgccaucuca

SEQ ID NO: 52430 - RNA, 18 nt, Artificial Sequence
  derived and/or modified sequence opt6 from anti-influenza_CDR
uuuggagcgauagcggga

SEQ ID NO: 52431 - RNA, 18 nt, Artificial Sequence
  derived and/or modified sequence opt6 from anti-influenza_CDR
caagauaucucucgauau

SEQ ID NO: 52432 - RNA, 18 nt, Artificial Sequence
  derived and/or modified sequence opt6 from anti-influenza_CDR
caaaauauagggccaugg

SEQ ID NO: 52433 - RNA, 18 nt, Artificial Sequence
  derived and/or modified sequence opt6 from anti-influenza_CDR
caaagcguaaauagacgc

SEQ ID NO: 52434 - RNA, 18 nt, Artificial Sequence
  derived and/or modified sequence opt6 from anti-influenza_CDR
caauccaucuccaccuac

SEQ ID NO: 52435 - RNA, 18 nt, Artificial Sequence
  derived and/or modified sequence opt6 from anti-influenza_CDR
cagggcauaauaacauac

SEQ ID NO: 52436 - RNA, 18 nt, Artificial Sequence
  derived and/or modified sequence opt6 from anti-influenza_CDR
cagggaauaagcaguuac

SEQ ID NO: 52437 - RNA, 18 nt, Artificial Sequence
  derived and/or modified sequence opt6 from anti-influenza_CDR
caggacguaaguacaugg

SEQ ID NO: 52438 - RNA, 18 nt, Artificial Sequence
  derived and/or modified sequence opt6 from anti-influenza_CDR
caggacauauauauauau

SEQ ID NO: 52439 - RNA, 18 nt, Artificial Sequence
  derived and/or modified sequence opt6 from anti-influenza_CDR
gaaaacauauggaacaau

SEQ ID NO: 52440 - RNA, 18 nt, Artificial Sequence
  derived and/or modified sequence opt6 from anti-influenza_CDR
ggguuuacgguuacgagu

SEQ ID NO: 52441 - RNA, 18 nt, Artificial Sequence
  derived and/or modified sequence opt6 from anti-influenza_CDR
caagauauaucuggacau

SEQ ID NO: 52442 - RNA, 18 nt, Artificial Sequence
  derived and/or modified sequence opt6 from anti-influenza_CDR
ucacuacugacagaaguc

SEQ ID NO: 52443 - RNA, 18 nt, Artificial Sequence
  derived and/or modified sequence opt6 from anti-influenza_CDR
ggcucgaguauaaguaau

SEQ ID NO: 52444 - RNA, 18 nt, Artificial Sequence
  derived and/or modified sequence opt6 from anti-influenza_CDR
gggggaaguauaacgagu

SEQ ID NO: 52445 - RNA, 18 nt, Artificial Sequence
  derived and/or modified sequence opt6 from anti-influenza_CDR
ggggggaguauaaguagu

SEQ ID NO: 52446 - RNA, 18 nt, Artificial Sequence
  derived and/or modified sequence opt6 from anti-influenza_CDR
ggcuugagugugaguucg

SEQ ID NO: 52447 - RNA, 18 nt, Artificial Sequence
  derived and/or modified sequence opt6 from anti-influenza_CDR
ggggcgaguauaaguagu

SEQ ID NO: 52448 - RNA, 18 nt, Artificial Sequence
  derived and/or modified sequence opt6 from anti-influenza_CDR
ggggauaguauaaguagu

SEQ ID NO: 52449 - RNA, 18 nt, Artificial Sequence
  derived and/or modified sequence opt6 from anti-influenza_CDR
ggcgggaguauaaguaau

SEQ ID NO: 52450 - RNA, 18 nt, Artificial Sequence
  derived and/or modified sequence opt6 from anti-influenza_CDR
ggugggaguauaagugcg

SEQ ID NO: 52451 - RNA, 18 nt, Artificial Sequence
  derived and/or modified sequence opt6 from anti-influenza_CDR
ggauuuagcgugagugau

SEQ ID NO: 52452 - RNA, 18 nt, Artificial Sequence
  derived and/or modified sequence opt6 from anti-influenza_CDR
ucuagaucucuagauguc

SEQ ID NO: 52453 - RNA, 18 nt, Artificial Sequence
  derived and/or modified sequence opt6 from anti-influenza_CDR
cgaucacaacaaaccgua

SEQ ID NO: 52454 - RNA, 18 nt, Artificial Sequence
  derived and/or modified sequence opt6 from anti-influenza_CDR
caaaccauaaacaacuac

SEQ ID NO: 52455 - RNA, 18 nt, Artificial Sequence
  derived and/or modified sequence opt6 from anti-influenza_CDR
aauaugggcccgacauca

SEQ ID NO: 52456 - RNA, 18 nt, Artificial Sequence
  derived and/or modified sequence opt6 from anti-influenza_CDR
caaguagucgggacaaau

SEQ ID NO: 52457 - RNA, 18 nt, Artificial Sequence
  derived and/or modified sequence opt6 from anti-influenza_CDR
caaggcauaaauacacau

SEQ ID NO: 52458 - RNA, 18 nt, Artificial Sequence
  derived and/or modified sequence opt6 from anti-influenza_CDR
caggacauaagaaauaga

SEQ ID NO: 52459 - RNA, 18 nt, Artificial Sequence
  derived and/or modified sequence opt6 from anti-influenza_CDR
caggggauagggaguaau

SEQ ID NO: 52460 - RNA, 18 nt, Artificial Sequence
  derived and/or modified sequence opt6 from anti-influenza_CDR
cagacaauauacagaugg

SEQ ID NO: 52461 - RNA, 18 nt, Artificial Sequence
  derived and/or modified sequence opt6 from anti-influenza_CDR
caaacaaucacccgauuc

SEQ ID NO: 52462 - RNA, 18 nt, Artificial Sequence
  derived and/or modified sequence opt6 from anti-influenza_CDR
agauugggcgagaaauuu

SEQ ID NO: 52463 - RNA, 18 nt, Artificial Sequence
  derived and/or modified sequence opt6 from anti-influenza_CDR
aaguugggggauaaguuu

SEQ ID NO: 52464 - RNA, 18 nt, Artificial Sequence
  derived and/or modified sequence opt6 from anti-influenza_CDR
caagggcuaggaaguaau

SEQ ID NO: 52465 - RNA, 18 nt, Artificial Sequence
  derived and/or modified sequence opt6 from anti-influenza_CDR
uauaucgggaguaagagc

SEQ ID NO: 52466 - RNA, 18 nt, Artificial Sequence
  derived and/or modified sequence opt6 from anti-influenza_CDR
caacucaucuccuccuac

SEQ ID NO: 52467 - RNA, 18 nt, Artificial Sequence
  derived and/or modified sequence opt6 from anti-influenza_CDR
caauccgucucaucaaac

SEQ ID NO: 52468 - RNA, 18 nt, Artificial Sequence
  derived and/or modified sequence opt6 from anti-influenza_CDR
caagucaucucuucauau

SEQ ID NO: 52469 - RNA, 18 nt, Artificial Sequence
  derived and/or modified sequence opt6 from anti-influenza_CDR
caaagcguaaacagaaac

SEQ ID NO: 52470 - RNA, 18 nt, Artificial Sequence
  derived and/or modified sequence opt6 from anti-influenza_CDR
gauaucgggaguaagagu

SEQ ID NO: 52471 - RNA, 18 nt, Artificial Sequence
  derived and/or modified sequence opt6 from anti-influenza_CDR
caauccgucucaacaaac

SEQ ID NO: 52472 - RNA, 18 nt, Artificial Sequence
  derived and/or modified sequence opt6 from anti-influenza_CDR
augauagcgggauggcac

SEQ ID NO: 52473 - RNA, 18 nt, Artificial Sequence
  derived and/or modified sequence opt6 from anti-influenza_CDR
caagauauaucgacaugg

SEQ ID NO: 52474 - RNA, 18 nt, Artificial Sequence
  derived and/or modified sequence opt6 from anti-influenza_CDR
gaaaaaauauacagcaac

SEQ ID NO: 52475 - RNA, 21 nt, Artificial Sequence
  derived and/or modified sequence opt6 from anti-influenza_CDR
aucuacuacaacuacaacauc

SEQ ID NO: 52476 - RNA, 21 nt, Artificial Sequence
  derived and/or modified sequence opt6 from anti-influenza_CDR
caaucaauuucauccggcuac

SEQ ID NO: 52477 - RNA, 21 nt, Artificial Sequence
  derived and/or modified sequence opt6 from anti-influenza_CDR
caauccgucuccucauccuau

SEQ ID NO: 52478 - RNA, 21 nt, Artificial Sequence
  derived and/or modified sequence opt6 from anti-influenza_CDR
caaaccgucuccucauccuau

SEQ ID NO: 52479 - RNA, 21 nt, Artificial Sequence
  derived and/or modified sequence opt6 from anti-influenza_CDR
aguaauaaugcggucuggaac

SEQ ID NO: 52480 - RNA, 21 nt, Artificial Sequence
  derived and/or modified sequence opt6 from anti-influenza_CDR
aguaauagugcggucuggaac

SEQ ID NO: 52481 - RNA, 21 nt, Artificial Sequence
  derived and/or modified sequence opt6 from anti-influenza_CDR
gccgccacaacacuacaauca

SEQ ID NO: 52482 - RNA, 21 nt, Artificial Sequence
  derived and/or modified sequence opt6 from anti-influenza_CDR
agcaauagagcgaccuggaac

SEQ ID NO: 52483 - RNA, 21 nt, Artificial Sequence
  derived and/or modified sequence opt6 from anti-influenza_CDR
gccaccucaacacuucaauca

SEQ ID NO: 52484 - RNA, 21 nt, Artificial Sequence
  derived and/or modified sequence opt6 from anti-influenza_CDR
ucaaauucagcaaccuggaac

SEQ ID NO: 52485 - RNA, 21 nt, Artificial Sequence
  derived and/or modified sequence opt6 from anti-influenza_CDR
gccuccucaacccuucaauca

SEQ ID NO: 52486 - RNA, 21 nt, Artificial Sequence
  derived and/or modified sequence opt6 from anti-influenza_CDR
aguuauaaugcggucuggaac

SEQ ID NO: 52487 - RNA, 21 nt, Artificial Sequence
  derived and/or modified sequence opt6 from anti-influenza_CDR
gccgcuucuucucguuuaucu

SEQ ID NO: 52488 - RNA, 21 nt, Artificial Sequence
  derived and/or modified sequence opt6 from anti-influenza_CDR
gcagcaagcaguagaggaagu

SEQ ID NO: 52489 - RNA, 21 nt, Artificial Sequence
  derived and/or modified sequence opt6 from anti-influenza_CDR
auauaccauagcggaagugca

SEQ ID NO: 52490 - RNA, 21 nt, Artificial Sequence
  derived and/or modified sequence opt6 from anti-influenza_CDR
auauauuacucuggcguuaca

SEQ ID NO: 52491 - RNA, 21 nt, Artificial Sequence
  derived and/or modified sequence opt6 from anti-influenza_CDR
ucuaguuauuuagcuugguau

SEQ ID NO: 52492 - RNA, 21 nt, Artificial Sequence
  derived and/or modified sequence opt6 from anti-influenza_CDR
caaucccucuccuccuccucc

SEQ ID NO: 52493 - RNA, 21 nt, Artificial Sequence
  derived and/or modified sequence opt6 from anti-influenza_CDR
cagagcguaagcauaagcuau

SEQ ID NO: 52494 - RNA, 21 nt, Artificial Sequence
  derived and/or modified sequence opt6 from anti-influenza_CDR
gacguaacagaaagaccaagc

SEQ ID NO: 52495 - RNA, 21 nt, Artificial Sequence
  derived and/or modified sequence opt6 from anti-influenza_CDR
gcugccucuacauuacuagau

SEQ ID NO: 52496 - RNA, 21 nt, Artificial Sequence
  derived and/or modified sequence opt6 from anti-influenza_CDR
gccgccucaacucuucauuca

SEQ ID NO: 52497 - RNA, 21 nt, Artificial Sequence
  derived and/or modified sequence opt6 from anti-influenza_CDR
ggggcaaguaguuuacaggga

SEQ ID NO: 52498 - RNA, 21 nt, Artificial Sequence
  derived and/or modified sequence opt6 from anti-influenza_CDR
acgaaugggguaaauguaggg

SEQ ID NO: 52499 - RNA, 21 nt, Artificial Sequence
  derived and/or modified sequence opt6 from anti-influenza_CDR
gacgcaagcacaagagcaaca

SEQ ID NO: 52500 - RNA, 21 nt, Artificial Sequence
  derived and/or modified sequence opt6 from anti-influenza_CDR
ucugaaacuuauuacuggucc

SEQ ID NO: 52501 - RNA, 21 nt, Artificial Sequence
  derived and/or modified sequence opt6 from anti-influenza_CDR
gaagcgguaaaucuagagagu

SEQ ID NO: 52502 - RNA, 21 nt, Artificial Sequence
  derived and/or modified sequence opt6 from anti-influenza_CDR
ggcgcaagcacaagagcaaca

SEQ ID NO: 52503 - RNA, 21 nt, Artificial Sequence
  derived and/or modified sequence opt6 from anti-influenza_CDR
gugaguggguauuauuggucg

SEQ ID NO: 52504 - RNA, 21 nt, Artificial Sequence
  derived and/or modified sequence opt6 from anti-influenza_CDR
auaacgggagugagaguggga

SEQ ID NO: 52505 - RNA, 21 nt, Artificial Sequence
  derived and/or modified sequence opt6 from anti-influenza_CDR
gacgcaagcaauagagcgaca

SEQ ID NO: 52506 - RNA, 21 nt, Artificial Sequence
  derived and/or modified sequence opt6 from anti-influenza_CDR
gaaguaacuaacuggccaucg

SEQ ID NO: 52507 - RNA, 21 nt, Artificial Sequence
  derived and/or modified sequence opt6 from anti-influenza_CDR
aaagauagcgaacgaccgagc

SEQ ID NO: 52508 - RNA, 21 nt, Artificial Sequence
  derived and/or modified sequence opt6 from anti-influenza_CDR
agcgggaauuauuacuggaac

SEQ ID NO: 52509 - RNA, 21 nt, Artificial Sequence
  derived and/or modified sequence opt6 from anti-influenza_CDR
uccacaaccauacgccacucc

SEQ ID NO: 52510 - RNA, 21 nt, Artificial Sequence
  derived and/or modified sequence opt6 from anti-influenza_CDR
gacgauagcggaagaccgagu

SEQ ID NO: 52511 - RNA, 21 nt, Artificial Sequence
  derived and/or modified sequence opt6 from anti-influenza_CDR
agaaaugacuuaagaccgagc

SEQ ID NO: 52512 - RNA, 21 nt, Artificial Sequence
  derived and/or modified sequence opt6 from anti-influenza_CDR
ucuguugaucauuauuggucu

SEQ ID NO: 52513 - RNA, 21 nt, Artificial Sequence
  derived and/or modified sequence opt6 from anti-influenza_CDR
gccgucucuauacuucaaucu

SEQ ID NO: 52514 - RNA, 21 nt, Artificial Sequence
  derived and/or modified sequence opt6 from anti-influenza_CDR
gacgauacagauagaccaagc

SEQ ID NO: 52515 - RNA, 21 nt, Artificial Sequence
  derived and/or modified sequence opt6 from anti-influenza_CDR
gaaaacaacaaaagaccauca

SEQ ID NO: 52516 - RNA, 21 nt, Artificial Sequence
  derived and/or modified sequence opt6 from anti-influenza_CDR
gacucaagcaauagagcgcca

SEQ ID NO: 52517 - RNA, 21 nt, Artificial Sequence
  derived and/or modified sequence opt6 from anti-influenza_CDR
gaaguaacaaaaaggccaucg

SEQ ID NO: 52518 - RNA, 21 nt, Artificial Sequence
  derived and/or modified sequence opt6 from anti-influenza_CDR
gccaccucaaacacacacuca

SEQ ID NO: 52519 - RNA, 21 nt, Artificial Sequence
  derived and/or modified sequence opt6 from anti-influenza_CDR
gccgcaagcaaucuagaaaau

SEQ ID NO: 52520 - RNA, 21 nt, Artificial Sequence
  derived and/or modified sequence opt6 from anti-influenza_CDR
gcagcaucaggacuacaauca

SEQ ID NO: 52521 - RNA, 21 nt, Artificial Sequence
  derived and/or modified sequence opt6 from anti-influenza_CDR
ggcuuuacaguuucgucuaau

SEQ ID NO: 52522 - RNA, 21 nt, Artificial Sequence
  derived and/or modified sequence opt6 from anti-influenza_CDR
ggggggggguauaguuggaau

SEQ ID NO: 52523 - RNA, 21 nt, Artificial Sequence
  derived and/or modified sequence opt6 from anti-influenza_CDR
ggcgcaagcaaucuacagagu

SEQ ID NO: 52524 - RNA, 21 nt, Artificial Sequence
  derived and/or modified sequence opt6 from anti-influenza_CDR
ggcgcaacaaaucuacaaagu

SEQ ID NO: 52525 - RNA, 21 nt, Artificial Sequence
  derived and/or modified sequence opt6 from anti-influenza_CDR
ggcgcuagcaaucuacauagu

SEQ ID NO: 52526 - RNA, 21 nt, Artificial Sequence
  derived and/or modified sequence opt6 from anti-influenza_CDR
ggcgcaagcacacuacagagu

SEQ ID NO: 52527 - RNA, 21 nt, Artificial Sequence
  derived and/or modified sequence opt6 from anti-influenza_CDR
gacaauagcgauagaccgagc

SEQ ID NO: 52528 - RNA, 21 nt, Artificial Sequence
  derived and/or modified sequence opt6 from anti-influenza_CDR
ggcgcaagcucacuacagagu

SEQ ID NO: 52529 - RNA, 21 nt, Artificial Sequence
  derived and/or modified sequence opt6 from anti-influenza_CDR
ggcaauagcaauagaccgagc

SEQ ID NO: 52530 - RNA, 21 nt, Artificial Sequence
  derived and/or modified sequence opt6 from anti-influenza_CDR
gccgccucuucacuucaaucu

SEQ ID NO: 52531 - RNA, 21 nt, Artificial Sequence
  derived and/or modified sequence opt6 from anti-influenza_CDR
gccgccucuucucuucauucu

SEQ ID NO: 52532 - RNA, 21 nt, Artificial Sequence
  derived and/or modified sequence opt6 from anti-influenza_CDR
ggcgcaagcacacuacagaau

SEQ ID NO: 52533 - RNA, 21 nt, Artificial Sequence
  derived and/or modified sequence opt6 from anti-influenza_CDR
ggcgcaacagaucuacaaagu

SEQ ID NO: 52534 - RNA, 21 nt, Artificial Sequence
  derived and/or modified sequence opt6 from anti-influenza_CDR
ucaggugcguauuauuggacg

SEQ ID NO: 52535 - RNA, 21 nt, Artificial Sequence
  derived and/or modified sequence opt6 from anti-influenza_CDR
gucuccgauaacuauaucaau

SEQ ID NO: 52536 - RNA, 21 nt, Artificial Sequence
  derived and/or modified sequence opt6 from anti-influenza_CDR
ugggcgagcacaagagaaagc

SEQ ID NO: 52537 - RNA, 21 nt, Artificial Sequence
  derived and/or modified sequence opt6 from anti-influenza_CDR
uccaauaaccaacgcccaucc

SEQ ID NO: 52538 - RNA, 21 nt, Artificial Sequence
  derived and/or modified sequence opt6 from anti-influenza_CDR
gaaguaagcaauagaccgagc

SEQ ID NO: 52539 - RNA, 21 nt, Artificial Sequence
  derived and/or modified sequence opt6 from anti-influenza_CDR
aaaaacacccaacgcccaucc

SEQ ID NO: 52540 - RNA, 21 nt, Artificial Sequence
  derived and/or modified sequence opt6 from anti-influenza_CDR
gacaacaacaaaagaccauca

SEQ ID NO: 52541 - RNA, 21 nt, Artificial Sequence
  derived and/or modified sequence opt6 from anti-influenza_CDR
gaugccucuacacuuagaucu

SEQ ID NO: 52542 - RNA, 21 nt, Artificial Sequence
  derived and/or modified sequence opt6 from anti-influenza_CDR
caagauaacagaagaccgagc

SEQ ID NO: 52543 - RNA, 21 nt, Artificial Sequence
  derived and/or modified sequence opt6 from anti-influenza_CDR
gacguaagcaaaagaccaagu

SEQ ID NO: 52544 - RNA, 21 nt, Artificial Sequence
  derived and/or modified sequence opt6 from anti-influenza_CDR
gacgcaagcucaagagcgaca

SEQ ID NO: 52545 - RNA, 21 nt, Artificial Sequence
  derived and/or modified sequence opt6 from anti-influenza_CDR
cucgggagcaauagagcgagc

SEQ ID NO: 52546 - RNA, 21 nt, Artificial Sequence
  derived and/or modified sequence opt6 from anti-influenza_CDR
ggagcaagcacaagagcggca

SEQ ID NO: 52547 - RNA, 21 nt, Artificial Sequence
  derived and/or modified sequence opt6 from anti-influenza_CDR
gacgauagcgauagaccgagc

SEQ ID NO: 52548 - RNA, 21 nt, Artificial Sequence
  derived and/or modified sequence opt6 from anti-influenza_CDR
agagauggacaaagaccaagc

SEQ ID NO: 52549 - RNA, 21 nt, Artificial Sequence
  derived and/or modified sequence opt6 from anti-influenza_CDR
ggagcaagcucaagagcgaca

SEQ ID NO: 52550 - RNA, 21 nt, Artificial Sequence
  derived and/or modified sequence opt6 from anti-influenza_CDR
ggcgcgagcucgagagcgagu

SEQ ID NO: 52551 - RNA, 21 nt, Artificial Sequence
  derived and/or modified sequence opt6 from anti-influenza_CDR
gccgccucaacacuucaauca

SEQ ID NO: 52552 - RNA, 21 nt, Artificial Sequence
  derived and/or modified sequence opt6 from anti-influenza_CDR
cucgugagcaagcgcgcgagc

SEQ ID NO: 52553 - RNA, 21 nt, Artificial Sequence
  derived and/or modified sequence opt6 from anti-influenza_CDR
gacguaacauacagaccauca

SEQ ID NO: 52554 - RNA, 21 nt, Artificial Sequence
  derived and/or modified sequence opt6 from anti-influenza_CDR
augcaagcacucgaaaccccg

SEQ ID NO: 52555 - RNA, 21 nt, Artificial Sequence
  derived and/or modified sequence opt6 from anti-influenza_CDR
caaaauuacggcaguccauuc

SEQ ID NO: 52556 - RNA, 21 nt, Artificial Sequence
  derived and/or modified sequence opt6 from anti-influenza_CDR
caacaauacggcucacuacca

SEQ ID NO: 52557 - RNA, 21 nt, Artificial Sequence
  derived and/or modified sequence opt6 from anti-influenza_CDR
ugggggaguuauuuggagagu

SEQ ID NO: 52558 - RNA, 21 nt, Artificial Sequence
  derived and/or modified sequence opt6 from anti-influenza_CDR
agcgcaagcacacgcgcaaca

SEQ ID NO: 52559 - RNA, 21 nt, Artificial Sequence
  derived and/or modified sequence opt6 from anti-influenza_CDR
ggcgcgagcacgagagcaagu

SEQ ID NO: 52560 - RNA, 21 nt, Artificial Sequence
  derived and/or modified sequence opt6 from anti-influenza_CDR
ggcgcaagcacaagagauaca

SEQ ID NO: 52561 - RNA, 21 nt, Artificial Sequence
  derived and/or modified sequence opt6 from anti-influenza_CDR
aaagugagcacgcucgagagc

SEQ ID NO: 52562 - RNA, 21 nt, Artificial Sequence
  derived and/or modified sequence opt6 from anti-influenza_CDR
agcaauaccgaacgcccaagc

SEQ ID NO: 52563 - RNA, 21 nt, Artificial Sequence
  derived and/or modified sequence opt6 from anti-influenza_CDR
aaaauaagcaaucgcgacagc

SEQ ID NO: 52564 - RNA, 21 nt, Artificial Sequence
  derived and/or modified sequence opt6 from anti-influenza_CDR
uccgcuagccaucgcuauucc

SEQ ID NO: 52565 - RNA, 21 nt, Artificial Sequence
  derived and/or modified sequence opt6 from anti-influenza_CDR
cagagcguacgcucaaacaau

SEQ ID NO: 52566 - RNA, 21 nt, Artificial Sequence
  derived and/or modified sequence opt6 from anti-influenza_CDR
cagaguguuagaucaggcuau

SEQ ID NO: 52567 - RNA, 21 nt, Artificial Sequence
  derived and/or modified sequence opt6 from anti-influenza_CDR
auauauuaucgcgggaguacg

SEQ ID NO: 52568 - RNA, 21 nt, Artificial Sequence
  derived and/or modified sequence opt6 from anti-influenza_CDR
guauauuauuccggaauuaca

SEQ ID NO: 52569 - RNA, 21 nt, Artificial Sequence
  derived and/or modified sequence opt6 from anti-influenza_CDR
ucccacuucgccaacuuaaaa

SEQ ID NO: 52570 - RNA, 21 nt, Artificial Sequence
  derived and/or modified sequence opt6 from anti-influenza_CDR
cucaacaaauccaaacccuac

SEQ ID NO: 52571 - RNA, 21 nt, Artificial Sequence
  derived and/or modified sequence opt6 from anti-influenza_CDR
aaauuagcgaauacgggcacg

SEQ ID NO: 52572 - RNA, 21 nt, Artificial Sequence
  derived and/or modified sequence opt6 from anti-influenza_CDR
gcugccucuacacuuacaucu

SEQ ID NO: 52573 - RNA, 21 nt, Artificial Sequence
  derived and/or modified sequence opt6 from anti-influenza_CDR
gacgcgaguaaguuagcgagu

SEQ ID NO: 52574 - RNA, 21 nt, Artificial Sequence
  derived and/or modified sequence opt6 from anti-influenza_CDR
uuugcaucuagacuugcaucu

SEQ ID NO: 52575 - RNA, 21 nt, Artificial Sequence
  derived and/or modified sequence opt6 from anti-influenza_CDR
ucugcauccacacuugcaucu

SEQ ID NO: 52576 - RNA, 21 nt, Artificial Sequence
  derived and/or modified sequence opt6 from anti-influenza_CDR
gaaguaagccaaagaccaagc

SEQ ID NO: 52577 - RNA, 21 nt, Artificial Sequence
  derived and/or modified sequence opt6 from anti-influenza_CDR
ggcgggacauuaaauaauuau

SEQ ID NO: 52578 - RNA, 21 nt, Artificial Sequence
  derived and/or modified sequence opt6 from anti-influenza_CDR
gauauagucaugacucaaucu

SEQ ID NO: 52579 - RNA, 24 nt, Artificial Sequence
  derived and/or modified sequence opt6 from anti-influenza_CDR
gguuuuacuuuuucuaauuaugcu

SEQ ID NO: 52580 - RNA, 24 nt, Artificial Sequence
  derived and/or modified sequence opt6 from anti-influenza_CDR
gguuuuacuuuuucuaauuauggu

SEQ ID NO: 52581 - RNA, 24 nt, Artificial Sequence
  derived and/or modified sequence opt6 from anti-influenza_CDR
gguuuuacuuuuucuucuuaugcu

SEQ ID NO: 52582 - RNA, 24 nt, Artificial Sequence
  derived and/or modified sequence opt6 from anti-influenza_CDR
gguuuuacuuuuucuacuuaugcu

SEQ ID NO: 52583 - RNA, 24 nt, Artificial Sequence
  derived and/or modified sequence opt6 from anti-influenza_CDR
ggagguauauuuauaagucaggcu

SEQ ID NO: 52584 - RNA, 24 nt, Artificial Sequence
  derived and/or modified sequence opt6 from anti-influenza_CDR
gguggaauuuuuaguccguaugca

SEQ ID NO: 52585 - RNA, 24 nt, Artificial Sequence
  derived and/or modified sequence opt6 from anti-influenza_CDR
ggugggccauuuaguggauuugca

SEQ ID NO: 52586 - RNA, 24 nt, Artificial Sequence
  derived and/or modified sequence opt6 from anti-influenza_CDR
gguggaacuuuuaauucacaugca

SEQ ID NO: 52587 - RNA, 24 nt, Artificial Sequence
  derived and/or modified sequence opt6 from anti-influenza_CDR
ggaucgaauauaggaucgaauacg

SEQ ID NO: 52588 - RNA, 24 nt, Artificial Sequence
  derived and/or modified sequence opt6 from anti-influenza_CDR
ggugugacuuuuaguauguaugca

SEQ ID NO: 52589 - RNA, 24 nt, Artificial Sequence
  derived and/or modified sequence opt6 from anti-influenza_CDR
ggcgugacuuuuaguauguauaca

SEQ ID NO: 52590 - RNA, 24 nt, Artificial Sequence
  derived and/or modified sequence opt6 from anti-influenza_CDR
ggcguaacuucaucuaauuaucca

SEQ ID NO: 52591 - RNA, 24 nt, Artificial Sequence
  derived and/or modified sequence opt6 from anti-influenza_CDR
auaauagcaauauucggaacaaca

SEQ ID NO: 52592 - RNA, 24 nt, Artificial Sequence
  derived and/or modified sequence opt6 from anti-influenza_CDR
auaauaccauuauucggaacagca

SEQ ID NO: 52593 - RNA, 24 nt, Artificial Sequence
  derived and/or modified sequence opt6 from anti-influenza_CDR
auaauaccacuauucggcacaaca

SEQ ID NO: 52594 - RNA, 24 nt, Artificial Sequence
  derived and/or modified sequence opt6 from anti-influenza_CDR
auaauaccaauguucggagcaaca

SEQ ID NO: 52595 - RNA, 24 nt, Artificial Sequence
  derived and/or modified sequence opt6 from anti-influenza_CDR
auaauaccaauguucggaacaaca

SEQ ID NO: 52596 - RNA, 24 nt, Artificial Sequence
  derived and/or modified sequence opt6 from anti-influenza_CDR
auaaauaguggaggaggggcgacg

SEQ ID NO: 52597 - RNA, 24 nt, Artificial Sequence
  derived and/or modified sequence opt6 from anti-influenza_CDR
auaucagcaguauucggaacagca

SEQ ID NO: 52598 - RNA, 24 nt, Artificial Sequence
  derived and/or modified sequence opt6 from anti-influenza_CDR
auaagcuacgacgcaaacuacaaa

SEQ ID NO: 52599 - RNA, 24 nt, Artificial Sequence
  derived and/or modified sequence opt6 from anti-influenza_CDR
auaucauacgacggaaauuacaaa

SEQ ID NO: 52600 - RNA, 24 nt, Artificial Sequence
  derived and/or modified sequence opt6 from anti-influenza_CDR
auaucguacgauggaucgaacaag

SEQ ID NO: 52601 - RNA, 24 nt, Artificial Sequence
  derived and/or modified sequence opt6 from anti-influenza_CDR
auaaguuaugacgggaguaaucaa

SEQ ID NO: 52602 - RNA, 24 nt, Artificial Sequence
  derived and/or modified sequence opt6 from anti-influenza_CDR
caacaauacuaccgcucacccuca

SEQ ID NO: 52603 - RNA, 24 nt, Artificial Sequence
  derived and/or modified sequence opt6 from anti-influenza_CDR
guucuuccucuuuuuggcguuacu

SEQ ID NO: 52604 - RNA, 24 nt, Artificial Sequence
  derived and/or modified sequence opt6 from anti-influenza_CDR
ggagggacauuuaguucagaugca

SEQ ID NO: 52605 - RNA, 24 nt, Artificial Sequence
  derived and/or modified sequence opt6 from anti-influenza_CDR
auaauacccguauuccaaaccgca

SEQ ID NO: 52606 - RNA, 24 nt, Artificial Sequence
  derived and/or modified sequence opt6 from anti-influenza_CDR
acaucaaacauaggcucaaacgca

SEQ ID NO: 52607 - RNA, 24 nt, Artificial Sequence
  derived and/or modified sequence opt6 from anti-influenza_CDR
ggguauaguuuuacgaguaggugg

SEQ ID NO: 52608 - RNA, 24 nt, Artificial Sequence
  derived and/or modified sequence opt6 from anti-influenza_CDR
auauauccaucugacucugacguc

SEQ ID NO: 52609 - RNA, 24 nt, Artificial Sequence
  derived and/or modified sequence opt6 from anti-influenza_CDR
caacaauacgacaacuggcuauca

SEQ ID NO: 52610 - RNA, 24 nt, Artificial Sequence
  derived and/or modified sequence opt6 from anti-influenza_CDR
ggagggacguuuaguaauuauggg

SEQ ID NO: 52611 - RNA, 24 nt, Artificial Sequence
  derived and/or modified sequence opt6 from anti-influenza_CDR
ggcgcuucuauuucuucuucuuau

SEQ ID NO: 52612 - RNA, 24 nt, Artificial Sequence
  derived and/or modified sequence opt6 from anti-influenza_CDR
ggcgggacuuuuaguucauaugau

SEQ ID NO: 52613 - RNA, 24 nt, Artificial Sequence
  derived and/or modified sequence opt6 from anti-influenza_CDR
auaauaccaauauacggaacagca

SEQ ID NO: 52614 - RNA, 24 nt, Artificial Sequence
  derived and/or modified sequence opt6 from anti-influenza_CDR
ggauacacaaguacaacauacgga

SEQ ID NO: 52615 - RNA, 24 nt, Artificial Sequence
  derived and/or modified sequence opt6 from anti-influenza_CDR
auaaacccauacaacggcaaccca

SEQ ID NO: 52616 - RNA, 24 nt, Artificial Sequence
  derived and/or modified sequence opt6 from anti-influenza_CDR
auaugguaugauggagauaacaag

SEQ ID NO: 52617 - RNA, 24 nt, Artificial Sequence
  derived and/or modified sequence opt6 from anti-influenza_CDR
ggcuuuacauuuagugauuucugg

SEQ ID NO: 52618 - RNA, 24 nt, Artificial Sequence
  derived and/or modified sequence opt6 from anti-influenza_CDR
auagaucaagacggaaaugaaaga

SEQ ID NO: 52619 - RNA, 24 nt, Artificial Sequence
  derived and/or modified sequence opt6 from anti-influenza_CDR
ucaucaaacaucggcaaaaacuac

SEQ ID NO: 52620 - RNA, 24 nt, Artificial Sequence
  derived and/or modified sequence opt6 from anti-influenza_CDR
ggauauacauuuacaaauuacugg

SEQ ID NO: 52621 - RNA, 24 nt, Artificial Sequence
  derived and/or modified sequence opt6 from anti-influenza_CDR
auauucccacccgacucccaaacc

SEQ ID NO: 52622 - RNA, 24 nt, Artificial Sequence
  derived and/or modified sequence opt6 from anti-influenza_CDR
ggcuauaguuuuagugauuacugg

SEQ ID NO: 52623 - RNA, 24 nt, Artificial Sequence
  derived and/or modified sequence opt6 from anti-influenza_CDR
auauauccagccucaucugaaauu

SEQ ID NO: 52624 - RNA, 24 nt, Artificial Sequence
  derived and/or modified sequence opt6 from anti-influenza_CDR
aguggggauagugggacguggaau

SEQ ID NO: 52625 - RNA, 24 nt, Artificial Sequence
  derived and/or modified sequence opt6 from anti-influenza_CDR
ggcgggacauuaaauaauuaugca

SEQ ID NO: 52626 - RNA, 24 nt, Artificial Sequence
  derived and/or modified sequence opt6 from anti-influenza_CDR
auuucuccuauuuucggcacucuu

SEQ ID NO: 52627 - RNA, 24 nt, Artificial Sequence
  derived and/or modified sequence opt6 from anti-influenza_CDR
gguguauuuuuuaguucgcaugcg

SEQ ID NO: 52628 - RNA, 24 nt, Artificial Sequence
  derived and/or modified sequence opt6 from anti-influenza_CDR
auaucaccaauguucggaacaaca

SEQ ID NO: 52629 - RNA, 24 nt, Artificial Sequence
  derived and/or modified sequence opt6 from anti-influenza_CDR
gguuuuacuuuuucucguuuuggu

SEQ ID NO: 52630 - RNA, 24 nt, Artificial Sequence
  derived and/or modified sequence opt6 from anti-influenza_CDR
auaugguaugacgggaguaauaaa

SEQ ID NO: 52631 - RNA, 24 nt, Artificial Sequence
  derived and/or modified sequence opt6 from anti-influenza_CDR
caaacauauggaggagugaguaca

SEQ ID NO: 52632 - RNA, 24 nt, Artificial Sequence
  derived and/or modified sequence opt6 from anti-influenza_CDR
gauagcgcaggcaauagacauagc

SEQ ID NO: 52633 - RNA, 24 nt, Artificial Sequence
  derived and/or modified sequence opt6 from anti-influenza_CDR
uuuagagggggcaauaguuugagu

SEQ ID NO: 52634 - RNA, 24 nt, Artificial Sequence
  derived and/or modified sequence opt6 from anti-influenza_CDR
ggauauacauuuacaacuuacugg

SEQ ID NO: 52635 - RNA, 24 nt, Artificial Sequence
  derived and/or modified sequence opt6 from anti-influenza_CDR
auagacccauaugacucugaaacu

SEQ ID NO: 52636 - RNA, 24 nt, Artificial Sequence
  derived and/or modified sequence opt6 from anti-influenza_CDR
auacguaaguuuuugaacugguac

SEQ ID NO: 52637 - RNA, 24 nt, Artificial Sequence
  derived and/or modified sequence opt6 from anti-influenza_CDR
caacaauacgacggacuaccauuu

SEQ ID NO: 52638 - RNA, 24 nt, Artificial Sequence
  derived and/or modified sequence opt6 from anti-influenza_CDR
auaagaaacagccuaaacugguac

SEQ ID NO: 52639 - RNA, 24 nt, Artificial Sequence
  derived and/or modified sequence opt6 from anti-influenza_CDR
caacaagccaacucauucccacuc

SEQ ID NO: 52640 - RNA, 24 nt, Artificial Sequence
  derived and/or modified sequence opt6 from anti-influenza_CDR
ucacuauuaacagaagucgaaaca

SEQ ID NO: 52641 - RNA, 24 nt, Artificial Sequence
  derived and/or modified sequence opt6 from anti-influenza_CDR
caacaauccuauuccaugcccgca

SEQ ID NO: 52642 - RNA, 24 nt, Artificial Sequence
  derived and/or modified sequence opt6 from anti-influenza_CDR
ggagggccgguaaguggaggagga

SEQ ID NO: 52643 - RNA, 24 nt, Artificial Sequence
  derived and/or modified sequence opt6 from anti-influenza_CDR
caacaaucauuuuccguacccgca

SEQ ID NO: 52644 - RNA, 24 nt, Artificial Sequence
  derived and/or modified sequence opt6 from anti-influenza_CDR
caacaaaccuacuccaucccccuc

SEQ ID NO: 52645 - RNA, 24 nt, Artificial Sequence
  derived and/or modified sequence opt6 from anti-influenza_CDR
caacaaucauauuccguacccgca

SEQ ID NO: 52646 - RNA, 24 nt, Artificial Sequence
  derived and/or modified sequence opt6 from anti-influenza_CDR
caacaaaccuucuccaucccccuc

SEQ ID NO: 52647 - RNA, 24 nt, Artificial Sequence
  derived and/or modified sequence opt6 from anti-influenza_CDR
ggagauaguauaacaaguggggca

SEQ ID NO: 52648 - RNA, 24 nt, Artificial Sequence
  derived and/or modified sequence opt6 from anti-influenza_CDR
caagcaugggauaguucgacagca

SEQ ID NO: 52649 - RNA, 24 nt, Artificial Sequence
  derived and/or modified sequence opt6 from anti-influenza_CDR
caacaauacggaucaucauuaugg

SEQ ID NO: 52650 - RNA, 24 nt, Artificial Sequence
  derived and/or modified sequence opt6 from anti-influenza_CDR
gcauauggauauacauuugacccu

SEQ ID NO: 52651 - RNA, 24 nt, Artificial Sequence
  derived and/or modified sequence opt6 from anti-influenza_CDR
augcaagcacuccaaacaccacuc

SEQ ID NO: 52652 - RNA, 24 nt, Artificial Sequence
  derived and/or modified sequence opt6 from anti-influenza_CDR
caacaauacggcucaucacuaaca

SEQ ID NO: 52653 - RNA, 24 nt, Artificial Sequence
  derived and/or modified sequence opt6 from anti-influenza_CDR
caaaaauauaacuccgcccccuca

SEQ ID NO: 52654 - RNA, 24 nt, Artificial Sequence
  derived and/or modified sequence opt6 from anti-influenza_CDR
caacaaagaucaaacuggcuaaaa

SEQ ID NO: 52655 - RNA, 24 nt, Artificial Sequence
  derived and/or modified sequence opt6 from anti-influenza_CDR
uccucucaaucccgcuccucuacu

SEQ ID NO: 52656 - RNA, 24 nt, Artificial Sequence
  derived and/or modified sequence opt6 from anti-influenza_CDR
ccauaugacguaccagauuacgaa

SEQ ID NO: 52657 - RNA, 24 nt, Artificial Sequence
  derived and/or modified sequence opt6 from anti-influenza_CDR
ccauaugacguuccagauuacgcu

SEQ ID NO: 52658 - RNA, 24 nt, Artificial Sequence
  derived and/or modified sequence opt6 from anti-influenza_CDR
ccgggagauuuuaaugauuaugaa

SEQ ID NO: 52659 - RNA, 24 nt, Artificial Sequence
  derived and/or modified sequence opt6 from anti-influenza_CDR
ccgaaaguacgcgaucaagaaagc

SEQ ID NO: 52660 - RNA, 24 nt, Artificial Sequence
  derived and/or modified sequence opt6 from anti-influenza_CDR
accuccuacaccuccuccaacacc

SEQ ID NO: 52661 - RNA, 24 nt, Artificial Sequence
  derived and/or modified sequence opt6 from anti-influenza_CDR
ggcgggaauuuuaauaauuaugcg

SEQ ID NO: 52662 - RNA, 24 nt, Artificial Sequence
  derived and/or modified sequence opt6 from anti-influenza_CDR
auuucaccuauauucggcucuaca

SEQ ID NO: 52663 - RNA, 24 nt, Artificial Sequence
  derived and/or modified sequence opt6 from anti-influenza_CDR
uccuccuacaccuccuccaauacc

SEQ ID NO: 52664 - RNA, 24 nt, Artificial Sequence
  derived and/or modified sequence opt6 from anti-influenza_CDR
ggcgggacauuuaauaauuaugca

SEQ ID NO: 52665 - RNA, 24 nt, Artificial Sequence
  derived and/or modified sequence opt6 from anti-influenza_CDR
auuucuccuauuuucgguucuguu

SEQ ID NO: 52666 - RNA, 24 nt, Artificial Sequence
  derived and/or modified sequence opt6 from anti-influenza_CDR
uccucaaauaucggccacaauuuc

SEQ ID NO: 52667 - RNA, 24 nt, Artificial Sequence
  derived and/or modified sequence opt6 from anti-influenza_CDR
ggcacuugggauaguucguuaucg

SEQ ID NO: 52668 - RNA, 24 nt, Artificial Sequence
  derived and/or modified sequence opt6 from anti-influenza_CDR
ggagggauaauaagaaaguaugcg

SEQ ID NO: 52669 - RNA, 24 nt, Artificial Sequence
  derived and/or modified sequence opt6 from anti-influenza_CDR
auaauagccauauucaauacagcc

SEQ ID NO: 52670 - RNA, 24 nt, Artificial Sequence
  derived and/or modified sequence opt6 from anti-influenza_CDR
ggcuauacauuuacagcuuacacu

SEQ ID NO: 52671 - RNA, 24 nt, Artificial Sequence
  derived and/or modified sequence opt6 from anti-influenza_CDR
auaaacgcaggaaauggacauaca

SEQ ID NO: 52672 - RNA, 24 nt, Artificial Sequence
  derived and/or modified sequence opt6 from anti-influenza_CDR
ggcgguacauuuauuaauuaugcu

SEQ ID NO: 52673 - RNA, 24 nt, Artificial Sequence
  derived and/or modified sequence opt6 from anti-influenza_CDR
auaauaccaguauacggaacauca

SEQ ID NO: 52674 - RNA, 24 nt, Artificial Sequence
  derived and/or modified sequence opt6 from anti-influenza_CDR
gguuuuacuuuucguucucaugcu

SEQ ID NO: 52675 - RNA, 24 nt, Artificial Sequence
  derived and/or modified sequence opt6 from anti-influenza_CDR
auaucauacgacgaaguaaacaaa

SEQ ID NO: 52676 - RNA, 24 nt, Artificial Sequence
  derived and/or modified sequence opt6 from anti-influenza_CDR
gguuauaauuuugccgcuuauuau

SEQ ID NO: 52677 - RNA, 24 nt, Artificial Sequence
  derived and/or modified sequence opt6 from anti-influenza_CDR
ucaaauccaaauacaggaggagca

SEQ ID NO: 52678 - RNA, 24 nt, Artificial Sequence
  derived and/or modified sequence opt6 from anti-influenza_CDR
ggcuauacauuaauagauuacuau

SEQ ID NO: 52679 - RNA, 24 nt, Artificial Sequence
  derived and/or modified sequence opt6 from anti-influenza_CDR
auaaauccaauaaacggcggaaca

SEQ ID NO: 52680 - RNA, 24 nt, Artificial Sequence
  derived and/or modified sequence opt6 from anti-influenza_CDR
gguuuuacuuuuucugcuuaugcu

SEQ ID NO: 52681 - RNA, 24 nt, Artificial Sequence
  derived and/or modified sequence opt6 from anti-influenza_CDR
acgaguuaugacgggagagauagc

SEQ ID NO: 52682 - RNA, 24 nt, Artificial Sequence
  derived and/or modified sequence opt6 from anti-influenza_CDR
ggauuuacauuuaccaauuacgcu

SEQ ID NO: 52683 - RNA, 24 nt, Artificial Sequence
  derived and/or modified sequence opt6 from anti-influenza_CDR
auaucauucgacgaagacaacaaa

SEQ ID NO: 52684 - RNA, 24 nt, Artificial Sequence
  derived and/or modified sequence opt6 from anti-influenza_CDR
gguuuuaauuuuaguucguauggg

SEQ ID NO: 52685 - RNA, 24 nt, Artificial Sequence
  derived and/or modified sequence opt6 from anti-influenza_CDR
auauggaguggggggaguaauaag

SEQ ID NO: 52686 - RNA, 24 nt, Artificial Sequence
  derived and/or modified sequence opt6 from anti-influenza_CDR
ggauuuauauuuggcgauuuugcu

SEQ ID NO: 52687 - RNA, 24 nt, Artificial Sequence
  derived and/or modified sequence opt6 from anti-influenza_CDR
gguuuuaauuuugaugaguaugug

SEQ ID NO: 52688 - RNA, 24 nt, Artificial Sequence
  derived and/or modified sequence opt6 from anti-influenza_CDR
auaggagcagacggaagagggaca

SEQ ID NO: 52689 - RNA, 24 nt, Artificial Sequence
  derived and/or modified sequence opt6 from anti-influenza_CDR
ggcgggagugugaguaauuauuau

SEQ ID NO: 52690 - RNA, 24 nt, Artificial Sequence
  derived and/or modified sequence opt6 from anti-influenza_CDR
ggcgguacuuuuaguuauuaugcu

SEQ ID NO: 52691 - RNA, 24 nt, Artificial Sequence
  derived and/or modified sequence opt6 from anti-influenza_CDR
auaauuccaauugucgguacagcc

SEQ ID NO: 52692 - RNA, 24 nt, Artificial Sequence
  derived and/or modified sequence opt6 from anti-influenza_CDR
acaucaaacaucggcucaaacaca

SEQ ID NO: 52693 - RNA, 24 nt, Artificial Sequence
  derived and/or modified sequence opt6 from anti-influenza_CDR
gguuauaauuuuccuaaauacugg

SEQ ID NO: 52694 - RNA, 24 nt, Artificial Sequence
  derived and/or modified sequence opt6 from anti-influenza_CDR
auauauccaggugauucugauguu

SEQ ID NO: 52695 - RNA, 24 nt, Artificial Sequence
  derived and/or modified sequence opt6 from anti-influenza_CDR
ggucauacuuuuauuucuuacgcu

SEQ ID NO: 52696 - RNA, 24 nt, Artificial Sequence
  derived and/or modified sequence opt6 from anti-influenza_CDR
auaguaccaauauucggaacagua

SEQ ID NO: 52697 - RNA, 24 nt, Artificial Sequence
  derived and/or modified sequence opt6 from anti-influenza_CDR
ggauuuacauuuagaacauacgga

SEQ ID NO: 52698 - RNA, 24 nt, Artificial Sequence
  derived and/or modified sequence opt6 from anti-influenza_CDR
auaucauacgacggaacaaacaaa

SEQ ID NO: 52699 - RNA, 24 nt, Artificial Sequence
  derived and/or modified sequence opt6 from anti-influenza_CDR
gguuuuacuuuuucuucuuauggu

SEQ ID NO: 52700 - RNA, 24 nt, Artificial Sequence
  derived and/or modified sequence opt6 from anti-influenza_CDR
auaagcuacgacgaaauaaacaaa

SEQ ID NO: 52701 - RNA, 24 nt, Artificial Sequence
  derived and/or modified sequence opt6 from anti-influenza_CDR
ggauuuaguuuguggacgaguggg

SEQ ID NO: 52702 - RNA, 24 nt, Artificial Sequence
  derived and/or modified sequence opt6 from anti-influenza_CDR
augagcuaugacgagacaaaaaaa

SEQ ID NO: 52703 - RNA, 24 nt, Artificial Sequence
  derived and/or modified sequence opt6 from anti-influenza_CDR
gguuuuacuuuuucucguuauucu

SEQ ID NO: 52704 - RNA, 24 nt, Artificial Sequence
  derived and/or modified sequence opt6 from anti-influenza_CDR
auauccgacaccucacgaacaauc

SEQ ID NO: 52705 - RNA, 24 nt, Artificial Sequence
  derived and/or modified sequence opt6 from anti-influenza_CDR
gguuuuacuuuuaauucuuaugcu

SEQ ID NO: 52706 - RNA, 24 nt, Artificial Sequence
  derived and/or modified sequence opt6 from anti-influenza_CDR
auaagaggaagcggagaaaauaca

SEQ ID NO: 52707 - RNA, 24 nt, Artificial Sequence
  derived and/or modified sequence opt6 from anti-influenza_CDR
gguuuuacuuuuucucguuuuucu

SEQ ID NO: 52708 - RNA, 24 nt, Artificial Sequence
  derived and/or modified sequence opt6 from anti-influenza_CDR
auaagcgauaccggacgaacaaua

SEQ ID NO: 52709 - RNA, 24 nt, Artificial Sequence
  derived and/or modified sequence opt6 from anti-influenza_CDR
ggggauaguuuuacgaguuauugg

SEQ ID NO: 52710 - RNA, 24 nt, Artificial Sequence
  derived and/or modified sequence opt6 from anti-influenza_CDR
auauacccacgcgacuccgaaacc

SEQ ID NO: 52711 - RNA, 24 nt, Artificial Sequence
  derived and/or modified sequence opt6 from anti-influenza_CDR
ggcuauacauuuacagcuuaccau

SEQ ID NO: 52712 - RNA, 24 nt, Artificial Sequence
  derived and/or modified sequence opt6 from anti-influenza_CDR
auaaauccaaacucaggcgcaaca

SEQ ID NO: 52713 - RNA, 24 nt, Artificial Sequence
  derived and/or modified sequence opt6 from anti-influenza_CDR
gguuuuacuuuuucugauuauugg

SEQ ID NO: 52714 - RNA, 24 nt, Artificial Sequence
  derived and/or modified sequence opt6 from anti-influenza_CDR
auaucuucagacggaucuacaacu

SEQ ID NO: 52715 - RNA, 24 nt, Artificial Sequence
  derived and/or modified sequence opt6 from anti-influenza_CDR
gguuuuucguuuucuaaugcuugg

SEQ ID NO: 52716 - RNA, 24 nt, Artificial Sequence
  derived and/or modified sequence opt6 from anti-influenza_CDR
ggguuaacguuuucgaaugcgugg

SEQ ID NO: 52717 - RNA, 24 nt, Artificial Sequence
  derived and/or modified sequence opt6 from anti-influenza_CDR
ggguuuacguuuucgaaugcgugg

SEQ ID NO: 52718 - RNA, 24 nt, Artificial Sequence
  derived and/or modified sequence opt6 from anti-influenza_CDR
ggauuaucauuuuuaaaugccugg

SEQ ID NO: 52719 - RNA, 24 nt, Artificial Sequence
  derived and/or modified sequence opt6 from anti-influenza_CDR
ggguuuucguuuuugaaugcgugg

SEQ ID NO: 52720 - RNA, 24 nt, Artificial Sequence
  derived and/or modified sequence opt6 from anti-influenza_CDR
ggguuaacguuuuugaaugcgugg

SEQ ID NO: 52721 - RNA, 24 nt, Artificial Sequence
  derived and/or modified sequence opt6 from anti-influenza_CDR
ggguuuacguuuuugaaugcgugg

SEQ ID NO: 52722 - RNA, 24 nt, Artificial Sequence
  derived and/or modified sequence opt6 from anti-influenza_CDR
ggcuauacauuuacagauuacuau

SEQ ID NO: 52723 - RNA, 24 nt, Artificial Sequence
  derived and/or modified sequence opt6 from anti-influenza_CDR
guaaauccauauucaggcggaacu

SEQ ID NO: 52724 - RNA, 24 nt, Artificial Sequence
  derived and/or modified sequence opt6 from anti-influenza_CDR
ggcuauacauuuacagauuacaau

SEQ ID NO: 52725 - RNA, 24 nt, Artificial Sequence
  derived and/or modified sequence opt6 from anti-influenza_CDR
auauauccaaauaacggcggaacc

SEQ ID NO: 52726 - RNA, 24 nt, Artificial Sequence
  derived and/or modified sequence opt6 from anti-influenza_CDR
ggguauacguuuacggguuauaau

SEQ ID NO: 52727 - RNA, 24 nt, Artificial Sequence
  derived and/or modified sequence opt6 from anti-influenza_CDR
auauauccaaauaacggcguaacc

SEQ ID NO: 52728 - RNA, 24 nt, Artificial Sequence
  derived and/or modified sequence opt6 from anti-influenza_CDR
auggaaacggacacguuauuguua

SEQ ID NO: 52729 - RNA, 27 nt, Artificial Sequence
  derived and/or modified sequence opt6 from anti-influenza_CDR
gacggcguaacaaauaaaguaaacuca

SEQ ID NO: 52730 - RNA, 27 nt, Artificial Sequence
  derived and/or modified sequence opt6 from anti-influenza_CDR
gggagugauguggggaguaguaauuug

SEQ ID NO: 52731 - RNA, 27 nt, Artificial Sequence
  derived and/or modified sequence opt6 from anti-influenza_CDR
augcaaaacauccuacucccacucaca

SEQ ID NO: 52732 - RNA, 27 nt, Artificial Sequence
  derived and/or modified sequence opt6 from anti-influenza_CDR
augcaaucacuccaacucccccucaca

SEQ ID NO: 52733 - RNA, 27 nt, Artificial Sequence
  derived and/or modified sequence opt6 from anti-influenza_CDR
caacaacacuaccgcacaccaccaacc

SEQ ID NO: 52734 - RNA, 27 nt, Artificial Sequence
  derived and/or modified sequence opt6 from anti-influenza_CDR
caacaauacggcaacucaccauacaca

SEQ ID NO: 52735 - RNA, 27 nt, Artificial Sequence
  derived and/or modified sequence opt6 from anti-influenza_CDR
caacaauacggcucaucaccauacaca

SEQ ID NO: 52736 - RNA, 27 nt, Artificial Sequence
  derived and/or modified sequence opt6 from anti-influenza_CDR
caacaauacggcacaucaccacaaaca

SEQ ID NO: 52737 - RNA, 27 nt, Artificial Sequence
  derived and/or modified sequence opt6 from anti-influenza_CDR
caacaauacggauaccuaccccuaacu

SEQ ID NO: 52738 - RNA, 27 nt, Artificial Sequence
  derived and/or modified sequence opt6 from anti-influenza_CDR
caagcaugggauagcucgacagcagua

SEQ ID NO: 52739 - RNA, 27 nt, Artificial Sequence
  derived and/or modified sequence opt6 from anti-influenza_CDR
cagcauuauaaugcauacuggggaaca

SEQ ID NO: 52740 - RNA, 27 nt, Artificial Sequence
  derived and/or modified sequence opt6 from anti-influenza_CDR
caacaaaccuacucauccccccccacc

SEQ ID NO: 52741 - RNA, 27 nt, Artificial Sequence
  derived and/or modified sequence opt6 from anti-influenza_CDR
caacaauacuacuccuuccccuacacc

SEQ ID NO: 52742 - RNA, 27 nt, Artificial Sequence
  derived and/or modified sequence opt6 from anti-influenza_CDR
augcaagcacuccaacucccacucgca

SEQ ID NO: 52743 - RNA, 27 nt, Artificial Sequence
  derived and/or modified sequence opt6 from anti-influenza_CDR
caacaagccaacucauucccauucaca

SEQ ID NO: 52744 - RNA, 27 nt, Artificial Sequence
  derived and/or modified sequence opt6 from anti-influenza_CDR
caacaacuaaacggcuacccacuaaca

SEQ ID NO: 52745 - RNA, 27 nt, Artificial Sequence
  derived and/or modified sequence opt6 from anti-influenza_CDR
augcaagcacuccaaaccccacucaca

SEQ ID NO: 52746 - RNA, 27 nt, Artificial Sequence
  derived and/or modified sequence opt6 from anti-influenza_CDR
caacaaaacuacaacuggccacuaaca

SEQ ID NO: 52747 - RNA, 27 nt, Artificial Sequence
  derived and/or modified sequence opt6 from anti-influenza_CDR
caacaauacgacacaucauccggacuc

SEQ ID NO: 52748 - RNA, 27 nt, Artificial Sequence
  derived and/or modified sequence opt6 from anti-influenza_CDR
caacaauacaacucauggccaagaaca

SEQ ID NO: 52749 - RNA, 27 nt, Artificial Sequence
  derived and/or modified sequence opt6 from anti-influenza_CDR
guuauauauucgcaugggcgugcguau

SEQ ID NO: 52750 - RNA, 27 nt, Artificial Sequence
  derived and/or modified sequence opt6 from anti-influenza_CDR
caacaauacggagacagcagauacaca

SEQ ID NO: 52751 - RNA, 27 nt, Artificial Sequence
  derived and/or modified sequence opt6 from anti-influenza_CDR
cuccaacacaacucauaccccuacacc

SEQ ID NO: 52752 - RNA, 27 nt, Artificial Sequence
  derived and/or modified sequence opt6 from anti-influenza_CDR
agaaaaaugacaacagcauucgacagc

SEQ ID NO: 52753 - RNA, 27 nt, Artificial Sequence
  derived and/or modified sequence opt6 from anti-influenza_CDR
caaagaaaccacucaccaucauggaca

SEQ ID NO: 52754 - RNA, 27 nt, Artificial Sequence
  derived and/or modified sequence opt6 from anti-influenza_CDR
caacaaucauacgacaacccacaaaca

SEQ ID NO: 52755 - RNA, 27 nt, Artificial Sequence
  derived and/or modified sequence opt6 from anti-influenza_CDR
caacaauccagacgacuaccauacaca

SEQ ID NO: 52756 - RNA, 27 nt, Artificial Sequence
  derived and/or modified sequence opt6 from anti-influenza_CDR
agaaaaaugacaacagcaauagacuac

SEQ ID NO: 52757 - RNA, 27 nt, Artificial Sequence
  derived and/or modified sequence opt6 from anti-influenza_CDR
auaagauacaccggacaacaacuacua

SEQ ID NO: 52758 - RNA, 27 nt, Artificial Sequence
  derived and/or modified sequence opt6 from anti-influenza_CDR
caacacuacggaacaauaucacaaaca

SEQ ID NO: 52759 - RNA, 27 nt, Artificial Sequence
  derived and/or modified sequence opt6 from anti-influenza_CDR
caacaauacuccaccuccccccccacc

SEQ ID NO: 52760 - RNA, 27 nt, Artificial Sequence
  derived and/or modified sequence opt6 from anti-influenza_CDR
caacaauacggcaacucaccaauaaca

SEQ ID NO: 52761 - RNA, 27 nt, Artificial Sequence
  derived and/or modified sequence opt6 from anti-influenza_CDR
caacaauacuacucccgcccauacaca

SEQ ID NO: 52762 - RNA, 27 nt, Artificial Sequence
  derived and/or modified sequence opt6 from anti-influenza_CDR
caggugugggauaauuuuggaggggua

SEQ ID NO: 52763 - RNA, 27 nt, Artificial Sequence
  derived and/or modified sequence opt6 from anti-influenza_CDR
caacaauccuacuccuccccccucacc

SEQ ID NO: 52764 - RNA, 27 nt, Artificial Sequence
  derived and/or modified sequence opt6 from anti-influenza_CDR
caacaauauuucgccacuccccgcacc

SEQ ID NO: 52765 - RNA, 27 nt, Artificial Sequence
  derived and/or modified sequence opt6 from anti-influenza_CDR
caacaauacuacuucuccccccucacc

SEQ ID NO: 52766 - RNA, 27 nt, Artificial Sequence
  derived and/or modified sequence opt6 from anti-influenza_CDR
caacauuucggcacaucuguauuuaca

SEQ ID NO: 52767 - RNA, 27 nt, Artificial Sequence
  derived and/or modified sequence opt6 from anti-influenza_CDR
caacaauacuauaacgccccccuaacc

SEQ ID NO: 52768 - RNA, 27 nt, Artificial Sequence
  derived and/or modified sequence opt6 from anti-influenza_CDR
guccuuuuuacuucuccuuuugacuuu

SEQ ID NO: 52769 - RNA, 27 nt, Artificial Sequence
  derived and/or modified sequence opt6 from anti-influenza_CDR
uuguuaucguauucgggugugugggug

SEQ ID NO: 52770 - RNA, 27 nt, Artificial Sequence
  derived and/or modified sequence opt6 from anti-influenza_CDR
uuuuuaucguauucgggugcgugggug

SEQ ID NO: 52771 - RNA, 27 nt, Artificial Sequence
  derived and/or modified sequence opt6 from anti-influenza_CDR
caacaaucauucucaaaauccuggacc

SEQ ID NO: 52772 - RNA, 27 nt, Artificial Sequence
  derived and/or modified sequence opt6 from anti-influenza_CDR
guacaauacguucaauuucccuggaca

SEQ ID NO: 52773 - RNA, 27 nt, Artificial Sequence
  derived and/or modified sequence opt6 from anti-influenza_CDR
caacaauccuacucccccccccucacc

SEQ ID NO: 52774 - RNA, 27 nt, Artificial Sequence
  derived and/or modified sequence opt6 from anti-influenza_CDR
uucauauauuacggcggaaauacaaaa

SEQ ID NO: 52775 - RNA, 27 nt, Artificial Sequence
  derived and/or modified sequence opt6 from anti-influenza_CDR
guuauauauucgggugggaguacguau

SEQ ID NO: 52776 - RNA, 27 nt, Artificial Sequence
  derived and/or modified sequence opt6 from anti-influenza_CDR
uuuauguuucauuccggaucuccacgu

SEQ ID NO: 52777 - RNA, 27 nt, Artificial Sequence
  derived and/or modified sequence opt6 from anti-influenza_CDR
caacaaaccuacuccacccccaucacc

SEQ ID NO: 52778 - RNA, 27 nt, Artificial Sequence
  derived and/or modified sequence opt6 from anti-influenza_CDR
uuuuuuuauaauggcggcucuacuaaa

SEQ ID NO: 52779 - RNA, 27 nt, Artificial Sequence
  derived and/or modified sequence opt6 from anti-influenza_CDR
caacaauccuacaacaccccccucauc

SEQ ID NO: 52780 - RNA, 27 nt, Artificial Sequence
  derived and/or modified sequence opt6 from anti-influenza_CDR
cauauauaugauuacgggcguacguuu

SEQ ID NO: 52781 - RNA, 27 nt, Artificial Sequence
  derived and/or modified sequence opt6 from anti-influenza_CDR
guuuucuauucagaaacccguaccuau

SEQ ID NO: 52782 - RNA, 27 nt, Artificial Sequence
  derived and/or modified sequence opt6 from anti-influenza_CDR
caagugugggggaguucgagugaucau

SEQ ID NO: 52783 - RNA, 27 nt, Artificial Sequence
  derived and/or modified sequence opt6 from anti-influenza_CDR
uacguguacaaucgcgggagcacgaaa

SEQ ID NO: 52784 - RNA, 27 nt, Artificial Sequence
  derived and/or modified sequence opt6 from anti-influenza_CDR
uacauauacaaucgcgggagcacgaaa

SEQ ID NO: 52785 - RNA, 27 nt, Artificial Sequence
  derived and/or modified sequence opt6 from anti-influenza_CDR
caacaauccuacaacacccccaucacc

SEQ ID NO: 52786 - RNA, 27 nt, Artificial Sequence
  derived and/or modified sequence opt6 from anti-influenza_CDR
caacaauacuacuccuccccccccacc

SEQ ID NO: 52787 - RNA, 27 nt, Artificial Sequence
  derived and/or modified sequence opt6 from anti-influenza_CDR
uaccuauauuacuccggcuccacaaaa

SEQ ID NO: 52788 - RNA, 27 nt, Artificial Sequence
  derived and/or modified sequence opt6 from anti-influenza_CDR
caacaauccuacuccccccccaucacc

SEQ ID NO: 52789 - RNA, 27 nt, Artificial Sequence
  derived and/or modified sequence opt6 from anti-influenza_CDR
uacguguacaauagcgggaacacgaaa

SEQ ID NO: 52790 - RNA, 27 nt, Artificial Sequence
  derived and/or modified sequence opt6 from anti-influenza_CDR
caacaauccuacaacaccccccucacc

SEQ ID NO: 52791 - RNA, 27 nt, Artificial Sequence
  derived and/or modified sequence opt6 from anti-influenza_CDR
cauauauuugacuccggaucuacauau

SEQ ID NO: 52792 - RNA, 27 nt, Artificial Sequence
  derived and/or modified sequence opt6 from anti-influenza_CDR
guuuuuuauucagcugaccguacuucu

SEQ ID NO: 52793 - RNA, 27 nt, Artificial Sequence
  derived and/or modified sequence opt6 from anti-influenza_CDR
caacaauacuacuccaccccccucacc

SEQ ID NO: 52794 - RNA, 27 nt, Artificial Sequence
  derived and/or modified sequence opt6 from anti-influenza_CDR
uauauauauuacuccggcaauacauau

SEQ ID NO: 52795 - RNA, 27 nt, Artificial Sequence
  derived and/or modified sequence opt6 from anti-influenza_CDR
caacaauccuacuccaccccccucacc

SEQ ID NO: 52796 - RNA, 27 nt, Artificial Sequence
  derived and/or modified sequence opt6 from anti-influenza_CDR
caacaauacggcuccucaucccuaacu

SEQ ID NO: 52797 - RNA, 27 nt, Artificial Sequence
  derived and/or modified sequence opt6 from anti-influenza_CDR
ucuuccuauaccucuuccucuaccuac

SEQ ID NO: 52798 - RNA, 27 nt, Artificial Sequence
  derived and/or modified sequence opt6 from anti-influenza_CDR
caaagauacaacucagccccaccaaua

SEQ ID NO: 52799 - RNA, 27 nt, Artificial Sequence
  derived and/or modified sequence opt6 from anti-influenza_CDR
caacaauacggacgaacaccacuaaca

SEQ ID NO: 52800 - RNA, 27 nt, Artificial Sequence
  derived and/or modified sequence opt6 from anti-influenza_CDR
caacaauacggcucaagcccaagaaca

SEQ ID NO: 52801 - RNA, 27 nt, Artificial Sequence
  derived and/or modified sequence opt6 from anti-influenza_CDR
caacaauacggcucaucaccacuaaca

SEQ ID NO: 52802 - RNA, 27 nt, Artificial Sequence
  derived and/or modified sequence opt6 from anti-influenza_CDR
caagugugggauagcucgagcgaucac

SEQ ID NO: 52803 - RNA, 27 nt, Artificial Sequence
  derived and/or modified sequence opt6 from anti-influenza_CDR
aaggaguuuagugagguggaggggagg

SEQ ID NO: 52804 - RNA, 27 nt, Artificial Sequence
  derived and/or modified sequence opt6 from anti-influenza_CDR
aaagaauucaauaaccuggaaaaaaga

SEQ ID NO: 52805 - RNA, 27 nt, Artificial Sequence
  derived and/or modified sequence opt6 from anti-influenza_CDR
caacaacacuaccgcacacccccaucc

SEQ ID NO: 52806 - RNA, 27 nt, Artificial Sequence
  derived and/or modified sequence opt6 from anti-influenza_CDR
augcaagcaacucacuggccacuaaca

SEQ ID NO: 52807 - RNA, 27 nt, Artificial Sequence
  derived and/or modified sequence opt6 from anti-influenza_CDR
caacaauacuacuccuaccccuacacc

SEQ ID NO: 52808 - RNA, 27 nt, Artificial Sequence
  derived and/or modified sequence opt6 from anti-influenza_CDR
aguucggauguggguggguauaauuau

SEQ ID NO: 52809 - RNA, 27 nt, Artificial Sequence
  derived and/or modified sequence opt6 from anti-influenza_CDR
aguucggacgugggugauuauaauuau

SEQ ID NO: 52810 - RNA, 27 nt, Artificial Sequence
  derived and/or modified sequence opt6 from anti-influenza_CDR
caacaauacaacaacuggccacuauca

SEQ ID NO: 52811 - RNA, 27 nt, Artificial Sequence
  derived and/or modified sequence opt6 from anti-influenza_CDR
caacaaucauacaacuacccccgcacc

SEQ ID NO: 52812 - RNA, 27 nt, Artificial Sequence
  derived and/or modified sequence opt6 from anti-influenza_CDR
augcaaggacuacaaacaccauacaca

SEQ ID NO: 52813 - RNA, 27 nt, Artificial Sequence
  derived and/or modified sequence opt6 from anti-influenza_CDR
caacaacacuacuccaucccccucacc

SEQ ID NO: 52814 - RNA, 27 nt, Artificial Sequence
  derived and/or modified sequence opt6 from anti-influenza_CDR
cuacaacacaauucauaccccuggacc

SEQ ID NO: 52815 - RNA, 27 nt, Artificial Sequence
  derived and/or modified sequence opt6 from anti-influenza_CDR
caacaauacaacaccuggccacuaaca

SEQ ID NO: 52816 - RNA, 27 nt, Artificial Sequence
  derived and/or modified sequence opt6 from anti-influenza_CDR
caacaauacaacuccuuccccuaccgc

SEQ ID NO: 52817 - RNA, 27 nt, Artificial Sequence
  derived and/or modified sequence opt6 from anti-influenza_CDR
caacaauccuauuccgcccccuuuacc

SEQ ID NO: 52818 - RNA, 27 nt, Artificial Sequence
  derived and/or modified sequence opt6 from anti-influenza_CDR
caagcaugggauagcucgacaguagua

SEQ ID NO: 52819 - RNA, 27 nt, Artificial Sequence
  derived and/or modified sequence opt6 from anti-influenza_CDR
caagcaugggauagcacgacaguagua

SEQ ID NO: 52820 - RNA, 27 nt, Artificial Sequence
  derived and/or modified sequence opt6 from anti-influenza_CDR
uuacaauauggcucaaguccgagaaca

SEQ ID NO: 52821 - RNA, 27 nt, Artificial Sequence
  derived and/or modified sequence opt6 from anti-influenza_CDR
aguucggauguggguggguaugauuau

SEQ ID NO: 52822 - RNA, 27 nt, Artificial Sequence
  derived and/or modified sequence opt6 from anti-influenza_CDR
caacaauacacauacuggccacuaaca

SEQ ID NO: 52823 - RNA, 27 nt, Artificial Sequence
  derived and/or modified sequence opt6 from anti-influenza_CDR
caacaauacgauaaauggccaccagga

SEQ ID NO: 52824 - RNA, 27 nt, Artificial Sequence
  derived and/or modified sequence opt6 from anti-influenza_CDR
augcaaucucuccagaccucuaucacu

SEQ ID NO: 52825 - RNA, 27 nt, Artificial Sequence
  derived and/or modified sequence opt6 from anti-influenza_CDR
agccagauagaacuagcaguauuacua

SEQ ID NO: 52826 - RNA, 27 nt, Artificial Sequence
  derived and/or modified sequence opt6 from anti-influenza_CDR
augcaagcacuccaaaccccauacaca

SEQ ID NO: 52827 - RNA, 27 nt, Artificial Sequence
  derived and/or modified sequence opt6 from anti-influenza_CDR
caacaaagaucacacuggccaccaaua

SEQ ID NO: 52828 - RNA, 27 nt, Artificial Sequence
  derived and/or modified sequence opt6 from anti-influenza_CDR
caacauuucuggggaacuccauuaaca

SEQ ID NO: 52829 - RNA, 27 nt, Artificial Sequence
  derived and/or modified sequence opt6 from anti-influenza_CDR
caacaaaacuaugaagacccauggaca

SEQ ID NO: 52830 - RNA, 27 nt, Artificial Sequence
  derived and/or modified sequence opt6 from anti-influenza_CDR
caacaagccaacucauucccacccaca

SEQ ID NO: 52831 - RNA, 27 nt, Artificial Sequence
  derived and/or modified sequence opt6 from anti-influenza_CDR
caacaaagagaucacuggccaccaaua

SEQ ID NO: 52832 - RNA, 27 nt, Artificial Sequence
  derived and/or modified sequence opt6 from anti-influenza_CDR
auggauagucguuugaauuugguuuuu

SEQ ID NO: 52833 - RNA, 27 nt, Artificial Sequence
  derived and/or modified sequence opt6 from anti-influenza_CDR
augaaauugcccguacgcuuacucgua

SEQ ID NO: 52834 - RNA, 30 nt, Artificial Sequence
  derived and/or modified sequence opt6 from anti-influenza_CDR
ggggauagugugacgagagggggauuuuau

SEQ ID NO: 52835 - RNA, 30 nt, Artificial Sequence
  derived and/or modified sequence opt6 from anti-influenza_CDR
caauccgucaccuucaacaacaaaaacuac

SEQ ID NO: 52836 - RNA, 30 nt, Artificial Sequence
  derived and/or modified sequence opt6 from anti-influenza_CDR
caauccgucaccuucaacuacaaaaacuac

SEQ ID NO: 52837 - RNA, 30 nt, Artificial Sequence
  derived and/or modified sequence opt6 from anti-influenza_CDR
cgcgcucaaucucucucuuccuaucuacau

SEQ ID NO: 52838 - RNA, 30 nt, Artificial Sequence
  derived and/or modified sequence opt6 from anti-influenza_CDR
ucuucauacacaucuucauccacauacguc

SEQ ID NO: 52839 - RNA, 30 nt, Artificial Sequence
  derived and/or modified sequence opt6 from anti-influenza_CDR
caaagauacaacucagccccaccaauaaca

SEQ ID NO: 52840 - RNA, 30 nt, Artificial Sequence
  derived and/or modified sequence opt6 from anti-influenza_CDR
ggcgggaguauaaguucgggaacguauuau

SEQ ID NO: 52841 - RNA, 30 nt, Artificial Sequence
  derived and/or modified sequence opt6 from anti-influenza_CDR
caacaauccuacuccucacucauguucaca

SEQ ID NO: 52842 - RNA, 30 nt, Artificial Sequence
  derived and/or modified sequence opt6 from anti-influenza_CDR
cuauugauauauggcgcgagcacgagagca

SEQ ID NO: 52843 - RNA, 30 nt, Artificial Sequence
  derived and/or modified sequence opt6 from anti-influenza_CDR
ugugcguauggggguaaguauuugguugug

SEQ ID NO: 52844 - RNA, 30 nt, Artificial Sequence
  derived and/or modified sequence opt6 from anti-influenza_CDR
aggccagauuuuuauggcgauuuugaauac

SEQ ID NO: 52845 - RNA, 30 nt, Artificial Sequence
  derived and/or modified sequence opt6 from anti-influenza_CDR
caacacuacggauauucaccuagauaugca

SEQ ID NO: 52846 - RNA, 30 nt, Artificial Sequence
  derived and/or modified sequence opt6 from anti-influenza_CDR
caacaaagaucacacuggccaccaauaaca

SEQ ID NO: 52847 - RNA, 30 nt, Artificial Sequence
  derived and/or modified sequence opt6 from anti-influenza_CDR
aguucguaugcggguucgaguacgugggug

SEQ ID NO: 52848 - RNA, 30 nt, Artificial Sequence
  derived and/or modified sequence opt6 from anti-influenza_CDR
uuauuauauucagguggagauccgguugca

SEQ ID NO: 52849 - RNA, 30 nt, Artificial Sequence
  derived and/or modified sequence opt6 from anti-influenza_CDR
caacaauacggcggaucaccaagauauaca

SEQ ID NO: 52850 - RNA, 30 nt, Artificial Sequence
  derived and/or modified sequence opt6 from anti-influenza_CDR
agguaugggaguggguauggguuugauagu

SEQ ID NO: 52851 - RNA, 30 nt, Artificial Sequence
  derived and/or modified sequence opt6 from anti-influenza_CDR
aguucauacgcgggcaauuauaaucacgug

SEQ ID NO: 52852 - RNA, 30 nt, Artificial Sequence
  derived and/or modified sequence opt6 from anti-influenza_CDR
caacaauacauaaacuggcgaccacuauca

SEQ ID NO: 52853 - RNA, 30 nt, Artificial Sequence
  derived and/or modified sequence opt6 from anti-influenza_CDR
auaggugcagguuaugaugugcauugguau

SEQ ID NO: 52854 - RNA, 30 nt, Artificial Sequence
  derived and/or modified sequence opt6 from anti-influenza_CDR
cuacuaauauacgacaauaacaacagaccc

SEQ ID NO: 52855 - RNA, 30 nt, Artificial Sequence
  derived and/or modified sequence opt6 from anti-influenza_CDR
caaucauacgacaacucacuauccggcucc

SEQ ID NO: 52856 - RNA, 30 nt, Artificial Sequence
  derived and/or modified sequence opt6 from anti-influenza_CDR
cuacuaauauacgacgccucaaaccuacaa

SEQ ID NO: 52857 - RNA, 30 nt, Artificial Sequence
  derived and/or modified sequence opt6 from anti-influenza_CDR
cuauuaauacaugacgcuagcaaucuagaa

SEQ ID NO: 52858 - RNA, 30 nt, Artificial Sequence
  derived and/or modified sequence opt6 from anti-influenza_CDR
gugcagagguuaaguuaugggauggaugua

SEQ ID NO: 52859 - RNA, 30 nt, Artificial Sequence
  derived and/or modified sequence opt6 from anti-influenza_CDR
gugcaaaagaguuauuacgggauggaugua

SEQ ID NO: 52860 - RNA, 30 nt, Artificial Sequence
  derived and/or modified sequence opt6 from anti-influenza_CDR
ucuucauacacaucuucauccacacauguc

SEQ ID NO: 52861 - RNA, 30 nt, Artificial Sequence
  derived and/or modified sequence opt6 from anti-influenza_CDR
aguucauacacgagcucgagcacgcucgug

SEQ ID NO: 52862 - RNA, 30 nt, Artificial Sequence
  derived and/or modified sequence opt6 from anti-influenza_CDR
accaaacgaucacaacaaaccguaauccca

SEQ ID NO: 52863 - RNA, 30 nt, Artificial Sequence
  derived and/or modified sequence opt6 from anti-influenza_CDR
accucacgaucacaacaaaccguaauccca

SEQ ID NO: 52864 - RNA, 30 nt, Artificial Sequence
  derived and/or modified sequence opt6 from anti-influenza_CDR
ucaucuaacuauaaccgccgauucacaccu

SEQ ID NO: 52865 - RNA, 30 nt, Artificial Sequence
  derived and/or modified sequence opt6 from anti-influenza_CDR
agaccgaaaguaagagaucaagaaagcaga

SEQ ID NO: 52866 - RNA, 30 nt, Artificial Sequence
  derived and/or modified sequence opt6 from anti-influenza_CDR
aggccguggguaagaggaguaaguaguaga

SEQ ID NO: 52867 - RNA, 30 nt, Artificial Sequence
  derived and/or modified sequence opt6 from anti-influenza_CDR
aggccguggguaagaggauuaaguaguaga

SEQ ID NO: 52868 - RNA, 30 nt, Artificial Sequence
  derived and/or modified sequence opt6 from anti-influenza_CDR
agaccgaaaguaagaggacaagcaggaaga

SEQ ID NO: 52869 - RNA, 30 nt, Artificial Sequence
  derived and/or modified sequence opt6 from anti-influenza_CDR
gcaccagcaguagcagcacaagcaucagca

SEQ ID NO: 52870 - RNA, 30 nt, Artificial Sequence
  derived and/or modified sequence opt6 from anti-influenza_CDR
guacaccauccaggaacagauaacgaucaa

SEQ ID NO: 52871 - RNA, 30 nt, Artificial Sequence
  derived and/or modified sequence opt6 from anti-influenza_CDR
uucggacaagggacaaaaguagaaauaaaa

SEQ ID NO: 52872 - RNA, 30 nt, Artificial Sequence
  derived and/or modified sequence opt6 from anti-influenza_CDR
ggauuugcauuucauaauagagcuaugcau

SEQ ID NO: 52873 - RNA, 30 nt, Artificial Sequence
  derived and/or modified sequence opt6 from anti-influenza_CDR
ggucuuacuuuuucuucuuaugcuguucau

SEQ ID NO: 52874 - RNA, 30 nt, Artificial Sequence
  derived and/or modified sequence opt6 from anti-influenza_CDR
gguccuacuuuuucuucuuaugcuguucau

SEQ ID NO: 52875 - RNA, 30 nt, Artificial Sequence
  derived and/or modified sequence opt6 from anti-influenza_CDR
ggcucuauauuuucaaauuacggcauaucu

SEQ ID NO: 52876 - RNA, 30 nt, Artificial Sequence
  derived and/or modified sequence opt6 from anti-influenza_CDR
ggauacagcuuuaacaauuacggaauaaau

SEQ ID NO: 52877 - RNA, 30 nt, Artificial Sequence
  derived and/or modified sequence opt6 from anti-influenza_CDR
ggcuauacauuuaacgcuuacuauauacau

SEQ ID NO: 52878 - RNA, 30 nt, Artificial Sequence
  derived and/or modified sequence opt6 from anti-influenza_CDR
ggcuauacauuuacaucuuucauuauguau

SEQ ID NO: 52879 - RNA, 30 nt, Artificial Sequence
  derived and/or modified sequence opt6 from anti-influenza_CDR
agggguaauuaugggaauggguuugcguau

SEQ ID NO: 52880 - RNA, 30 nt, Artificial Sequence
  derived and/or modified sequence opt6 from anti-influenza_CDR
caacaauacggaagcucaccagcacuaaca

SEQ ID NO: 52881 - RNA, 30 nt, Artificial Sequence
  derived and/or modified sequence opt6 from anti-influenza_CDR
caagaauacaacaacgacagcccacuaaca

SEQ ID NO: 52882 - RNA, 30 nt, Artificial Sequence
  derived and/or modified sequence opt6 from anti-influenza_CDR
auaagaucaggauuaaacagauucgagaca

SEQ ID NO: 52883 - RNA, 30 nt, Artificial Sequence
  derived and/or modified sequence opt6 from anti-influenza_CDR
gucuucuauuccgguucaucuaacuauaau

SEQ ID NO: 52884 - RNA, 30 nt, Artificial Sequence
  derived and/or modified sequence opt6 from anti-influenza_CDR
ggagcgaguauaaguacgggcgggaauuau

SEQ ID NO: 52885 - RNA, 30 nt, Artificial Sequence
  derived and/or modified sequence opt6 from anti-influenza_CDR
auauucuacuccggcacaaccaaauacaac

SEQ ID NO: 52886 - RNA, 30 nt, Artificial Sequence
  derived and/or modified sequence opt6 from anti-influenza_CDR
gcuucauaugccgguacauauauacaucua

SEQ ID NO: 52887 - RNA, 30 nt, Artificial Sequence
  derived and/or modified sequence opt6 from anti-influenza_CDR
caacaacucaacuccuacccccccaucacc

SEQ ID NO: 52888 - RNA, 30 nt, Artificial Sequence
  derived and/or modified sequence opt6 from anti-influenza_CDR
caacaauuuaacgacuggccauuccuaaca

SEQ ID NO: 52889 - RNA, 30 nt, Artificial Sequence
  derived and/or modified sequence opt6 from anti-influenza_CDR
caacaacucaccacauacccccccauaacc

SEQ ID NO: 52890 - RNA, 30 nt, Artificial Sequence
  derived and/or modified sequence opt6 from anti-influenza_CDR
ggaggaaguauaaguaaugggggauaucau

SEQ ID NO: 52891 - RNA, 30 nt, Artificial Sequence
  derived and/or modified sequence opt6 from anti-influenza_CDR
ggcgauucaguuaucaauucagcuuacuau

SEQ ID NO: 52892 - RNA, 30 nt, Artificial Sequence
  derived and/or modified sequence opt6 from anti-influenza_CDR
caacaauacgacaacuggcuaccaauaaca

SEQ ID NO: 52893 - RNA, 30 nt, Artificial Sequence
  derived and/or modified sequence opt6 from anti-influenza_CDR
gcuggagauuauaguggagguauauaugca

SEQ ID NO: 52894 - RNA, 30 nt, Artificial Sequence
  derived and/or modified sequence opt6 from anti-influenza_CDR
gcaggagauuauaguggaaguaauuaugca

SEQ ID NO: 52895 - RNA, 30 nt, Artificial Sequence
  derived and/or modified sequence opt6 from anti-influenza_CDR
gcaggagauuauucaggagcaaauuaugca

SEQ ID NO: 52896 - RNA, 30 nt, Artificial Sequence
  derived and/or modified sequence opt6 from anti-influenza_CDR
ggccuaagucuauacucaaacgaaaucaau

SEQ ID NO: 52897 - RNA, 30 nt, Artificial Sequence
  derived and/or modified sequence opt6 from anti-influenza_CDR
gcuucauaugcagguaauaauauauaugua

SEQ ID NO: 52898 - RNA, 30 nt, Artificial Sequence
  derived and/or modified sequence opt6 from anti-influenza_CDR
gcaucucaaucuguaucuacauuucuagcu

SEQ ID NO: 52899 - RNA, 30 nt, Artificial Sequence
  derived and/or modified sequence opt6 from anti-influenza_CDR
auaaaaagcaauacagacggcggaacaaca

SEQ ID NO: 52900 - RNA, 30 nt, Artificial Sequence
  derived and/or modified sequence opt6 from anti-influenza_CDR
gagucgguggauauauacgggaauaguuuu

SEQ ID NO: 52901 - RNA, 30 nt, Artificial Sequence
  derived and/or modified sequence opt6 from anti-influenza_CDR
gagucuauagauauauacggaaauucauuu

SEQ ID NO: 52902 - RNA, 30 nt, Artificial Sequence
  derived and/or modified sequence opt6 from anti-influenza_CDR
gcaggagauuauaguggaguaaauuaugca

SEQ ID NO: 52903 - RNA, 33 nt, Artificial Sequence
  derived and/or modified sequence opt6 from anti-influenza_CDR
gcagcaugggaugacaguuuaaauggacaauua

SEQ ID NO: 52904 - RNA, 33 nt, Artificial Sequence
  derived and/or modified sequence opt6 from anti-influenza_CDR
uguaguuaugcggguaguaguaguaguaggguu

SEQ ID NO: 52905 - RNA, 33 nt, Artificial Sequence
  derived and/or modified sequence opt6 from anti-influenza_CDR
cuaguacuagcaacaggacuaagaaacucacca

SEQ ID NO: 52906 - RNA, 33 nt, Artificial Sequence
  derived and/or modified sequence opt6 from anti-influenza_CDR
caaucauuacuacauucagacggcaaaaccuau

SEQ ID NO: 52907 - RNA, 33 nt, Artificial Sequence
  derived and/or modified sequence opt6 from anti-influenza_CDR
cgcacaucccaaucccuauccucauaccuacac

SEQ ID NO: 52908 - RNA, 33 nt, Artificial Sequence
  derived and/or modified sequence opt6 from anti-influenza_CDR
cgcgcaagccaacgccuaaacucauacuuacac

SEQ ID NO: 52909 - RNA, 33 nt, Artificial Sequence
  derived and/or modified sequence opt6 from anti-influenza_CDR
cgcacaucucaaucccuacgcucauaccuacac

SEQ ID NO: 52910 - RNA, 33 nt, Artificial Sequence
  derived and/or modified sequence opt6 from anti-influenza_CDR
cgcacaucucaaucccuauccucauacacacac

SEQ ID NO: 52911 - RNA, 33 nt, Artificial Sequence
  derived and/or modified sequence opt6 from anti-influenza_CDR
cgcacaucccaaucccuauccucauacgaccac

SEQ ID NO: 52912 - RNA, 33 nt, Artificial Sequence
  derived and/or modified sequence opt6 from anti-influenza_CDR
caagugugggauagcucgagcgaucacuaugua

SEQ ID NO: 52913 - RNA, 33 nt, Artificial Sequence
  derived and/or modified sequence opt6 from anti-influenza_CDR
caagugugggggaguucgagugaucauuaugua

SEQ ID NO: 52914 - RNA, 33 nt, Artificial Sequence
  derived and/or modified sequence opt6 from anti-influenza_CDR
gggacgugggauaguaguuuaaguguagggaug

SEQ ID NO: 52915 - RNA, 33 nt, Artificial Sequence
  derived and/or modified sequence opt6 from anti-influenza_CDR
caaucauuacuacacggaaacggauauaacuau

SEQ ID NO: 52916 - RNA, 33 nt, Artificial Sequence
  derived and/or modified sequence opt6 from anti-influenza_CDR
agagcaagucagggaauaagaaaugacuuagga

SEQ ID NO: 52917 - RNA, 33 nt, Artificial Sequence
  derived and/or modified sequence opt6 from anti-influenza_CDR
cgcgcaagccagaacauacgcucauacuuaaac

SEQ ID NO: 52918 - RNA, 33 nt, Artificial Sequence
  derived and/or modified sequence opt6 from anti-influenza_CDR
agagcaaaucaagacauaggaauauaccuaaac

SEQ ID NO: 52919 - RNA, 33 nt, Artificial Sequence
  derived and/or modified sequence opt6 from anti-influenza_CDR
agagcaagccaaagcguaagcaauaacuuagcc

SEQ ID NO: 52920 - RNA, 33 nt, Artificial Sequence
  derived and/or modified sequence opt6 from anti-influenza_CDR
caacaauaccacaacuggccaccaucauacuca

SEQ ID NO: 52921 - RNA, 33 nt, Artificial Sequence
  derived and/or modified sequence opt6 from anti-influenza_CDR
agagcaagccaaggaauacuaaauugcuuagca

SEQ ID NO: 52922 - RNA, 33 nt, Artificial Sequence
  derived and/or modified sequence opt6 from anti-influenza_CDR
agggcaagucaaucaauagcaaguugguuagca

SEQ ID NO: 52923 - RNA, 33 nt, Artificial Sequence
  derived and/or modified sequence opt6 from anti-influenza_CDR
gccccacgcguauacgaauacuauuucgaucaa

SEQ ID NO: 52924 - RNA, 33 nt, Artificial Sequence
  derived and/or modified sequence opt6 from anti-influenza_CDR
agagcaagccaaagcguaagcucauacuuagcc

SEQ ID NO: 52925 - RNA, 33 nt, Artificial Sequence
  derived and/or modified sequence opt6 from anti-influenza_CDR
agcggagacgcacuaccaaaacaaaaugcauac

SEQ ID NO: 52926 - RNA, 33 nt, Artificial Sequence
  derived and/or modified sequence opt6 from anti-influenza_CDR
caaagugcagauaguaguggaacaaguugggua

SEQ ID NO: 52927 - RNA, 33 nt, Artificial Sequence
  derived and/or modified sequence opt6 from anti-influenza_CDR
ggagggaguaauauagggggaaagagugugcau

SEQ ID NO: 52928 - RNA, 33 nt, Artificial Sequence
  derived and/or modified sequence opt6 from anti-influenza_CDR
caacacuauggaucuucaccuagauaugcauuu

SEQ ID NO: 52929 - RNA, 33 nt, Artificial Sequence
  derived and/or modified sequence opt6 from anti-influenza_CDR
cgcgcaucccaauccauauccucauaccuaaac

SEQ ID NO: 52930 - RNA, 33 nt, Artificial Sequence
  derived and/or modified sequence opt6 from anti-influenza_CDR
ggagggaacgcgauagggagcaagaaagugcau

SEQ ID NO: 52931 - RNA, 33 nt, Artificial Sequence
  derived and/or modified sequence opt6 from anti-influenza_CDR
caagugugggauuucacgauugaucaugugguc

SEQ ID NO: 52932 - RNA, 33 nt, Artificial Sequence
  derived and/or modified sequence opt6 from anti-influenza_CDR
gcgacuugggauggaaguuuaagugcaugggua

SEQ ID NO: 52933 - RNA, 33 nt, Artificial Sequence
  derived and/or modified sequence opt6 from anti-influenza_CDR
agagcaagucaaaguguaggcaauuacuuagcc

SEQ ID NO: 52934 - RNA, 33 nt, Artificial Sequence
  derived and/or modified sequence opt6 from anti-influenza_CDR
caacaaagaucuaaauggccaccuauguauuca

SEQ ID NO: 52935 - RNA, 33 nt, Artificial Sequence
  derived and/or modified sequence opt6 from anti-influenza_CDR
gauguaucuacaacuuggucuugguuugcaccu

SEQ ID NO: 52936 - RNA, 33 nt, Artificial Sequence
  derived and/or modified sequence opt6 from anti-influenza_CDR
agagcaagccaaaacauaaaaagauacuucaac

SEQ ID NO: 52937 - RNA, 33 nt, Artificial Sequence
  derived and/or modified sequence opt6 from anti-influenza_CDR
agagcaagccaaagcguaggaaauagcuuagca

SEQ ID NO: 52938 - RNA, 33 nt, Artificial Sequence
  derived and/or modified sequence opt6 from anti-influenza_CDR
ggugaaucuacacuuucauauuacgcuguaucu

SEQ ID NO: 52939 - RNA, 33 nt, Artificial Sequence
  derived and/or modified sequence opt6 from anti-influenza_CDR
cgcgcaagccaaaacauauacaaauaccuaaac

SEQ ID NO: 52940 - RNA, 33 nt, Artificial Sequence
  derived and/or modified sequence opt6 from anti-influenza_CDR
gcuaguuguaguggugguuauuguauuuuagau

SEQ ID NO: 52941 - RNA, 33 nt, Artificial Sequence
  derived and/or modified sequence opt6 from anti-influenza_CDR
cgcacaucccaauccauauccucauaccuaaac

SEQ ID NO: 52942 - RNA, 33 nt, Artificial Sequence
  derived and/or modified sequence opt6 from anti-influenza_CDR
cgcgcaagucagaguauaggcgcauacguaaac

SEQ ID NO: 52943 - RNA, 33 nt, Artificial Sequence
  derived and/or modified sequence opt6 from anti-influenza_CDR
cgcgcaucccaauccauauccacauaccuaaac

SEQ ID NO: 52944 - RNA, 33 nt, Artificial Sequence
  derived and/or modified sequence opt6 from anti-influenza_CDR
cgcgcaucucaaucuauagacaaauuccuaaau

SEQ ID NO: 52945 - RNA, 33 nt, Artificial Sequence
  derived and/or modified sequence opt6 from anti-influenza_CDR
ggcgggcauaauauagggaguaauagugugcau

SEQ ID NO: 52946 - RNA, 33 nt, Artificial Sequence
  derived and/or modified sequence opt6 from anti-influenza_CDR
cgcgcaucucaauccauauccacauaccuacac

SEQ ID NO: 52947 - RNA, 33 nt, Artificial Sequence
  derived and/or modified sequence opt6 from anti-influenza_CDR
caugugggcgggcauacguaugggauugauuau

SEQ ID NO: 52948 - RNA, 33 nt, Artificial Sequence
  derived and/or modified sequence opt6 from anti-influenza_CDR
cgcgcaagccagagcauaagcaauuacuuaaac

SEQ ID NO: 52949 - RNA, 33 nt, Artificial Sequence
  derived and/or modified sequence opt6 from anti-influenza_CDR
cacgaugacgcaagucauggauauaguauaagc

SEQ ID NO: 52950 - RNA, 33 nt, Artificial Sequence
  derived and/or modified sequence opt6 from anti-influenza_CDR
cgcgcaucccaaaccauauccacauaccuaaac

SEQ ID NO: 52951 - RNA, 33 nt, Artificial Sequence
  derived and/or modified sequence opt6 from anti-influenza_CDR
cgcgcaucucaaucuauauccagauaucuaaau

SEQ ID NO: 52952 - RNA, 33 nt, Artificial Sequence
  derived and/or modified sequence opt6 from anti-influenza_CDR
gggacuugggauaguaguuuaagugcauaugua

SEQ ID NO: 52953 - RNA, 33 nt, Artificial Sequence
  derived and/or modified sequence opt6 from anti-influenza_CDR
agcucgaacuauuacgauagcguguacgauuac

SEQ ID NO: 52954 - RNA, 33 nt, Artificial Sequence
  derived and/or modified sequence opt6 from anti-influenza_CDR
gcagccugggacgauauauuaaauguaccagua

SEQ ID NO: 52955 - RNA, 33 nt, Artificial Sequence
  derived and/or modified sequence opt6 from anti-influenza_CDR
guggcuugggaugauaguguagauggauaugua

SEQ ID NO: 52956 - RNA, 33 nt, Artificial Sequence
  derived and/or modified sequence opt6 from anti-influenza_CDR
gggccuaaauauuauagugaauauauggacgua

SEQ ID NO: 52957 - RNA, 33 nt, Artificial Sequence
  derived and/or modified sequence opt6 from anti-influenza_CDR
agagcaagucaaggcauaaguucauacuuagcc

SEQ ID NO: 52958 - RNA, 33 nt, Artificial Sequence
  derived and/or modified sequence opt6 from anti-influenza_CDR
ucaagcgguuacuauccagaauacuuucaagau

SEQ ID NO: 52959 - RNA, 33 nt, Artificial Sequence
  derived and/or modified sequence opt6 from anti-influenza_CDR
agcgggcauaaauuaggggauaaguaugugagu

SEQ ID NO: 52960 - RNA, 33 nt, Artificial Sequence
  derived and/or modified sequence opt6 from anti-influenza_CDR
ucaaccggauauuaucccgccuaccuacaccac

SEQ ID NO: 52961 - RNA, 33 nt, Artificial Sequence
  derived and/or modified sequence opt6 from anti-influenza_CDR
cgugcaucucaacguguaucuucauauuuagcc

SEQ ID NO: 52962 - RNA, 33 nt, Artificial Sequence; identical to SEQ ID NO: 51855
  derived and/or modified sequence opt6 from anti-influenza_CDR

SEQ ID NO: 52963 - RNA, 33 nt, Artificial Sequence
  derived and/or modified sequence opt6 from anti-influenza_CDR
caagugugggauagcucgagcgaucacgcggua

SEQ ID NO: 52964 - RNA, 33 nt, Artificial Sequence
  derived and/or modified sequence opt6 from anti-influenza_CDR
gcaacaugggacgauaauuuaaguggaccagua

SEQ ID NO: 52965 - RNA, 33 nt, Artificial Sequence
  derived and/or modified sequence opt6 from anti-influenza_CDR
ucauccggcuauuauccugccuauuuaccucau

SEQ ID NO: 52966 - RNA, 33 nt, Artificial Sequence
  derived and/or modified sequence opt6 from anti-influenza_CDR
ggagggaauaauauagggaguaagggagugcau

SEQ ID NO: 52967 - RNA, 33 nt, Artificial Sequence
  derived and/or modified sequence opt6 from anti-influenza_CDR
caagugugggauagcucgagcgaucacguggua

SEQ ID NO: 52968 - RNA, 33 nt, Artificial Sequence
  derived and/or modified sequence opt6 from anti-influenza_CDR
ggcaauuacuauuacgagagcucgcucgauuau

SEQ ID NO: 52969 - RNA, 33 nt, Artificial Sequence
  derived and/or modified sequence opt6 from anti-influenza_CDR
ggaccucacuauuacucuucauauauggaugua

SEQ ID NO: 52970 - RNA, 33 nt, Artificial Sequence
  derived and/or modified sequence opt6 from anti-influenza_CDR
agagcaagucaaggcauaaguacauacuuagcc

SEQ ID NO: 52971 - RNA, 33 nt, Artificial Sequence
  derived and/or modified sequence opt6 from anti-influenza_CDR
ggaccuacauauuacuauucauauauggaugua

SEQ ID NO: 52972 - RNA, 33 nt, Artificial Sequence
  derived and/or modified sequence opt6 from anti-influenza_CDR
ggagggaacaauauagggagaaauagcgugcac

SEQ ID NO: 52973 - RNA, 33 nt, Artificial Sequence
  derived and/or modified sequence opt6 from anti-influenza_CDR
caaguuuggcauucaucuucagaucacuauguc

SEQ ID NO: 52974 - RNA, 33 nt, Artificial Sequence
  derived and/or modified sequence opt6 from anti-influenza_CDR
ucauccggcuacuacccccaauacuuucaagac

SEQ ID NO: 52975 - RNA, 33 nt, Artificial Sequence
  derived and/or modified sequence opt6 from anti-influenza_CDR
cgugcaucucaaucuguaucuagauauuuagcu

SEQ ID NO: 52976 - RNA, 33 nt, Artificial Sequence
  derived and/or modified sequence opt6 from anti-influenza_CDR
uggggacaagggacaacauuaacaguaaguagu

SEQ ID NO: 52977 - RNA, 33 nt, Artificial Sequence
  derived and/or modified sequence opt6 from anti-influenza_CDR
agagcaagccaaucaguagacucaaacuuagca

SEQ ID NO: 52978 - RNA, 33 nt, Artificial Sequence
  derived and/or modified sequence opt6 from anti-influenza_CDR
cgugcaucccaauccguaucucauaauuuagcc

SEQ ID NO: 52979 - RNA, 33 nt, Artificial Sequence
  derived and/or modified sequence opt6 from anti-influenza_CDR
cgugcaucucaaucuguaucuucaaauuuagcc

SEQ ID NO: 52980 - RNA, 33 nt, Artificial Sequence
  derived and/or modified sequence opt6 from anti-influenza_CDR
agagcaagccaaucaguagaccauaacuuagca

SEQ ID NO: 52981 - RNA, 33 nt, Artificial Sequence
  derived and/or modified sequence opt6 from anti-influenza_CDR
caacacuacacaaacuggccaccaagacuaaca

SEQ ID NO: 52982 - RNA, 33 nt, Artificial Sequence
  derived and/or modified sequence opt6 from anti-influenza_CDR
caacacuacacaaacuaccccccccgccuaacc

SEQ ID NO: 52983 - RNA, 33 nt, Artificial Sequence
  derived and/or modified sequence opt6 from anti-influenza_CDR
caacacuacacaaacuuccccccccgccuaacc

SEQ ID NO: 52984 - RNA, 33 nt, Artificial Sequence
  derived and/or modified sequence opt6 from anti-influenza_CDR
cgugcaucucaagucauaucucacaaucuagcc

SEQ ID NO: 52985 - RNA, 33 nt, Artificial Sequence
  derived and/or modified sequence opt6 from anti-influenza_CDR
caacauuacucaaacuggccacccagacuaaca

SEQ ID NO: 52986 - RNA, 33 nt, Artificial Sequence
  derived and/or modified sequence opt6 from anti-influenza_CDR
caacacuacucaaacuuccccccccgccuaacc

SEQ ID NO: 52987 - RNA, 33 nt, Artificial Sequence
  derived and/or modified sequence opt6 from anti-influenza_CDR
caacacuacucaaacuaccccccccgccuaacc

SEQ ID NO: 52988 - RNA, 33 nt, Artificial Sequence
  derived and/or modified sequence opt6 from anti-influenza_CDR
cgugcaucucaaucuguagcuaauaauuuagcc

SEQ ID NO: 52989 - RNA, 33 nt, Artificial Sequence
  derived and/or modified sequence opt6 from anti-influenza_CDR
caacaauacaacaacuggccaccaauguacaca

SEQ ID NO: 52990 - RNA, 33 nt, Artificial Sequence
  derived and/or modified sequence opt6 from anti-influenza_CDR
agggcaagucaaaguauaggaaauugguuagca

SEQ ID NO: 52991 - RNA, 33 nt, Artificial Sequence
  derived and/or modified sequence opt6 from anti-influenza_CDR
caaagauacacaucaaacucacaaggcuucaca

SEQ ID NO: 52992 - RNA, 33 nt, Artificial Sequence
  derived and/or modified sequence opt6 from anti-influenza_CDR
gcagcaugggaugauacauuaaauggaccagua

SEQ ID NO: 52993 - RNA, 33 nt, Artificial Sequence
  derived and/or modified sequence opt6 from anti-influenza_CDR
aaagcaagccaaaacguaggaucaaacguagca

SEQ ID NO: 52994 - RNA, 33 nt, Artificial Sequence
  derived and/or modified sequence opt6 from anti-influenza_CDR
caggugugggauaugaguagugauagaagggua

SEQ ID NO: 52995 - RNA, 33 nt, Artificial Sequence
  derived and/or modified sequence opt6 from anti-influenza_CDR
caaucacuccuacacucaaacggcuauaacuau

SEQ ID NO: 52996 - RNA, 33 nt, Artificial Sequence
  derived and/or modified sequence opt6 from anti-influenza_CDR
acauauuuaguaggagcaguaggauuucaacac

SEQ ID NO: 52997 - RNA, 33 nt, Artificial Sequence; identical to SEQ ID NO: 51908
  derived and/or modified sequence opt6 from anti-influenza_CDR

SEQ ID NO: 52998 - RNA, 33 nt, Artificial Sequence
  derived and/or modified sequence opt6 from anti-influenza_CDR
caaagccuauuagacagcaauggcuauaacuau

SEQ ID NO: 52999 - RNA, 33 nt, Artificial Sequence
  derived and/or modified sequence opt6 from anti-influenza_CDR
augcaagcacuccaaaccccacccauguacaca

SEQ ID NO: 53000 - RNA, 33 nt, Artificial Sequence
  derived and/or modified sequence opt6 from anti-influenza_CDR
caaucacuacuacacucaaacggcuacaaccac

SEQ ID NO: 53001 - RNA, 33 nt, Artificial Sequence
  derived and/or modified sequence opt6 from anti-influenza_CDR
caagugugggauauaacgagcgauuuaguggua

SEQ ID NO: 53002 - RNA, 33 nt, Artificial Sequence
  derived and/or modified sequence opt6 from anti-influenza_CDR
agagcaagucaagacauaaguacaugguuagca

SEQ ID NO: 53003 - RNA, 33 nt, Artificial Sequence
  derived and/or modified sequence opt6 from anti-influenza_CDR
cgugcaucuagaucuauaacuacauuucuagcu

SEQ ID NO: 53004 - RNA, 33 nt, Artificial Sequence
  derived and/or modified sequence opt6 from anti-influenza_CDR
gguuggggugcaguuacaaguccguuugauuuu

SEQ ID NO: 53005 - RNA, 33 nt, Artificial Sequence
  derived and/or modified sequence opt6 from anti-influenza_CDR
cgcgcuucccaauccguuuccucuuccuaucuc

SEQ ID NO: 53006 - RNA, 36 nt, Artificial Sequence
  derived and/or modified sequence opt6 from anti-influenza_CDR
caauccguccucuacuccucaaacaacaaaaacuac

SEQ ID NO: 53007 - RNA, 36 nt, Artificial Sequence
  derived and/or modified sequence opt6 from anti-influenza_CDR
gcggcaugggaugauaguuuaaguggaaguugggua

SEQ ID NO: 53008 - RNA, 36 nt, Artificial Sequence
  derived and/or modified sequence opt6 from anti-influenza_CDR
guauuuuacucugcagauagaacuucauaugcagau

SEQ ID NO: 53009 - RNA, 36 nt, Artificial Sequence
  derived and/or modified sequence opt6 from anti-influenza_CDR
agaguaggacaaagcguaagcggaagccaucuagca

SEQ ID NO: 53010 - RNA, 36 nt, Artificial Sequence
  derived and/or modified sequence opt6 from anti-influenza_CDR
acacuaucauccgccuacucaaauuacaaagucgac

SEQ ID NO: 53011 - RNA, 36 nt, Artificial Sequence
  derived and/or modified sequence opt6 from anti-influenza_CDR
guggggacgggagggauagugggaaguaaaggggau

SEQ ID NO: 53012 - RNA, 36 nt, Artificial Sequence
  derived and/or modified sequence opt6 from anti-influenza_CDR
agauauucacguucaucuccagguacauuugaaucu

SEQ ID NO: 53013 - RNA, 36 nt, Artificial Sequence
  derived and/or modified sequence opt6 from anti-influenza_CDR
caaucuuaugauucuucucuuucugguuuucauguu

SEQ ID NO: 53014 - RNA, 36 nt, Artificial Sequence
  derived and/or modified sequence opt6 from anti-influenza_CDR
cgagcaagccaaagcguaagcucaagccaacuagca

SEQ ID NO: 53015 - RNA, 36 nt, Artificial Sequence
  derived and/or modified sequence opt6 from anti-influenza_CDR
cgagcaagccaauucguaagcacacgcucacuagca

SEQ ID NO: 53016 - RNA, 36 nt, Artificial Sequence
  derived and/or modified sequence opt6 from anti-influenza_CDR
gcgacaugggaugauaguuuaaauggauuuuaugua

SEQ ID NO: 53017 - RNA, 36 nt, Artificial Sequence
  derived and/or modified sequence opt6 from anti-influenza_CDR
cgagcuagccauuucguuaacuaucgcucacuagcu

SEQ ID NO: 53018 - RNA, 36 nt, Artificial Sequence
  derived and/or modified sequence opt6 from anti-influenza_CDR
agagcaagccauuucguaauaggaagagcaguagca

SEQ ID NO: 53019 - RNA, 36 nt, Artificial Sequence
  derived and/or modified sequence opt6 from anti-influenza_CDR
aggauauaucaugggggaaauaguggauuugauuuu

SEQ ID NO: 53020 - RNA, 36 nt, Artificial Sequence
  derived and/or modified sequence opt6 from anti-influenza_CDR
acacuaucauccggauuugacaauuaucaaguagcc

SEQ ID NO: 53021 - RNA, 36 nt, Artificial Sequence
  derived and/or modified sequence opt6 from anti-influenza_CDR
guagggaaugggggaaauguggcgaguaagggagau

SEQ ID NO: 53022 - RNA, 36 nt, Artificial Sequence
  derived and/or modified sequence opt6 from anti-influenza_CDR
guaaggggagggaguacgguagcguauuuuggagug

SEQ ID NO: 53023 - RNA, 36 nt, Artificial Sequence
  derived and/or modified sequence opt6 from anti-influenza_CDR
uguuugaguaggaugaggggguauggguuggaugug

SEQ ID NO: 53024 - RNA, 36 nt, Artificial Sequence
  derived and/or modified sequence opt6 from anti-influenza_CDR
guaggacagauggauaaauauuaugcaauggaugua

SEQ ID NO: 53025 - RNA, 36 nt, Artificial Sequence
  derived and/or modified sequence opt6 from anti-influenza_CDR
ggaguaacaaacaaaguaaacagcauaauagacaaa

SEQ ID NO: 53026 - RNA, 36 nt, Artificial Sequence
  derived and/or modified sequence opt6 from anti-influenza_CDR
ggaguaacaaacaaaguaaacagaauaauagacaaa

SEQ ID NO: 53027 - RNA, 36 nt, Artificial Sequence
  derived and/or modified sequence opt6 from anti-influenza_CDR
ggaguaacaaacaaagaaaacagcauaauagacaaa

SEQ ID NO: 53028 - RNA, 36 nt, Artificial Sequence
  derived and/or modified sequence opt6 from anti-influenza_CDR
ccucuagguauacuucacuauuacgcuauggaucua

SEQ ID NO: 53029 - RNA, 36 nt, Artificial Sequence
  derived and/or modified sequence opt6 from anti-influenza_CDR
aaaauaacaagcaaaguaaacaacauaguagacaaa

SEQ ID NO: 53030 - RNA, 36 nt, Artificial Sequence
  derived and/or modified sequence opt6 from anti-influenza_CDR
ggaauaacaaacaaaguaaacagcauaauagacaaa

SEQ ID NO: 53031 - RNA, 36 nt, Artificial Sequence
  derived and/or modified sequence opt6 from anti-influenza_CDR
aaugggagaaguaguacgaguuggggaauagaugug

SEQ ID NO: 53032 - RNA, 36 nt, Artificial Sequence
  derived and/or modified sequence opt6 from anti-influenza_CDR
ggaauaacaaacaaagaaaacagcguaauagaaaaa

SEQ ID NO: 53033 - RNA, 36 nt, Artificial Sequence
  derived and/or modified sequence opt6 from anti-influenza_CDR
ccuuuagguucacguuauuauuaugguauggaugua

SEQ ID NO: 53034 - RNA, 36 nt, Artificial Sequence
  derived and/or modified sequence opt6 from anti-influenza_CDR
gggauaacgaacaagguaaauagcgugauagagaaa

SEQ ID NO: 53035 - RNA, 36 nt, Artificial Sequence
  derived and/or modified sequence opt6 from anti-influenza_CDR
ggcguaacaaacaaaguaaacucaauaauaaacaaa

SEQ ID NO: 53036 - RNA, 36 nt, Artificial Sequence
  derived and/or modified sequence opt6 from anti-influenza_CDR
cacaugggcuaucaaguaagagaaacaauggacgua

SEQ ID NO: 53037 - RNA, 36 nt, Artificial Sequence
  derived and/or modified sequence opt6 from anti-influenza_CDR
gcaacaugggacagaagaccaacagcauauguagua

SEQ ID NO: 53038 - RNA, 36 nt, Artificial Sequence
  derived and/or modified sequence opt6 from anti-influenza_CDR
gaaggaaaauggggaccacaagcagcauucgauaua

SEQ ID NO: 53039 - RNA, 36 nt, Artificial Sequence
  derived and/or modified sequence opt6 from anti-influenza_CDR
ggagauaaagggauauauuacuauuauauggacgug

SEQ ID NO: 53040 - RNA, 36 nt, Artificial Sequence
  derived and/or modified sequence opt6 from anti-influenza_CDR
gguuccgguuaucauauuucuacuccuuuugauaau

SEQ ID NO: 53041 - RNA, 36 nt, Artificial Sequence
  derived and/or modified sequence opt6 from anti-influenza_CDR
cgagcaagccagagcguaagcucaagcuaucuagca

SEQ ID NO: 53042 - RNA, 36 nt, Artificial Sequence
  derived and/or modified sequence opt6 from anti-influenza_CDR
ggaucuggauauacaacuagaaauuacuuugacuau

SEQ ID NO: 53043 - RNA, 36 nt, Artificial Sequence
  derived and/or modified sequence opt6 from anti-influenza_CDR
agagcaagccagagcguaagcucaaacuaucuagga

SEQ ID NO: 53044 - RNA, 36 nt, Artificial Sequence
  derived and/or modified sequence opt6 from anti-influenza_CDR
ggaucuacauaugacuuuucaucuggacuugauuau

SEQ ID NO: 53045 - RNA, 36 nt, Artificial Sequence
  derived and/or modified sequence opt6 from anti-influenza_CDR
ggaguacaccauccaggaacagauaacgaucaaaua

SEQ ID NO: 53046 - RNA, 36 nt, Artificial Sequence
  derived and/or modified sequence opt6 from anti-influenza_CDR
ggcguacaccauccaucaacagauucagaucaaaca

SEQ ID NO: 53047 - RNA, 36 nt, Artificial Sequence
  derived and/or modified sequence opt6 from anti-influenza_CDR
ggaguacaccacccaucaaacgaaacagaacaaaga

SEQ ID NO: 53048 - RNA, 36 nt, Artificial Sequence
  derived and/or modified sequence opt6 from anti-influenza_CDR
caaucaaucacauucgacuacaaaaacuaccucgcc

SEQ ID NO: 53049 - RNA, 36 nt, Artificial Sequence
  derived and/or modified sequence opt6 from anti-influenza_CDR
ggaggguuaauagggacgggaaguuauuauuggggg

SEQ ID NO: 53050 - RNA, 36 nt, Artificial Sequence
  derived and/or modified sequence opt6 from anti-influenza_CDR
gcuagauauaacuggggaauuagauauuucgauuuc

SEQ ID NO: 53051 - RNA, 36 nt, Artificial Sequence
  derived and/or modified sequence opt6 from anti-influenza_CDR
caaucaguccucucaaacuccaaaaaccuaaacuac

SEQ ID NO: 53052 - RNA, 36 nt, Artificial Sequence
  derived and/or modified sequence opt6 from anti-influenza_CDR
ugucagguuugggagacaagugaagauuuaugggua

SEQ ID NO: 53053 - RNA, 39 nt, Artificial Sequence
  derived and/or modified sequence opt6 from anti-influenza_CDR
gcuagagguggacguuauuauguagauuauuuugauuau

SEQ ID NO: 53054 - RNA, 39 nt, Artificial Sequence
  derived and/or modified sequence opt6 from anti-influenza_CDR
gcuagaucuggcgauggcuauaauuauuacuuuccauug

SEQ ID NO: 53055 - RNA, 39 nt, Artificial Sequence
  derived and/or modified sequence opt6 from anti-influenza_CDR
gcgcguggguguggguauaauuguuauuauuuugauggg

SEQ ID NO: 53056 - RNA, 39 nt, Artificial Sequence
  derived and/or modified sequence opt6 from anti-influenza_CDR
agcggaagcucaagcaauauaggaagcaauacaguaaac

SEQ ID NO: 53057 - RNA, 39 nt, Artificial Sequence
  derived and/or modified sequence opt6 from anti-influenza_CDR
gauucuccuuauucuucuucuuggucuuuuuuugauuau

SEQ ID NO: 53058 - RNA, 39 nt, Artificial Sequence
  derived and/or modified sequence opt6 from anti-influenza_CDR
agcgggagugauaguaauauaggggacuauuucgugugc

SEQ ID NO: 53059 - RNA, 39 nt, Artificial Sequence
  derived and/or modified sequence opt6 from anti-influenza_CDR
gcgagaaugguagugguaacgggagauggauuugaugug

SEQ ID NO: 53060 - RNA, 39 nt, Artificial Sequence
  derived and/or modified sequence opt6 from anti-influenza_CDR
uggcuaaguauaauaaaugcgggagggggagauauagau

SEQ ID NO: 53061 - RNA, 39 nt, Artificial Sequence
  derived and/or modified sequence opt6 from anti-influenza_CDR
gcagccucaucauuacaaucaggaguaccaucaagauuu

SEQ ID NO: 53062 - RNA, 39 nt, Artificial Sequence
  derived and/or modified sequence opt6 from anti-influenza_CDR
caugaugcuaaauuuucugguucuuauuauguugcuucu

SEQ ID NO: 53063 - RNA, 39 nt, Artificial Sequence
  derived and/or modified sequence opt6 from anti-influenza_CDR
caugauguuaaauuuucugguucuuauuauguugcuucu

SEQ ID NO: 53064 - RNA, 39 nt, Artificial Sequence
  derived and/or modified sequence opt6 from anti-influenza_CDR
acaggaagugaaaguacaacaggauacggaauggaugua

SEQ ID NO: 53065 - RNA, 39 nt, Artificial Sequence
  derived and/or modified sequence opt6 from anti-influenza_CDR
gcagcaaguacaaguguauuaggauauggaauggaugua

SEQ ID NO: 53066 - RNA, 39 nt, Artificial Sequence
  derived and/or modified sequence opt6 from anti-influenza_CDR
ucaggaucaacauuuaauauaggaucaaacgcaguagac

SEQ ID NO: 53067 - RNA, 39 nt, Artificial Sequence
  derived and/or modified sequence opt6 from anti-influenza_CDR
ucuggaucuagaucuaauguuggagauaacucuguauau

SEQ ID NO: 53068 - RNA, 39 nt, Artificial Sequence
  derived and/or modified sequence opt6 from anti-influenza_CDR
uccggaucuucaucuaauaucggaaaugauuauguaucu

SEQ ID NO: 53069 - RNA, 39 nt, Artificial Sequence
  derived and/or modified sequence opt6 from anti-influenza_CDR
gggggagggaguuauggggcguaugagggauuugauuau

SEQ ID NO: 53070 - RNA, 39 nt, Artificial Sequence
  derived and/or modified sequence opt6 from anti-influenza_CDR
uccggaucuucaucuaauauuggaucuaauuauguauau

SEQ ID NO: 53071 - RNA, 39 nt, Artificial Sequence
  derived and/or modified sequence opt6 from anti-influenza_CDR
gccagaagacaacaacuauacaaaggauacuaccaccau

SEQ ID NO: 53072 - RNA, 39 nt, Artificial Sequence
  derived and/or modified sequence opt6 from anti-influenza_CDR
uccggaucuacaucuaauauuggauauaacccuguaucu

SEQ ID NO: 53073 - RNA, 39 nt, Artificial Sequence
  derived and/or modified sequence opt6 from anti-influenza_CDR
gcuagagguaugaauuacuauagugauuacuuugacuau

SEQ ID NO: 53074 - RNA, 39 nt, Artificial Sequence
  derived and/or modified sequence opt6 from anti-influenza_CDR
gcuagaggucauucugguucuuaucguuuauuugauuuu

SEQ ID NO: 53075 - RNA, 39 nt, Artificial Sequence
  derived and/or modified sequence opt6 from anti-influenza_CDR
gcaaaaccauuaagagguagcuauagauauuucgaucua

SEQ ID NO: 53076 - RNA, 39 nt, Artificial Sequence
  derived and/or modified sequence opt6 from anti-influenza_CDR
ccaauauggguaaaaacaccacuaaaacuagcaaacgga

SEQ ID NO: 53077 - RNA, 39 nt, Artificial Sequence
  derived and/or modified sequence opt6 from anti-influenza_CDR
caagcaucccaaucaguauacaacaaaaacaaccuagcc

SEQ ID NO: 53078 - RNA, 39 nt, Artificial Sequence
  derived and/or modified sequence opt6 from anti-influenza_CDR
caaucauccgaaucaguauacaaaaacaacaaccuagcc

SEQ ID NO: 53079 - RNA, 39 nt, Artificial Sequence
  derived and/or modified sequence opt6 from anti-influenza_CDR
caaucaucccaaucagucgacucaaacaaccaacuauca

SEQ ID NO: 53080 - RNA, 39 nt, Artificial Sequence
  derived and/or modified sequence opt6 from anti-influenza_CDR
caaagcucacaaucagucgacaacaauaaagaccuagca

SEQ ID NO: 53081 - RNA, 39 nt, Artificial Sequence
  derived and/or modified sequence opt6 from anti-influenza_CDR
caaucaucccaauccguauacaacaacaaccgccuaucc

SEQ ID NO: 53082 - RNA, 39 nt, Artificial Sequence
  derived and/or modified sequence opt6 from anti-influenza_CDR
caaucaucccaaucagucuacaaaaacaacaaccuagcc

SEQ ID NO: 53083 - RNA, 39 nt, Artificial Sequence
  derived and/or modified sequence opt6 from anti-influenza_CDR
gggggaggguuuggguggagucagacguauuuuggauau

SEQ ID NO: 53084 - RNA, 42 nt, Artificial Sequence
  derived and/or modified sequence opt6 from anti-influenza_CDR
uggcuagggagaacguauuauagaucgaaaugguauaaugac

SEQ ID NO: 53085 - RNA, 42 nt, Artificial Sequence
  derived and/or modified sequence opt6 from anti-influenza_CDR
ggggguuugguuggggguuaugaugaguauuuuuuugauuau

SEQ ID NO: 53086 - RNA, 42 nt, Artificial Sequence
  derived and/or modified sequence opt6 from anti-influenza_CDR
cauccuaaauauuuuuaugguucugguucuuauccugauuuu

SEQ ID NO: 53087 - RNA, 42 nt, Artificial Sequence
  derived and/or modified sequence opt6 from anti-influenza_CDR
acggguucgaguucggaugugggugcgaguaauagugugagu

SEQ ID NO: 53088 - RNA, 42 nt, Artificial Sequence
  derived and/or modified sequence opt6 from anti-influenza_CDR
ggugcauauuacgauucaucuggauauccagcuuucuauaua

SEQ ID NO: 53089 - RNA, 42 nt, Artificial Sequence
  derived and/or modified sequence opt6 from anti-influenza_CDR
acagguucgaguucgaauauagguucggauuaugaugugcau

SEQ ID NO: 53090 - RNA, 42 nt, Artificial Sequence
  derived and/or modified sequence opt6 from anti-influenza_CDR
gaauuugaaaccucaggcuauuuccauggcucauuugauuau

SEQ ID NO: 53091 - RNA, 42 nt, Artificial Sequence
  derived and/or modified sequence opt6 from anti-influenza_CDR
gcaucuucaaccggagccguaacuucaucuuacuuuccaaau

SEQ ID NO: 53092 - RNA, 42 nt, Artificial Sequence
  derived and/or modified sequence opt6 from anti-influenza_CDR
acgggagggaguucggauauaggagcgaguaauagugugagu

SEQ ID NO: 53093 - RNA, 42 nt, Artificial Sequence
  derived and/or modified sequence opt6 from anti-influenza_CDR
acggguucgaguucggauguggguggguaugauuaugugagu

SEQ ID NO: 53094 - RNA, 42 nt, Artificial Sequence
  derived and/or modified sequence opt6 from anti-influenza_CDR
ggaucaaguacaggagcaguaacaagaggacacuauccauau

SEQ ID NO: 53095 - RNA, 42 nt, Artificial Sequence
  derived and/or modified sequence opt6 from anti-influenza_CDR
ggaucaucaacaggaccaguaacaucaggacauuacccauau

SEQ ID NO: 53096 - RNA, 42 nt, Artificial Sequence
  derived and/or modified sequence opt6 from anti-influenza_CDR
cacuauggagauucagaagcaauaaaugacgcauuugacaua

SEQ ID NO: 53097 - RNA, 42 nt, Artificial Sequence
  derived and/or modified sequence opt6 from anti-influenza_CDR
acagguucgaguucgaauauaggugcggguuaugaugugcau

SEQ ID NO: 53098 - RNA, 42 nt, Artificial Sequence
  derived and/or modified sequence opt6 from anti-influenza_CDR
auuccucauuauaauuuugguucugguucuuauuuugauuau

SEQ ID NO: 53099 - RNA, 42 nt, Artificial Sequence
  derived and/or modified sequence opt6 from anti-influenza_CDR
acggguacgaguucggauguggguggguauaauuaugugagu

SEQ ID NO: 53100 - RNA, 42 nt, Artificial Sequence
  derived and/or modified sequence opt6 from anti-influenza_CDR
acggguacgaguucggaugugggugcguauaauuaugugagu

SEQ ID NO: 53101 - RNA, 42 nt, Artificial Sequence
  derived and/or modified sequence opt6 from anti-influenza_CDR
gcagaaagaccaaaaguaagaggacaagcaggaagaaugaau

SEQ ID NO: 53102 - RNA, 42 nt, Artificial Sequence
  derived and/or modified sequence opt6 from anti-influenza_CDR
ggaaguaggccguggguaagaggaguaaguaguagaauaagu

SEQ ID NO: 53103 - RNA, 42 nt, Artificial Sequence
  derived and/or modified sequence opt6 from anti-influenza_CDR
auauggggaguagcagcaccaggaacagcagcagcacaaaua

SEQ ID NO: 53104 - RNA, 42 nt, Artificial Sequence
  derived and/or modified sequence opt6 from anti-influenza_CDR
uggguaagacaaccaccaggaaaaggauuagaauggguagca

SEQ ID NO: 53105 - RNA, 42 nt, Artificial Sequence
  derived and/or modified sequence opt6 from anti-influenza_CDR
gcaagagggccagaaggaguauggggaagaucaauagauagu

SEQ ID NO: 53106 - RNA, 42 nt, Artificial Sequence
  derived and/or modified sequence opt6 from anti-influenza_CDR
gcacgagauccagauacaccauucguacgagcauucgauagc

SEQ ID NO: 53107 - RNA, 42 nt, Artificial Sequence
  derived and/or modified sequence opt6 from anti-influenza_CDR
acagguucaacuucagauauagguucauauaacuauguaucu

SEQ ID NO: 53108 - RNA, 42 nt, Artificial Sequence
  derived and/or modified sequence opt6 from anti-influenza_CDR
ugggauuggaauuuugauuuauauuuagguugguuugauccu

SEQ ID NO: 53109 - RNA, 42 nt, Artificial Sequence
  derived and/or modified sequence opt6 from anti-influenza_CDR
ugggcuuggaauuuugauuuuuuuuuagguugguuugauccu

SEQ ID NO: 53110 - RNA, 42 nt, Artificial Sequence
  derived and/or modified sequence opt6 from anti-influenza_CDR
gguccagguuauaguggauaucauuauggaugguuugauaca

SEQ ID NO: 53111 - RNA, 42 nt, Artificial Sequence
  derived and/or modified sequence opt6 from anti-influenza_CDR
gcgagaugggacuauggaguguaugagggauauauagauuau

SEQ ID NO: 53112 - RNA, 45 nt, Artificial Sequence
  derived and/or modified sequence opt6 from anti-influenza_CDR
gcaagagcaggaacaacauuaacaagauuuaacugguuugaccca

SEQ ID NO: 53113 - RNA, 45 nt, Artificial Sequence
  derived and/or modified sequence opt6 from anti-influenza_CDR
gcaagagcaggaacaacaguaacaagauuuaauugguuugaccca

SEQ ID NO: 53114 - RNA, 45 nt, Artificial Sequence
  derived and/or modified sequence opt6 from anti-influenza_CDR
gcgagagggcaaagguacuauuaugauagagauggaauggacgug

SEQ ID NO: 53115 - RNA, 45 nt, Artificial Sequence
  derived and/or modified sequence opt6 from anti-influenza_CDR
gcaagaucaggcggauaucuaccacaaaauaacuggauagaccca

SEQ ID NO: 53116 - RNA, 45 nt, Artificial Sequence
  derived and/or modified sequence opt6 from anti-influenza_CDR
auggaaaacgaaagaacacuagacuuccaugacucaaacguaaaa

SEQ ID NO: 53117 - RNA, 45 nt, Artificial Sequence
  derived and/or modified sequence opt6 from anti-influenza_CDR
ggagcugaucauggaaguggaaguaauuuuguaaguccauaugua

SEQ ID NO: 53118 - RNA, 45 nt, Artificial Sequence
  derived and/or modified sequence opt6 from anti-influenza_CDR
gauacaagaagcucacuagauaacuaucaauauggaauggacgua

SEQ ID NO: 53119 - RNA, 45 nt, Artificial Sequence
  derived and/or modified sequence opt6 from anti-influenza_CDR
gaagauuaugauauauuaacaggagcaggaccgggaauggaagua

SEQ ID NO: 53120 - RNA, 45 nt, Artificial Sequence
  derived and/or modified sequence opt6 from anti-influenza_CDR
cauccauaugauguuuuaacuggaucuggagauugguuugauccu

SEQ ID NO: 53121 - RNA, 45 nt, Artificial Sequence
  derived and/or modified sequence opt6 from anti-influenza_CDR
ggagcugaucauggaaguggaaauaauuuuguaaguccauaugua

SEQ ID NO: 53122 - RNA, 45 nt, Artificial Sequence
  derived and/or modified sequence opt6 from anti-influenza_CDR
guaauauauagcggaggaucgacauauuaugcagacucaguaaaa

SEQ ID NO: 53123 - RNA, 45 nt, Artificial Sequence
  derived and/or modified sequence opt6 from anti-influenza_CDR
ugguaccaacaaaaaccaggaaaagcaccaaaacuacuaauauac

SEQ ID NO: 53124 - RNA, 45 nt, Artificial Sequence
  derived and/or modified sequence opt6 from anti-influenza_CDR
gauccauauaacgacggaacaaaauauaacgaaaaauuugaagga

SEQ ID NO: 53125 - RNA, 45 nt, Artificial Sequence
  derived and/or modified sequence opt6 from anti-influenza_CDR
gcaagagcacauacagcucuaacuagauuuagauggcuagaucca

SEQ ID NO: 53126 - RNA, 45 nt, Artificial Sequence
  derived and/or modified sequence opt6 from anti-influenza_CDR
gcaucucuagauuacgauuucucuuacuauuaccauagagaugua

SEQ ID NO: 53127 - RNA, 45 nt, Artificial Sequence
  derived and/or modified sequence opt6 from anti-influenza_CDR
gcuagaguugcaacuccauauuauuaugaaucuggauuugacuau

SEQ ID NO: 53128 - RNA, 45 nt, Artificial Sequence
  derived and/or modified sequence opt6 from anti-influenza_CDR
gcgagaaggggagggggauggcaauauuauuauggaauggaugug

SEQ ID NO: 53129 - RNA, 48 nt, Artificial Sequence
  derived and/or modified sequence opt6 from anti-influenza_CDR
ucuggacauauaacuguauuuggaguuaauguugacgcuuuugauaug

SEQ ID NO: 53130 - RNA, 48 nt, Artificial Sequence
  derived and/or modified sequence opt6 from anti-influenza_CDR
ggaggacauauaacaguauucggacuaaauauagacgcauaugauaua

SEQ ID NO: 53131 - RNA, 48 nt, Artificial Sequence
  derived and/or modified sequence opt6 from anti-influenza_CDR
ggaggacacauaacagaauucggacuaaauauagacgcauaugacaua

SEQ ID NO: 53132 - RNA, 48 nt, Artificial Sequence
  derived and/or modified sequence opt6 from anti-influenza_CDR
ggaggacauauaacaguauuuggaguaaauauagacgcauuugauaua

SEQ ID NO: 53133 - RNA, 48 nt, Artificial Sequence
  derived and/or modified sequence opt6 from anti-influenza_CDR
ggaggacauauaacaguauuuggaguaaauauagaugcauuugaugua

SEQ ID NO: 53134 - RNA, 48 nt, Artificial Sequence
  derived and/or modified sequence opt6 from anti-influenza_CDR
gcaagagauggcuggggacaacaauuaguaccauauuauuuugauuau

SEQ ID NO: 53135 - RNA, 48 nt, Artificial Sequence
  derived and/or modified sequence opt6 from anti-influenza_CDR
gauuuuuggguuucuuauuauuaugauucuucugcuccuccugcuauu

SEQ ID NO: 53136 - RNA, 48 nt, Artificial Sequence
  derived and/or modified sequence opt6 from anti-influenza_CDR
gcaagagcaggaguaaaaauauuuggauuaauaguaggggcauuagau

SEQ ID NO: 53137 - RNA, 48 nt, Artificial Sequence
  derived and/or modified sequence opt6 from anti-influenza_CDR
gcacgugauggugcagguucauauuauccuuuaaauugguuugauccu

SEQ ID NO: 53138 - RNA, 48 nt, Artificial Sequence
  derived and/or modified sequence opt6 from anti-influenza_CDR
guuauauauucgcaugggcgugcguauuauagugcaagugugaauggg

SEQ ID NO: 53139 - RNA, 48 nt, Artificial Sequence
  derived and/or modified sequence opt6 from anti-influenza_CDR
gacacacuacacaacggauacacaaacuacaauccaucacuaagagga

SEQ ID NO: 53140 - RNA, 48 nt, Artificial Sequence
  derived and/or modified sequence opt6 from anti-influenza_CDR
uacauauccuacaacggccgcccaaaauacaacccaucccuaaccuca

SEQ ID NO: 53141 - RNA, 48 nt, Artificial Sequence
  derived and/or modified sequence opt6 from anti-influenza_CDR
gaaacaagauuuggagaacuauuaagcccauaugaugcauuugaaaua

SEQ ID NO: 53142 - RNA, 48 nt, Artificial Sequence
  derived and/or modified sequence opt6 from anti-influenza_CDR
cuaauauacugggacgacgacaaaagauacaguccaagccuaaaaaga

SEQ ID NO: 53143 - RNA, 48 nt, Artificial Sequence
  derived and/or modified sequence opt6 from anti-influenza_CDR
uacauauacuacaucggcaacacagacuacagaccaucacuaaaauca

SEQ ID NO: 53144 - RNA, 48 nt, Artificial Sequence
  derived and/or modified sequence opt6 from anti-influenza_CDR
gaaauaucacacggcggaucaacaaacuacaacccaucacuaaaauca

SEQ ID NO: 53145 - RNA, 48 nt, Artificial Sequence
  derived and/or modified sequence opt6 from anti-influenza_CDR
gaaauaaaccacucaggccgaacaaacuacaacccaucacuaaaauca

SEQ ID NO: 53146 - RNA, 48 nt, Artificial Sequence
  derived and/or modified sequence opt6 from anti-influenza_CDR
cuaauaucaugggacgacgaaaaacacuacucaccaucacuacaauca

SEQ ID NO: 53147 - RNA, 48 nt, Artificial Sequence
  derived and/or modified sequence opt6 from anti-influenza_CDR
gaggguguguauuuugauucggguacguauagggguuauuuugauuau

SEQ ID NO: 53148 - RNA, 48 nt, Artificial Sequence
  derived and/or modified sequence opt6 from anti-influenza_CDR
uacauauaccacuccggcuccacaaacuacaacccaucccuaaaauca

SEQ ID NO: 53149 - RNA, 48 nt, Artificial Sequence
  derived and/or modified sequence opt6 from anti-influenza_CDR
uacauauacuaccgcggcuccacauucuacaauccaucccuaaaauca

SEQ ID NO: 53150 - RNA, 48 nt, Artificial Sequence
  derived and/or modified sequence opt6 from anti-influenza_CDR
uacauauccuacuccggauccacaaaauacaauccaucccuccgcuca

SEQ ID NO: 53151 - RNA, 48 nt, Artificial Sequence
  derived and/or modified sequence opt6 from anti-influenza_CDR
gaaauaaaacacucaggcagaacaaacuacaacccaucacuagaauca

SEQ ID NO: 53152 - RNA, 48 nt, Artificial Sequence
  derived and/or modified sequence opt6 from anti-influenza_CDR
gaaauaaaccacucaggcggaacaaacuacaauccaucacuaaaaaga

SEQ ID NO: 53153 - RNA, 48 nt, Artificial Sequence
  derived and/or modified sequence opt6 from anti-influenza_CDR
uucauguacuacuccgccuccacauacuacaacccaucccuaaaauca

SEQ ID NO: 53154 - RNA, 48 nt, Artificial Sequence
  derived and/or modified sequence opt6 from anti-influenza_CDR
uacguauacuacuccggauccacaaccuacaacccaucccuaaaauca

SEQ ID NO: 53155 - RNA, 48 nt, Artificial Sequence; identical to SEQ ID NO: 22587
  derived and/or modified sequence opt6 from anti-influenza_CDR

SEQ ID NO: 53156 - RNA, 48 nt, Artificial Sequence
  derived and/or modified sequence opt6 from anti-influenza_CDR
uucauauacuacggcggcaacacaaaauacaacccaucacuaaaauca

SEQ ID NO: 53157 - RNA, 48 nt, Artificial Sequence
  derived and/or modified sequence opt6 from anti-influenza_CDR
uucauguuccacuccggauccccacgcuacaacccaacccuaaaauca

SEQ ID NO: 53158 - RNA, 48 nt, Artificial Sequence
  derived and/or modified sequence opt6 from anti-influenza_CDR
uucuucuacaacggcggcucaacaaaauacaacccaucacuaaaauca

SEQ ID NO: 53159 - RNA, 48 nt, Artificial Sequence
  derived and/or modified sequence opt6 from anti-influenza_CDR
cacauauacgacuacggccgcacauucuacaauucaucacuacaauca

SEQ ID NO: 53160 - RNA, 48 nt, Artificial Sequence
  derived and/or modified sequence opt6 from anti-influenza_CDR
guauucuauucagaaacaagaacauacuacgcagacucaguaaaagga

SEQ ID NO: 53161 - RNA, 48 nt, Artificial Sequence
  derived and/or modified sequence opt6 from anti-influenza_CDR
uacguauacaaccgcggauccacaaaauacucaccaucccuaaaauca

SEQ ID NO: 53162 - RNA, 48 nt, Artificial Sequence
  derived and/or modified sequence opt6 from anti-influenza_CDR
uacauauacaaccgcggauccacaaaauacacaccaucccuaaaauca

SEQ ID NO: 53163 - RNA, 48 nt, Artificial Sequence
  derived and/or modified sequence opt6 from anti-influenza_CDR
uaccuauacuacuccggcuccacaaaauacaaccccucccucaaauca

SEQ ID NO: 53164 - RNA, 48 nt, Artificial Sequence
  derived and/or modified sequence opt6 from anti-influenza_CDR
uacguauacaacuccggaaacacaaaauacaacccaucccuaaaauca

SEQ ID NO: 53165 - RNA, 48 nt, Artificial Sequence
  derived and/or modified sequence opt6 from anti-influenza_CDR
cacauauucgacuccggauccacauacuacaacccaucacuaaaauca

SEQ ID NO: 53166 - RNA, 48 nt, Artificial Sequence
  derived and/or modified sequence opt6 from anti-influenza_CDR
guauuuuacucugcagauagaacuucauaugcagauucaguuaaaggu

SEQ ID NO: 53167 - RNA, 48 nt, Artificial Sequence
  derived and/or modified sequence opt6 from anti-influenza_CDR
uacauauacuacuccggcaacacauacuacaaccccucccucaaauca

SEQ ID NO: 53168 - RNA, 48 nt, Artificial Sequence
  derived and/or modified sequence opt6 from anti-influenza_CDR
cgaucuucccaaucauuacuccauucaaauggcuauaacuaucucgau

SEQ ID NO: 53169 - RNA, 48 nt, Artificial Sequence
  derived and/or modified sequence opt6 from anti-influenza_CDR
accauauaccacuccggcuccacauacuacaacccaucccuaaaauca

SEQ ID NO: 53170 - RNA, 48 nt, Artificial Sequence
  derived and/or modified sequence opt6 from anti-influenza_CDR
cgaucuucccaaucauuacuccauuccaauggccauaucuauuucgau

SEQ ID NO: 53171 - RNA, 48 nt, Artificial Sequence
  derived and/or modified sequence opt6 from anti-influenza_CDR
auauggggaguagcagcaccaagcacagcaagcgcacaaacaucauua

SEQ ID NO: 53172 - RNA, 48 nt, Artificial Sequence
  derived and/or modified sequence opt6 from anti-influenza_CDR
cgcuccucucaaucacuucuauauaccgauggcuuuaccuaucucucu

SEQ ID NO: 53173 - RNA, 48 nt, Artificial Sequence
  derived and/or modified sequence opt6 from anti-influenza_CDR
gcaaaaccaagauuagacuaucuagauuacuuucacgcagccgacuca

SEQ ID NO: 53174 - RNA, 48 nt, Artificial Sequence
  derived and/or modified sequence opt6 from anti-influenza_CDR
gcuagaucuccagguuacucuggauauuuauauggaugguucgaucca

SEQ ID NO: 53175 - RNA, 48 nt, Artificial Sequence
  derived and/or modified sequence opt6 from anti-influenza_CDR
gcaauagcaggaaguggaagugcagauuaugcaaguugggcaaaagga

SEQ ID NO: 53176 - RNA, 48 nt, Artificial Sequence
  derived and/or modified sequence opt6 from anti-influenza_CDR
gcaauagcaggaucaggaucagcagauuaugcaagcugggcaaaaagu

SEQ ID NO: 53177 - RNA, 48 nt, Artificial Sequence
  derived and/or modified sequence opt6 from anti-influenza_CDR
gcaauaggaggaggaggaagugcagauuaugcaaguugggcaaaaagu

SEQ ID NO: 53178 - RNA, 48 nt, Artificial Sequence
  derived and/or modified sequence opt6 from anti-influenza_CDR
agaucaucacaaucauuacucagaucaaacggcuauaacuaccuagac

SEQ ID NO: 53179 - RNA, 48 nt, Artificial Sequence
  derived and/or modified sequence opt6 from anti-influenza_CDR
caaggagaucacauagcauggcuauuaagaggaauaaauuuugauuac

SEQ ID NO: 53180 - RNA, 51 nt, Artificial Sequence
  derived and/or modified sequence opt6 from anti-influenza_CDR
gcaagauuaggaucaggaaguuaucauaauggaccaaauugguuugaucca

SEQ ID NO: 53181 - RNA, 51 nt, Artificial Sequence
  derived and/or modified sequence opt6 from anti-influenza_CDR
gcaagagcagaaaauuuauuaaguccauacuuagcagaaggauuugaccca

SEQ ID NO: 53182 - RNA, 51 nt, Artificial Sequence
  derived and/or modified sequence opt6 from anti-influenza_CDR
guaauaucauacgauggaucaaacaaauacuaugcagauagcguaaaagga

SEQ ID NO: 53183 - RNA, 51 nt, Artificial Sequence
  derived and/or modified sequence opt6 from anti-influenza_CDR
ggaacaauaccacuacuaggaacaacaaacuacgcacaaaaauuccaagga

SEQ ID NO: 53184 - RNA, 51 nt, Artificial Sequence
  derived and/or modified sequence opt6 from anti-influenza_CDR
ggaauaauagcaguauucaacacagcaaacuacgcacaaaaauuccaagga

SEQ ID NO: 53185 - RNA, 51 nt, Artificial Sequence
  derived and/or modified sequence opt6 from anti-influenza_CDR
aauauagaggacgauggaggggacaaguauuauguagauagugugaaaggg

SEQ ID NO: 53186 - RNA, 51 nt, Artificial Sequence
  derived and/or modified sequence opt6 from anti-influenza_CDR
uggauaaauccaaauucaggaacaacaggaagugcacaaagauuucaagga

SEQ ID NO: 53187 - RNA, 51 nt, Artificial Sequence
  derived and/or modified sequence opt6 from anti-influenza_CDR
ggaauaaauccaguauucggaagaccacacuaugcacaaaaauuucaagga

SEQ ID NO: 53188 - RNA, 51 nt, Artificial Sequence
  derived and/or modified sequence opt6 from anti-influenza_CDR
ggaauaauaccacuaauaaacgcaccaaacuacgcaccaaaauuccaagga

SEQ ID NO: 53189 - RNA, 51 nt, Artificial Sequence
  derived and/or modified sequence opt6 from anti-influenza_CDR
ggaauaauaccaaugaugggaacaguaaacuaugcacaaaaacuacaagga

SEQ ID NO: 53190 - RNA, 51 nt, Artificial Sequence
  derived and/or modified sequence opt6 from anti-influenza_CDR
ggaauaauaccacuauucggagcagcaaaauacgcacaaaaauuccaagga

SEQ ID NO: 53191 - RNA, 51 nt, Artificial Sequence
  derived and/or modified sequence opt6 from anti-influenza_CDR
aaaucaucccaacgcguacucuacuccucaaacaacaaaaacuaccuagcc

SEQ ID NO: 53192 - RNA, 51 nt, Artificial Sequence
  derived and/or modified sequence opt6 from anti-influenza_CDR
uuaauaucugacgauggaucuaacaaauucuaugcagauucaguuaaaggu

SEQ ID NO: 53193 - RNA, 51 nt, Artificial Sequence
  derived and/or modified sequence opt6 from anti-influenza_CDR
auaauaucauacgacggaaaugaccaauacuauacagacagcguaaaagga

SEQ ID NO: 53194 - RNA, 51 nt, Artificial Sequence
  derived and/or modified sequence opt6 from anti-influenza_CDR
uggauaucaacauacaacggcaacacaaacuucgcacaaaacuuccaaggc

SEQ ID NO: 53195 - RNA, 51 nt, Artificial Sequence
  derived and/or modified sequence opt6 from anti-influenza_CDR
guagaaggaagcuauagagauuucuggaacaaucaaaauagauuugacccg

SEQ ID NO: 53196 - RNA, 51 nt, Artificial Sequence
  derived and/or modified sequence opt6 from anti-influenza_CDR
uggauaaacccaaacucaggagacacaaauuacgcacaaaaauuccaagga

SEQ ID NO: 53197 - RNA, 51 nt, Artificial Sequence
  derived and/or modified sequence opt6 from anti-influenza_CDR
aaauccucccaaucaguccucuacuccuccaacaauaaaucccaccucgcc

SEQ ID NO: 53198 - RNA, 51 nt, Artificial Sequence
  derived and/or modified sequence opt6 from anti-influenza_CDR
auaauauacccaggagacucagacacaagauacucaccaucauuccaagga

SEQ ID NO: 53199 - RNA, 51 nt, Artificial Sequence
  derived and/or modified sequence opt6 from anti-influenza_CDR
gguauaauuccaguuuucccuacaccuaacuaugcacaaauguuucaaggu

SEQ ID NO: 53200 - RNA, 51 nt, Artificial Sequence
  derived and/or modified sequence opt6 from anti-influenza_CDR
ggaauaguaccaguauucggaacagcaaacuaugcacaaaaauuucaagga

SEQ ID NO: 53201 - RNA, 51 nt, Artificial Sequence
  derived and/or modified sequence opt6 from anti-influenza_CDR
uggauaaacccagaaucaggagacacaaaauacgcacaaaaauuccaagga

SEQ ID NO: 53202 - RNA, 51 nt, Artificial Sequence
  derived and/or modified sequence opt6 from anti-influenza_CDR
agaucaucacaaucaauauuccacaacucaaacaacgaaaacuaccucgcc

SEQ ID NO: 53203 - RNA, 51 nt, Artificial Sequence
  derived and/or modified sequence opt6 from anti-influenza_CDR
uggauaaaugcaaaaagaggaggaacaaauuaugcacaaaaauuccaagga

SEQ ID NO: 53204 - RNA, 51 nt, Artificial Sequence
  derived and/or modified sequence opt6 from anti-influenza_CDR
uggauaaauccagacucaggagcaacaucaagugcacaaaauuuccaagga

SEQ ID NO: 53205 - RNA, 51 nt, Artificial Sequence
  derived and/or modified sequence opt6 from anti-influenza_CDR
uggauaaguccagacucagacgcaacaaaauaugcacaaaaauuucaagga

SEQ ID NO: 53206 - RNA, 51 nt, Artificial Sequence
  derived and/or modified sequence opt6 from anti-influenza_CDR
aauauaaaacaagacggaagagaaaaauacuacguagacagccuaagagga

SEQ ID NO: 53207 - RNA, 51 nt, Artificial Sequence
  derived and/or modified sequence opt6 from anti-influenza_CDR
ggaauaauagcaauauucggaacaccaaaauacgcacaaaaauuccaagga

SEQ ID NO: 53208 - RNA, 51 nt, Artificial Sequence
  derived and/or modified sequence opt6 from anti-influenza_CDR
aaauccucccaauccauccucaacuccuccaacaacaaaaacuaccucgcc

SEQ ID NO: 53209 - RNA, 51 nt, Artificial Sequence
  derived and/or modified sequence opt6 from anti-influenza_CDR
uggauaagcgcauacaauggaaacacaaauuacgcacaaaaauuccaagga

SEQ ID NO: 53210 - RNA, 51 nt, Artificial Sequence
  derived and/or modified sequence opt6 from anti-influenza_CDR
ggaguaauaccaauauuuagaacagcaaauuacgcacaaaauuuccaagga

SEQ ID NO: 53211 - RNA, 51 nt, Artificial Sequence
  derived and/or modified sequence opt6 from anti-influenza_CDR
ggaauaauagcaauauuccacacaccaaaauacgcacaaaaauuccaagga

SEQ ID NO: 53212 - RNA, 51 nt, Artificial Sequence
  derived and/or modified sequence opt6 from anti-influenza_CDR
gguauaucuccaauguucgguacaacuacauaugcacaaaaauuucaaggu

SEQ ID NO: 53213 - RNA, 51 nt, Artificial Sequence
  derived and/or modified sequence opt6 from anti-influenza_CDR
aaaucaucccaauccguccucuacuccuccaacaacaaaaacuaccucgcc

SEQ ID NO: 53214 - RNA, 51 nt, Artificial Sequence
  derived and/or modified sequence opt6 from anti-influenza_CDR
ggaauaauaccaauauucggaacaacaaaauacgcaccaaaauuccaagga

SEQ ID NO: 53215 - RNA, 51 nt, Artificial Sequence
  derived and/or modified sequence opt6 from anti-influenza_CDR
ggaauaagcccacuauucggaacaacaaacuacgcacaaaaauuccaagga

SEQ ID NO: 53216 - RNA, 51 nt, Artificial Sequence
  derived and/or modified sequence opt6 from anti-influenza_CDR
ggaauaaugggaauguucggaacaacaaacuaugcacaaaaauuucaagga

SEQ ID NO: 53217 - RNA, 51 nt, Artificial Sequence
  derived and/or modified sequence opt6 from anti-influenza_CDR
ggaauaauaggaauguuuggaaguacaaauuaugcacaaaauuuucaagga

SEQ ID NO: 53218 - RNA, 51 nt, Artificial Sequence
  derived and/or modified sequence opt6 from anti-influenza_CDR
uggauaaauccaaauucaggcggaacaaauuaugcacaaaaauuccaagga

SEQ ID NO: 53219 - RNA, 51 nt, Artificial Sequence
  derived and/or modified sequence opt6 from anti-influenza_CDR
gcaauaucaagcucaggagauagcacauacuaugcagauagcguaaaagga

SEQ ID NO: 53220 - RNA, 51 nt, Artificial Sequence
  derived and/or modified sequence opt6 from anti-influenza_CDR
ucaauaucaagcucaagcucauacauauacuaugucgacagcguaaaagga

SEQ ID NO: 53221 - RNA, 51 nt, Artificial Sequence
  derived and/or modified sequence opt6 from anti-influenza_CDR
gacauaauaggaauguucggaucaacaaacuaugcacaaaauuuccaagga

SEQ ID NO: 53222 - RNA, 51 nt, Artificial Sequence
  derived and/or modified sequence opt6 from anti-influenza_CDR
ggaauaauaccaauguucggaacaacaaacuacgcacaaaaauuccaagga

SEQ ID NO: 53223 - RNA, 51 nt, Artificial Sequence
  derived and/or modified sequence opt6 from anti-influenza_CDR
ggaauaauagcaauauucggaacagcaaacuacgcacaaaaauuccaagga

SEQ ID NO: 53224 - RNA, 51 nt, Artificial Sequence
  derived and/or modified sequence opt6 from anti-influenza_CDR
ggaauaauaccaauauucggaacaacaaacuacgcacaaaaauuccaagga

SEQ ID NO: 53225 - RNA, 51 nt, Artificial Sequence
  derived and/or modified sequence opt6 from anti-influenza_CDR
ggaauauucgcacuauuuggaacaacagacuacgcacaaaaauuccaagga

SEQ ID NO: 53226 - RNA, 51 nt, Artificial Sequence
  derived and/or modified sequence opt6 from anti-influenza_CDR
ggaauaauaggaauguucggaacagcaaacuaugcacaaaaauuucaagga

SEQ ID NO: 53227 - RNA, 51 nt, Artificial Sequence
  derived and/or modified sequence opt6 from anti-influenza_CDR
ggaauaauagcaguauucggaacaacaaaauacgcacauaaauuccaagga

SEQ ID NO: 53228 - RNA, 51 nt, Artificial Sequence
  derived and/or modified sequence opt6 from anti-influenza_CDR
gguauauuaggaguuuucgguucaccuucauaugcacaaaaauuucaaggu

SEQ ID NO: 53229 - RNA, 51 nt, Artificial Sequence
  derived and/or modified sequence opt6 from anti-influenza_CDR
ggaauauuuggaauguucggaacagcaaacuaugcacaaaaauuucaagga

SEQ ID NO: 53230 - RNA, 51 nt, Artificial Sequence
  derived and/or modified sequence opt6 from anti-influenza_CDR
uggauaagcgcauacacaggagauacagauuacgcacaaaaauuccaagga

SEQ ID NO: 53231 - RNA, 51 nt, Artificial Sequence
  derived and/or modified sequence opt6 from anti-influenza_CDR
aguuuugacccagaagacggagaaacaauauacgcacaaaaauuucaagga

SEQ ID NO: 53232 - RNA, 51 nt, Artificial Sequence
  derived and/or modified sequence opt6 from anti-influenza_CDR
ggaauaaguggaaguggagaaaguacauauuaugcagauaguguaaaagga

SEQ ID NO: 53233 - RNA, 51 nt, Artificial Sequence
  derived and/or modified sequence opt6 from anti-influenza_CDR
guaguaaguuaugauggaaauuauaaauauuaugcagauaguguacaggga

SEQ ID NO: 53234 - RNA, 51 nt, Artificial Sequence
  derived and/or modified sequence opt6 from anti-influenza_CDR
ggcuccauaucuuacuccggcucuacauauuaccauccaucucuaaaauca

SEQ ID NO: 53235 - RNA, 51 nt, Artificial Sequence
  derived and/or modified sequence opt6 from anti-influenza_CDR
acaagaggaagaccaauaggaagaaauugggaaccaagagacaaagacuau

SEQ ID NO: 53236 - RNA, 51 nt, Artificial Sequence
  derived and/or modified sequence opt6 from anti-influenza_CDR
gcacgugaagcuggauaucauucuucauuuucagguguauauuuugauuau

SEQ ID NO: 53237 - RNA, 51 nt, Artificial Sequence
  derived and/or modified sequence opt6 from anti-influenza_CDR
agaauagacccaaacggaagcggaacaacauacgcacaaaaauuucaagga

SEQ ID NO: 53238 - RNA, 51 nt, Artificial Sequence
  derived and/or modified sequence opt6 from anti-influenza_CDR
agaauagacccaaacggagcaggaacaacauaugcacaaaaauuucaagga

SEQ ID NO: 53239 - RNA, 51 nt, Artificial Sequence
  derived and/or modified sequence opt6 from anti-influenza_CDR
uggauagauccaaauaacgauggaacuauauaugcacaaaaauuucaaggu

SEQ ID NO: 53240 - RNA, 51 nt, Artificial Sequence
  derived and/or modified sequence opt6 from anti-influenza_CDR
augauguacccaggagacucagacacaauauacucaccaucauuccaagga

SEQ ID NO: 53241 - RNA, 51 nt, Artificial Sequence
  derived and/or modified sequence opt6 from anti-influenza_CDR
augauguauccaggagacgcagacgcaauauauaguccaaguuuucaagga

SEQ ID NO: 53242 - RNA, 51 nt, Artificial Sequence
  derived and/or modified sequence opt6 from anti-influenza_CDR
augauguauccaggugaaucugaaacuauauauucaccuucauuucaaggc

SEQ ID NO: 53243 - RNA, 51 nt, Artificial Sequence
  derived and/or modified sequence opt6 from anti-influenza_CDR
augauguacccaggagacgcagacacaauauauucaccaucauuccaagga

SEQ ID NO: 53244 - RNA, 51 nt, Artificial Sequence
  derived and/or modified sequence opt6 from anti-influenza_CDR
augauguauccagguucaucugacacuauauauucaccuucauuucaaggu

SEQ ID NO: 53245 - RNA, 51 nt, Artificial Sequence
  derived and/or modified sequence opt6 from anti-influenza_CDR
augauguacccaggagacucagacgcaauauacucaccaucauuucaagga

SEQ ID NO: 53246 - RNA, 51 nt, Artificial Sequence
  derived and/or modified sequence opt6 from anti-influenza_CDR
augauguacccaggagacacagacacaauauacucaccaucauuccaagga

SEQ ID NO: 53247 - RNA, 51 nt, Artificial Sequence
  derived and/or modified sequence opt6 from anti-influenza_CDR
augauguauccaggugaaucugacacuauauauucaccuucauuucaaggc

SEQ ID NO: 53248 - RNA, 51 nt, Artificial Sequence
  derived and/or modified sequence opt6 from anti-influenza_CDR
guaauaaguugggauaguggaaggauaggguaugcggauaguguaaaggga

SEQ ID NO: 53249 - RNA, 51 nt, Artificial Sequence
  derived and/or modified sequence opt6 from anti-influenza_CDR
guccguucuggugcuuauuauuuuaauuauuuaguuccuuauuuugauuau

SEQ ID NO: 53250 - RNA, 51 nt, Artificial Sequence
  derived and/or modified sequence opt6 from anti-influenza_CDR
guccguucuggugcuuauuauguuaauuauuuaguuccuuauuuugauuau

SEQ ID NO: 53251 - RNA, 51 nt, Artificial Sequence
  derived and/or modified sequence opt6 from anti-influenza_CDR
auaauaaguugggauaguggaaggauaggguaugcggauaguguaagggga

SEQ ID NO: 53252 - RNA, 51 nt, Artificial Sequence
  derived and/or modified sequence opt6 from anti-influenza_CDR
cauggagguguauauuauuauggaagugcaaguucagguugguuugauccu

SEQ ID NO: 53253 - RNA, 54 nt, Artificial Sequence
  derived and/or modified sequence opt6 from anti-influenza_CDR
agaacauacuacagaucaaaaugguacaaugacuacgcagaaagcguaaaauca

SEQ ID NO: 53254 - RNA, 54 nt, Artificial Sequence
  derived and/or modified sequence opt6 from anti-influenza_CDR
agaacauacuacagaucaaaaugguacuaugacuaugcagaaagcguaaaauca

SEQ ID NO: 53255 - RNA, 54 nt, Artificial Sequence
  derived and/or modified sequence opt6 from anti-influenza_CDR
agaacauacuacagaucaaaaugguacaaugacuacgcaguaagcguaaaauca

SEQ ID NO: 53256 - RNA, 54 nt, Artificial Sequence
  derived and/or modified sequence opt6 from anti-influenza_CDR
agaacauacuacagaucaaaaugguacaacgacuacgcagacuuccuaaaaaga

SEQ ID NO: 53257 - RNA, 54 nt, Artificial Sequence
  derived and/or modified sequence opt6 from anti-influenza_CDR
agaacauacuauagaucaggaugguacaaugacuaugcagaaagcguaaaauca

SEQ ID NO: 53258 - RNA, 54 nt, Artificial Sequence
  derived and/or modified sequence opt6 from anti-influenza_CDR
gcgagauugggcgggaauaaggauuauggagauuacuugugguauuuugauuua

SEQ ID NO: 53259 - RNA, 54 nt, Artificial Sequence
  derived and/or modified sequence opt6 from anti-influenza_CDR
gcaaaagauacagcagaccauggagauuauguagacuuaggauuuuuugaugca

SEQ ID NO: 53260 - RNA, 54 nt, Artificial Sequence
  derived and/or modified sequence opt6 from anti-influenza_CDR
gcaagaucaggaauauuugauuggucagcaccacuaguagaagcauucgauaua

SEQ ID NO: 53261 - RNA, 54 nt, Artificial Sequence
  derived and/or modified sequence opt6 from anti-influenza_CDR
gcaagacaugcaaguuguagugcaagaucauguuauuggggaccaguagauuau

SEQ ID NO: 53262 - RNA, 54 nt, Artificial Sequence
  derived and/or modified sequence opt6 from anti-influenza_CDR
gaugcaccuccaaauguagaaguagcuucaaugacaaauugguauuucgaucua

SEQ ID NO: 53263 - RNA, 54 nt, Artificial Sequence
  derived and/or modified sequence opt6 from anti-influenza_CDR
uuaagaacagacuauggagauccagauaguguauauuauuacggaauggaugua

SEQ ID NO: 53264 - RNA, 54 nt, Artificial Sequence
  derived and/or modified sequence opt6 from anti-influenza_CDR
gguacaugugcaggugauuguucacuucauuauuauuauuaugguuuagaugua

SEQ ID NO: 53265 - RNA, 54 nt, Artificial Sequence
  derived and/or modified sequence opt6 from anti-influenza_CDR
cacguaagcguaagccauggcggaagaacaaaaucaaacccaagcguaauguca

SEQ ID NO: 53266 - RNA, 54 nt, Artificial Sequence
  derived and/or modified sequence opt6 from anti-influenza_CDR
gcauuaauauauuucgauggaaguaaacaauacuaugcagauucaguaaaagga

SEQ ID NO: 53267 - RNA, 54 nt, Artificial Sequence
  derived and/or modified sequence opt6 from anti-influenza_CDR
acauuaauaucauacgauggagcaaaccaauacuaugcagauagcguaaaagga

SEQ ID NO: 53268 - RNA, 54 nt, Artificial Sequence
  derived and/or modified sequence opt6 from anti-influenza_CDR
gcuguaccuggaccuguauuuggaauuuuuccuccauggucauauuuugauaau

SEQ ID NO: 53269 - RNA, 54 nt, Artificial Sequence
  derived and/or modified sequence opt6 from anti-influenza_CDR
ggaggaauaauaccaauauucggagcagcaaauuacgcacaaaaauuccaagga

SEQ ID NO: 53270 - RNA, 54 nt, Artificial Sequence
  derived and/or modified sequence opt6 from anti-influenza_CDR
ggauggauaagcgcauacacaggaaauacacauuacgcaaaaaauuucgaagga

SEQ ID NO: 53271 - RNA, 54 nt, Artificial Sequence
  derived and/or modified sequence opt6 from anti-influenza_CDR
ggauggauaaacccaaauuuuggaggaacacauuacgcaagaaaauuccaagga

SEQ ID NO: 53272 - RNA, 54 nt, Artificial Sequence
  derived and/or modified sequence opt6 from anti-influenza_CDR
guaagauggagagcggcagcaguaauaauggaucaauuuuauaaaauggaugua

SEQ ID NO: 53273 - RNA, 54 nt, Artificial Sequence
  derived and/or modified sequence opt6 from anti-influenza_CDR
gcuguuccugguccuauuuuugguauuuuuccuccuuggucuuauuuugaucau

SEQ ID NO: 53274 - RNA, 54 nt, Artificial Sequence
  derived and/or modified sequence opt6 from anti-influenza_CDR
gcagcaucaacagcaacaucaggaacauacuaugcaaugagaccauucgauuuc

SEQ ID NO: 53275 - RNA, 57 nt, Artificial Sequence
  derived and/or modified sequence opt6 from anti-influenza_CDR
gcaagaggaaaaaggccaggauauuguaguggaggaguauguaguagugauuauugg

SEQ ID NO: 53276 - RNA, 57 nt, Artificial Sequence
  derived and/or modified sequence opt6 from anti-influenza_CDR
gcccgucacuauccauauuacgaucuaccuacagguuucuauucacaauucgauuuc

SEQ ID NO: 53277 - RNA, 57 nt, Artificial Sequence
  derived and/or modified sequence opt6 from anti-influenza_CDR
ggaaguggaggguaugggggauuugauuauuuugggaaauugaggacgugggauuuu

SEQ ID NO: 53278 - RNA, 57 nt, Artificial Sequence
  derived and/or modified sequence opt6 from anti-influenza_CDR
uuuauaagaacaagaccauggggaggaacagcagauacagcagcaucaguaaaagga

SEQ ID NO: 53279 - RNA, 57 nt, Artificial Sequence
  derived and/or modified sequence opt6 from anti-influenza_CDR
uuaaauuaucaugauucagguacauauuauaaugcaccuagagguugguuugacccu

SEQ ID NO: 53280 - RNA, 57 nt, Artificial Sequence
  derived and/or modified sequence opt6 from anti-influenza_CDR
guaaaagaugguuauuguacauuaacaaguuguccuguagguugguauuuugauuua

SEQ ID NO: 53281 - RNA, 57 nt, Artificial Sequence
  derived and/or modified sequence opt6 from anti-influenza_CDR
gcuguuccugguccuauuuuugguauuuuuccuccuuggucuuauuuugaucauugg

SEQ ID NO: 53282 - RNA, 57 nt, Artificial Sequence
  derived and/or modified sequence opt6 from anti-influenza_CDR
gcaagagcaaugauacaaggaguaguaacauuauauuuaagaccaggagauuacugg

SEQ ID NO: 53283 - RNA, 57 nt, Artificial Sequence
  derived and/or modified sequence opt6 from anti-influenza_CDR
gcaaaaguaggaccguauacagguuaugaugauuauaauuauuauggaauggacgua

SEQ ID NO: 53284 - RNA, 57 nt, Artificial Sequence
  derived and/or modified sequence opt6 from anti-influenza_CDR
gcaaaaguagaaagaaguuuuuaugacggaaguggauauggagaugcauuagaaaua

SEQ ID NO: 53285 - RNA, 57 nt, Artificial Sequence
  derived and/or modified sequence opt6 from anti-influenza_CDR
uauugugcaagaggaagaguaaauaguggauaugauuggggaccgaauuuugauagu

SEQ ID NO: 53286 - RNA, 57 nt, Artificial Sequence
  derived and/or modified sequence opt6 from anti-influenza_CDR
uuuugugcaagaggaaguccaaauucaggauaugacuggggaccacauuuugauuau

SEQ ID NO: 53287 - RNA, 57 nt, Artificial Sequence
  derived and/or modified sequence opt6 from anti-influenza_CDR
agaauaaaaucaaauacagacggaggaacaacagacuaugcagcaccaguaaaagga

SEQ ID NO: 53288 - RNA, 57 nt, Artificial Sequence
  derived and/or modified sequence opt6 from anti-influenza_CDR
cuaagacuacaaggagaaguaguaguaccaccaucacaaucaaacugguucgaccca

SEQ ID NO: 53289 - RNA, 60 nt, Artificial Sequence
  derived and/or modified sequence opt6 from anti-influenza_CDR
gcgaaagagggagggaauacgauauuuggauugguaacgauggcguauuauuuugauagu

SEQ ID NO: 53290 - RNA, 60 nt, Artificial Sequence
  derived and/or modified sequence opt6 from anti-influenza_CDR
gcaagagcaggaggagauucaaguggauauuauggagcauuaggaagauuuuuucagcau

SEQ ID NO: 53291 - RNA, 60 nt, Artificial Sequence
  derived and/or modified sequence opt6 from anti-influenza_CDR
gcgaaagauagcaggggauauugcucgagcauaauauguuucgagggagggcuagauaau

SEQ ID NO: 53292 - RNA, 60 nt, Artificial Sequence
  derived and/or modified sequence opt6 from anti-influenza_CDR
gguucagguucaucugaccguucagauuacgauccacauuacuauuacuauuuagaugua

SEQ ID NO: 53293 - RNA, 60 nt, Artificial Sequence
  derived and/or modified sequence opt6 from anti-influenza_CDR
ggaacagauccagauacagaaguauauugcagaguaggaaauugugcagcauuugauuau

SEQ ID NO: 53294 - RNA, 60 nt, Artificial Sequence
  derived and/or modified sequence opt6 from anti-influenza_CDR
ggaacuucacauguaucuagauauuucgauuggcuuccaccuacaaauugguuugacccu

SEQ ID NO: 53295 - RNA, 60 nt, Artificial Sequence
  derived and/or modified sequence opt6 from anti-influenza_CDR
ggaacagauccagauacagaaggauauugcagaagcggaagcuguagcgcauucgauuuc

SEQ ID NO: 53296 - RNA, 60 nt, Artificial Sequence
  derived and/or modified sequence opt6 from anti-influenza_CDR
ggaacagauccagauacagaaguauauugcagagcaggaaauugugcagcauuugauuuu

SEQ ID NO: 53297 - RNA, 60 nt, Artificial Sequence
  derived and/or modified sequence opt6 from anti-influenza_CDR
agaggaggacauaguuuuggauauggaaguggaggagauacacauagugaauuugauagu

SEQ ID NO: 53298 - RNA, 60 nt, Artificial Sequence
  derived and/or modified sequence opt6 from anti-influenza_CDR
cauaugaguaugcaacaaguaguaagugcaggaugggaaagagcagauuuaguaggagau

SEQ ID NO: 53299 - RNA, 60 nt, Artificial Sequence
  derived and/or modified sequence opt6 from anti-influenza_CDR
gauucccgucuucguucucuucuuuauuuugaauggcuuucucaagguuauuuuaauccu

SEQ ID NO: 53300 - RNA, 60 nt, Artificial Sequence
  derived and/or modified sequence opt6 from anti-influenza_CDR
gcaagacaucuaggacaacaacuaguaagcaauacauauuacuauuacggaauggaugua

SEQ ID NO: 53301 - RNA, 63 nt, Artificial Sequence
  derived and/or modified sequence opt6 from anti-influenza_CDR
acaacaggaggaacaacaacauguacagcagcaggauguggaggaggauguuguacauguugu

SEQ ID NO: 53302 - RNA, 63 nt, Artificial Sequence
  derived and/or modified sequence opt6 from anti-influenza_CDR
gcaagagcagcagacgaaucaguagaaagccuaacaauaaaagcauucagaacaaauuaccau

SEQ ID NO: 53303 - RNA, 63 nt, Artificial Sequence
  derived and/or modified sequence opt6 from anti-influenza_CDR
gcuagaaugccauuagcaaauuacgaucuauuaacaggucuauauauaggugcauuugacuua

SEQ ID NO: 53304 - RNA, 63 nt, Artificial Sequence
  derived and/or modified sequence opt6 from anti-influenza_CDR
gacaugcuagcguacuauagcgauaacucgggaaagaaauauaacguguacgggauggaugua

SEQ ID NO: 53305 - RNA, 63 nt, Artificial Sequence
  derived and/or modified sequence opt6 from anti-influenza_CDR
gauauguuagcguauuauuaugauggaucgggaauaagauauaauuuguacgggauggaugua

SEQ ID NO: 53306 - RNA, 66 nt, Artificial Sequence
  derived and/or modified sequence opt6 from anti-influenza_CDR
gcuaaagauccccgucuccgucaccuucucuauuucccuuucacuuccaugaucuauuuugauuau

SEQ ID NO: 53307 - RNA, 66 nt, Artificial Sequence
  derived and/or modified sequence opt6 from anti-influenza_CDR
gcaaaagauagccaacuaagaagccuauuauauuucgaaugguuaagccaaggauauuucgaucca

SEQ ID NO: 53308 - RNA, 66 nt, Artificial Sequence
  derived and/or modified sequence opt6 from anti-influenza_CDR
gcaaaagauagccaacuaagaagccuauuauauuucgaaugguuaagccaaggauauuucgauuac

SEQ ID NO: 53309 - RNA, 66 nt, Artificial Sequence
  derived and/or modified sequence opt6 from anti-influenza_CDR
gcaaaagauagccaacuaagaagccuauuauauuucgaaugguuaagccaaggauauuucgaacca

SEQ ID NO: 53310 - RNA, 66 nt, Artificial Sequence
  derived and/or modified sequence opt6 from anti-influenza_CDR
gcaaaagaaagaccgcuaagacuauuaagauauuucgauugguuaagcggaggagcaaacgauuac

SEQ ID NO: 53311 - RNA, 66 nt, Artificial Sequence
  derived and/or modified sequence opt6 from anti-influenza_CDR
gcuagagauguacauaauuaugacuuucuaacuggauauccauuacacuuauacgguauggaugua

SEQ ID NO: 53312 - RNA, 66 nt, Artificial Sequence
  derived and/or modified sequence opt6 from anti-influenza_CDR
gcgagagauggaagggaaggguauuuuuaugggagugggaguuuuuauaauuuaaagggauugaau

SEQ ID NO: 53313 - RNA, 66 nt, Artificial Sequence
  derived and/or modified sequence opt6 from anti-influenza_CDR
aguacagauagaggacauguauuaagauauuuuggauggauguuaccaggagaugcauuugaugua

SEQ ID NO: 53314 - RNA, 66 nt, Artificial Sequence
  derived and/or modified sequence opt6 from anti-influenza_CDR
uuaaacuauuacgauagaucaggauaucacucaccagauggaccaagcaauaacugguucgaucca

SEQ ID NO: 53315 - RNA, 66 nt, Artificial Sequence
  derived and/or modified sequence opt6 from anti-influenza_CDR
gcaagaguaccaagagacagacuacuaacacuauauuacgaaucaucaacauacggauuugacuau

SEQ ID NO: 53316 - RNA, 66 nt, Artificial Sequence
  derived and/or modified sequence opt6 from anti-influenza_CDR
gcaagaaaauggggaagaaugacaguauucggaguagcaacagaucaauuauacuauuucgauuac

SEQ ID NO: 53317 - RNA, 66 nt, Artificial Sequence
  derived and/or modified sequence opt6 from anti-influenza_CDR
gcaacagauauaguaguagaaagagaugcaaguuuaggaggauuuaauaguuauggaauggaugua

SEQ ID NO: 53318 - RNA, 69 nt, Artificial Sequence
  derived and/or modified sequence opt6 from anti-influenza_CDR
gcaagaaacuuaccagauauagcaguaguaacagcaguacaagacgcaacaccaguaugguucgaucca

SEQ ID NO: 53319 - RNA, 69 nt, Artificial Sequence
  derived and/or modified sequence opt6 from anti-influenza_CDR
gacgguccauauucagaugacuuuagaucuggauaugcagcuagauauagauauuucgguauggaugua

SEQ ID NO: 53320 - RNA, 72 nt, Artificial Sequence
  derived and/or modified sequence opt6 from anti-influenza_CDR
ggaagagaacuauuaagauuacaacauuucuuaacagauagccaaagcgaaagaagagacuguuucgaucca

SEQ ID NO: 53321 - RNA, 72 nt, Artificial Sequence
  derived and/or modified sequence opt6 from anti-influenza_CDR
augaguuuauuaacagaaguagaaacaccaacaagaaaugaauggggauguagauguaaugacaguagugac

SEQ ID NO: 53322 - RNA, 72 nt, Artificial Sequence
  derived and/or modified sequence opt6 from anti-influenza_CDR
augucacuauuaacagaaguagaaacaccaacaaaaaacgaaugggaaugcagaugcaaugacucaagcgac

SEQ ID NO: 53323 - RNA, 72 nt, Artificial Sequence
  derived and/or modified sequence opt6 from anti-influenza_CDR
augagucuauuaacagaaguagaaacaccaauaagaaaugaaugggaaugcagauguaaugacaguagugac

SEQ ID NO: 53324 - RNA, 72 nt, Artificial Sequence
  derived and/or modified sequence opt6 from anti-influenza_CDR
augagucuauuaacagaaguagaaacaccaauaagaaacggaugggaauguaaauguaaugacaguagugac

SEQ ID NO: 53325 - RNA, 72 nt, Artificial Sequence
  derived and/or modified sequence opt6 from anti-influenza_CDR
augaguuuauuaacagaaguagaaacgccaauaagaagugaauggggauguagauguaaugauaguagugau

SEQ ID NO: 53326 - RNA, 72 nt, Artificial Sequence
  derived and/or modified sequence opt6 from anti-influenza_CDR
augaguuuuuuaccagaaguagaaacaccaauaagaaaugaauggggauguagauguaaugauaguagugac

SEQ ID NO: 53327 - RNA, 72 nt, Artificial Sequence
  derived and/or modified sequence opt6 from anti-influenza_CDR
augaguuuauuaacagaaguagaaacaccaauaagaaaugaauggggauguagauguaaugacagcaguaac

SEQ ID NO: 53328 - RNA, 72 nt, Artificial Sequence
  derived and/or modified sequence opt6 from anti-influenza_CDR
augaguuuauuaacagaaguagaaacaccaauaagaaaagaauggggauguagauguaaugacaguagugac

SEQ ID NO: 53329 - RNA, 72 nt, Artificial Sequence
  derived and/or modified sequence opt6 from anti-influenza_CDR
augaguuuuuuaacagaaguagaaacaccaauaagaaaugaauggggauguagauguaaugacaguagugac

SEQ ID NO: 53330 - RNA, 72 nt, Artificial Sequence
  derived and/or modified sequence opt6 from anti-influenza_CDR
augaguuuaccaacagaaguagaaacaccaauaagaagugaauggggauguagauguaaugacaguagugau

SEQ ID NO: 53331 - RNA, 72 nt, Artificial Sequence
  derived and/or modified sequence opt6 from anti-influenza_CDR
augaguuuauuaccagaaguagaaacaccaauaagaaaugaauggggauguagauguaaugacaguagugac

SEQ ID NO: 53332 - RNA, 72 nt, Artificial Sequence
  derived and/or modified sequence opt6 from anti-influenza_CDR
augaguuuauuaccagaaguagaaacaccaauaagaaauggauggggauguagauguaaugauaguagugac

SEQ ID NO: 53333 - RNA, 72 nt, Artificial Sequence
  derived and/or modified sequence opt6 from anti-influenza_CDR
augaguuuauuaacagaaguagaaacgccaacaagaaauggaugggaauguagauguaguggaaguagugau

SEQ ID NO: 53334 - RNA, 72 nt, Artificial Sequence
  derived and/or modified sequence opt6 from anti-influenza_CDR
augagucuauuaacagaaguagaaacaccaauaagaaaugaaugggaauacagauguaaugacagcagugac

SEQ ID NO: 53335 - RNA, 72 nt, Artificial Sequence
  derived and/or modified sequence opt6 from anti-influenza_CDR
augaguuuauuaacagaaguagaaacaccaauaagaaaugaaugggaauauagauguagugacagcagugac

SEQ ID NO: 53336 - RNA, 72 nt, Artificial Sequence
  derived and/or modified sequence opt6 from anti-influenza_CDR
augagcuuacuaacagaaguagaaacgccaacaagaaauggaugggaauguagauauagcgauagcucagac

SEQ ID NO: 53337 - RNA, 72 nt, Artificial Sequence
  derived and/or modified sequence opt6 from anti-influenza_CDR
augaguuuuuuaacggaaguggaaacguuaacgagaaauggaugggaauguagauguagugauaguagugac

SEQ ID NO: 53338 - RNA, 72 nt, Artificial Sequence
  derived and/or modified sequence opt6 from anti-influenza_CDR
augaguuuguuaacggaaguggaaacguuaacgagaaauggaugggaauguaaauguagagauaguagugac

SEQ ID NO: 53339 - RNA, 72 nt, Artificial Sequence
  derived and/or modified sequence opt6 from anti-influenza_CDR
augaguuuauuaacagaaguagaaacaccaauaagaaaugaauggggauguagauguaaugacaguagugac

SEQ ID NO: 53340 - RNA, 72 nt, Artificial Sequence
  derived and/or modified sequence opt6 from anti-influenza_CDR
augaguuuauuaacagaaguagaaacgccaauaagaagugaauggggauguagauguaaugauaguggagau

SEQ ID NO: 53341 - RNA, 72 nt, Artificial Sequence
  derived and/or modified sequence opt6 from anti-influenza_CDR
augucacuauuaacagaaguagaaacaccaauaagaaacgaaugggaaugcagaugcaauggaucaagcgau

SEQ ID NO: 53342 - RNA, 72 nt, Artificial Sequence
  derived and/or modified sequence opt6 from anti-influenza_CDR
augaguuuaccaacagaaguagaaacaccaauaagaaaugaauggggauguagauguaaugacaguagugac

SEQ ID NO: 53343 - RNA, 72 nt, Artificial Sequence
  derived and/or modified sequence opt6 from anti-influenza_CDR
augaguuuauuaacagaaguagaaacgccaauaagaaaugaauggggauguagauguaauggaaguagugau

SEQ ID NO: 53344 - RNA, 72 nt, Artificial Sequence
  derived and/or modified sequence opt6 from anti-influenza_CDR
augaguuuguuaacggaaguggauacguuaacgagaaauggauggggauguagauguagugauaguagugac

SEQ ID NO: 53345 - RNA, 72 nt, Artificial Sequence
  derived and/or modified sequence opt6 from anti-influenza_CDR
augaguuuguuaacggaaguggaaacguuaacgaaaaauggauggggauguagauguagugauaguagugac

SEQ ID NO: 53346 - RNA, 72 nt, Artificial Sequence
  derived and/or modified sequence opt6 from anti-influenza_CDR
augaguuuauuaacagaaguagaaacaccaacaagaaauggaugggaauguaaauguagugacaguagugac

SEQ ID NO: 53347 - RNA, 72 nt, Artificial Sequence
  derived and/or modified sequence opt6 from anti-influenza_CDR
augaguuuauuaacagaaguagaaacacauacaagaaacggaugggaauguaaauguagugacaguagugac

SEQ ID NO: 53348 - RNA, 72 nt, Artificial Sequence
  derived and/or modified sequence opt6 from anti-influenza_CDR
augucacuacuaacagaaguaaaaacaccaacaagaaacggaugggaaugcaaaugcucagacucaucagac

SEQ ID NO: 53349 - RNA, 72 nt, Artificial Sequence
  derived and/or modified sequence opt6 from anti-influenza_CDR
augaguuuguuaacggaaguggaaacguuaacgagaaauggauggggauguagauguagugauaguagugac

SEQ ID NO: 53350 - RNA, 72 nt, Artificial Sequence
  derived and/or modified sequence opt6 from anti-influenza_CDR
augaguuuauuaacagaaguagaaacgccaacaagagauggaugggaauguaaauguagugauaguagugac

SEQ ID NO: 53351 - RNA, 72 nt, Artificial Sequence
  derived and/or modified sequence opt6 from anti-influenza_CDR
augaguuuauuaacagaaguagaaacgccaacaagaaauggauggggauguagauguagugauaguagugac

SEQ ID NO: 53352 - RNA, 72 nt, Artificial Sequence
  derived and/or modified sequence opt6 from anti-influenza_CDR
augagucuauuaacagaaguagaaacaccaacaagaaacggaugggaauguaaauguaaugacaguagugac

SEQ ID NO: 53353 - RNA, 72 nt, Artificial Sequence
  derived and/or modified sequence opt6 from anti-influenza_CDR
augaguuuguuaacggaaguggaaacguuaacgagaaauggaugggaauguaaauguagugauaguagugac

SEQ ID NO: 53354 - RNA, 72 nt, Artificial Sequence
  derived and/or modified sequence opt6 from anti-influenza_CDR
augucacuauuaacagaaguagaaacaccaauaagaaacgaauggggaugcaaaugcaaugacucaagcgac

SEQ ID NO: 53355 - RNA, 72 nt, Artificial Sequence
  derived and/or modified sequence opt6 from anti-influenza_CDR
augaguuuuuuaacagaaguagaaacgccaauaagaaaugaauggggauguagauguaauggaaguagugau

SEQ ID NO: 53356 - RNA, 72 nt, Artificial Sequence
  derived and/or modified sequence opt6 from anti-influenza_CDR
augaguuuauuaacagaaguagaaacgccaacaagaaauggaugggaauguagauguaaugauaguagugac

SEQ ID NO: 53357 - RNA, 72 nt, Artificial Sequence
  derived and/or modified sequence opt6 from anti-influenza_CDR
augucacuauuaacagaaguagaaacaccaauaagaaaaggaugggaaugcaauugcucagacucaagcgac

SEQ ID NO: 53358 - RNA, 72 nt, Artificial Sequence
  derived and/or modified sequence opt6 from anti-influenza_CDR
augucacuauuaacagaaguagaaacaccaacaagaaacgaaugggaaugcagaugcucagacucaagcgac

SEQ ID NO: 53359 - RNA, 72 nt, Artificial Sequence
  derived and/or modified sequence opt6 from anti-influenza_CDR
augaguuuguuaacgggaguggaaacgcauacgagaaauggauggggauguaaauguagugauaguagugac

SEQ ID NO: 53360 - RNA, 72 nt, Artificial Sequence
  derived and/or modified sequence opt6 from anti-influenza_CDR
augaguuuauuaccggaaguagaaacacauacaagaaauggauggggauguagauguagugauaguagugac

SEQ ID NO: 53361 - RNA, 72 nt, Artificial Sequence
  derived and/or modified sequence opt6 from anti-influenza_CDR
acugacgguccauauucagaugacuuuagaucuggauaugcagcuagauauagauauuucgguauggaugua

SEQ ID NO: 53362 - RNA, 75 nt, Artificial Sequence
  derived and/or modified sequence opt6 from anti-influenza_CDR
gcaaaacauaugaguuuacaacaaguaguaagugcaggaugggaaagagcagauuuaguaggagaugcauuugau

SEQ ID NO: 53363 - RNA, 75 nt, Artificial Sequence
  derived and/or modified sequence opt6 from anti-influenza_CDR
gcaaaacauuuaaguaugcaacaaguaguaagugcaggaugggaaagagcagauuuaguaggagaugcauuugau

SEQ ID NO: 53364 - RNA, 75 nt, Artificial Sequence
  derived and/or modified sequence opt6 from anti-influenza_CDR
gcaaaacaugcaaguuuacaacaaguaguaagugcaggaugggaaagagcagauuuaguaggagaugcauuugau

SEQ ID NO: 53365 - RNA, 75 nt, Artificial Sequence
  derived and/or modified sequence opt6 from anti-influenza_CDR
gcaaaacauaguaguuuacaacaaguaguaagugcaggaugggaaagagcagauuuaguaggagaugcauuugau

SEQ ID NO: 53366 - RNA, 75 nt, Artificial Sequence
  derived and/or modified sequence opt6 from anti-influenza_CDR
gcaaaacauuuaaguuuacaacaaguaguaagugcaggaugggaaagagcagauuuaguaggagaugcauuugau

SEQ ID NO: 53367 - RNA, 75 nt, Artificial Sequence
  derived and/or modified sequence opt6 from anti-influenza_CDR
gcaaaacauaugaguaugcaacaaguaguaagugcaggaugggaaagagcagauuuaguaggagaugcauuugau

SEQ ID NO: 53368 - RNA, 75 nt, Artificial Sequence
  derived and/or modified sequence opt6 from anti-influenza_CDR
gcaagaggaccagaaacauacuacuacgacaaaacaaacuggcuaaacucacacccagacgaauacuuccaacac

SEQ ID NO: 53369 - RNA, 75 nt, Artificial Sequence
  derived and/or modified sequence opt6 from anti-influenza_CDR
acaacugacgguccauauagcgaugacuuuagaucuggauaugcagcuagauauagauauuucgguauggaugua

SEQ ID NO: 53370 - RNA, 75 nt, Artificial Sequence
  derived and/or modified sequence opt6 from anti-influenza_CDR
acugacgguccauauagugaugacuuuagaucuggauaugcagcuagauauagauauuucgguauggauguaugg

SEQ ID NO: 53371 - RNA, 78 nt, Artificial Sequence
  derived and/or modified sequence opt6 from anti-influenza_CDR
gauauacaaaugacacaaucaccaagcucauuaagcgcaagcguaggagauagaguaacaauaacauguagaucaagc

SEQ ID NO: 53372 - RNA, 78 nt, Artificial Sequence
  derived and/or modified sequence opt6 from anti-influenza_CDR
gcaacaggaagagcagcaacaggaucagcaucauguacaggaggaggaacauauuggacauauuguacauguacaaca

SEQ ID NO: 53373 - RNA, 81 nt, Artificial Sequence
  derived and/or modified sequence opt6 from anti-influenza_CDR
ggauacauaccagaagcaccaagagauggacaagcauauguaagaaaagauggagaauggguacuauuaagcacauucuua

SEQ ID NO: 53374 - RNA, 90 nt, Artificial Sequence
  derived and/or modified sequence opt6 from anti-influenza_CDR
caaguacaauuacuagaaacaggaggaggauuaguaaaaccaggacaaagccuaaaauuaagcugugcagcaagcggauucacauucaca

SEQ ID NO: 53375 - RNA, 96 nt, Artificial Sequence
  derived and/or modified sequence opt6 from anti-influenza_CDR
agauucacaauaucaagagacaacucaaaaaacacacuauaccuacaaaugaacucacuaagagcagaagacacagcaguauacuacugcgcaaaa

SEQ ID NO: 53376 - RNA, 96 nt, Artificial Sequence
  derived and/or modified sequence opt6 from anti-influenza_CDR
ggaguaccaucaagauuuagcggaagcggaagcggaacagauuucacacuaacaauaagcucauuacaaccagaagauuucgcaacauauuacugu

SEQ ID NO: 53377 - RNA, 15 nt, Artificial Sequence
  derived and/or modified sequence opt6 from anti-OX40_HeavyChain_CDR1
agcuauagcaugaac

SEQ ID NO: 53378 - RNA, 15 nt, Artificial Sequence
  derived and/or modified sequence opt6 from anti-OX40_HeavyChain_CDR1
gauuacgcuaugcau

SEQ ID NO: 53379 - RNA, 15 nt, Artificial Sequence
  derived and/or modified sequence opt6 from anti-OX40_HeavyChain_CDR1
gacucauauaugucu

SEQ ID NO: 53380 - RNA, 15 nt, Artificial Sequence
  derived and/or modified sequence opt6 from anti-OX40_HeavyChain_CDR1
gacgcguauaugagu

SEQ ID NO: 53381 - RNA, 15 nt, Artificial Sequence
  derived and/or modified sequence opt6 from anti-OX40_HeavyChain_CDR1
gagucauauauguca

SEQ ID NO: 53382 - RNA, 15 nt, Artificial Sequence
  derived and/or modified sequence opt6 from anti-OX40_HeavyChain_CDR1
aguggguauuggaau

SEQ ID NO: 53383 - RNA, 21 nt, Artificial Sequence
  derived and/or modified sequence opt6 from anti-OX40_LightChain_CDR2
uauaccucccgccuucacucu

SEQ ID NO: 53384 - RNA, 21 nt, Artificial Sequence
  derived and/or modified sequence opt6 from anti-OX40_LightChain_CDR2
gccgccucuucacuucaaucu

SEQ ID NO: 53385 - RNA, 21 nt, Artificial Sequence
  derived and/or modified sequence opt6 from anti-OX40_LightChain_CDR2
gacgcaagcaauagagcgaca

SEQ ID NO: 53386 - RNA, 21 nt, Artificial Sequence
  derived and/or modified sequence opt6 from anti-OX40_LightChain_CDR2
uauaccucucgacuucgcucu

SEQ ID NO: 53387 - RNA, 24 nt, Artificial Sequence
  derived and/or modified sequence opt6 from anti-OX40_LightChain_CDR3
caacaaagaucaaacuggccaaca

SEQ ID NO: 53388 - RNA, 24 nt, Artificial Sequence
  derived and/or modified sequence opt6 from anti-OX40_HeavyChain_CDR3
gcuccucguugguauuuuucuguu

SEQ ID NO: 53389 - RNA, 24 nt, Artificial Sequence
  derived and/or modified sequence opt6 from anti-OX40_HeavyChain_CDR3
gcuccucguugguauuuuucugcu

SEQ ID NO: 53390 - RNA, 24 nt, Artificial Sequence
  derived and/or modified sequence opt6 from anti-OX40_HeavyChain_CDR3
gcgccaagaugguauuuugcagua

SEQ ID NO: 53391 - RNA, 27 nt, Artificial Sequence
  derived and/or modified sequence opt6 from anti-OX40_LightChain_CDR3
caacaaggaaauacauuaccauggaca

SEQ ID NO: 53392 - RNA, 27 nt, Artificial Sequence
  derived and/or modified sequence opt6 from anti-OX40_HeavyChain_CDR3
gagucggguugguauuuguuugauuau

SEQ ID NO: 53393 - RNA, 27 nt, Artificial Sequence
  derived and/or modified sequence opt6 from anti-OX40_LightChain_CDR3
caacaauacaacuccuacccccccacc

SEQ ID NO: 53394 - RNA, 27 nt, Artificial Sequence
  derived and/or modified sequence opt6 from anti-OX40_LightChain_CDR3
caacaaggccacacacuaccaccaaca

SEQ ID NO: 53395 - RNA, 27 nt, Artificial Sequence
  derived and/or modified sequence opt6 from anti-OX40_LightChain_CDR3
caacaaggccauacauuaccagcaaca

SEQ ID NO: 53396 - RNA, 27 nt, Artificial Sequence
  derived and/or modified sequence opt6 from anti-OX40_LightChain_CDR3
caacaaggccauacagcaccaccaaca

SEQ ID NO: 53397 - RNA, 27 nt, Artificial Sequence
  derived and/or modified sequence opt6 from anti-OX40_LightChain_CDR3
caacaaggcgcaacacuaccaccaaca

SEQ ID NO: 53398 - RNA, 27 nt, Artificial Sequence
  derived and/or modified sequence opt6 from anti-OX40_LightChain_CDR3
caacaaggacacgcacuaccaccaaca

SEQ ID NO: 53399 - RNA, 27 nt, Artificial Sequence
  derived and/or modified sequence opt6 from anti-OX40_LightChain_CDR3
caacaagcccacacacucccacccaca

SEQ ID NO: 53400 - RNA, 27 nt, Artificial Sequence
  derived and/or modified sequence opt6 from anti-OX40_LightChain_CDR3
caacaaggacacacacuagcaccaaca

SEQ ID NO: 53401 - RNA, 27 nt, Artificial Sequence
  derived and/or modified sequence opt6 from anti-OX40_LightChain_CDR3
caagccggccauacauuaccaccaaca

SEQ ID NO: 53402 - RNA, 30 nt, Artificial Sequence
  derived and/or modified sequence opt6 from anti-OX40_HeavyChain_CDR1
ggauauacauuuacaucuuacguuaugcau

SEQ ID NO: 53403 - RNA, 30 nt, Artificial Sequence
  derived and/or modified sequence opt6 from anti-OX40_HeavyChain_CDR3
uauuacggcucaucuuuaucuauggauuau

SEQ ID NO: 53404 - RNA, 33 nt, Artificial Sequence
  derived and/or modified sequence opt6 from anti-OX40_LightChain_CDR1
cgcgcaucucaagacauaucuaacuaccuaaau

SEQ ID NO: 53405 - RNA, 33 nt, Artificial Sequence
  derived and/or modified sequence opt6 from anti-OX40_LightChain_CDR1
agggcaagucaaggaauaaguaguugguuagca

SEQ ID NO: 53406 - RNA, 33 nt, Artificial Sequence
  derived and/or modified sequence opt6 from anti-OX40_LightChain_CDR1
cgugcaucucaaucuguaucuucauauuuagcc

SEQ ID NO: 53407 - RNA, 39 nt, Artificial Sequence
  derived and/or modified sequence opt6 from anti-OX40_HeavyChain_CDR3
uauagguaugauuaugauggugggcaugcgauggauuau

SEQ ID NO: 53408 - RNA, 39 nt, Artificial Sequence
  derived and/or modified sequence opt6 from anti-OX40_HeavyChain_CDR3
uauaaauaugauuaugaugccggacaugcaauggacuau

SEQ ID NO: 53409 - RNA, 39 nt, Artificial Sequence
  derived and/or modified sequence opt6 from anti-OX40_HeavyChain_CDR3
uauaaguaugauuaugauggcgggcaugcgauggauuau

SEQ ID NO: 53410 - RNA, 45 nt, Artificial Sequence
  derived and/or modified sequence opt6 from anti-OX40_HeavyChain_CDR3
gaucaaucgacugcagauuauuauuuuuauuauggcauggacgua

SEQ ID NO: 53411 - RNA, 48 nt, Artificial Sequence
  derived and/or modified sequence opt6 from anti-OX40_HeavyChain_CDR2
uacauauccuacaacggcaucacauaccacaacccaucccucaaauca

SEQ ID NO: 53412 - RNA, 48 nt, Artificial Sequence
  derived and/or modified sequence opt6 from anti-OX40_HeavyChain_CDR2
uacauauccuacaacgccaucacauaccacaacccaucccucaaauca

SEQ ID NO: 53413 - RNA, 48 nt, Artificial Sequence
  derived and/or modified sequence opt6 from anti-OX40_HeavyChain_CDR2
uacauauccuacuccggcaucacauaccacaaccccucccucaaauca

SEQ ID NO: 53414 - RNA, 51 nt, Artificial Sequence
  derived and/or modified sequence opt6 from anti-OX40_HeavyChain_CDR2
uauauaaauccauauaacgacggaacaaaauauaacgaaaaauucaaaggc

SEQ ID NO: 53415 - RNA, 51 nt, Artificial Sequence
  derived and/or modified sequence opt6 from anti-OX40_HeavyChain_CDR2
uauauaucuucaucuucaucuacaauugacuaugcagauucaguuaaaggu

SEQ ID NO: 53416 - RNA, 51 nt, Artificial Sequence
  derived and/or modified sequence opt6 from anti-OX40_HeavyChain_CDR2
ggaauaaguuggaauaguggaaguauaggguaugcggauaguguaaaggga

SEQ ID NO: 53417 - RNA, 51 nt, Artificial Sequence
  derived and/or modified sequence opt6 from anti-OX40_HeavyChain_CDR2
gauauguauccagauaacggugacucaagcuauaaccaaaaauuuagagaa

SEQ ID NO: 53418 - RNA, 51 nt, Artificial Sequence
  derived and/or modified sequence opt6 from anti-OX40_HeavyChain_CDR2
gauauguauccagauaacgcugacucaagcuauaaccaaaaauuuagagaa

SEQ ID NO: 53419 - RNA, 51 nt, Artificial Sequence
  derived and/or modified sequence opt6 from anti-OX40_HeavyChain_CDR2
gauauguauccagauaacgcagacgcaagcuauaaccaaaaauuuagagaa

SEQ ID NO: 53420 - RNA, 51 nt, Artificial Sequence
  derived and/or modified sequence opt6 from anti-OX40_HeavyChain_CDR2
gauauguauccagauaacggagacgcaagcuauaaccaaaaauuuagagaa

SEQ ID NO: 53421 - RNA, 51 nt, Artificial Sequence
  derived and/or modified sequence opt6 from anti-OX40_HeavyChain_CDR2
gauauguauccagauagcggugacucaagcuauaaccaaaaauuuagagaa

SEQ ID NO: 53422 - RNA, 51 nt, Artificial Sequence
  derived and/or modified sequence opt6 from anti-OX40_HeavyChain_CDR2
gauauguauccagauaacgguagcucaagcuauaaccaaaaauuuagagaa

SEQ ID NO: 53423 - RNA, 309 nt, Artificial Sequence
  derived and/or modified sequence opt6 from Ig_LightChain_kappa_constant_domain
acaguagcagcaccaucaguauucauauucccaccaucagacgaacaacuaaaaucaggaacagcaucaguaguaugccuacuaaacaacuucuacccaagagaagcaaaaguacaauggaaaguagacaacgcacuacaaucaggaaacucacaagaaucaguaacagaacaagacucaaaagacucaacauacucacuaucaucaacacuaacacuaucaaaagcagacuacgaaaaacacaaaguauacgcaugcgaaguaacacaccaaggacuauccucaccaguaacaaaaucauucaacaga

SEQ ID NO: 53424 - RNA, 309 nt, Artificial Sequence
  derived and/or modified sequence opt6 from Ig_LightChain_kappa_constant_domain
acaguagcagcaccaucaguauucauauucccaccaucagacgaacaacuaaaaucaggaacagcaucaguaguaugccuacuaaacaacuucuacccaagagaagcaaaaguacaauggaaaguagacaacgcacuacaaucaggaaacucacaagaaucaguaacagaacaagacucaaaagacucaacauacucacuaucaaacacacuaacacuaucaaaagcagacuacgaaaaacacaaaguauacgcaugcgaaguaacacaccaaggacuaucaucaccaguaacaaaaucauucaacaga

SEQ ID NO: 53425 - RNA, 312 nt, Artificial Sequence
  derived and/or modified sequence opt6 from Ig_LightChain_lambda_constant_domain
ccaaaagcagcaccaucaguaacacuauucccaccaucaucagaagaacuacaagcaaacaaagcaacauuaguaugccuaauaucagacuucuacccaggagccguaacaguagcauggaaagcagacucaucaccaguaaaagcaggaguagaaacaacaacaccaucaaaacaaucaaacaacaaauacgcagcaucaucauacuuaucacuaacaccagaacaauggaaaucacacagaucauacucaugccaaguaacacacgaaggaucaacaguagaaaaaacaguagcaccaacagaaugcuca

SEQ ID NO: 53426 - RNA, 312 nt, Artificial Sequence
  derived and/or modified sequence opt6 from Ig_LightChain_lambda_constant_domain
ccaaaagcagcaccaucaguaacacuauucccaccaucaucagaagaacuacaagcaaacaaagcaacacuaguaugccuaauaucagacuucuacccaggagcaguaacaguagcauggaaagcagacucaucaccaguaaaagcaggaguagaaacaacaacaccaucaaaacaaucaaacaacaaauacgcagcaucaucauaccuaucacuaacaccagaacaauggaaaucacacagaucauacucaugccaaguaacacacgaaggaucaacaguagaaaaaacaguagcaccagcagaaugcuca

SEQ ID NO: 53427 - RNA, 312 nt, Artificial Sequence
  derived and/or modified sequence opt6 from Ig_LightChain_lambda_constant_domain
ccaaaagcagcaccaucaguaacacuauucccaccaucaucagaagaacuacaagcaaacaaagcaacacuaguaugccuaauaucagacuucuacccaggagcaguaacaguagcauggaaagcagacucaucaccaguaaaagcaggaguagaaacaacaacaccaucaaaacaaucaaacaacaaauacgcagcaucaucauaccuaucacuaacaccagaacaauggaaaucacacaaaucauacagcugccaaguaacacacgaaggaucaacaguagaaaaaacaguagcaccaacagaaugcuca

SEQ ID NO: 53428 - RNA, 312 nt, Artificial Sequence
  derived and/or modified sequence opt6 from Ig_LightChain_lambda_constant_domain
ccaaaagcagcaccaucaguaacacuauucccaccaucaucagaagaacuacaagcaaacaaagcaacacuaguaugccuaauaucagacuucuacccaggcgcaguaacaguagcauggaaagcagacucaucaccaguaaaagcaggaguagaaacaacaacaccaucaaaacaaucaaacaacaaauacgcagcaucaucauaccuaucacuaacaccagaacaauggaaaucacacaaaucauacucaugccaaguaacacacgaaggaucaacaguagaaaaaacaguagcaccagcagaaugcuca

SEQ ID NO: 53429 - RNA, 282 nt, Artificial Sequence
  derived and/or modified sequence opt6 from IgG1_HeavyChain_CH1_constant_domain
ucagcaucaacaaaaggaccaucaguauucccacuagcaccaucaucaaaaucaacaucaggaggaacagcagcacuaggaugccuaguaaaagacuacuucccagaaccaguaacaguaucauggaacucaggaguacacacauucccagcaguacuacaaucaucaggacuauacucacuaucaucaguaguaacaguaccaucaucaucacuaggaacacaaacauacauaugcaacguaaaccacaaaccaucaaacacaaaaguagacaaaaaagua

SEQ ID NO: 53430 - RNA, 270 nt, Artificial Sequence
  derived and/or modified sequence opt6 from IgG1_HeavyChain_CH1_constant_domain
ucaggaccaucaguauucccacuagcaccaucaucaaaaucaacaucaggaggaacagcagcacuaggaugccuaguaaaagacuacuucccagaaccaguaacaguaucauggaacucaggaguacacacauucccagcaguacuacaaucaucaggacuauacucacuaucaucaguaguaacaguaccaucaucaucacuaggaacacaaacauacauaugcaacguaaaccacaaaccaucaaacacaaaaguagacaaaaaagua

SEQ ID NO: 53431 - RNA, 270 nt, Artificial Sequence
  derived and/or modified sequence opt6 from IgG1_HeavyChain_CH1_constant_domain
ucaggaccaucaguauucccacuagcaccaucaucaaaaucaacaucaggaggaacagcagcacuaggaugccuaguaaaagacuacuucccagaaccaguaacaguaucauggaacucaggaguacacacauucccagcaguacuacaaucaucaggacuauacucacuaucaucaguaguaacaguaccaucaucaucacuaggaacacaaacauacauaugcaacguaaaccacaaaccaucaaacacaaaaguagacaaaaaagca

SEQ ID NO: 53432 - RNA, 270 nt, Artificial Sequence
  derived and/or modified sequence opt6 from IgG1_HeavyChain_CH1_constant_domain
ucaggaccaucaguauucccacuagcaccaucaucaaaaucaacaucaggaggaacagcagcacuaggaugccuaguaaaagacuacuucccagaaccaguaacaguaucauggaacucaggaguacacacauucccagcaguacuacaaucaucaggacuauacucacuaucaucaguaguaacaguaccaucaucaucacuaggaacacaaacauacauaugcaacguaaaccacaaaccaucaaacacaaaaguagacaaaagagua

SEQ ID NO: 53433 - RNA, 270 nt, Artificial Sequence
  derived and/or modified sequence opt6 from IgG1_HeavyChain_CH1_constant_domain
ucaggaccaucaguauucccacuagcaccaucaucaaaaucaacaucaggaggaacagcagcacuaggaugccuaguaaaagacuacuucccagaaccaguaacaguaucauggaacucaggaguacacacauucccagcaguacuacaaucaucaggacuauacucacuaucaucaguaguaacaguaccaucaucaucacuaggaacacaaacauacauaugcaacguaaaccacaaaccaucaaacacaaaaguagacaaaagagca

SEQ ID NO: 53434 - RNA, 270 nt, Artificial Sequence
  derived and/or modified sequence opt6 from IgG1_HeavyChain_CH1_constant_domain
ucaggaccaucaguacuaccacuagcaccaucaucaaaaucaacaucaggaggaacagcagcacuaggaugcuuaguaaaagacuacuucccagaaccaguaacaguaucauggaacucaggaguccacacauucccagcaguacuacaaucaucaggacuauacucacuaucaucaguaguaacaguaccaucaucaucacuaggaacacaaacauacauaugcaacguaaaccacaaaccaucaaacacaaaaguagacaaaaaagua

SEQ ID NO: 53435 - RNA, 270 nt, Artificial Sequence
  derived and/or modified sequence opt6 from IgG1_HeavyChain_CH1_constant_domain
ucaggaccaucaguacuaccacuagcaccaucaucaaaaucaacaucaggaggaacagcagcacuaggaugccuaguaaaagacuacuucccagaaccaguaacaguaucauggaacucaggaguacacacauucccagcaguauuacaaucaucaggacuauacucacuaucaucaguaguaacaguaccauccucaucacuaggaacacaaacauacauaugcaacguaaaccacaaaccaucaaacacaaaaguagacaaaaaagca

SEQ ID NO: 53436 - RNA, 270 nt, Artificial Sequence
  derived and/or modified sequence opt6 from IgG1_HeavyChain_CH1_constant_domain
ucaggaccaucaguacuaccacuagcaccaucaucaaaaucaacaucaggaggaacagcagcacuaggaugccuaguaaaagacuacuucccagaaccaguaacaguaucauggaacucaggaguacacacauucccagcaguacuacaaucaucaggacuauacucacuaucaucaguaguaacaguaccaucaucaucacuaggaacacaaacauacauaugcaacguaaaccacaaaccaucaaacacaaaaguagacaaaagagua

SEQ ID NO: 53437 - RNA, 270 nt, Artificial Sequence
  derived and/or modified sequence opt6 from IgG1_HeavyChain_CH1_constant_domain
ucuggaccuucaguucuaccucuagcuccaucuucaaaaucaacuucagguggaacugcagcucuagguugccuuguaaaagacuauuucccugaaccuguaacuguaucuuggaacucagguguacauacauuuccagcuguacuucaaucuucaggucuauauucacuuucaucuguaguuacaguuccaucuucaucucuagguacacaaacauauauauguaauguuaaccauaaaccuucaaauacaaaaguagauaaacgugca

SEQ ID NO: 53438 - RNA, 282 nt, Artificial Sequence
  derived and/or modified sequence opt6 from IgG1_HeavyChain_CH1_constant_domain
ucagcaucaacaaaaggaccaucaguauucccacuagcaccaucaucaaaaucaacaucaggaggaacagcagcacuaggaugccuaguaaaagacuacuucccagaaccaguaacaguaucauggaacucaggaguacacacauucccagcaguacuacaaucaucaggacuauacucacuaucaucaguaguaacaguaccaucaucaucacuaggaacacaaacauacauaugcaacguaaaccacaaaccaucaaacacaaaaguagacaaaaaagca

SEQ ID NO: 53439 - RNA, 282 nt, Artificial Sequence
  derived and/or modified sequence opt6 from IgG1_HeavyChain_CH1_constant_domain
ucagcaucaacaaaaggaccaucaguauucccacuagcaccaucaucaaaaucaacaucaggaggaacagcagcacuaggaugccuaguaaaagacuacuucccagaaccaguaacaguaucauggaacucaggaguacacacauucccagcaguacuacaaucaucaggacuauacucacuaucaucaguaguaacaguaccaucaucaucacuaggaacacaaacauacauaugcaacguaaaccacaaaccaucaaacacaaaaguagacaaaagagua

SEQ ID NO: 53440 - RNA, 282 nt, Artificial Sequence
  derived and/or modified sequence opt6 from IgG1_HeavyChain_CH1_constant_domain
ucagcaucaacaaaaggaccaucaguauucccacuagcaccaucaucaaaaucaacaucaggaggaacagcagcacuaggaugccuaguaaaagacuacuucccagaaccaguaacaguaucauggaacucaggaguacacacauucccagcaguacuacaaucaucaggacuauacucacuaucaucaguaguaacaguaccaucaucaucacuaggaacacaaacauacauaugcaacguaaaccacaaaccaucaaacacaaaaguagacaaaagagca

SEQ ID NO: 53441 - RNA, 282 nt, Artificial Sequence
  derived and/or modified sequence opt6 from IgG1_HeavyChain_CH1_constant_domain
ucagcaucaacaaaaggaccaucaguacuaccauuagcaccaucaucaaaaucaacaucaggaggaacagcagcacuaggaugccuaguaaaagacuacuucccagaaccaguaacaguaucauggaacucaggaguacacacauucccagcaguacuacaaucaucaggacuauacucacuaucaucaguaguaacaguaccaucaucaucacuaggaacacaaacauacauaugcaacguaaaccacaaaccaucaaacacaaaaguagacaaaaaagua

SEQ ID NO: 53442 - RNA, 282 nt, Artificial Sequence
  derived and/or modified sequence opt6 from IgG1_HeavyChain_CH1_constant_domain
ucagcaucaacaaaaggaccaucaguacuaccacuagcaccaucaucaaaaucaacaucaggaggaacagcagcacuaggaugccuaguaaaagacuacuucccagaaccaguaacaguaucauggaacucaggaguacacacauucccagccguacuacaaucaucaggacuauacucacuaucaucaguaguaacaguaccaucaucaucacuaggaacacaaacauacauaugcaacguaaaccacaaaccaucaaacacaaaaguagacaaaaaagca

SEQ ID NO: 53443 - RNA, 282 nt, Artificial Sequence
  derived and/or modified sequence opt6 from IgG1_HeavyChain_CH1_constant_domain
ucagcaucaacaaaaggaccaucaguacuaccacuagcaccaucaucaaaaucaacaucaggaggaacagcagcacuaggaugccuaguaaaagacuacuucccagaaccaguaacaguaucauggaacucaggaguacacacauucccagcaguacuacaaucaucaggacuauacucacuaucaucaguaguaacaguaccaucaucaucacuaggaacacaaacauacauaugcaacguaaaccacaaaccaucaaacacaaaaguagacaaaagagua

SEQ ID NO: 53444 - RNA, 282 nt, Artificial Sequence
  derived and/or modified sequence opt6 from IgG1_HeavyChain_CH1_constant_domain
ucagcaucaacaaaaggaccaucaguacuaccauuagcaccaucaucaaaaucaacaucaggaggaacagcagcacuaggaugccuaguaaaagacuacuucccagaaccaguaacaguaucauggaacucaggaguacacacauucccagcaguacuacaaucaucaggacuauacucacuaucaucaguaguaacaguaccaucaucaucacuaggaacacaaacauacauaugcaacguaaaccacaaaccaucaaacacaaaaguagacaaaagagca

SEQ ID NO: 53445 - RNA, 330 nt, Artificial Sequence
  derived and/or modified sequence opt6 from IgG1_HeavyChain_CH2_constant_domain
gcaccagaauuacuaggaggaccaucaguauuccuauucccaccaaaaccaaaagacacacuaaugauaucaagaacaccagaaguaacaugcguaguaguagacguaucacacgaagacccagaaguaaaauucaacugguacguagacggaguagaaguacacaacgcaaaaacaaaaccaagagaagaacaauacaacucaacauacagaguaguaucaguacuaacaguacuacaccaagacuggcuaaacggaaaagaauacaaaugcaaaguaucaaacaaagcacuaccagcaccaauagaaaaaacaauaagcaaagcaaaa

SEQ ID NO: 53446 - RNA, 330 nt, Artificial Sequence
  derived and/or modified sequence opt6 from IgG1_HeavyChain_CH2_constant_domain
gcaccagaacuacuaggaggaccaucaguauuccuauucccaccaaaaccaaaagacacacuaaugauaucaagaacaccagaaguaacaugcguaguaguagacguaucacacgaagacccagaaguaaaauucaacguauacguagacggaguagaaguacacaacgcaaaaacaaaaccaagagaagaacaauacaacucaacauacagaguaguaucaguacuaacaguauuacaccaagacuggcuaaacggaaaagaauacaaaugcaaaguaucaaacaaagcacuaccagcaccaauagaaaaaacaauaucaaaagcaaaa

SEQ ID NO: 53447 - RNA, 330 nt, Artificial Sequence
  derived and/or modified sequence opt6 from IgG1_HeavyChain_CH2_constant_domain
gcaccagaacuacuaggaggaccaucaguauuccuauucccaccaaaaccaaaagacacacuaaugauaucaagaacaccagaaguaacaugcguaguaguagacguaucacacgaagacccagaaguaaaauucaacguauacguagacggaguagaaguacacaacgcaaaaacaaaaccaagagaagaacaauacgcaucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53448 - RNA, 330 nt, Artificial Sequence
  derived and/or modified sequence opt6 from IgG1_HeavyChain_CH2_constant_domain
gcaccagaacuacuaggaggaccaucaguauuccuauucccaccaaaaccaaaagacacacuaaugauaucaagaacaccagaaguaacaugcguaguaguagacguaucacacgaagacccagaaguaaaauucaacugguacguagacggaguagaaguacacaacgcaaaaacaaaaccaagagaagaacaauacgcaucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53449 - RNA, 330 nt, Artificial Sequence
  derived and/or modified sequence opt6 from IgG1_HeavyChain_CH2_constant_domain
gcaccagaacuacuaggagcaccaucaguauuccuauucccaccaaaaccaaaagacacacuaaugauaucaagaacaccagaaguaacaugcguaguaguagacguaucacacgaagacccagaaguaaaauucaacguauacguagacggaguagaaguacacaacgcaaaaacaaaaccaagagaagaacaauacaacucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53450 - RNA, 330 nt, Artificial Sequence
  derived and/or modified sequence opt6 from IgG1_HeavyChain_CH2_constant_domain
gcaccagaacuacuaggagcaccaucaguauuccuauucccaccaaaaccaaaagacacacuaaugauaucaagaacaccagaaguaacaugcguaguaguagacguaucacacgaagacccagaaguaaaauucaacguauacguagacggaguagaaguacacaacgcaaaaacaaaaccaagagaagaacaauacgcaucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53451 - RNA, 330 nt, Artificial Sequence
  derived and/or modified sequence opt6 from IgG1_HeavyChain_CH2_constant_domain
gcaccagaacuacuaggagcaccaucaguauuccuauucccaccaaaaccaaaagacacacuaaugauaucaagaacaccagaaguaacaugcguaguaguagacguaucacacgaagacccagaaguaaaauucaacugguacguagacggaguagaaguacacaacgcaaaaacaaaaccaagagaagaacaauacaacucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53452 - RNA, 330 nt, Artificial Sequence
  derived and/or modified sequence opt6 from IgG1_HeavyChain_CH2_constant_domain
gcaccagaacuacuaggagcaccaucaguauuccuauucccaccaaaaccaaaagacacacuaaugauaucaagaacaccagaaguaacaugcguaguaguagacguaucacacgaagacccagaaguaaaauucaacugguacguagacggaguagaaguacacaacgcaaaaacaaaaccaagagaagaacaauacgcaucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53453 - RNA, 330 nt, Artificial Sequence
  derived and/or modified sequence opt6 from IgG1_HeavyChain_CH2_constant_domain
gcaccagaacuagcaggaggaccaucaguauuccuauucccaccaaaaccaaaagacacacuaaugauaagcagaacaccagaaguaacaugcguaguaguagacguaucacacgaagacccagaaguaaaauucaacguauacguagacggaguagaaguacacaacgcaaaaacaaaaccaagagaagaacaauacaacucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53454 - RNA, 330 nt, Artificial Sequence
  derived and/or modified sequence opt6 from IgG1_HeavyChain_CH2_constant_domain
gcaccagaacuagcaggaggaccaucaguauuccuauucccaccaaaaccaaaagacacauuaaugauaucaagaacaccagaaguaacaugcguaguaguagacguaucacacgaagacccagaaguaaaauucaacguauacguagacggaguagaaguacacaacgcaaaaacaaaaccaagagaagaacaauacgcaucaacauacagaguaguaucaguacuaacaguacuacaccaagacugguuaaacggaaaagaauacaaaugcaaaguaucaaacaaagcacuaccagcaccaauagaaaaaacaauaucaaaagcaaaa

SEQ ID NO: 53455 - RNA, 330 nt, Artificial Sequence
  derived and/or modified sequence opt6 from IgG1_HeavyChain_CH2_constant_domain
gcaccagaacuagcaggaggaccaucaguauuccuauucccaccaaaaccaaaagacacacuaaugauaucaagaacaccagaaguaacaugcguaguaguagacguaucacacgaagacccagaaguaaaauucaacugguacguagacggaguagaaguacacaacgcaaaaacaaaaccaagagaagaacaauacaacucaacauacagaguaguaucaguacuaacaguccuacaccaagacuggcuaaacggaaaagaauacaaaugcaaaguaucaaacaaagcacuaccagcaccaauagaaaaaacaauaucaaaagcaaaa

SEQ ID NO: 53456 - RNA, 330 nt, Artificial Sequence
  derived and/or modified sequence opt6 from IgG1_HeavyChain_CH2_constant_domain
gcaccagaacuagcaggaggaccaucaguauuccuauucccaccaaaaccaaaagacacacuaaugauaucaagaacaccagaaguaacaugcguaguaguagacguaucacacgaagacccagaaguaaaauucaacugguacguagacggaguagaaguacacaacgcaaaaacaaaaccaagagaagaacaauacgcaucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53457 - RNA, 330 nt, Artificial Sequence
  derived and/or modified sequence opt6 from IgG1_HeavyChain_CH2_constant_domain
gcaccagaacuagcaggagcaccaucaguauuccuauucccaccaaaacccaaagacacacuaaugauaucaagaacaccagaaguaacaugcguaguaguagacguaucacacgaagacccagaaguaaaauucaacguauacguagacggaguagaaguacacaacgcaaaaacaaaaccacgagaagaacaauacaacucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53458 - RNA, 330 nt, Artificial Sequence
  derived and/or modified sequence opt6 from IgG1_HeavyChain_CH2_constant_domain
gcaccagaacuagcaggagcaccaucaguauuccuauucccaccaaaaccaaaagacacacuaaugauaucaagaacaccagaaguaacaugcguaguaguagacguaucacacgaagacccagaaguaaaauucaacguauacguagacggaguagaaguacacaacgcaaaaacaaaaccaagagaagaacaauacgcaucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53459 - RNA, 330 nt, Artificial Sequence
  derived and/or modified sequence opt6 from IgG1_HeavyChain_CH2_constant_domain
gcaccagaacuagcaggagcaccaucaguauuccuauucccaccaaaaccaaaagacacacuaaugauaucaagaacaccagaaguaacaugcguaguaguagacguaucacacgaagacccagaaguaaaauucaacugguacguagacggaguagaaguacacaacgcaaaaacaaaaccaagagaagaacaauacaacucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53460 - RNA, 330 nt, Artificial Sequence
  derived and/or modified sequence opt6 from IgG1_HeavyChain_CH2_constant_domain
gcaccagaacuagcaggagcaccaucaguauuccuauucccaccaaaaccaaaagacacacuaaugauaucaagaacaccagaaguaacaugcguaguaguagacguaucacacgaagacccagaaguaaaauucaacugguacguagacggaguagaaguacacaacgcaaaaacaaaaccaagagaagaacaauacgcaucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53461 - RNA, 330 nt, Artificial Sequence
  derived and/or modified sequence opt6 from IgG1_HeavyChain_CH2_constant_domain
gcaccagaagcacuaggaggaccaucaguauuccuauucccaccaaaaccaaaagacacacuaaugauaucaagaacaccagaaguaacaugcguaguaguagacguaucacacgaagacccagaaguaaaauucaacguauacguagacggaguagaaguacacaacgcaaaaacaaaaccaagagaagaacaauacaacucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53462 - RNA, 330 nt, Artificial Sequence
  derived and/or modified sequence opt6 from IgG1_HeavyChain_CH2_constant_domain
gcaccagaagcacuaggaggaccaucaguauuccuauucccaccaaaaccaaaagacacacuaaugauaucaagaacaccagaaguaacaugcguaguaguagacguaucacacgaagacccagaaguaaaauucaacguauacguagacggaguagaaguacacaacgcaaaaacaaaaccaagagaagaacaauacgcaucaacauacagaguaguaucaguacuaacaguacuacaccaagacuggcuaaacggaaaagaauacaaaugcaaaguaucaaacaaagcacuaccagcaccaauagaaaaaacaauaagcaaagcaaaa

SEQ ID NO: 53463 - RNA, 330 nt, Artificial Sequence
  derived and/or modified sequence opt6 from IgG1_HeavyChain_CH2_constant_domain
gcaccagaagcacuaggaggaccaucaguauuccuauucccaccaaaaccaaaagacacacuaaugauaagcagaacaccagaaguaacaugcguaguaguagacguaucacacgaagacccagaaguaaaauucaacugguacguagacggaguagaaguacacaacgcaaaaacaaaaccaagagaagaacaauacaacucaacauacagaguaguaucaguacuaacaguacuacaccaagacuggcuaaacggaaaagaauacaaaugcaaaguaucaaacaaagcauuaccagcaccaauagaaaaaacaauaucaaaagcaaaa

SEQ ID NO: 53464 - RNA, 330 nt, Artificial Sequence
  derived and/or modified sequence opt6 from IgG1_HeavyChain_CH2_constant_domain
gcaccagaagcacuaggaggaccaucaguauucuuauucccaccaaaaccaaaagacacauuaaugauaucaagaacaccagaaguaacaugcguaguaguagacguaucacacgaagacccagaaguaaaauucaacugguacguagacggaguagaaguacacaacgcaaaaacaaaaccaagagaagaacaauacgcaucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53465 - RNA, 330 nt, Artificial Sequence
  derived and/or modified sequence opt6 from IgG1_HeavyChain_CH2_constant_domain
gcaccagaagcacuaggagcaccaucaguauuccuauucccaccaaaaccaaaagacacacuaaugauaucaagaacaccagaaguaacaugcguaguaguagacguaucacacgaagacccagaaguaaaauucaacguauacguagacggaguagaaguacacaacgcaaaaacaaaaccaagagaagaacaauacaacucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53466 - RNA, 330 nt, Artificial Sequence
  derived and/or modified sequence opt6 from IgG1_HeavyChain_CH2_constant_domain
gcaccagaagcacuaggagcaccaucaguauucuuauucccaccaaaaccaaaagacacacuaaugauaucaagaacaccagaaguaacaugcguaguaguagacguaucacacgaagacccagaaguaaaauucaacguauacguagacggaguagaaguacacaacgcaaaaacaaaaccaagagaagaacaauacgcaucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53467 - RNA, 330 nt, Artificial Sequence
  derived and/or modified sequence opt6 from IgG1_HeavyChain_CH2_constant_domain
gcaccagaagcacuaggagcaccaucaguauuccuauucccaccaaaaccaaaagacacacuaaugauaucaagaacaccagaaguaacaugcguagucguagacguaucacacgaagacccagaaguaaaauucaacugguacguagacggaguagaaguacacaacgcaaaaacaaaaccaagagaagaacaauacaacucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53468 - RNA, 330 nt, Artificial Sequence
  derived and/or modified sequence opt6 from IgG1_HeavyChain_CH2_constant_domain
gcaccagaagcacuaggagcaccaucaguauuccuauucccaccaaaaccaaaagacacacuaaugauaucaagaacaccagaaguaacaugcguaguaguagacguaucacacgaagacccagaaguaaaauucaacugguacguagacggaguagaaguacacaacgcaaaaacaaaaccaagagaagaacaauacgcaucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53469 - RNA, 330 nt, Artificial Sequence
  derived and/or modified sequence opt6 from IgG1_HeavyChain_CH2_constant_domain
gcaccagaagcagcaggaggaccaucaguauuccuauucccaccaaaaccaaaagacacacuaaugauaucaagaacaccagaaguaacaugcguaguaguagacguaucacacgaagacccagaaguaaaauucaacguauacguagacggaguagaaguacacaacgcaaaaacaaaaccaagagaagaacaauacaacucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53470 - RNA, 330 nt, Artificial Sequence
  derived and/or modified sequence opt6 from IgG1_HeavyChain_CH2_constant_domain
gcaccagaagcagcaggaggaccaagcguauuccuauucccaccaaaaccaaaagacacacuaaugauaucaagaacaccagaaguaacaugcguaguaguagacguaucacaugaagacccagaaguaaaauucaacguauacguagacggaguagaaguacacaacgcaaaaacaaaaccaagagaagaacaauacgcaucaacauacagaguaguaagcguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53471 - RNA, 330 nt, Artificial Sequence
  derived and/or modified sequence opt6 from IgG1_HeavyChain_CH2_constant_domain
gcaccagaagcagccggaggaccaucaguauuccuauucccaccaaaaccaaaagacacacuaaugauaucaagaacaccagaaguaacaugcguaguaguagacguaagccacgaagacccagaaguaaaauucaacugguacguagacggaguagaaguacacaacgcaaaaacaaaaccaagagaagaacaauacaacucaacauacagaguaguaucaguacuaacaguacuacaccaagacugguuaaacggaaaagaauacaaaugcaaaguaucaaacaaagcacuaccagcaccaauagaaaaaacaauaucaaaagcaaaa

SEQ ID NO: 53472 - RNA, 330 nt, Artificial Sequence
  derived and/or modified sequence opt6 from IgG1_HeavyChain_CH2_constant_domain
gcaccagaagcagcaggaggaccaucaguauuccuauucccaccaaaaccaaaagacacacuaaugauaucaagaacaccagaaguaacaugcguaguaguagacguaucacacgaagacccagaaguaaaauucaacugguacguagacggaguagaaguacacaacgcaaaaacaaaaccaagagaagaacaauacgcaucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53473 - RNA, 330 nt, Artificial Sequence
  derived and/or modified sequence opt6 from IgG1_HeavyChain_CH2_constant_domain
gcaccagaagcagcaggagcaccaucaguauuccuauucccaccaaaaccaaaagacacacuaaugauaucaagaacaccagaaguaacaugcguaguaguagacguaucacacgaagacccagaaguaaaauucaacguauacguagacggaguagaaguacacaacgcaaaaacaaaaccaagagaagaacaauacaacucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53474 - RNA, 330 nt, Artificial Sequence
  derived and/or modified sequence opt6 from IgG1_HeavyChain_CH2_constant_domain
gcaccagaagcagcaggagcaccaucaguauuccuauucccaccaaaaccaaaagacacacuaaugauaucaagaacaccagaaguaacaugcguaguaguagacguaucacacgaagacccagaaguaaaauucaacguauacguagacggaguagaaguacacaacgcaaaaacaaaaccaagagaagaacaauacgcaucaacauacagaguaguaucaguacuaacaguacuacaccaagacuggcuaaacggaaaagaauacaaaugcaaaguaucaaacaaagcacuaccagcaccaauagaaaaaacaauaucaaaagcaaaa

SEQ ID NO: 53475 - RNA, 330 nt, Artificial Sequence
  derived and/or modified sequence opt6 from IgG1_HeavyChain_CH2_constant_domain
gcaccagaagcagcaggagcaccaucaguauuccuauucccaccaaaaccaaaagacacacuaaugauaucaagaacaccagaaguaacaugcguaguaguagacguaucacacgaagacccagaaguaaaauucaacugguacguagacggaguagaaguacacaacgcaaaaacaaaaccaagagaagaacaauacaacucaacauacagaguaguaucaguacuaacaguacuacaccaagacugguuaaacggaaaagaauacaaaugcaaaguaucaaacaaagcacuaccagcaccaauagaaaaaacaauaucaaaagcaaaa

SEQ ID NO: 53476 - RNA, 330 nt, Artificial Sequence
  derived and/or modified sequence opt6 from IgG1_HeavyChain_CH2_constant_domain
gcaccagaagcagcaggagcaccaucaguauuccuauucccaccaaaaccaaaagacacauuaaugauaagcagaacaccagaaguaacaugcguaguaguagacguaucacacgaagacccagaaguaaaauucaacugguacguagacggaguagaaguacacaacgcaaaaacaaaaccaagagaagaacaauacgcaucaacauacagaguaguaagcguacuaacaguacuacaccaagacugguuaaacggaaaagaauacaaaugcaaaguaucaaacaaagcacuaccagcaccaauagaaaaaacaauaucaaaagcaaaa

SEQ ID NO: 53477 - RNA, 318 nt, Artificial Sequence
  derived and/or modified sequence opt6 from IgG1_HeavyChain_CH3_constant_domain
ggacaaccaagagaaccacaaguauacacacuaccaccaucaagagaagaaaugacaaaaaaccaaguaucacuaacaugccuaguaaaaggauucuacccaucagacauagcaguagaaugggaaucaaacggacaaccagaaaacaacuacaaaacaacaccaccaguacuagacucagacggaucauucuuccuauacucaaaacuaacaguagacaaaucaagauggcaacaaggaaacguauucucaugcucaguaaugcacgaagcacuacacaaccacuacacacaaaaaucacuaucacuaucaccagga

SEQ ID NO: 53478 - RNA, 318 nt, Artificial Sequence
  derived and/or modified sequence opt6 from IgG1_HeavyChain_CH3_constant_domain
ggacaaccaagagaaccacaaguauacacacuaccaccaucaagagaagaacuaacaaaaaaccaaguaucacuaacaugccuaguaaaaggauucuacccaucagacauagcaguagaaugggaaucaaacggacaaccagaaaacaacuacaaaacaacaccaccaguacuagacucagacggaucauucuuccuauacucaaaacuaacaguagacaaaucaagauggcaacaaggaaacguauucucaugcucaguaaugcacgaagcacuacacaaccacuacacacaaaaaucacuaucacuaucaccagga

SEQ ID NO: 53479 - RNA, 318 nt, Artificial Sequence
  derived and/or modified sequence opt6 from IgG1_HeavyChain_CH3_constant_domain
ggacaaccaagagaaccacaaguauacacacuaccaccaucaagagaugaaaugacaaaaaaccaaguaucacuaacaugccuaguaaaaggauucuacccaucagacauagcaguagaaugggaaucaaacggacaaccagaaaacaacuacaaaacaacaccaccaguacuagacucagacggaucauucuuccuauacucaaaacuaacaguagacaaaucaagauggcaacaaggaaacguauucucaugcucaguaaugcacgaagcacuacacaaccacuacacacaaaaaucacuaucacuaucaccagga

SEQ ID NO: 53480 - RNA, 318 nt, Artificial Sequence
  derived and/or modified sequence opt6 from IgG1_HeavyChain_CH3_constant_domain
ggacaaccaagagaaccacaaguauacacacuaccaccaucaagagacgaacuaacaaaaaaccaaguaucacuaacaugccuaguaaaaggauucuacccaucagacauagcaguagaaugggaaucaaacggacaaccagaaaacaacuacaaaacaacaccaccaguacuagacucagacggaucauucuuccuauacucaaaacuaacaguagacaaaucaagauggcaacaaggaaacguauucucaugcucaguaaugcacgaagcacuacacaaccacuacacacaaaaaucacuaucacuaucaccagga

SEQ ID NO: 53481 - RNA, 297 nt, Artificial Sequence
  derived and/or modified sequence opt6 from IgG2_HeavyChain_CH1_constant_domain
ucagcaucaacaaaaggaccaucaguauucccacuagcaccaugcucaagaucaacaucagaaucaacagcagcacuaggaugccuaguaaaagacuacuucccagaaccaguaacaguaucauggaacucaggagcacuaacaucaggaguacacacauucccagcaguacuacaaucaucaggauuauacucacuaucaucaguaguaacaguaccaucaucaaacuucggaacacaaacauacacaugcaacguagaccacaaaccaucaaacacaaaaguagacaaaacagua

SEQ ID NO: 53482 - RNA, 297 nt, Artificial Sequence
  derived and/or modified sequence opt6 from IgG2_HeavyChain_CH1_constant_domain
ucagcaucaacaaaaggaccaucaguauucccacuagcaccaugcucaagaucaacaucagaaucaacagcagcacuaggaugccuaguaaaagacuacuucccagaaccaguaacaguaucauggaacucaggagcacuaacaucaggaguacacacauucccagcaguacuacaaucaucaggacuauacucacuaucaucaguaguaacaguaacaucaucaaacuucggaacacaaacauacacaugcaacguagaccacaaaccaucaaacacaaaaguagacaaaacagua

SEQ ID NO: 53483 - RNA, 327 nt, Artificial Sequence
  derived and/or modified sequence opt6 from IgG2_HeavyChain_CH2_constant_domain
gcaccaccaguagcaggaccaucaguauuccuauucccaccaaaaccaaaagacacacuaaugauaucaagaacaccagaaguaacaugcguaguaguagacguaucacacgaagacccagaaguacaauucaacugguacguagacggaguagaaguacacaacgcaaaaacaaaaccaagagaagaacaauucaacucaacauucagaguaguaucaguacuaacaguaguacaccaagacuggcuaaacggaaaagaauacaaaugcaaaguaucaaacaaaggauuaccagcaccaauagaaaaaacaauaucaaaaacaaaa

SEQ ID NO: 53484 - RNA, 327 nt, Artificial Sequence
  derived and/or modified sequence opt6 from IgG2_HeavyChain_CH2_constant_domain
gcaccaccaguagcaggaccaucaguauuccuauucccaccaaaaccaaaagacacacuaaugauaucaagaacaccagaaguaacaugcguaguaguagacguaucacacgaagacccagaaguacaauucaacugguacguagacggaguagaaguacacaacgcaaaaacaaaaccaagagaagaacaauucaacucaacauucagaguaguaucaguacuaacaguaguacaccaagacuggcuaaacggaaaagaauacaaaugcaaaguaucaaacaaaggacuaccagcaucaauagaaaaaacaauaucaaaaacaaaa

SEQ ID NO: 53485 - RNA, 327 nt, Artificial Sequence
  derived and/or modified sequence opt6 from IgG2_HeavyChain_CH2_constant_domain
gcaccaccaguagcaggaccaucaguauuccuauucccaccaaaaccaaaagacacacuaaugauaucaagaacaccagaaguaacaugcguaguaguagacguaucacacgaagacccagaaguacaauucaacugguacguagacggaguagaaguacacaacgcaaaaacaaaaccaagagaagaacaauucaacucaacauucagaguaguaucaguacuaacaguaguacaccaagacuggcuaaacggaaaagaauacaaaugcaaaguaucaaacaaaggacuaccaucaccaauagaaaaaacaauaucaaaaacaaaa

SEQ ID NO: 53486 - RNA, 327 nt, Artificial Sequence
  derived and/or modified sequence opt6 from IgG2_HeavyChain_CH2_constant_domain
gcaccaccaguagcaggaccaucaguauuccuauucccaccaaaaccaaaagacacacuaaugauaucaagaacaccagaaguaacaugcguaguaguagacguaagccacgaagacccagaaguacaauucaacugguacguagacggaguagaaguacacaacgcaaaaacaaaaccaagagaagaacaauucaacucaacauucagaguaguaucaguacuaacaguaguacaccaagacuggcuaaacggaaaagaauacaaaugcaaaguaucaaacaaaggacuaccaucaucaauagaaaaaacaauaucaaaaacaaaa

SEQ ID NO: 53487 - RNA, 327 nt, Artificial Sequence
  derived and/or modified sequence opt6 from IgG2_HeavyChain_CH2_constant_domain
gcaccaccaguagcaggaccaucaguauuccuauucccaccaaaaccaaaagacacacuaaugauaucaagaacaccagaaguaacaugcguaguaguagacguaucacacgaagacccagaaguacaauucaacugguacguagacggaauggaaguacacaacgcaaaaacaaaaccaagagaagaacaauucaacucaacauuccgaguaguaucaguacuaacaguaguacaccaagacuggcuaaacggaaaagaauacaaaugcaaaguaucaaacaaaggacuaccagcaccaauagaaaaaacaauaucaaaaacaaaa

SEQ ID NO: 53488 - RNA, 327 nt, Artificial Sequence
  derived and/or modified sequence opt6 from IgG2_HeavyChain_CH2_constant_domain
gcaccaccaguagcaggaccaucaguauuccuauucccaccaaaaccaaaagacacacuaaugauaucaagaacaccagaaguaacaugcguaguaguagacguaucacacgaagacccagaaguacaauucaacugguacguagacggaauggaaguacacaacgcaaaaacaaaaccaagagaagaacaauucaacucaacauucagaguaguaucaguacuaacaguaguacaccaagacuggcuaaacggaaaagaauacaaaugcaaaguaucaaacaaaggacuaccagcaucaauagaaaaaaccauaucaaaaacaaaa

SEQ ID NO: 53489 - RNA, 327 nt, Artificial Sequence
  derived and/or modified sequence opt6 from IgG2_HeavyChain_CH2_constant_domain
gcaccaccaguagcaggaccaucaguauuccuauucccaccaaaaccaaaagacacacuaaugauaucaagaacaccagaaguaacaugcguaguaguagacguaucacacgaagacccagaaguacaauucaacugguacguagacggaauggaaguacacaacgcaaaaacaaaaccaagagaagaacaauucaacucaacauucagaguaguaucaguacuaacaguaguacaccaagacuggcuaaacggaaaagaauacaaaugcaaaguaucaaacaaaggacuaccaucaccaauagaaaaaacaauaucaaaaacaaaa

SEQ ID NO: 53490 - RNA, 327 nt, Artificial Sequence
  derived and/or modified sequence opt6 from IgG2_HeavyChain_CH2_constant_domain
gcaccaccaguagcaggaccaucaguauucuuauucccaccaaaaccaaaagacacacuaaugauaucaagaacaccagaaguaacaugcguaguaguagacguaucacacgaagacccagaaguacaauucaacugguacguagacggaauggaaguacacaacgcaaaaacaaaaccaagagaagaacaauucaacucaacauucagaguaguaucaguauuaacaguaguacaccaagacuggcuaaacggaaaagaauacaaaugcaaaguaucaaacaaaggacuaccaucaucaauagaaaaaacaauaucaaaaacaaaa

SEQ ID NO: 53491 - RNA, 318 nt, Artificial Sequence
  derived and/or modified sequence opt6 from IgG2_HeavyChain_CH3_constant_domain
ggacaaccaagagaaccacaaguauacacacuaccaccaucaagagaagaaaugacaaaaaaccaaguaucacuaacaugccuaguaaaaggauucuacccaucagacauagcaguagaaugggaaucaaacggacaaccagaaaacaacuacaaaacaacaccaccaaugcuagacucagacggaucauucuuccuauacucaaaacuaacaguagacaaaucaagauggcaacaaggaaacguauucucaugcucaguaaugcacgaagcacuacacaaccacuacacacaaaaaucacuaucacuaucaccagga

SEQ ID NO: 53492 - RNA, 297 nt, Artificial Sequence
  derived and/or modified sequence opt6 from IgG4_HeavyChain_CH1_constant_domain
ucagcaucaacaaaaggaccaucaguauucccacuagcaccaugcucaagaucaacaucagaaucaacagcagcauuaggaugccuaguaaaagacuacuucccagaaccaguaacaguaucauggaacucaggagcacuaacaucaggaguacacacauucccagcaguauuacaaucaucaggacuauacucacuaucaucaguaguaacaguaccaucaucaucacuaggaacaaaaacauacacaugcaacguagaccacaaaccaucaaacacaaaaguagacaaaagagua

SEQ ID NO: 53493 - RNA, 330 nt, Artificial Sequence
  derived and/or modified sequence opt6 from IgG4_HeavyChain_CH2_constant_domain
gcaccagaauuccuaggaggaccaucaguauuccuauucccaccaaaaccaaaagacacacuaaugauaucaagaacaccagaaguaacaugcguaguaguagacguaucacaagaagacccagaaguacaauucaacugguacguagacggaguagaaguacacaacgcaaaaacaaaaccaagagaagaacaauucaacucaacauaccgaguaguaucaguacuaacaguacuacaccaagacuggcuaaacggaaaagaauacaaaugcaaaguaucaaacaaaggacuaccaucaucaauagaaaaaacaauaucaaaagcaaaa

SEQ ID NO: 53494 - RNA, 318 nt, Artificial Sequence
  derived and/or modified sequence opt6 from IgG4_HeavyChain_CH3_constant_domain
ggacaaccaagagaaccacaaguauacacacuaccaccaucacaagaagaaaugacaaaaaaccaaguaucacuaacaugccuaguaaaaggauucuacccaucagacauagcaguagaaugggaaucaaacggacaaccagaaaacaacuacaaaacaacaccaccaguacuagacucagacggaucauucuuccuauacucaagacuaacaguagacaaaucaagauggcaagaaggaaacguauucucaugcuccguaaugcacgaagcacuacacaaccacuacacacaaaaaucacuaucacuaucacuagga

SEQ ID NO: 53495 - RNA, 1347 nt, Artificial Sequence
  derived and/or modified sequence opt11 from AAB-003_gamma1-Chain
gaaguccaacuccucgaauccggcggaggccucguccaacccggcggaucccuacgccuauccugcgccgccagcggcuucacauuuucaaacuacggcauguccuggguccgccaagcacccggcaaaggacucgaaugggucgccagcauacgauccggcggaggacgcaccuacuacuccgacaauguaaaaggacgauuuacaaucucucgcgacaacuccaaaaacacacucuaccuacaaaugaacucccuaagagcagaagacacagccgucuacuacugcgucagauacgaccauuacucaggcuccuccgacuacuggggccaaggcacccucgugaccguauccuccgcaucuaccaaaggacccuccguuuucccccuagcacccuccuccaaaucuaccuccggaggaaccgccgcccuaggcugccuuguaaaagauuacuuccccgaacccgucaccgucuccuggaacuccggcgcacucaccucaggaguccacaccuucccugccguccuccaaagcuccgggcucuauucccucuccuccguagugaccgucccauccucaagccuaggcacccaaaccuacaucugcaacguuaaccacaaaccauccaacaccaaaguagacaagaaagucgaaccaaaauccugcgacaaaacccacaccuguccacccugcccagccccugaagccgccggcgccccuagcgucuuccuuuucccacccaaacccaaagacacccuaaugauaucccgaacccccgagguaaccugcgucgucgucgacgucucacacgaagaccccgaagucaaauucaacugguacgucgacggagucgaaguccacaacgccaaaaccaagccccgagaagaacaauacaauuccaccuacagaguugucuccguccuaaccguccuccaccaagacuggcucaacggcaaagaauacaaaugcaaaguuagcaacaaggcccuccccgcacccaucgagaaaaccaucucaaaagcaaaaggccaaccacgcgaaccacaagucuacacccuacccccaucacgcgaggaaaugacuaaaaaccaaguaucccugacaugccuagucaaaggauucuaccccucagacaucgccgucgaaugggaaucaaacggacaacccgaaaauaacuacaaaaccacaccgcccguccucgauucagacggcuccuucuuccucuacucaaaacucaccgucgacaaaucacgcuggcaacaaggcaacguauucuccugcuccgucaugcacgaagcucuccacaaucacuacacccaaaaaucacucucccuaucacccggcaaa

SEQ ID NO: 53496 - RNA, 1329 nt, Artificial Sequence
  derived and/or modified sequence opt11 from Abagovomab_HeavyChain
caagucaaacuccaagaaagcggcgccgaacuugcacgccccggagccucaguaaaacucucaugcaaagccuccggcuacaccuucaccaacuacuggaugcaauggguaaaacaaagaccuggccagggacucgacuggauaggcgccaucuacccaggcgacggaaauacccgauacacccacaaauucaaaggaaaagccacacuaaccgccgacaaaucauccucaacugcauacaugcaacucuccucccuagccagcgaagacuccggcgucuacuacugcgcccgcggcgaaggcaacuacgcaugguucgccuacuggggccaaggcacuacagucacagucuccuccgccaaaacaacacccccaucuguauacccccucgcaccaggauccgccgcccaaacaaacuccauggucacucucggcugccucguaaaaggcuacuucccagagccagucaccguaaccuggaacuccggcucccuuucaucaggcguccacaccuucccagccguacuccaaucagaccucuacacccuaucgucguccguuaccguccccucuuccacauggcccuccgaaacuguuaccugcaacgucgcccaccccgccuccuccacaaaagucgacaagaaaaucguaccccgcgacugcggcugcaaacccugcaucugcacaguacccgaaguuucaucagucuucaucuucccucccaaacccaaagacguacuaaccaucacccucacccccaaaguaacuugcgucgucguagacaucuccaaagacgaccccgaaguccaauucucgugguucgucgacgacguagaaguccacaccgcacaaacccaaccccgcgaagaacaauucaacuccaccuuccgcuccgucuccgaacucccaaucaugcaccaagacuggcucaacggaaaagaauuuaaaugcagagucaacucagccgccuucccugcacccauagagaaaaccaucuccaagaccaaaggccgucccaaagcaccccaagucuauaccaucccacccccaaaagaacaaauggccaaagacaaaguaucccucacaugcaugaucaccgacuucuuccccgaagacaucaccgucgaauggcaauggaacggccaacccgccgaaaacuauaaaaacacacaacccauaauggacaccgauggcuccuacuucgucuacuccaaacuuaacguccaaaaaucaaacugggaagccgguaacaccuucacaugcuccguccuccacgaaggacuccacaaucaccacaccgaaaaaucccucucccacucacccggcaaa

SEQ ID NO: 53497 - RNA, 642 nt, Artificial Sequence
  derived and/or modified sequence opt11 from Abagovomab_LightChain
gacaucgaacucacacaaucccccgccucacuauccgccagcgucggcgaaaccgucacaaucaccugccaagccuccgaaaacaucuacuccuaccucgccuggcaccaacaaaaacaaggcaaauccccccaacuccucgucuacaacgccaaaacccucgccggcggcgucuccucccgcuucuccggcuccggcucaggcacacacuucucccuaaaaaucaaaucccuccaacccgaagacuucggcaucuacuacugccaacaccacuacggcauccuccccaccuucggcggcggcaccaaacucgaaaucaaacgcgccgacgccgcccccaccgucuccaucuucccccccuccuccgaacaacucaccucaggcggcgccucagucgucugcuuccucaacaacuucuaccccaaagacaucaacgucaaauggaaaaucgacggcuccgaacgccaaaacggcguccucaacucauggaccgaccaagacuccaaagacucaaccuacuccauguccucaacccucacccuaaccaaagacgaauacgaacgccacaacuccuacaccugcgaagccacccacaaaaccuccaccucccccaucgucaaauccuucaaccgaaacgaaugc

SEQ ID NO: 53498 - RNA, 1350 nt, Artificial Sequence
  derived and/or modified sequence opt11 from Abciximab_HeavyChain
gaaguccaacuacaacaaagcggcgcagaacucguuaaacccggcgcauccguuaaacuaagcugcaccgccuccggcuucaacaucaaggacaccuacguccacuggguaaaacaacgccccgaacaaggacucgaauggaucggccgaaucgaucccgccaacggauacacaaaauacgaccccaaauuccaaggaaaagccacuaucaccgcggacacaagcuccaacacugcauaccuccaacucucaucacucacauccgaagacaccgccgucuacuacugcguccgcccacucuacgacuacuacgcaauggacuacuggggccaaggcaccucagucacagucucguccgccaaaaccacagcuccaucagucuacccccucgcccccgucugcggcgauacaaccggcuccagcgucacacuaggcugccucguaaaaggauacuucccagaacccguaacccuuaccuggaacuccgguucacuaagcucaggcguccacaccuuccccgcaguccuacaaucagaccucuacacccuauccuccucagucaccgucaccagcuccaccuggcccucccaauccauuaccugcaacgucgcccaccccgccuccucaaccaaaguagacaagaaaaucgaaccccgacccaaauccugcgacaaaacccacacuugcccacccugcccagcccccgaacuccucggcggccccuccgucuuccucuucccacccaaacccaaagacacccucaugaucucccgcacacccgaaguaacaugcguugucguagacgucucccacgaagaccccgaagucaaauucaacugguacgucgacggagucgaaguccacaacgccaaaaccaaaccccgcgaagaacaauacaacuccacauaccguguagucuccguccuaaccguacuccaccaagacuggcuaaacggcaaagaauacaaaugcaaagucuccaacaaagcccuacccgcacccaucgagaaaaccaucuccaaagccaaaggccaaccccgcgaaccacaagucuacacccuuccacccucacgcgacgaacuaaccaaaaaccaggucucccuaacaugccucguaaaaggcuucuaccccucagacaucgcugucgaaugggaaucuaacggccaaccagaaaacaauuacaaaaccacacccccuguacucgacucagacggcucuuucuuucucuacagcaaacuuacagucgacaaaucccgcuggcaacaaggcaacgucuucucuugcagcgucaugcacgaagcccuacacaaccacuacacccaaaaaucucucucccucucucccggcaag

SEQ ID NO: 53499 - RNA, 642 nt, Artificial Sequence
  derived and/or modified sequence opt11 from Abciximab_LightChain
gacauccucaugacccaaucaccauccuccauguccgucucccuaggcgacaccgucuccaucaccugccacgccucacaaggcaucuccucaaacaucggcuggcuacaacaaaaaccaggaaaauccuucaugggccuaaucuacuacggcaccaaccucgucgacggcguccccucccgauucucuggcuccggcucaggcgccgacuacucccucaccaucuccucccucgacucagaagacuucgccgacuacuacugcguccaauacgcccaacuccccuacacauucggcggcggaaccaaacucgaaaucaaacgcgccgacgccgcccccaccguauccaucuucccccccuccuccgaacaacuaaccuccggcggcgccuccgucgucugcuuccucaacaacuucuacccaaaagacaucaacgucaaauggaaaaucgacggcucagaacgccaaaacggcguccucaacucauggaccgaccaagacuccaaagacuccaccuacuccauguccuccacccucacccucaccaaagacgaauacgaacgccacaacuccuacaccugcgaagccacccacaaaaccucaaccucccccaucgucaaaucauucaaccgcaacgaaugc

SEQ ID NO: 53500 - RNA, 1341 nt, Artificial Sequence
  derived and/or modified sequence opt11 from Abituzumab_HeavyChain1
caaguccaacuccaacaaagcggcggagaacucgccaaacccggagcuuccgucaaagucuccugcaaagcgucuggcuacaccuucagcucauucuggaugcacuggguucgacaagcgccaggccaaggacuugaauggauaggcuacaucaacccccgaucaggauacaccgaauacaacgagauauuccgcgacaaagcaacaaugaccaccgacaccuccacuuccaccgccuauauggaacucucaucucuccgcucagaagacaccgccgucuacuacugcgcauccuuccucggacgcggcgcaauggacuacuggggucaaggcaccaccgucaccgucuccuccgcaucaaccaaaggcccaagcguauucccccucgcccccuguucccgcagcacauccgaauccacugccgcccucggcugccuagucaaagacuacuuccccgaacccgucaccguaucauggaacuccggagcacucaccucagguguccacaccuuccccgccguccuccaaagcucaggccuauacucacucuccuccgucgucacagucccaucuuccaacuucggcacccaaaccuacacaugcaacguagaccacaaacccuccaacacaaaaguagacaaaaccguugaaccuaaaucaucugacaaaacccacacaugcccgcccugccccgcacccccagucgccggccccuccgucuucuuguucccacccaaacccaaggacacccucaugauaucacgcaccccagaagucacaugcgucgucgucgacgucagucacgaagaccccgaaguacaauucaacugguacguagacggcguagaaguccacaacgccaaaaccaaacccagagaagaacaagcccagucgaccuuccgaguagucucaguucucaccgucguccaccaagacuggcuaaacggcaaagaauauaaaugcaaagucucaaacaaaggacuacccgcccccauagagaaaacuauaagcaaaaccaaaggccaaccccgcgaaccacaaguauacacccucccgcccucccgagaagaaaugaccaaaaaccaagucucacucacaugccuagucaaaggcuuuuaccccucugacauagccguagaaugggaauccaacggccaacccgaaaacaacuacaaaaccaccccucccaugcucgacuccgacggauccuucuuccuauacuccaaacucaccgucgacaaauccagauggcaacaaggcaacgucuuuuccugcuccgucaugcacgaagcccuacacaaccacuacacccaaaaaucacucuccuuaucacccggcaaa

SEQ ID NO: 53501 - RNA, 642 nt, Artificial Sequence
  derived and/or modified sequence opt11 from Abituzumab_LightChain1
gacauccaaaugacacaaucccccuccucacuauccgccuccgucggcgaccgcguaaccaucacaugccgcgccagccaggacaucuccaacuaccucgccugguaccaacaaaaacccggcaaagccccaaaacuccucaucuacuacacaagcaaaauccacuccggcguccccucccgcuucucaggcuccggcuccggcaccgacuacaccuucaccaucuccucccuccaacccgaagacaucgccaccuacuacugccaacaaggcaacaccuuccccuacaccuucggacaaggcaccaaagucgaaaucaaacgcaccgucgccgcccccuccgucuucaucuucccacccucagacgaacaacucaaauccggcacagccuccguagucugccuccucaacaacuucuacccucgcgaagccaaaguccaauggaaggucgacaacgcccuccaauccggcaacucccaagaaucaguaaccgaacaagacuccaaagacucaaccuacucccuauccuccacacuaacccuaucaaaagccgacuacgaaaaacacaaagucuacgccugcgaagucacccaccaaggccucuccucccccgucaccaaauccuucaaccgcggcgaaugc

SEQ ID NO: 53502 - RNA, 1332 nt, Artificial Sequence
  derived and/or modified sequence opt11 from Abrilumab_HeavyChain1
caaguccaacucguccaaucaggcgccgaagucaaaaagcccggggccucgguuaaggucagcugcaaagucucuggcuacacccucuccgaccucuccauccacuggguacgccaggcaccaggcaagggauuagaauggaugggaggauucgacccccaagacggcgaaacaaucuacgcccagaaauuccaaggccgagucaccaugaccgaagacaccuccacugacaccgccuacauggaacuuuccucccuaaaauccgaagacaccgcagucuacuacugcgccaccggaucaucauccucaugguucgaccccuggggccaaggaacacucgucacagucucauccgcuuccacaaaaggccccucaguauucccacucgcccccugcucucgcucaaccuccgaauccaccgccgcccucggcugccucgucaaagacuacuuccccgaacccgucacagucuccuggaacucaggcgcacucaccuccgguguacacaccuuccccgccguccuucaguccuccggccucuacucccucuccuccgucguuaccguacccucaucgaacuucggaacccagaccuauaccugcaacguggaucacaaaccguccaacaccaaagucgacaaaacagucgaacgaaaaugcugcguagaaugcccaccaugccccgcacccccaguagccggccccuccgucuuccuauucccacccaaacccaaggacacacuaaugaucuccagaacccccgagguaaccugcgucguugucgacguaucccacgaagacccagagguccaguucaacugguacguagacggagucgaaguucacaacgccaaaaccaagccaagggaagaacaauuuaacucaaccuuccgcguagucuccguccucacugucguccaccaagacuggcuuaacggcaaagaauacaaaugcaaagucuccaacaaaggccuacccgcccccauagagaaaacaaucucuaaaaccaaaggccaaccacgcgaaccccaagucuacacccuuccacccagccgcgaagaaaugaccaaaaaccaagucagccuaaccugccucgucaaaggcuuuuaccccuccgacaucgccgucgaaugggaauccaacggccaacccgaaaacaacuacaaaaccacacccccaaugcucgacucugacgggucauucuuccucuacucaaaacuuaccgucgacaaauccagauggcaacaaggcaacgucuucuccugcuccgucaugcacgaagcccuccacaaccacuacacccaaaaaucccucucacucucacccggcaaa

SEQ ID NO: 53503 - RNA, 642 nt, Artificial Sequence
  derived and/or modified sequence opt11 from Abrilumab_LightChain1
gacauccaaaugacacaaucgcccucaagcguaagcgccagcguaggcgaccgcgucaccauaaccugccgcgcaucccaaggcauaagcucauggcucgccugguaccaacaaaaacccggaaaagcacccaaacuccuaaucuacggcgcaagcaaccucgaaagcggaguccccagcagauucucaggcucaggcucaggcacagacuuuacccucaccauauccucccuacaaccagaagacuucgccaacuacuacugccaacaagcaaacucauucccauggacauucggacaaggcaccaaagucgagaucaaacgcaccgucgcagccccguccguauucaucuucccacccucagacgaacaacugaaaucaggcacagccucagucgucugccuacucaacaacuucuacccccgagaagccaaaguccaauggaaagucgacaacgcgcuccaauccggaaacucgcaagaaagcgucaccgaacaagacagcaaagacucaaccuacagccuaagcucaacccuaacccucagcaaagcagacuacgaaaaacacaaaguauacgcaugcgaagucacacaccaaggccuaagcucacccgucaccaagagcuucaacagaggcgaaugc

SEQ ID NO: 53504 - RNA, 639 nt, Artificial Sequence
  derived and/or modified sequence opt11 from Abrilumab_LightChain1_variant2
caaaucguccuaacacaaucccccgcuaucauguccgccucccccggcgaaaaagucacaauaaccugcuccgccuccuccuccgucuccuacaugaacugguuccaacaaaaacccggcaccucccccaaacucuggaucuacucaaccuccaaccucgcauccggcguccccgcccgcuucuccggcucaggauccggaaccucauacucacucaccaucucccgcauggaagcagaagacgccgccaccuacuacugccaacaacgauccuccuaccccaacaccuucggcggcggcaccaaacuagaaaucaaacgcgccgacgcagcccccaccgucuccaucuucccacccucauccgaacaacucaccucaggcggcgcaucagucgucugcuuccuaaacaacuucuaccccaaagacaucaacgucaaauggaaaaucgacggaucagaacgccaaaacggaguccuaaacuccuggaccgaccaagacuccaaagacuccacauacuccauguccucaacccucacccuaaccaaagacgaauacgaacgccacaacuccuacacaugcgaagccacccacaaaaccuccaccucccccaucgucaaauccuucaaccgcaacgaaugc

SEQ ID NO: 53505 - RNA, 1347 nt, Artificial Sequence
  derived and/or modified sequence opt11 from Actoxumab_HeavyChain1
gaaguacaacucguccaauccggcgccgaaguuaagaaauccggagaaucacucaaaauauccugcaaaggcuccggauauuccuucacaucauacuggauaggcuggguccgccaaaugccuggaaaaggccucgaauggaugggcaucuucuaccccggcgacuccuccacacgcuacucccccuccuuccaaggccaaguaaccauauccgcagacaaaagcgucaacaccgccuaccuccaaugguccucacucaaagccuccgacaccgcuauguacuacugugccagacgccgcaacuggggcaacgcauucgacauauggggacagggcaccauggucaccguauccuccgccuccacaaaaggccccucaguauucccccucgcaccauccuccaaaagcaccuccggcggcaccgccgcacucggaugccucguaaaagacuacuuccccgaacccgucacggucuccuggaacucaggcgcacucaccagcggaguacacacauuccccgccguccuccaguccagcggccucuacucccuauccagcguaguuaccguccccuccuccucccucggaacccaaaccuacaucugcaaugucaaucacaaacccagcaacaccaaagucgacaagcgcgucgaacccaaguccugcgacaaaacacacacuugcccucccugccccgcccccgaacuacucggaggcccauccguauuccuauucccacccaaacccaaagacacccucaugaucucccgcacccccgaaguaaccugcguagucgucgacgucagccacgaagaccccgaaguaaaauucaacugguacgucgauggugucgagguccacaacgcuaaaaccaagccccgcgaggaacaauacaacuccaccuaccgaguaguauccguccuaaccguacuccaccaagacuggcucaauggcaaagaauacaaaugcaaaguauccaacaaagcccuccccgcccccaucgagaaaaccaucucgaaagcaaaaggucaaccccgcgaaccccaaguauacacccucccgcccucccgagaagaaaugaccaagaaccaagucucacuaaccugccucgucaaaggcuucuaccccucggacaucgccguagaaugggaauccaacggacaacccgaaaacaacuacaaaaccacaccucccguccuagacagcgacggcucauucuuccucuacucaaaacucaccgucgacaaaucacgcuggcaacagggcaacguauuuuccugcuccgucaugcacgaagcacuucacaaccacuacacccaaaaaucccucagccucucccccggcaaa

SEQ ID NO: 53506 - RNA, 645 nt, Artificial Sequence
  derived and/or modified sequence opt11 from Actoxumab_LightChain1
gaaaucguccucacccaaucccccggcacccucucacucucccccggcgaacgcgccacacucuccugccgagccucccaauccgucucauccuccuaccucgccugguaccaacaaaaacccggccaagcuccccgacuacuaaucuacggcgccuccucccgcgccaccggcaucccagaccgauucuccggcuccggcuccggcaccgacuucacccucacaaucucccgucuagaacccgaagacuucgccgucuacuacugccaacaauacggcuccucaaccuggaccuucggccaaggcaccaaagucgaaaucaaacgcaccgucgccgcccccuccgucuucaucuucccacccuccgacgaacaacucaaauccggaaccgccuccgucgucugccuccucaacaacuucuacccccgcgaagccaaaguccaguggaaagucgacaacgcccuccaauccggcaacucccaagaauccgucaccgaacaagacuccaaagacucaaccuacucauuauccuccacccucacccucuccaaagccgacuacgaaaaacacaaagucuacgcaugcgaagucacccaccaaggccucuccucccccguaaccaaauccuucaacagaggcgaaugc

SEQ ID NO: 53507 - RNA, 672 nt, Artificial Sequence
  derived and/or modified sequence opt11 from Adalimumab_HeavyChain
gagguccagcucguggaaucgggcggaggccugguccagcccggacgcucccuccgacucucgugcgcggccucgggcuucaccuucgacgacuacgcaaugcacuggguacgccaggccccgggcaagggccuagaaugggucucggccauaaccuggaacucgggccacaucgacuacgcggacucgguagagggcagauucacgaucucgcgcgacaacgcgaaaaacagccuguaccuacaaaugaacucacucagggccgaggacacagcaguguacuacugcgcaaaagugagcuaccucuccaccgcgagcucgcucgacuacuggggccagggcacgcucgugaccgugagcucagcaucgaccaagggaccgagcguauucccacuagcccccucgagcaaaagcacgagcgggggcacggccgcacucggaugccuagucaaagacuacuucccggaacccguaaccgucucauggaacagcggagcauuaacauccggagugcacacguucccggccgugcuccagagcucgggacuguacucacucucgagcguagucacggucccaagcagcucauuaggcacgcaaacauacauaugcaacgucaaccacaagcccucgaacacaaaaguggacaagaaaguggaaccgaaaucgugc

SEQ ID NO: 53508 - RNA, 642 nt, Artificial Sequence
  derived and/or modified sequence opt11 from Adalimumab_LightChain
gacauccaaaugacccaaucacccucaagccuauccgcauccgucggcgaccgcgucaccaucacaugccgcgccucccaaggcauccgcaacuaccucgccugguaccaacaaaaacccggcaaagcacccaaacuccucaucuacgccgccuccacccuccaaagcggcguccccucacgcuucucaggcuccggcucaggcaccgacuucacccucacaaucuccucccuccaacccgaagacgucgccaccuacuacugccaacgauacaaccgcgcccccuacaccuucggccaaggcaccaaagucgaaaucaaacgcaccgucgccgcccccucagucuucaucuucccacccuccgacgaacaacuaaaauccggcacagccucagucgucugccuccucaacaacuucuacccccgcgaagccaaaguccaauggaaagucgacaacgcccuccaauccggcaacucccaagaaagcgucaccgaacaagacucaaaagacuccaccuacucccucuccucaacacucacacucuccaaagccgacuacgaaaaacacaaagucuacgccugcgaagucacccaccaaggccucuccucacccgucaccaaauccuucaaccgcggcgaaugc

SEQ ID NO: 53509 - RNA, 1359 nt, Artificial Sequence
  derived and/or modified sequence opt11 from Aducanumab_HeavyChain1
caaguccaacucgucgaauccggaggcggcgucguccaacccggccgaucucuccgacucucaugcgccgccuccggauucgcauucucauccuacggcaugcacuggguccgacaagcccccggcaaaggccucgaauggguagcaguaaucugguucgauggcacaaagaaauacuacaccgacuccgucaaaggcagauucaccaucagccgggacaauuccaaaaacacccucuaccuccaaaugaacacccuccgcgccgaggacaccgcagucuacuauugcgcacgagaucggggaaucggcgcccgccgcggacccuacuacauggacgucuggggcaaaggcaccaccgucacagucucauccgccuccaccaaaggccccuccgucuucccacuagcaccuuccuccaaauccaccuccggcggaaccgccgcccucggcugucucgucaaagacuacuucccagaacccgucaccgucuccuggaacuccggcgcccuuaccuccggcguccacaccuucccagcuguacuccaaucaucgggccucuacucccucucaucagucgucacaguacccucuucaucucucggcacacaaaccuacauaugcaacguaaaccacaaacccagcaacaccaaagucgacaaaagaguagaacccaaaucaugcgauaaaacccacacaugcccacccugcccagcccccgaacuccucggcggacccucaguguuccucuucccucccaaaccuaaagacacacucaugaucucucguacccccgaagucacuugcgucgucgucgaugucucacacgaagacccagaagucaaauucaacugguacguagacggugucgaaguccacaaugccaaaaccaaaccccgagaagaacaauacaacucgaccuaccgcgucguauccguccucaccguccuccaccaagacuggcucaauggcaaagaauauaaaugcaaagucucaaacaaagcacuccccgcccccaucgagaaaacaauauccaaagcaaaaggccaaccacgcgaaccccaagucuacacacucccacccucccgcgaagaaaugaccaaaaaccaaguaucccuuaccugccucgucaaaggcuucuaccccuccgacaucgcagucgaaugggaaagcaacggccaacccgaaaacaacuacaagaccacaccacccguccucgacuccgacggcuccuucuuccuguacuccaaacucaccgucgacaaauccagauggcaacaaggaaacgucuucuccugcuccguaaugcacgaagcccugcacaaccacuacacccaaaaaucccuaucucuaucccccggc

SEQ ID NO: 53510 - RNA, 642 nt, Artificial Sequence
  derived and/or modified sequence opt11 from Aducanumab_LightChain1
gacauccaaaugacccaaucccccuccucacucuccgccuccgucggcgaccgcguaaccauaaccugccgcgccucacaaucaaucucuucauaccuaaacugguaccaacaaaaacccgguaaagcccccaaacuacucaucuacgccgccuccucccuccaauccggcguccccucccgcuucucaggcuccggcuccggcaccgacuucacccucaccaucagcucgcuccaacccgaagacuucgccaccuacuacugccaacaauccuacucaacuccccucaccuucggaggcggcaccaaagucgaaauaaagcgcaccgucgcagcccccagcgucuucaucuucccacccucagacgaacaacucaaauccggcaccgccuccgucgucugccuccucaacaacuucuacccccgcgaagccaagguccaauggaaagucgacaacgcccuccaauccggcaacucccaagaauccgucaccgaacaagacuccaaagacucaaccuacucccuauccuccacccucacccuaucaaaagccgacuacgaaaaacacaaagucuacgcaugcgaagucacccaccaaggccuauccucccccgucaccaaauccuucaaccgcggcgaaugc

SEQ ID NO: 53511 - RNA, 1359 nt, Artificial Sequence
  derived and/or modified sequence opt11 from Afasevikumab_HeavyChain1
gaaguccaacucgucgaauccggcggcgggcucguccaacccggacgaucacucaggcuuuccugcgccgccuccggguucacauucgacgacuacgccaugcacuggguccgccaagcccccggcaaaggccucgaaugggucuccggcaucaacuggagcucaggcggaaucggcuacgccgacuccguaaaaggucgcuucaccaucucacgcgacaacgccaaaaacucccucuaccuccaaaugaacucccuccgcgcagaagacaccgcacucuacuacugcgcccgagacaucggcggauucggcgaguucuacuggaacuucggucucuggggacgcggaacccuggucacugucuccuccgcauccaccaaaggccccucagucuucccccucgccccauccucgaaauccaccuccggcggcaccgccgcccuaggaugccuagucaaagauuacuuccccgaacccguaaccgucagcuggaacuccggagcccuaaccucagguguccacaccuucccagccguccuccaauccuccggccuuuacucccuaucauccgucgucaccguccccuccucaagucucgguacacaaacauacaucugcaacguaaaucacaaaccauccaacaccaaagucgacaaacgaguagaacccaaaagcugcgacaaaacacauaccugcccacccugccccgcacccgaacuacuaggagggccauccgucuuccuauucccacccaaacccaaagacacccuaaugaucucccgaacccccgaaguuaccugcgucgucguggacgucucacacgaagaccccgaaguaaaauucaacugguacguagacggagucgaaguccacaacgccaagaccaaacccagagaagaacaauacaacuccaccuacagagucgucuccguccucacaguacuccaccaagacuggcucaacggcaaagaauacaaaugcaaagucucaaacaaagcccuccccgcucccaucgaaaagacaaucucuaaagcuaaaggacaaccccgagaaccccaaguauacacccucccacccucccgagaagaaaugaccaaaaaccaagucucccucacaugccucguuaaaggauuuuaccccuccgacaucgccgucgaaugggaaagcaauggccaacccgaaaacaauuacaaaaccaccccacccguccucgacucagacggauccuucuuccucuacucaaaacucacugucgacaaauccagauggcaacaaggcaacguauucucaugcucagucaugcacgaagcccuccacaaucacuacacccagaaaucacuaagccugucccccggcaaa

SEQ ID NO: 53512 - RNA, 645 nt, Artificial Sequence
  derived and/or modified sequence opt11 from Afasevikumab_LightChain1
gaaaucguccucacccaaucccccgccacccugucacucucccccggcgaacgcgccacccucuccugccgcgccucccaauccguccgcucuuaccucgccugguaccaacaaaaacccggccaagccccccgacuccucaucuacgacgccucaaaccgcgccaccggcauccccgcccgcuucuccggcuccggauccggcaccgacuucacacucaccaucucaucccucgaaccagaagacuucgccguauacuacugccaacaacgcuccaacuggccccccgccaccuucggcggcggcaccaaagucgaaaucaaacgcacagucgcugcccccuccgucuucaucuucccccccuccgacgaacaacuaaaauccggaaccgccuccgucgucugccuacucaacaacuucuacccccgcgaagcaaaaguccaauggaaaguagacaacgcacuccaauccggcaacucccaagaauccgucaccgaacaagacuccaaagacucaaccuacucucuauccuccacccucacccucuccaaagccgacuacgaaaaacacaaagucuacgccugcgaagucacccaccaaggacucuccucccccgucaccaaauccuucaaccgcggcgaaugc

SEQ ID NO: 53513 - RNA, 1293 nt, Artificial Sequence
  derived and/or modified sequence opt11 from Aflibercept_Fusion_protein1
uccgacacaggccgcccauucguugaaauguacucagaaauaccagaaauaauccacaugaccgaaggccgcgaacucgucauacccugccgagucacaucucccaauaucaccgucacccucaagaaauucccccucgacaccuuaauacccgacggcaaacguaucauaugggacucacgcaaaggcuucaucaucuccaacgcaacuuacaaagagaucggccucuuaaccugcgaagccaccguaaacggucaccucuacaaaaccaacuaccucacccacagacaaaccaacacaaucauagacgucguacucuccccaucccacggcaucgaacuauccgucggcgaaaaacucguccuuaacugcacugcccgaaccgaacucaacgucggcaucgacuucaacugggaauaccccuccagcaaacaccaacacaagaaacucguaaaccgcgaccugaaaacccaaagcggcucagagaugaagaaauuccuauccacacuaaccaucgacggcguaacccgauccgaccaaggccuauacacaugcgccgccuccuccggucucaugaccaagaaaaacuccacauucguaagaguccacgaaaaagacaaaacccacacaugcccacccugccccgcccccgaacuacucggcggccccuccgucuuccucuucccacccaaacccaaagacacccucaugaucagcagaaccccagaaguaaccugcgucgucgucgacgucucccacgaagaccccgaagucaaauucaacugguacgucgacggaguagaaguacacaacgcgaaaacaaaaccccgcgaagaacaauacaacucaacauaccgcguagucaguguacucaccguccuccaccaagacuggcucaacggcaaagaauacaaaugcaaaguauccaacaaagcacuccccgcccccaucgagaaaaccauaucaaaagccaaaggccaaccccgcgaaccccaagucuacacacuaccucccucccgagacgaacuaaccaaaaaccaaguaucccucaccugucucgucaaaggcuucuaccccuccgacaucgcagucgaaugggaaucaaacggacaacccgaaaacaacuacaaaaccacaccucccguccucgacucugacggcucauucuuccucuacucaaaacucacagucgacaaaucacgcuggcaacaaggcaacgucuucuccugcagcgucaugcacgaagcccuacacaaccacuauacccaaaaaucccucucgcuaucccccggc

SEQ ID NO: 53514 - RNA, 1332 nt, Artificial Sequence
  derived and/or modified sequence opt11 from Afutuzuab_HeavyChain1
caaguccaauuaguacaauccggcgcugaagucaagaaacccggcucaagugucaaagucuccugcaaagccucaggcuacgccuucucauacucuuggaucaacuggguacgccaagcacccggacaaggccucgaauggggccgcauauucccuggcgacggcgacacagacuacaacggaaaauucaaaggccgugucacaaucaccgccgacaaaagcacauccacagccuacgaacucuccucacuccgcucagaagacacagccgucuacuacugugcccgaaacgucuucgacggauacuggcucgucuacuggggccaaggcacccucguuacggucucauccgccuccaccaaaggccccuccguauucccccucgcccccucauccaaauccaccucaggcggcacagccgcccucggcugccuuguaaaagacuacuucccagagccagucaccguaucauggaacuccggcgcacucacaagcggaguccacacauuccccgccguacuccaauccucaggccuauauagccucagcucugucgucaccgucccauccucgucccuaggcacacaaacauacaucugcaaugucaaccacaaacccuccaauaccaaaguagauaagaaaguugaacccaaaucaugcgacaaaacccacaccuguccacccugccccgcccccgagcuccucggcggccccuccgucuuccuauucccacccaaacccaaagacacccucauuucccgaacccccgaaguuaccugcgucgucgucgacgucagccacgaagaccccgaaguaaaauucaacugguacgucgacggcgucgaaguccacaacgccaaaacaaaaccccgcgaagaacaauacaacucaaccuaccgcgucgucagcguucucaccguccuccaccaagacuggcuaaacggaaaagaauauaaaugcaaagucucaaacaaagcccuacccgccccuaucgagaaaacaaucucaaaagccaaaggacaaccccgcgaaccccaagucuauacacucccucccucccgggacgaacuuaccaaaaaccaagucagccuaaccugccucgucaaagguuucuaccccucagacaucgccguugaaugggaauccaacggccaacccgaaaacaacuacaaaaccacaccucccguacucgacuccgacggcucauucuuccucuacucaaaacucacuguggacaaaucucgauggcaacaaggaaacgucuucuccugcuccguccacgaagcccuucacaaccacuacacccaaaaaucccuuucccucucacccgga

SEQ ID NO: 53515 - RNA, 651 nt, Artificial Sequence
  derived and/or modified sequence opt11 from Afutuzuab_LightChain1
gacaucgucacccaaacaccccucucccuacccgucacccccggcgaacccgccuccaucuccugccgcuccuccaaaucccuacuccacuccaacggcaucaccuaccucuacugguaccuccaaaaacccggccaaagcccccaacuccucaucuaccaaucaaaccuagucucuggcguccccgaccgcuucuccggcucuggauccggcaccgacuucacccucaaaaucucccgcgucgaagccgaagacguaggcgucuacuacugcgcccaaaaccuagaacuccccuacaccuucggcggcggcaccaaagucgaaaucaaacgcaccgucgccgcccccuccgucuucaucuucccacccuccgacgaacaacuaaaauccggcaccgcauccgucgucugccuccucaacaacuucuacccccgcgaagccaaaguccaauggaaagucgacaacgcccuccaauccggcaacucccaagaauccgucaccgaacaagacuccaaagacucaaccuauucucucuccucaacccucacccucuccaaagccgacuacgaaaaacacaaagucuacgccugcgaaguaacccaccaaggccuauccucccccgucaccaaauccuucaaccgcggcgaaugc

SEQ ID NO: 53516 - RNA, 1347 nt, Artificial Sequence
  derived and/or modified sequence opt11 from Afutuzumab_HeavyChain1
caaguccaacucguacaauccggcgccgaagucaagaaacccggcuccuccgucaaaguauccugcaaagccuccggauacgccuucuccuacagcuggaucaacuggguccgccaggccccaggacaagggcucgaauggaugggaagaaucuuccccggcgacggagacaccgacuacaacggcaaauucaaaggacgaguuaccaucacagccgacaaauccaccuccacagccuacauggaacucuccucccuccgcucagaagacaccgccguauauuacugcgcccguaacgucuucgacggcuacuggcuagucuacuggggccaaggcacccucgucacagucagcuccgccucaaccaaaggcccgucaguauucccccucgcccccuccucaaaaagcacaucuggcggaaccgccgcccucggcugccucgucaaagacuacuuccccgaacccguaaccguauccuggaacuccggcgcgcuaacauccggcguacacaccuuccccgcgguccuccagucauccggacucuacucccuaucaagcguagucaccgugcccuccuccucccuaggcacacaaaccuacauaugcaacgucaaucacaaaccguccaacaccaaaguagacaagaaagucgaacccaaauccugcgacaaaacacacacaugcccacccugccccgcccccgaacuccucggcggcccguccguauuccucuucccucccaaacccaaagacacccucaugauauccagaacgcccgaagucacaugcgucguagucgacgucagccacgaagacccggaagucaaauucaauugguacguagacggcgucgaaguacacaacgccaaaacuaaaccccgcgaagaacaguauaacuccaccuaccgcguagucuccguccuaaccguccuacaccaagacuggcucaacggaaaagaauacaaaugcaaagucuccaacaaagcacuacccgcacccauagagaaaaccauaucgaaagccaaaggacagccccgcgaaccccaagucuacacccucccaccauccagagacgaacucaccaaaaaccaaguaucccuaaccugccuaguuaaaggauucuaccccucagacaucgcaguagaaugggaauccaacggacaacccgaaaacaacuacaaaaccaccccacccguacucgacuccgacggaucauucuuccuauacagcaaacucaccgucgacaaaagccgauggcaacaaggcaacguauucucaugcuccgucaugcacgaagcacuccacaaccacuauacacaaaaaucccucucacucucccccggaaaa

SEQ ID NO: 53517 - RNA, 657 nt, Artificial Sequence
  derived and/or modified sequence opt11 from Afutuzumab_LightChain1
gacaucgucaugacccagacaccccucucccuacccgucacccccggagaacccgccucaaucuccugccgcuccuccaaaucacuccuccacuccaacggaaucaccuaccuauacugguaccuccaaaaacccggccaaucuccccaacuccugaucuaccaaauguccaaccucgucuccggcguccccgaccgcuucuccggcuccggcuccggcaccgacuucacccucaaaaucucccgagucgaagccgaagacguaggagucuacuacugcgcucaaaaccucgaacuccccuacaccuucggcggcggcaccaaagucgaaaucaaacgcacagucgccgccccauccgucuucaucuucccacccucagacgaacaacucaaauccggcaccgccuccgucguaugccuccucaacaacuucuacccccgagaagccaaaguccaauggaaagucgacaacgcccuccaaagcggcaacucacaagaauccgucaccgaacaagacagcaaagacuccaccuacucccucuccuccacacucacccuauccaaagccgacuacgaaaaacacaaaguauacgccugcgaagucacccaccaaggccuauccucccccgucaccaaauccuucaaccgcggcgaaugc

SEQ ID NO: 53518 - RNA, 684 nt, Artificial Sequence
  derived and/or modified sequence opt11 from Alacizumab_pegol_HeavyChain1
gaaguccaacuuguagaauccggcgguggucucguccaacccggcggcucccuccgccucuccugcgcagcaucaggcuucaccuucuccuccuacggcauguccuggguccgacaggcccccggcaaaggccucgaauggguagccaccaucaccuccggaggcuccuacaccuacuacgucgacuccguaaaaggccgcuucaccaucucacgcgacaacgccaaaaacacccucuaccuacaaaugaacucccuccgcgccgaagacaccgccguauacuacugcguacgcaucggcgaagacgcacucgacuauuggggccaaggcacccuugucaccgucuccucagccucuaccaaaggccccucuguauucccccucgcccccucauccaaauccaccucaggcggaaccgccgcccucggcugccucgucaaagacuacuuccccgaacccgucaccgucucauggaacucaggcgcccuuaccuccggcguccacaccuuccccgccguccuccaauccucaggccucuacucucucuccuccgucgucaccguccccuccuccucccucggcacccaaaccuacaucugcaacgucaaccacaaacccuccaacaccaaagucgacaagaaagucgaacccaaaucuugcgacaaaacccacacaugcgccgcc

SEQ ID NO: 53519 - RNA, 642 nt, Artificial Sequence
  derived and/or modified sequence opt11 from Alacizumab_pegol_LightChain1
gacauccaaaugacccaaucucccucaucccucuccgccuccguaggcgaccgagucacaaucaccugccgcgccucccaagacaucgccggcucccucaacuggcuccaacaaaaacccggcaaagccaucaaacgccucaucuacgccaccuccucccucgacucaggcguccccaaacgcuucuccggcucucgcuccggaucugacuacacccucaccaucuccucccuucaacccgaagacuucgccaccuacuacugccuccaauacggcucauucccccccaccuucggccaaggaaccaaagucgaaaucaaacgcaccgucgccgcccccuccgucuucaucuucccccccuccgacgaacaacucaaauccggcaccgcauccguagucugccuccucaacaacuucuacccccgcgaagccaaaguccaauggaaagucgacaacgcccuccaaucuggcaacucccaagaaagcguuaccgaacaagacuccaaagacuccaccuacucccuauccuccacacucacccucuccaaagcagacuacgaaaaacacaaagucuacgccugcgaagucacacaccaaggccucuccucccccgucaccaaauccuucaaccgcggcgaaugc

SEQ ID NO: 53520 - RNA, 1353 nt, Artificial Sequence
  derived and/or modified sequence opt11 from Alemtuzumab_HeavyChain
caaguccaacuacaggaauccggacccggccucguccgacccucacaaacacucagccugaccuguaccgucuccggcuucaccuucacagacuucuacaugaacuggguacgacaaccacccggccgcggacuagaauggaucggcuucauacgcgacaaagcaaaaggcuacacaacagaauauaaccccuccgucaaaggccgcgucacaaugcucgucgacaccuccaaaaaccaauucucccuucgccuaucaucuguaaccgccgccgacacagcagucuacuacugcgcccgagaaggacacaccgccgcacccuucgacuacuggggccaaggaagccuagucacagucucaucagcaagcacuaaaggccccuccgucuucccccucgcccccuccagcaaaucaaccucaggcggcaccgccgcccuaggcugccucgucaaagauuacuuccccgaaccugucaccgucuccuggaacuccggagcccucacauccggcguccacaccuuccccgccguccuacaguccucaggccuauacucccucuccuccguaguaaccguccccuccuccucccuaggaacacaaaccuacaucugcaauguaaaccacaaacccuccaacacaaaagucgacaagaaagucgaacccaaaucuugcgacaaaacccacacaugcccgcccugccccgcgcccgaauuacuuggcggccccucugucuuccucuucccucccaaacccaaagacacacucaugauaagccgaacacccgaagucacaugcgucgucguagacgucucccacgaagaccccgaaguuaaguucaauugguacguagacggcgucgaaguccacaacgccaaaacaaagccucgcgaagaacaauacaacucaaccuaccgaguagucuccguccucaccguacuccaccaagacuggcuaaauggcaaagaauacaaaugcaaggucuccaacaaggcccucccagccccaaucgaaaagaccaucucaaaagccaaaggccaacccagagaaccccaagucuacacccuuccaccaucacgcgacgaauuaaccaaaaaccaaguaucacuaaccugccucgucaaagguuuuuaccccuccgacaucgcagucgaaugggaauccaauggccaacccgaaaacaacuacaaaacaaccccucccguucucgacagugauggcagcuucuuccucuacuccaaacucaccguagacaaaucccgcuggcaacaaggaaacguauucuccugcuccgucaugcacgaagcacuccacaaccauuacacucagaaaucccucucccucucccccggaaaa

SEQ ID NO: 53521 - RNA, 657 nt, Artificial Sequence
  derived and/or modified sequence opt11 from Alemtuzumab_HeavyChain_variant_1bey_H
caaguccaacuccaagaauccggccccggacuuguacgccccucccaaacccucucccucaccugcaccgucuccggcuucaccuucaccgacuucuacaugaacuggguccgccaaccacccggccguggucucgaauggaucggcuucauccgagacaaagccaaaggcuacaccaccgaguacaaccccucagucaaaggccgagucaccaugcuagucgacaccuccaaaaaccaauucucccuacgccucuccuccguaaccgccgccgacaccgccgucuacuacugcgcccgcgaaggccacaccgccgcccccuucgacuauuggggacaaggcucacuagucacaguauccuccgccuccaccaaaggacccucagucuucccccucgcccccuccuccaaaucaaccucaggcggcaccgccgcccuaggcugccuagucaaagacuacuucccagaacccgucaccgucucauggaacucaggagcccucaccuccggcguucacacauuccccgccguccuccaauccuccggccucuacucccucucauccgucgucaccguccccuccuccucccucggcacccaaaccuacaucugcaacgucaaccacaaacccuccaacaccaaagucgacaaaaaagua

SEQ ID NO: 53522 - RNA, 660 nt, Artificial Sequence
  derived and/or modified sequence opt11 from Alemtuzumab_HeavyChain_variant_1ce1_H
caaguccaacuacaagaauccggccccggacucgucagacccucccaaacccucucccugaccugcaccgucuccggcuucaccuucaccgacuucuacaugaacuggguccgccaaccccccggccgcggccucgaauggaucggcuucauacgcgacaaagccaaaggcuacacaaccgaauacaaccccuccgucaaaggccgaguaaccaugcucgucgacaccuccaaaaaccaauucucccuccgucucuccuccgucacagccgccgacaccgccgucuacuacugcgcccgagaaggucacaccgccgcccccuucgacuacuggggccaaggcagccucgucaccgucuccuccgcauccaccaaaggccccuccguauucccccucgcccccucauccaaaucaaccucuggcggcaccgccgcccuuggcugccucgucaaagacuacuucccagaacccgucaccgucucauggaacuccggcgcccucaccuccggcguccacaccuuccccgccguacuccaauccuccggccucuacucccucuccucugucgucaccguccccucaucaucccucggcacccaaaccuacaucugcaacgucaaccacaaaccaucaaacacaaaagucgacaaaaaagucgaa

SEQ ID NO: 53523 - RNA, 1311 nt, Artificial Sequence
  derived and/or modified sequence opt11 from Alemtuzumab_HeavyChain_variant_8005_H
caaguccaacuccaagaaucaggcccaggccucguccgacccucccaaacccucucccuaaccuguacugucuccggauucacauucaccgacuucuacaugaauuggguccgacaaccacccggccgcggccucgaauggaucggauucaucagggacaaagccaaaggauacacaaccgaauacaaccccuccguaaaaggacgaguaaccaugcucgucgacacuagcaaaaaccaauucucccuccgccucuccagcgucaccgccgccgacaccgcaguauacuacugcgcucgcgaaggccacaccgccgcacccuucgacuacuggggccaaggaucccucgucaccgucucauccgccuccacuaagggaccaucaguguucccacucgcccccagcuccaaaucuaccuccggcggcaccgccgcccucggcugccucguaaaagacuacuuccccgaacccguaacagucuccuggaacucaggagcccucacaagcggcguccacacuuucccagcagucuuacaguccuccggccucuauagccucagcuccgucgucaccguccccucauccucccucggcacucaaacuuacaucugcaauguaaaccacaaacccagcaacacuaaagucgacaagaaagucgaagcccccgaacuacucggaggccccagcgucuuccucuuucccccaaaacccaaagacacccucaugaucucccgcacccccgaaguuaccugcgucgucguugacgucucacacgaagaccccgaaguaaaauucaacugguacgucgacggcgucgaaguccacaacgcaaaaaccaaaccccgagaagaacaauacaacuccaccuaccgcgucgucucaguccucaccguacuacaccaagacuggcucaacggcaaagaauacaaaugcaaaguauccaacaaagcccucccagcaccaaucgaaaagaccaucucgaaagccaaaggacaaccacgugaaccacaaguauacacccucccacccucacgugacgaacucaccaaaaaccaaguaucccuaacaugccuagucaaaggcuucuaccccucagacaucgccguagaaugggaauccaacggccaacccgaaaacaacuacaaaaccaccccacccguucucgacuccgacggcuccuucuuccucuacucuaaacucaccgucgacaagucaagauggcaacaaggaaacgucuucuccugcagcgucaugcacgaagcacuccacaaccacuacacccagaaaucacucucacucucacccggaaaa

SEQ ID NO: 53524 - RNA, 633 nt, Artificial Sequence
  derived and/or modified sequence opt11 from Alemtuzumab_LightChain
gacauccaaaugacccaaucacccucaucacucucagccuccgucggcgaccgcgucaccauaaccugcaaagccucccaaaacaucgacaaauaccucaacugguaccaacaaaaacccggcaaagcccccaaacuccuaaucuacaacaccaacaaccuccaaaccggcguccccucccgcuucuccggauccggcucaggcaccgacuucaccuucaccaucuccucccuccagcccgaagacaucgccaccuacuacugccuacaacacaucucccgcccccgcaccuucggccaaggcaccaaagucgagaucaaacggaccgucgcagcccccuccgucuucaucuucccacccuccgacgaacaacucaaaucaggcacagcauccgucgucugccuccucaacaacuucuacccccgggaagccaaaguccaauggaaagucgacaacgcccuccaaucaggcaacucccaagaauccgucacagaacaagacuccaaagacuccaccuacucccucuccuccacccucacccucuccaaagccgacuacgaaaaacacaaagucuacgccugcgaagucacacaccaaggccucuccucccccgucaccaaauccuucaaccgc

SEQ ID NO: 53525 - RNA, 642 nt, Artificial Sequence
  derived and/or modified sequence opt11 from Alemtuzumab_LightChain_variant_8005_L
gacauccaaaugacccaaucccccucaucccucuccgccuccgucggcgaccgcgucaccauuaccugcaaagccucacaaaacaucgacaaauaccucaacugguaccaacaaaaacccggcaaagcccccaaacuccucaucuacaacaccaacaaccuccaaaccggcguccccucccgcuucuccggcucaggcucaggcaccgacuucaccuucaccaucuccucccuccaacccgaagacaucgccaccuacuacugucuccaacacaucucccgcccccgaaccuucggccaaggcaccaaagucgaaaucaaacgcaccgucgccgcccccuccgucuucaucuucccucccuccgacgaacaacucaaaucaggcaccgccucagucguaugccuacuaaacaacuucuacccccgcgaagccaaaguccaauggaaagucgacaacgcccuccaauccggaaacucccaagaaagcgucaccgaacaagacuccaaagacuccaccuacucccuuuccucaacccucacccucuccaaagccgacuacgaaaaacacaaagucuacgccugcgaagucacccaccaaggccucuccucccccgucaccaaauccuucaaccgcggcgaaugc

SEQ ID NO: 53526 - RNA, 1341 nt, Artificial Sequence
  derived and/or modified sequence opt11 from Alirocumab_HeavyChain1
gaaguccaacucgucgaauccggcgggggacucguccaacccggcggaucccuccgccucuccugcgccgcaucaggcuucacuuucaacaacuacgccaugaacuggguacgccaagcacccggcaaaggacuagacugggucuccaccaucuccggauccggcgguacaaccaacuacgccgacuccguaaaaggccgcuucaucauuucccgcgacuccuccaaacacacccucuaccuccaaaugaacucacuacgcgccgaagacacagccguauacuacugcgccaaagacuccaacuggggcaacuucgaccuauggggccgcggcacccucguuaccgucuccucugcauccacaaaaggacccuccgucuuuccacucgccccaagcuccaaauccaccucaggcggcaccgccgcucucggaugccucgucaaagacuauuucccggaacccguaaccgucucauggaacucaggcgcccuaacaucaggcguccacaccuucccagccguccuccagucaucaggccuauacucccuaucauccguagucaccguccccuccuccagccuaggcacccaaaccuacauaugcaacgucaaucacaaacccuccaacaccaaagucgauaagaaagucgaacccaaauccugcgacaaaacccauaccugcccucccugcccagcccccgaacuccuaggcggcccauccgucuuccucuucccacccaaacccaaagacacacucaugaucucccgcacccccgaaguuaccugcgucgucgucgacgucucgcacgaagaccccgaaguaaaauucaacugguacgucgauggcgucgaaguccacaacgcgaaaaccaaaccgcgagaagaacaauacaacagcaccuaccgaguaguauccgucuuaacaguccuacaccaagacuggcucaacggcaaagaauacaaaugcaaagucucuaacaaagcucuacccgccccaaucgagaaaaccauuuccaaagcgaaaggccaaccccgcgaaccccaggucuacacccuaccgcccucccgugacgaacuaaccaaaaaccaaguaucccuaaccugccucguaaaaggauucuaccccagcgauaucgccguagaaugggaauccaacggacaacccgaaaacaauuacaaaaccaccccacccguacucgacuccgacggcucauucuuccucuacagcaaacucaccgucgacaaaucccgauggcagcaaggcaacgucuucuccugcucagucaugcacgaagcccuccacaaccacuacacucaaaagucccuaagccuaucccccgga

SEQ ID NO: 53527 - RNA, 660 nt, Artificial Sequence
  derived and/or modified sequence opt11 from Alirocumab_LightChain1
gacaucgucaugacccaaucccccgacagccucgccgucucccucggcgaacgcgccaccaucaacugcaaauccucccaauccguccucuaccgcucaaacaaccgcaacuuccucggcugguaccaacaaaaacccggccaaccacccaaccuccuaaucuacugggcauccacccgcgaauccggcguccccgaccgcuucuccggcuccggcuccggcaccgacuucacccuaaccaucuccucccuacaagccgaagacgucgccguauacuacugccaacaauacuacaccacccccuacaccuucggucaaggcaccaaacucgaaaucaaacgcaccgucgccgcccccuccguauucaucuucccccccuccgacgaacaacucaaauccggaaccgccuccgucgucugccuccucaacaacuucuacccccgcgaagccaaaguccaauggaaagucgacaacgcccuccaauccggcaacucccaagaauccgucaccgaacaagacuccaaagacuccaccuacucccucuccucaacccuaacccuauccaaagcagacuacgaaaaacacaaagucuacgccugcgaagucacccaccaaggccuauccucacccgucaccaaauccuucaaccgcggcgaaugc

SEQ ID NO: 53528 - RNA, 735 nt, Artificial Sequence
  derived and/or modified sequence opt11 from ALX-0061_HeavyChain1
gagguacagcugguggaaagcgggggagggcugguacagccgggagggagccugaggcugagcugcgcggcgagcgggaguguauucaagauaaacgugauggcaugguaccggcaagcaccaggaaaagggagagaguugguggcagggauaauaagcggagggagcacgagcuacgcagacagcgugaaggggagguucacaauaagcagggacaaugcgaagaacacgcuguaccuacagaugaacagccugaggccggaggacacagcgguguacuacugcgcguucauaacgacggagagcgacuacgaucuggggagaagguacugggggcaggggacgcuggugacggugagcagugggggaggagggagcgggggagggagcgaggugcagcugguggagagugggggagggcugguacagccggggaauagccugaggcugagcugcgcagcaaguggguucacauucagcagcuucgggaugucgugggugagacaagcgccggggaagggguuagaaugggugagcagcauaagugggagcgggagcgacacgcuguacgcggacagcgugaaggggcgguucacgauaagcagggacaacgcaaagacaacgcuguaccugcagaugaacagccugaggccggaggacacggcaguguacuacugcacgauaggagggagucugagcaggagcagccaagggacacugguaacagugagcagc

SEQ ID NO: 53529 - RNA, 1347 nt, Artificial Sequence
  derived and/or modified sequence opt11 from Amatuximab_HeavyChain1
caaguccaacuacaacaaucuggacccgaacucgagaaacccggcgccucagucaaaaucuccugcaaagccuccggauacuccuucacaggauauacuaugaacugggucaaacaaucccacggcaaaagccuggaauggaucggccuaaucacccccuacaacggcgccucaucauacaaccagaaauuccgcggcaaagcaacccucaccgucgacaaauccuccuccaccgccuacauggaccuucucagccuuaccucagaagacuccgccgucuacuucugcgcccggggcggcuacgacggccguggcuucgacuacuggggcucaggcacccccguaacugucucaagcgccucaaccaaaggacccuccgucuucccacuugcacccuccucuaaauccacuucaggcggcaccgcagcccuuggcugccucgucaaggacuacuucccagaacccguaaccguaucuuggaacuccggugcccucacaucuggaguacauaccuuccccgcaguacuccaauccuccggccuauacucacucucguccguagucaccguacccuccuccucacucggaacccagacauacaucugcaacgucaaccacaaacccuccaacaccaaagucgacaaaaaggucgaacccaaauccugcgacaaaacucacacauguccaccaugcccagcccccgaacuacucggcggucccuccgucuuccucuucccacccaaacccaaagacacacucaugaucucccguacaccagaaguaaccugcgucgucguagacguaucccacgaagacccugaaguaaaguucaacugguacgucgacggcgucgaaguccacaacgccaaaaccaaaccccgcgaagaacaauacaacucaaccuaucgcgucgucucuguccucaccguccuccaccaagacuggcucaacggcaaggaauacaaaugcaaagucucgaacaaagcccuccccgcacccauagagaaaaccaucuccaaagccaaaggucaaccccgcgaaccccaagucuacacacucccucccucacgcgacgaacucaccaaaaaccaagucucccuuaccugcuuaguuaagggcuuuuaccccuccgacauugccgucgaaugggaauccaacggccaacccgaaaacaauuacaaaacaacaccacccguccuagacuccgacggauccuucuuccuauacuccaaacuaacagucgacaaaucaagauggcaacaaggcaacguauucuccugcuccgucaugcacgaagcccuacacaaccacuacacccagaaaucccucucccucagccccggcaaa

SEQ ID NO: 53530 - RNA, 639 nt, Artificial Sequence
  derived and/or modified sequence opt11 from Amatuximab_LightChain1
gacaucgaacucacccaaagcccagccaucauguccgccucccccggagaaaaagucaccaugaccugcucagccuccagcuccgucuccuacaugcacugguaccagcaaaaaucuggcaccucccccaaacgcuggaucuacgacaccucaaaacucgccuccggcguccccggccgcuucuccggcucaggcucaggcaacucauacucccucaccaucuccuccgucgaagccgaagacgacgccaccuacuacugccaacaaugguccaaacacccccucaccuucggcagcggcaccaaagucgaaaucaaacgaaccgucgccgcccccuccguauucaucuucccacccuccgacgaacaacuaaaauccggcaccgccucagucgucugcuuacucaacaacuucuacccccgcgaagccaaaguccaauggaaagucgacaacgcccuccaauccggcaacucccaagaauccgucaccgaacaagacuccaaggacuccaccuacucacucuccuccacccucacccucuccaaagccgacuacgaaaaacacaaagucuacgcaugcgaagucacacaccaaggccucuccucccccgucaccaaauccuucaaccgaggcgaaugc

SEQ ID NO: 53531 - RNA, 1350 nt, Artificial Sequence
  derived and/or modified sequence opt11 from Anetumab_ravtansine_HeavyChain1
caagucgaacucguacaauccggagccgaaguaaagaaacccggcgaaucccucaaaaucuccugcaaaggcucaggauacuccuucaccucuuacuggaucggguggguacgccaagcacccggcaaaggucuagaauggaugggcauaauagaccccggagacucacgaacacgcuacucaccauccuuccaagggcaagucaccaucagugcagacaaaagcaucucaacagccuaccuacaauggucaucacuaaaagcauccgacaccgcgauguacuacugcgcccgaggccaacuguacggcggcaccuacauggacggauggggacaaggcacccucguuaccgucucauccgcauccaccaaaggaccuuccgucuucccacuugcccccuccagcaaaucaaccagcggcggcaccgccgcacuaggaugccucgucaaagacuacuucccggaacccguaaccgucucauggaacuccggagcccucacauccggaguccacaccuucccagcaguccuccaauccucaggccuauacucacucuccucagucgucaccguucccuccuccucccuuggcacccaaaccuacaucugcaacgucaaccacaaacccuccaacaccaaagucgacaagaaagucgaacccaaaucuugcgacaaaacucacacaugcccacccugccccgcacccgaacuccucgguggcccauccgucuuucucuuuccacccaaacccaaagacacucuaaugauaucccgcacccccgaagucacaugcgucguagucgacgucucccacgaagaccccgaagucaaauucaacugguaugucgacggcguagaaguccacaacgccaaaacaaaaccccgcgaagaacaauacaacuccaccuaccgcguaguaagcgugcuaaccguccuccaccaagacuggcucaacggcaaagaguacaaaugcaaaguauccaauaaagcccuacccgccccaaucgagaaaacgauauccaaagcaaaaggccaaccacgagaaccccaagucuacacccuaccacccucccgcgacgaacucaccaaaaaccaaguaucccuaaccugccuagucaaaggauucuaccccagcgacaucgccguagaaugggaauccaacggccaacccgaaaacaacuacaaaaccaccccacccguacuagacagcgacggaucauucuuccucuacuccaaacugacagucgacaaaucccgcuggcaacaaggcaacguauucucauguuccgucaugcacgaagcccuacacaaccacuacacacaaaaaucccucucccuaucacccggaaaa

SEQ ID NO: 53532 - RNA, 651 nt, Artificial Sequence
  derived and/or modified sequence opt11 from Anetumab_ravtansine_LightChain1
gacaucgcccucacacaacccgcuuccgucuccggcucucccggccaauccaucacaaucuccugcaccggcaccuccuccgacaucggcggcuacaacuccgucuccugguaccaacaacacccaggcaaagcccccaaacucaugaucuacggcgucaacaaccgacccuccggcgucuccaaccgcuucuccggcuccaaauccggaaacaccgccucccucaccaucuccggccuccaagccgaagacgaagccgacuacuacugcuccuccuacgacaucgaauccgcaacccccgucuucggcggcggcacaaaacuaaccguccuaggccaacccaaagccgccccauccgucacacuauucccccccuccuccgaagaacuccaagccaacaaagccacccucgucugccucaucucagacuucuaccccggcgcagucaccgucgccuggaaaggcgacuccucacccgucaaagccggcgucgaaaccaccacccccuccaaacaauccaacaacaaauacgccgccucauccuaccucucccuaacccccgaacaauggaaaucccaccgauccuacuccugccaagucacccacgaaggcuccaccgucgaaaaaaccgucgcccccaccgaaugcucc

SEQ ID NO: 53533 - RNA, 1341 nt, Artificial Sequence
  derived and/or modified sequence opt11 from Anifrolumab_HeavyChain1
gaaguacaacucguccaauccggcgccgaagucaaaaagcccggcgaaucucucaaaauaucaugcaagggcuccggcuacaucuucaccaauuacuggauagcauggguccgccaaaugccaggcaaaggacucgaaucgaugggcaucaucuacccaggcgauagcgacauccgcuacucacccucauuccaaggacaaguaaccauaucugcagacaaaucaaucaccacugcauaccuccaaugguccagucucaaagcauccgacaccgccauguacuacugcgcccgccacgacaucgaaggcuucgacuacuggggaaggggcacccucgucaccgucuccucagccucaaccaaagguccauccguuuucccacuggcgccauccuccaaauccaccucaggcggcacggccgcccucgggugccuagucaaagacuacuuccccgaacccgucaccgucucuuggaacuccggcgcccucaccuccggcguccacaccuucccagccguccuccaaagcuccggacucuacucccucuccuccguagucacggucccaagcucaucucucggcacccagaccuacaucugcaacgucaaccacaaacccuccaacaccaaagucgacaaacgcguagaacccaaaucuugcgacaaaacccacaccuguccacccugccccgcccccgaauuugaaggcggucccuccguauuccucuucccacccaaacccaaagacacccucaugaucucccgcacccccgaaguaaccugcgucgucgucgacgucucacaugaagaccccgaaguaaaauucaacugguacguagacggaguagaaguccacaacgcaaagaccaaaccacgcgaagaacaauacaacuccaccuaccgcgucgucuccguccucacuguccuacaccaagacuggcuaaacggcaaagaauacaaaugcaaagucagcaacaaggcccuccccgccuccauagagaaaacaaucucaaaagccaaaggccaaccacgugaaccccaaguauacacccuacccccaagccgagaagaaaugaccaaaaaccaagugucccuaaccugccuuguaaaaggcuucuaccccagcgacaucgccguugaaugggaaucgaacggccaacccgaaaacaacuacaaaaccaccccacccguccucgacucagacggcuccuucuucuuauacuccaaacuaaccgucgauaaaucccgcuggcaacaaggcaacgucuucucaugcucugucaugcacgaagcccuccacaaccauuacacucaaaaaucccuaucccucucacccggcaaa

SEQ ID NO: 53534 - RNA, 645 nt, Artificial Sequence
  derived and/or modified sequence opt11 from Anifrolumab_LightChain1
gaaaucguccucacacaaucccccggcacccucucccucucccccggcgaacgcgccaccuuauccugccgcgccucccaauccguaucauccuccuucuucgcaugguaccaacaaaaacccggccaagcuccccgucuccucaucuacggcgccucaucccgcgccaccggcauccccgaccgccucuccggcucuggcucaggcaccgacuucacccucaccaucacccgccucgaacccgaagacuucgccgucuacuacugccaacaauacgacuccuccgccaucaccuucggccaaggcacccgccucgaaaucaaacgcaccgucgccgcccccuccguauucaucuucccacccuccgacgaacaacuaaaauccggcaccgccucagucgucugccuccucaacaacuucuacccccgcgaagccaaaguccaauggaaagucgacaacgcccuccaauccggcaacucacaagaauccgucaccgaacaagacuccaaagacuccaccuacucccucuccucaacccucacccucuccaaagccgacuacgaaaaacacaaagucuacgccugcgaaguaacccaccaaggccucuccucccccgucaccaaauccuucaaccgcggcgaaugc

SEQ ID NO: 53535 - RNA, 1344 nt, Artificial Sequence
  derived and/or modified sequence opt11 from Anrukinzumab_HeavyChain1
gaaguccagcuagucgaauccggcggaggccucguccaacccggcggcucccuccgccuauccugcgccgccagcggcuucaccuucauaucauacgcaauguccuggguucgccaagccccaggcaagggccuugaaugggucgccagcaucuccucaggcggaaacaccuacuacccagacucagucaaaggccgcuucacaaucagccgcgacaacgccaaaaacagccuauaccuccaaaugaacucccuacgcgccgaagacaccgccgucuauuacugcgcacgccucgacggcuacuacuucggcuucgcauacuggggccaaggcacccucgucaccguaucuuccgcguccaccaaaggcccauccgucuucccccuagcccccucaucaaaaaguaccucaggaggaaccgcagcccucggaugccucguaaaagacuacuucccugaacccgucaccgucuccuggaacucuggcgccuuaacaagcggcguccauacauuccccgccguccuucaaucaucuggccucuacucacucucauccgucgucacagucccauccagcucacucggcacccaaacauacaucugcaacguaaaccacaaaccaucgaacaccaagguagacaagaaagucgaacccaaaucaugcgacaaaacccacacaugucccccaugccccgcaccagaagcccucggcgccccaagcgucuuccuauucccacccaaaccuaaagacacccucaugaucucaaggacccccgaagucacgugcguagucguagacgucucacacgaagaccccgaagucaaauucaacugguacguagacggagucgaaguccacaacgcaaaaacaaaacccagagaagaacaauacaacuccaccuaccgaguaguauccguccucaccguacuccaccaagacuggcucaacggcaaagaauacaaaugcaaaguauccaacaaagcccuccccgcacccaucgagaaaaccaucuccaaagcaaaaggccaaccccgcgaaccccaagucuacacccuaccacccucacgugaagaaaugaccaaaaaccaagucucacuuacuugccucguaaaaggcuucuacccaucagacaucgcaguagaaugggaauccaacggccaaccagaaaacaacuacaaaacaaccccacccguacuagacucagacggcuccuucuuccucuacuccaaacuuaccguagacaagucacgauggcaacaaggcaacguuuucagcugcuccgucaugcacgaagcacuacacaaccacuacacccaaaaaucccucucccuaucacccggaaaa

SEQ ID NO: 53536 - RNA, 654 nt, Artificial Sequence
  derived and/or modified sequence opt11 from Anrukinzumab_LightChain1
gacauccaaaugacccaaagccccuccucccucuccgccuccguaggcgaccgcgucaccauaaccugcaaagccuccgaauccguagacaacuacggcaaaucccucaugcacugguaccaacaaaaacccggcaaagcccccaaacuccuaaucuaccgcgcauccaaccuagaauccggcgucccaucccgguucucgggcuccggcucaggcaccgacuucacccuaaccaucuccucccuccaacccgaagacuucgccaccuacuacugccagcaaucaaacgaagaccccuggaccuucggaggcggcaccaaagucgaaauaaaacgcaccgucgccgcccccagcgucuucaucuucccacccuccgacgaacaacuaaaauccggcaccgccuccgucgucugccuacucaacaacuucuacccccgcgaagccaaaguccaauggaaagucgacaacgcgcuccaauccggcaacucacaagaauccgucaccgaacaagacagcaaagacuccaccuacucccuaagcuccacccugacccuaagcaaagccgacuacgaaaaacacaaaguauacgccugcgaagucacccaccaaggccucuccucacccgucaccaaauccuucaacagaggcgaaugc

SEQ ID NO: 53537 - RNA, 1338 nt, Artificial Sequence
  derived and/or modified sequence opt11 from Apolizumab_HeavyChain1
caaguacaacuacaagaauccggccccggccucgucaaacccuccgaaacccucucacuaaccugcacaguaucaggcuucagccucaccaacuauggcguacacuggguccgacaaucaccgggcaaaggacucgaguggaucggugucaaaugguccggaggcuccaccgaauauaacgccgccuucaucagcagacuaaccaucuccaaggacacguccaaaaaccaagucucccucaaacucaacucccuaacagccgcagacaccgccguauacuacugcgcacgcaacgaccgcuacgccauggacuacuggggccaaggcacccuaguaacugucucauccgccuccacuaaaggcccuuccgucuucccacuagcgcccuccagcaaauccaccuccggcggcacagccgcacucggcugccuaguaaaagacuacuuccccgagcccgucacagucuccuggaacucuggcgcgcucacaucuggcguccacaccuuuccagccguccuacaauccucaggccuauacagccuuuccucagucguaacaguacccuccucaucacucggcacccaaaccuacaucuguaacguaaaccacaaacccuccaacacaaaaguagacaagaaaguagaacccaaauccugcgacaaaacacacacaugcccacccugccccgcaccagaacuccuaggcggcccgucagucuuccucuucccacccaaacccaaagacacccuaaugaucucccgcaccccagaagucacuugcguugucgucgacgucucccacgaagaccccgaagugaaauucaacugguacgucgacggaguugagguccacaacgccaaaacaaaaccacgcgaagaacaauacaacucaaccuaccgagucgucuccgugcucacuguccuccaccaagacuggcuaaacggcaaagaauacaaaugcaaagucuccaacaaagcccucccagcccccaucgagaaaacaaucagcaaagccaaaggacaaccccgcgaaccacaaguauacacccucccaccaucccgcgacgaacucaccaaaaaccaagucucccuaacaugccucgucaaaggcuuuuaccccucagacauagcagucgaaugggaauccaacggacaacccgaaaacaacuacaaaaccaccccacccguccucgacuccgauggcuccuucuuccucuacuccaaacucaccgucgacaaaucccgauggcaacaaggcaacgucuucagcugcucagucaugcacgaggcccuccacaaccacuacacccagaaaagccucucccuaucccccggcaaa

SEQ ID NO: 53538 - RNA, 642 nt, Artificial Sequence
  derived and/or modified sequence opt11 from Apolizumab_LightChain1
gacauccaaaugacccaaucccccuccucccuaagcgccuccguaggcgaccgcgucaccaucacuugccgcgccuccgaaaacaucuacuccuaccuagccugguaccaacaaaaacccggcaaagcccccaaacuccuagucuccaacgccaaaacccucgcagaaggcguccccuccagauucuccggaucaggcucaggcaaacaauucacccucaccaucagcucccuccaacccgaagacuucgccacuuacuacugccaacaccacuacggcaacucauaccccuucggccaaggcaccaaacucgaaaucaaacgcaccgucgccgcccccuccgucuucaucuucccacccuccgacgaacaacuaaaauccggcaccgccuccgucgucugccuacucaacaacuucuacccccgagaagccaaaguccaauggaaagucgacaacgcccuccaauccggcaacucccaagaaucuguaaccgaacaagacuccaaagacuccaccuacucccucuccuccacccucacccucucaaaagccgacuacgaaaaacacaaagucuacgccugcgaagucacccaccaaggccucuccucccccguaacaaaauccuucaaccgaggcgaaugc

SEQ ID NO: 53539 - RNA, 378 nt, Artificial Sequence
  derived and/or modified sequence opt11 from Apomab_HeavyChain
gaggugcaguuggugcagagugggggggggguggagaggccgggggggagucugagguugaguugugcggcgaguggguuuacguuugaugauuaugcgaugugggugaggcaggcgccgggaaagggguuggagugggugagugggauaaauuggcagggggggaguacgggguaugcggauagugugaaggggagggugacgauaaguagggauaaugcgaagaauaguuuguauuugcagaugaauaguuugagggcggaggauacggcgguguauuauugugcgaagauauugggggcggggagggggugguauuuugauuacugggggaaggggacgacggugacggugagcagugcgaguacgaaggggccg

SEQ ID NO: 53540 - RNA, 324 nt, Artificial Sequence
  derived and/or modified sequence opt11 from Apomab_LightChain
uccgaacucacccaagaccccgccgucuccgucgcccucggccaaaccguccgcaucaccugcuccggcgacucccuccgcuccuacuacgccuccugguaccaacaaaaacccggccaagcccccguccucgucaucuacggcgccaacaaccgccccuccggcauccccgaccgauucuccggcuccuccuccggcaacaccgccucccucaccaucaccggcgcccaagccgaagacgaagccgacuacuacugcaacuccgccgacuccuccggcaaccacgucgucuucggcggcggcaccaaacucaccguccuaggc

SEQ ID NO: 53541 - RNA, 645 nt, Artificial Sequence
  derived and/or modified sequence opt11 from Aquaporumab_LightChain
gaaaucguccucacccaaucccccggaacacucucccucuccccaggagaacgcgccacccucuccugccgcgcaucccaaaccguacgcaccaacuaccuugcaugguuccaacaaaaacccggccaagcaccccgccuccucaucuucggcgccuccucacgagccaccggcauccccgaccgcuucuccggcucaggcucaggcaccgacuucacccucaccaucucccgccucgaacccgaagacuucgccgucuacuacugccaacaauacggcucaucccccuggaccuucggccaaggcaccaaagucgaaaucaaacgcacaguagccgcccccuccgucuucaucuucccacccucagacgaacaacucaaauccggcaccgccuccgucgucugccuccucaacaacuucuacccccgcgaagccaaaguccaauggaaagucgacaacgcccuccaauccggcaacucccaagaauccgucaccgaacaagacuccaaagacuccaccuacucacucuccuccacccucacccucuccaaagccgacuacgaaaaacacaaagucuacgcaugcgaaguuacacaccaaggccucuccagccccgucaccaaauccuucaaccgcggcgaaugc

SEQ ID NO: 53542 - RNA, 1326 nt, Artificial Sequence
  derived and/or modified sequence opt11 from Arcitumomab_99tc_HeavyChain
gaaguaaaacucgucgaauccggcggaggccucguccaaccuggaggcucacuccgacucuccugcgccaccuccggcuucaccuucaccgacuacuacaugaacugggucagacaaccucccggcaaagcccucgaauggcucggauucaucggcaacaaagcaaacggauacaccaccgaauacuccgcuuccgucaaaggacgauucaccaucucacgcgacaaaucccaauccauccuauaccuccaaaugaacacccuccgcgcugaggacuccgccaccuacuacugcacccgagaccgcggccuccgcuucuacuucgauuauuggggccaaggcaccacccucacaguaucaucagcaaaaaccaccccucccuccguuuacccccucgcccccggcuccgccgcccaaacaaacuccauggucacccucggaugccucgucaaaggauacuuccccgaacccgucacagucacuuggaacuccggaagccuauccuccgguguccacacauuccccgccguccuccaguccgaucucuacacccuaucauccucaguaaccguccccucgagcccccgcccauccgaaaccguaaccugcaauguagcccaccccgccuccuccaccaaaguagacaagaaaaucguccccagagacugcccacccugcaaaugccccgcccccaaccuccucggcggccccuccgucuucaucuucccaccaaaaaucaaagacguccucaugaucucacucucacccaucgucacaugcguagucgucgacgucuccgaagacgaccccgacguccaaaucucaugguucgucaacaacguugagguacacacggcccagacccagacacaccgugaagacuacaacuccacccuccgcguaguauccgcccucccuauucaacaccaagacuggauguccggcaaagaguucaaaugcaaagucaacaacaaagaccuucccgcacccaucgaacgcaccaucuccaaacccaaaggcucgguccgcgcaccccaagucuacguacucccaccacccgaagaagaaaugacaaagaaacaagucacccucacaugcauggucaccgacuucaugcccgaagacauauacgucgaguggaccaacaacggcaaaacagagcucaacuacaaaaacacagaacccguccuugacuccgacgggucauacuucauguacuccaaacuccgcguagaaaagaaaaacugggucgaacggaacagcuacuccugcagcgucguccacgaaggccuccacaaccaccacaccaccaaaucauucucacga

SEQ ID NO: 53543 - RNA, 639 nt, Artificial Sequence
  derived and/or modified sequence opt11 from Arcitumomab_99tc_LightChain
caaaccguccucucccaaucccccgcaauccucuccgccucccccggcgaaaaagucaccaugaccugccgcgccuccuccuccguaaccuacauccacugguaccaacaaaaacccggcucaucccccaaauccuggaucuacgccaccuccaaccucgccuccggcguccccgcccgcuucuccggcuccggcuccggcaccucauacucccuaaccaucucccgagucgaagccgaagacgccgccaccuacuacugccaacacugguccuccaaaccacccaccuucggcggcggaacaaaacucgaaaucaaaagagcugacgccgcccccaccgucuccaucuucccacccuccuccgaacaacucaccuccggcggcgccuccgucguuugcuuccucaacaacuucuaccccaaagacaucaacgucaaauggaaaaucgacggcucagaacgacaaaacggcguccucaacuccuggaccgaccaagacuccaaagacuccaccuacuccauguccuccacccucacacucacaaaagacgaauacgaacgccacaacucauacacaugcgaagccacccacaaaaccuccaccucccccaucgucaaauccuucaaccgcaacgaaugc

SEQ ID NO: 53544 - RNA, 1329 nt, Artificial Sequence
  derived and/or modified sequence opt11 from Ascrinvacumab_HeavyChain1
caaguccagcuacaagaauccggccccggccucgucaaacccucccaaacccuaucccuaaccugcaccguaucuggaggaucaaucuccuccggcgaauacuacuggaacuggauccgccaacacccaggcaaaggccucgaauggaucggcuacaucuacuacagcggcuccaccuacuacaaccccucccucaaaucccgcgucaccauauccgucgacacauccaaaaaccaguucucacuaaaacuaagcuccguaaccgccgcugacacagcagucuacuacugcgcccgagaauccgucgcaggauucgacuacuggggacaagguacccucgucaccguaucuagcgccuccaccaaaggcccauccgucuucccccucgcacccugcucacgcucuaccucagaaucaaccgcugcccuaggcugccuugucaaagacuacuuccccgaacccgucaccgucuccuggaacucaggcgcccuaaccuccggcguccacacauuucccgccguccuccagucauccggccucuacucccuuucaucugucgucacagucccaucuagcaacuucggcacccaaacauacacaugcaacgucgaccacaaacccaguaacaccaaagucgacaaaaccgucgagcguaaaugcugcgucgaaugcccacccugccccgcacccccugucgccggccccucagucuuccuauucccacccaaacccaaagacacccuaaugaucagccgaaccccagaaguaaccugcgucgugguagacgucucucacgaagacccagaaguccaauucaacugguacguagacggaguagaaguacacaacgcaaaaacaaaaccccgcgaagaacaauucaacucaaccuuccgcguagucuccguccucaccguaguccaccaagacuggcuaaacggcaaagaauacaaaugcaaagucucaaacaaaggacucccagcgcccauagagaaaaccaucuccaagacgaaaggccaaccccgcgaaccacaagucuacacacuaccacccucaagagaagaaaugaccaaaaaccaagucucccuaaccugccucguaaaaggauucuaccccuccgacauagcagucgaaugggaauccaauggacaacccgaaaacaacuacaaaaccaccccgcccaugcucgacucugacggauccuucuuccuauacucaaaacucaccgucgacaaaucccgcuggcaacaagguaacguauucuccugcucaguaaugcacgaagcacuccacaaccacuacacccaaaaaucacuaucacucucccccggu

SEQ ID NO: 53545 - RNA, 645 nt, Artificial Sequence
  derived and/or modified sequence opt11 from Ascrinvacumab_LightChain1
gaaaucguccucacacaaucccccggcacccuaucccucucccccggcgaacgcgccacccucucaugccgcgccucacaauccgucuccucaucauaccucgcaugguaccaacaaaaacccggccaagccccacgccuccucaucuacggaacauccucacgcgccaccgggauccccgaccgcuucucaggcucaggcuccggcaccgacuucacccucaccaucucacgccucgaacccgaagacuucgccgucuacuacugccaacaauacggauccucccccaucaccuucggccaaggcacccgccucgaaaucaaacgcaccgucgccgcacccuccgucuucaucuucccacccuccgacgaacaacucaaauccggcaccgccuccgucgucugccuccucaacaacuuuuacccccgagaagcaaagguccaauggaaagucgacaacgcccuccaauccggcaacucccaggaauccgucaccgaacaagacuccaaagacuccaccuacucccuaucauccacccuaacacucuccaaagccgacuacgaaaaacacaaagucuacgcaugcgaaguuacccaccaaggccucuccucccccguaaccaaauccuucaaccgcggcgaaugc

SEQ ID NO: 53546 - RNA, 1314 nt, Artificial Sequence
  derived and/or modified sequence opt11 from Aselizuab_HeavyChain1
gaaguacaacucgucgaguccggcggaggacucguacaacccggcggcucucuccgacuauccugcgccgccuccggcuuuaccuucucaaccuacgcaucuuggguacgucaggcccccggcaaaggacucgaauggguagccuccauaucuaccggaggcuccaccuacuaccccgacuccguuaaaggccgguuuaccauauccagagacaacgccaaaaacacacuauaccuccaaaacucacuccgagccgaagacaccgccgucuauuacugcgcacgggacuaugacggcuacuucgacuacuggggacaaggcacccuagucacaguaucaucugcauccaccaaaggccccuccgucuucccccuagcccccugcucccgcuccaccuccgaauccacagccgcccuaggcugccuagucaaagacuacuuccccgaaccagucaccgucuccuggaacuccggcgcacuaacauccggcguucacaccuuccccgccguacuccaaucgucaggccucuauucccucucauccgucgucacagucccaucuuccucccucggcaccaaaaccuauaccugcaacgucgaccacaagcccucaaacacaaaagucgacaaacgcguugaauccaaauacggcccaccaugcccuuccugcccagcacccgaguuccucggaggccccagcgucuuccucuuucccccaaaacccaaagacacccucauaagccgcaccccagaaguaaccugcgucgucgucgacgucagccaagaagacccagaaguccaauucaacugguacgucgacggcgucgaaguccacaacgccaaaacaaaaccaagagaagaacaauucaacuccaccuaccgaguaguaucaguccuaaccguccuacaccaagacuggcugaacggcaaagaauacaaaugcaaagucuccaacaaaggccuccccucauccaucgagaaaaccaucucaaaagccaaaggccaaccgcgagaaccccaagucuacacacuaccucccucccaagaagaaaccaaaaaccaaguaagccuaaccugccuagucaaaggcuucuaccccagcgacauagccgucgaaugggaauccaacggacaacccgaaaacaacuacaaaacuacuccacccguccucgacuccgacggauccuucuuccuguacucccgucucaccgucgacaaaucccgcuggcaagaaggcaacguguucuccugcuccguccacgaagcucuccacaaccacuacacccaaaaaucacucucacucucacuaggcaaa

SEQ ID NO: 53547 - RNA, 1311 nt, Artificial Sequence
  derived and/or modified sequence opt11 from Aselizuab_HeavyChain2
gaaguccaacuagucgaaucuggcggcggccuaguccaaccaggcggcucacuacgccuaucaugcgccgcauccggauucaccuucuccaccuacgccuccuggguaagacaggcccccggaaaaggacucgaaugggucgccucuauauccaccggcggcuccaccuacuaccccgacuccgucaaaggccgcuucaccaucucccgcgacaaugcaaaaaacaccuuauaccuccaaaacucucuucgugcugaagacaccgccgucuacuacugcgcccgcgacuacgacggcuacuucgacuacuggggccaaggcacccucgucaccguuagcucugccuccaccaaaggcccauccgucuucccccucgcacccugcucacgcagcaccuccgaaagcaccgccgcacucggaugccuugucaaagacuauuuccccgaaccugucacgguauccuggaacuccggcgcccucaccuccggcguacacacauucccagccguccuccaauccuccggccuguauucuuuaucuagcguuguaacagucccaagcuccucgcuugguaccaaaaccuacaccugcaacgucgaccacaaacccuccaacaccaaagucgacaaacgcguagaauccaaauauggcccccccugccccuccugccccgccccagaauuccucggcggccccuccgucuuccucuuccccccaaaacccaaagacaccaucucacguacaccagaagucaccugcgucguaguagacgucucacaagaagaccccgaaguccaauucaacugguacgucgacggcguagaaguacacaacgccaaaaccaaaccccgagaagaacaauucaacuccaccuaccgcgucguauccguccucaccguacuacaucaagacuggcucaacggcaaagaauacaaaugcaaagucuccaauaaaggccucccuucauccaucgaaaagacaauuuccaaagcaaaaggccaaccccgagaaccccaaguauacacacuaccccccucacaagaagaaaccaaaaaccaagugagccuuaccugccucgucaaaggcuucuacccauccgacaucgccgucgaaugggaaucaaacggccaacccgaaaacaacuauaaaacuaccccacccguccucgacuccgacgguucuuucuuccucuacucccgacucacagucgauaaaagccgauggcaagaaggcaacgucuucucuuguucuguccacgaagcccuccacaaccacuacacacagaaaucucucucacuaucccucggcaaa

SEQ ID NO: 53548 - RNA, 648 nt, Artificial Sequence
  derived and/or modified sequence opt11 from Aselizuab_LightChain1
gacauccaaacccaaucccccuccucacucuccgccuccgucggcgaucgcgucaccaucaccugcaaagccucccaauccgucgacuacgacggcgacucauacaacugguaccaacaaaaacccggcaaagcacccaaacuacuaaucuacgccgccucaaaccucgaaucuggcauccccucccgauucuccggcucaggauccggcaccgacuucacccucaccauauccucacuccaacccgaagacuucgccaccuacuacugccaacaauccaacgaagaccccuggacauucggccaaggcaccaaagucgaaaucaaacgcaccgucgccgcccccuccguauucaucuucccccccuccgacgaacaacucaaauccggcaccgccuccgucgucugccuccucaacaacuucuacccccgcgaagccaaaguccaauggaaagucgacaacgcccuccaauccggcaacucccaggaaucaguaaccgaacaagacuccaaggacuccaccuacucccucuccucaacccucacccucuccaaagccgacuacgaaaaacacaaaguauacgccugcgaagucacccaccaaggccuauccucacccguaaccaaauccuucaaccgcggcgaaugc

SEQ ID NO: 53549 - RNA, 1344 nt, Artificial Sequence
  derived and/or modified sequence opt11 from Atezolizumab_HeavyChain1
gaaguccagcuagucgaaagcggcggcggacucguccaaccgggcggcucccugcgccucucaugcgccgccuccggcuuuacuuucucagacuccuggauccacuggguccgccaagccccuggcaaaggccucgaaugggucgccuggauaucucccuacggcggcuccaccuacuacgccgacuccgucaaaggacgcuuuaccaucuccgcagacacauccaaaaacacagcauaccuccaaaugaacucccuccgcgccgaagacaccgccguauacuacugcgccagacgacacuggcccggcgguuucgacuacuggggacaaggcacucuagucaccguaagcucagccucaacaaaaggccccuccgucuucccacucgcccccuccucaaaaagcaccucaggaggaaccgccgcccucggaugucuaguuaaagacuacuuccccgaacccgucacagucucauggaacucaggagcacucaccucaggcguccacaccuuccccgcaguacuacaauccucaggccucuacucccucaguucaguagucacaguacccucguccuccuugggcacacaaaccuacaucugcaacgucaaccacaaaccauccaacaccaaaguugacaagaaagucgaaccaaaaagcugcgacaaaacccacacaugcccacccugccccgcaccagaacuccuaggcggaccaucagucuuccucuucccacccaagcccaaagacacacucaugauuagccgaacacccgaaguaacaugcguagucgucgacguaucccacgaggaccccgaagucaaauucaacugguacgucgacggcguugaaguccacaacgcaaaaaccaaaccacgcgaagaacaguaugccucaacauaucgagucgucaguguccucaccgucuuacaccaagacuggcuaaaugguaaagaauacaaaugcaaagucucaaacaaagcccuccccgcacccaucgagaaaaccauaagcaaagcaaaaggccaacccagagaaccacaagucuacacccucccacccucacgagaagaaaugaccaaaaaccaagucucccucaccugucucgucaaaggcuucuaccccuccgacauagccguagaaugggaaucgaacggccaacccgaaaacaacuacaaaaccaccccucccguccucgacagcgacggcuccuucuuccuguacagcaaacucaccgucgacaaaucacguuggcaacaaggcaacgucuucagcugcagcgucaugcacgaagcacuccacaaccacuacacacaaaagucccuaucccucagccccggaaag

SEQ ID NO: 53550 - RNA, 642 nt, Artificial Sequence
  derived and/or modified sequence opt11 from Atezolizumab_LightChain1
gacauccaaaugacccaaucacccucuucccuauccgccucagucggcgaccgcguaaccaucaccugccgcgccucccaagacgucuccaccgccguagccugguaccaacaaaaacccggcaaagcccccaaacuccucaucuacuccgccuccuuccucuacuccggcguccccucccgauucuccggcucaggcuccggcaccgacuucacccucaccaucuccucccuccaacccgaagacuucgccacauacuacugccaacaauaccucuaccaccccgccaccuucggccaaggcaccaaagucgaaaucaaacgcaccgucgccgcccccucugucuucaucuucccccccucugacgaacaacucaaaucuggcaccgccuccgucgucugccuccucaacaacuucuacccccgcgaagccaaaguccaauggaaagucgacaacgcccuccaauccggaaacucccaagaauccgucaccgaacaagacuccaaagacuccacauacagccucuccuccacccucacccucuccaaagccgacuacgaaaaacacaaagucuacgccugcgaaguaacacaccaaggccucuccucccccgucaccaaauccuucaaccgcggagaaugc

SEQ ID NO: 53551 - RNA, 1323 nt, Artificial Sequence
  derived and/or modified sequence opt11 from Atinumab_HeavyChain1
gaaguccaacucguagaaucaggcggcggccuaguacaacccggcggcucauuacgccucuccugcgccgccuccggcuucaccuucucaaacuacuggaugagcuggguacggcaggcccccggaaaaggacucgaauggguagccaccaucaaacaagacggcucccagaaaaacuacgucgacuccguaaaaggccgauucacaaucucccgcgacaacgccaaaaacucccucuaccuacgccucaacagucuccgagccgaagacaccgccgucuacuacugcgccaccgaacucuuugaccuauggggccgaggcucccuagucaccgucuccuccgccuccacuaagggccccuccguauucccacucgcccccugcagcagaucuacuuccgaaucaacagcagcccucggcugccuaguaaaagacuacuuuccugaaccagucaccgucuccuggaacuccggcgcccuaacauccggaguccacacuuuccccgccguacuacaaucaucgggucuauacucucuaucauccgucgucacagucccauccuccucccucggaacaaaaaccuauaccugcaacgucgaccacaaacccucaaacacaaaagucgacaaacgcgucgaauccaaauacggcccucccugccccuccugcccagcccccgaguuccucggcggccccaguguauuccucuucccacccaaacccaaagacacccucaugaucucccgaacccccgaaguaaccugcgucguagucgacgugucucaagaagaccccgaaguacaauucaacugguacgucgacggaguagaaguccacaacgccaaaacaaaacccagagaagaacaauucaacuccaccuaccgcgucgucagcguccucacaguccuccaccaagacugguugaacggcaaggaauacaaaugcaagguaucuaacaaaggccuacccuccuccauagagaaaaccauaagcaaagcaaaaggccaaccccgcgaaccccaagucuacacccuucccccaucccaagaagaaaugaccaaaaaccaagucucccuaaccugccucgucaagggcuucuaccccuccgacauagcagucgaaugggaaagcaacggacaacccgaaaacaacuacaaaaccacaccacccguccucgacucagacgggucauucuuccucuacucacgccucaccgucgacaaaagccgcuggcaagaaggaaacguguucucaugcagcgucaugcaugaagcucuccacaaccacuacacccaaaaaucccucucacucucccucggcaaa

SEQ ID NO: 53552 - RNA, 642 nt, Artificial Sequence
  derived and/or modified sequence opt11 from Atinumab_LightChain1
gaaaucguccucacacaaucgcccgccacccuaucccuaucccccggcgaacgcgccacccugagcugccgcgccagccaaagcguauccuccuaccucgccugguaccaacaaaaacccggacaagcacccagacuccuaaucuacgacgccuccaaccgcgccaccggcauccccgcccgcuucucaggcucaggcucaggcacagacuucacccucaccaucuccucccucgagcccgaagacuucgccgucuacuacugccaacaaagguccaacuggccaaucacuuucggccaaggcaccaaacucgaaaucaaacgcacagucgccgcccccuccgucuucaucuucccacccuccgacgaacaacucaaauccggcaccgccucagucgucugccuacucaacaacuucuacccccgcgaagccaaaguccaauggaaagucgacaacgcccuccaaagcggcaacucccaagaauccgucaccgaacaagacuccaaagacucaaccuacucccuauccucaacccucacccuauccaaagccgacuacgaaaaacacaaagucuacgcaugcgaagucacacaccaaggccugagcucacccguaaccaaauccuucaacagaggcgaaugc

SEQ ID NO: 53553 - RNA, 1329 nt, Artificial Sequence
  derived and/or modified sequence opt11 from Atlizuab_HeavyChain1
guacaacuccaggaauccggccccggacucguccgacccucacaaacacucucacuaaccugcaccguauccggcuauuccaucaccuccgaccacgccuggucauggguucgccaaccacccggacgcggccucgaauggaucggcuacauaucauacucgggaauaaccaccuacaaccccucccucaaaucacgcguuacccuccgagacacaagcaaaaaccaauuuucacuccgacuaucauccgucaccgccgccgacacagccgucuacuacugcgcccgaucccucgcucgaaccaccgccgacuacuggggacaaggcucacucguuacagucuccucagcauccaccaaaggacccuccgucuucccccucgcacccuccuccaaauccacuucuggcggcaccgcagcacucggcugccucgucaaagacuacuuucccgaacccgucaccgucuccuggaacuccggcgcccuuaccucaggaguccacaccuuccccgccguccuccagucuucaggccuuuacucccucuccucagucguaaccguccccuccuccagccucggcacccaaacauacaucugcaacgucaaccacaaacccuccaacaccaaaguagacaagaaagucgaaccaaaauccugcgacaaaacccauacauguccacccugccccgcacccgaacuccucggaggccccuccguuuuccucuuucccccaaaacccaaagacacccucaucucccgcacacccgaaguaaccugcgucguuguagacguaucacacgaagacccagaagucaaauucaacugguacgucgacggagucgaaguccacaacgccaaaaccaagccuagagaagaacaauacaacucaaccuaccgagucgucuccguccucaccguccuccaccaagacuggcuaaacggcaaagaauacaaaugcaaaguaucaaacaaagcccuccccgcucccaucgaaaagaccaucuccaaagccaaaggccaaccccgcgaaccacaagucuacacccuaccaccaucccgugacgaacuaaccaaaaaccaagucucucucaccugucucgucaaaggcuucuaccccuccgacauugccgucgaaugggaaucuaacggucaacccgaaaacaacuacaaaaccaccccgcccguccucgacucagacggcucauucuuccuuuacuccaaacucaccgucgacaaaucgcgauggcaacaaggcaacguuuucuccugcuccguccacgaagcccuccacaaccacuauacccaaaaaucccucucucucucucccggc

SEQ ID NO: 53554 - RNA, 639 nt, Artificial Sequence
  derived and/or modified sequence opt11 from Atlizuab_LightChain1
gacauccaaacccaaucccccuccucucucuccgcauccguaggagaucgcgucaccauaaccugccgcgccucccaagacaucuccuccuaccucaacugguaccaacaaaaacccggcaaagcccccaaacuacucaucuacuacaccucccgccuccacuccggaguccccucccgcuucuccggcuccggcucgggcaccgacuucaccuucaccaucuccucacuccaacccgaagacaucgccaccuacuacugccaacaaggcaacacacuacccuacacauucggccaaggcaccaaagucgaaaucaaacgcaccgucgccgcccccuccgucuucauauucccacccuccgacgaacaacucaaauccggcaccgccuccgucgucugccuccucaacaacuucuacccccgcgaagccaaaguccaauggaaagucgacaacgcccuccaauccggaaacucccaagaauccgucaccgaacaagacuccaaagacuccaccuacucccucuccuccacccucacccugagcaaagccgacuacgaaaaacauaaagucuacgccugcgaagucacccaccaaggacucuccucucccgucacaaaguccuucaaccgaggcgaaugc

SEQ ID NO: 53555 - RNA, 792 nt, Artificial Sequence
  derived and/or modified sequence opt11 from Aurograb_SingleChain
auggccaaaguacaacuacuccaaagcgcaaccgaagucaaaaaacccggcgccagcguaaaaguaagcugcaaagcauacggauacacauucaccgacuacggcauaaccuggguccgacaagcccccggacaaggacucgaauggauggguuggaucucagccuacaacggcuacacaaacuacgcccaaaaauuccaagaccgaauaacaaugaccacagacgccagcacaagcacagccuacauggaacuacgcagccuccgcccagacgacaccgccguccuauacugcgcaagagaccgcgaagacgccucccuccuccgcgacggccacuggggccaagggacccuagucacagucucaagcggaggaggcggcucaggaggaggcggaagcggcggaggaggcuccggcggaggcggaagcgaaaccacgcucacacaaucccccggcacccuaagccuaagcccaggcgaacgcgcaacccuaagcugcagagccucccaaaucguauccucaagcuaccucgccugguaccaacaaaaaccuggccaagccccacgccuccuaauauacggagccucaagcagagccacaggcauaccagaccgauucagcggaagcggcuccggaaccgacuucacucucacaaucucaaaacucgaaccagaagacuucgcagucuacuacugccaacacuacggaagcucaagcccauggacaagccgaccccgagaccaaagcgacaucaaacgugcagccgcacuagaacaccaccaccaccaccac

SEQ ID NO: 53556 - RNA, 1350 nt, Artificial Sequence
  derived and/or modified sequence opt11 from Avelumab_HeavyChain1
gaaguacaauuacucgaaucaggaggaggccucguccaacccggcggcucucuacgacucucaugcgccgccagcggcuucaccuuuuccuccuacaucaugauguggguacgccaagcaccaggcaaaggccucgaaugggucuccuccaucuaccccucaggcggaaucaccuucuacgccgacaccgucaaaggacgcuucaccaucuccagagacaacuccaaaaacacacuauaucuccaaaugaacucccuccgagccgaagacaccgcaguauacuacugcgcacgcaucaaacuaggcacaguaaccaccgucgacuacuggggucaaggcacacucgucaccgucuccucagcguccaccaaaggccccuccgucuuuccccuagcccccuccuccaaauccacaucaggcggaacagccgcacucggcugccucguaaaagacuacuuccccgaacccgucaccguaucauggaacuccggagcccucacauccggcguccacaccuuccccgccguccuccaaucaagcggucucuacucucucuccuccgucguuacaguccccucaaguucauuaggcacccaaacguacauaugcaacgucaaccacaaacccagcaacaccaaaguagacaagaaaguugaaccaaaauccugcgauaaaacccauaccugcccacccugccccgccccagaacuccuuggcggccccucaguauuccucuucccacccaaacccaaagacacccuuaugaucucccguacccccgaaguaaccugcgucgucgucgacguaucccacgaagaccccgaagucaaauucaacugguacgucgacggcgucgaaguccacaacgccaaaaccaaaccccgagaagaacaauacaacuccacauaccgcgucguaucgguacuuaccguccuccaccaagacuggcucaauggcaaagaauauaaaugcaaagucuccaacaaggcacuucccgcccccaucgaaaagacaauuuccaaagcaaaaggccaaccccgagaaccccaagucuacacccucccacccucccgagacgaacucaccaaaaaccaggucucccugaccugccucguaaaaggcuucuaccccuccgacaucgcagucgaaugggaauccaacggccaaccugaaaacaacuacaaaaccacacccccaguccuagacuccgacggaucauuuuuccuauacuccaaacugacuguagacaaaucccgauggcaacaaggcaacgucuucuccugcuccgucaugcacgaagcacuccacaaccacuacacacaaaaaucccucucacuauccccaggaaaa

SEQ ID NO: 53557 - RNA, 648 nt, Artificial Sequence
  derived and/or modified sequence opt11 from Avelumab_LightChain1
caauccgcccucacacaacccgccuccguuuccggcucccccggccaaucaaucaccaucuccugcacaggaacauccuccgacgucggcggcuacaacuacgucuccugguaucaacaacaccccgggaaagcccccaaacuuaugaucuacgacgucuccaaccgccccuccggcguaucaaaccgcuucuccggcuccaaauccggcaacaccgccucacucaccaucuccggccuacaagccgaagacgaagcagacuacuacugcucauccuacaccuccuccuccacccgagucuucggcaccggcaccaaagucacaguccucggacaacccaaagccaaccccaccgucacccucuucccccccucauccgaagaacuccaagcaaacaaagccacccucguaugccucaucuccgacuucuaccccggcgccgucaccgucgcauggaaagccgacggcucaccagucaaagccggcgucgaaaccaccaaaccaucuaaacaauccaacaacaaauacgccgcaucauccuaccucucccucaccccagaacaauggaaaucccaccgcuccuacucuugccaaguaacccacgaaggcuccaccgucgaaaaaaccgucgcccccaccgaaugcucc

SEQ ID NO: 53558 - RNA, 1344 nt, Artificial Sequence
  derived and/or modified sequence opt11 from Bapineuzumab_HeavyChain1
gaaguccaacuacucgaauccggcggcggccucguccaacccggcggcucccuccgccucuccugcgccgccuccggguucaccuucucaaacuacggcaugagcuggguccgccaagccccuggaaaaggucucgaaugggucgccuccauccguuccggcggcggccgaacuuacuacuccgacaacgugaaaggccgcuucaccaucagccgagacaacuccaaaaacacacucuaccuacaaaugaacucacuccgcgccgaagacaccgccgucuacuacugcguccgcuacgaccacuacucaggaucaagcgacuacuggggccaaggaaccuuagucaccgucucaagcgccuccaccaaaggccccucagucuucccccucgcccccuccuccaaauccaccucaggcggcacagccgcacucggcugccuaguaaaagauuacuuccccgaacccguaaccgucucuuggaacucaggcgcccucaccuccggcguucacaccuuccccgccguccuccaauccuccggccucuacucccuauccucuguaguaaccguccccucguccucccucggaacccaaacauacauaugcaacgucaaccauaaaccauccaacacuaaagucgacaagaaaguugaacccaaauccugcgacaaaacccacaccuguccacccugccccgcccccgaacugcucggcggcccuuccgucuuucuauucccaccaaaaccaaaagauacccuaaugauaucccgaacaccagaagucacuugcgucgucgucgacgucucccacgaagaccccgaagucaaauucaacugguacgucgacggcgucgaaguacacaacgccaaaaccaaaccccgcgaagaacaauacaacuccacauaccgcgucguauccguacuaacaguccuccaccaagacuggcuaaacggaaaagaauacaaaugcaaaguuucuaacaaagcucuaccugcccccaucgagaaaaccaucagcaaagccaaaggacaacccagagaaccccaaguauacacacucccaccaucccgcgaagaaaugaccaaaaaccagguaucccuaaccugucucguaaaaggcuucuacccgucagacaucgcagucgaaugggaaagcaacggccaacccgaaaacaacuacaagaccacaccaccaguacucgacucagacggauccuucuuccuauacagcaaauuaaccguugacaagagccgauggcaacaaggaaacgucuucuccugcucagucaugcacgaggcccuccacaaccacuauacccagaagucucucucacucucccccggu

SEQ ID NO: 53559 - RNA, 657 nt, Artificial Sequence
  derived and/or modified sequence opt11 from Bapineuzumab_LightChain1
gacgucgucaugacccaaucaccccucucccuccccgucacccccggcgaacccgccuccaucuccugcaaauccucccaaucccuacucgacuccgacgguaaaaccuaccucaacuggcuccuccaaaaacccggccaaucuccccaacgccuaaucuaccucgucuccaaacucgacuccggcguacccgaccgcuucucgggcuccggcuccggcaccgacuucacccucaaaaucucccgagucgaagccgaagacguaggagucuacuacugcuggcaaggcacccacuucccccgcaccuucggccaaggcaccaaagucgaaaucaaacgcacagucgccgcccccucaguauucaucuucccacccuccgacgaacaacucaaauccggcacagccuccgucgucugccuccucaacaacuucuacccccgcgaagccaaaguccaauggaaagucgacaacgcccuacaauccggaaacucccaagaauccgucaccgaacaagacucaaaagacuccaccuacucccucucauccacccucacccucucaaaagccgacuacgaaaaacacaaagucuacgccugcgaagucacccaccaaggccucuccucccccgucaccaaauccuucaaccgcggcgaaugc

SEQ ID NO: 53560 - RNA, 1338 nt, Artificial Sequence
  derived and/or modified sequence opt11 from Basiliximab_HeavyChain
caacuacaacaauccgguaccguucucgcccgacccggagcgucagucaaaauguccugcaaagccuccggcuacuccuucacccgcuacuggaugcacuggaucaaacaacgccccggccaaggccucgaauggauuggagccauuuaccccggcaacuccgacaccucauauaaccaaaaauucgaaggcaaagccaaacucaccgccgucaccucugcauccaccgcauacauggaacuuucaucccugacccacgaagacuccgcaguauacuacugcagccgcgacuacggcuacuacuuugacuucuggggacaaggcaccacacucaccgucucauccgccagcacuaaaggccccuccguauuccccuuagcgcccuccuccaaaucaacuuccgguggaacugccgcccucggcugccucgucaaagauuacuuccccgaacccguaacaguauccuggaacucaggcgcccuaaccucaggcguccacaccuuccccgccguccuacaaucauccggccucuacucgcucucauccgucgucacuguacccuccuccucccucggcacccaaaccuacauaugcaacgucaaccacaaacccuccaacacaaaaguagacaaacgcgucgaaccacccaaguccugcgacaaaacccauaccugcccacccugccccgcucccgaacuccugggcggccccucggucuucuuauucccacccaaacccaaagacacccucaugaucagccguacacccgaaguaaccugcgucgucgucgacgucagccacgaagaccccgaagucaaauucaacugguacgucgacggcgucgaaguccacaacgccaaaaccaaaccccgugaagaacaauacaacuccaccuaccgcguaguaucaguccuaacaguccuccaccaagacuggcucaacggaaaagaauacaagugcaaagucucaaacaaagcccuccccgcacccauugagaaaaccaucucaaaagccaaaggccaaccccgcgaaccccaggucuacacccucccacccucacgagacgaacucaccaaaaaccaagucucgcuaaccugccucguaaaagguuuuuaccccucugacaucgccgucgaaugggaaucuaauggccaacccgaaaacaacuacaaaaccacaccacccguccuugauuccgacggaucauucuuccuauacuccaagcucaccguugacaaaucccgcuggcaacaaggcaacguauucuccugcuccgucaugcacgaagcacuccacaaccacuacacccaaaaaucccuaagccucucacccggcaaa

SEQ ID NO: 53561 - RNA, 630 nt, Artificial Sequence
  derived and/or modified sequence opt11 from Basiliximab_LightChain
caaaucgucagcacccaaagccccgccaucaugucagccucacccggcgaaaaagucaccaugacaugcuccgcauccuccucccgcuccuacaugcaaugguaccaacaaaaaccaggcaccucccccaaacgcuggaucuacgacaccuccaaacucgcuuccgguguccccgcccgcuucucaggcuccggcucaggcaccucuuacucccuaaccaucuccucaauggaagccgaagacgcagccaccuacuacugccaccaacgcuccuccuacaccuucggcggcggcaccaaacuagaaaucaaacgaaccgucgccgcaccuucagucuucaucuucccacccuccgacgaacaacucaaauccggcaccgccucugucgucugccuccucaacaacuucuacccccgcgaagccaaaguccaauggaaagucgacaacgcccuccaaucuggcaacucccaagaaucagucaccgaacaagacuccaaagacuccaccuacucccucuccuccacccucacccuuuccaaagccgacuacgaaaaacacaaagucuacgccugcgaagucacccaccaaggccucuccucccccguaaccaaauccuucaaccgcggcgaa

SEQ ID NO: 53562 - RNA, 1350 nt, Artificial Sequence
  derived and/or modified sequence opt11 from Bavituximab_HeavyChain
gaaguacaacuccaacaauccggcccagaacucgaaaaacccggagccucaguaaagcucuccugcaaagccucuggcuacagcuucaccggauacaacaugaacuggguaaaacaaucccacggcaaaucccucgaauggaucggccacauagaucccuacuacggcgacaccuccuacaaccaaaaauuccgcggaaaagccacccuuaccgucgauaaaagcagcuccaccgccuacaugcaacuaaaaucccucaccuccgaggacagcgccguauacuacugcgucaaaggcggauacuacggccacugguacuucgacgucuggggcgccgggaccaccgucaccgucucuuccgccagcacaaaaggccccucagucuucccccucgcccccuccuccaaaucaaccucaggcggaacugccgcccuaggcugccucgucaaagauuacuucccagagcccgucacaguuucauggaacucaggagcccucaccucaggcguccacaccuuccccgcaguccuccaaagcuccggccucuacucccucucauccgucgucacagucccgucauccucacucggcacacaaaccuacaucugcaacgucaaccacaaacccagcaacaccaaaguagacaagaaagucgaaccaaaauccugcgacaaaacacacacaugcccacccugcccagcccccgaacuccucggcggcccgagcguauuccuauuucccccaaaacccaaagacacccucaugaucagccgcacccccgaaguaaccugcgucgucgucgacgucucacacgaagaccccgaagucaaauucaauugguacgucgacggcgucgagguccacaacgcuaaaaccaaaccccgcgaagaacaauacaacucaaccuaccgcgucguaucaguccuaacaguccuacaccaagacuggcuaaacggcaaagaauacaaaugcaaaguauccaauaaagcacugcccgcacccauagagaaaaccauauccaaagccaaaggccagccacgcgagccacaagucuacacgcuuccacccucccgagacgaacugacgaaaaaccaagucagccuaaccugccuggucaaaggcuucuaccccuccgacauagccgucgagugggaaucuaacggccaaccagaaaacaacuacaaaacaacacccccuguccucgacucugacggcuccuucuuccucuacuccaaacucaccguagacaaaucacgguggcagcaaggcaacguauucagcugcuccgucaugcacgaagcccuccacaaucacuacacgcaaaaaucccuaucccucagccccggcaaa

SEQ ID NO: 53563 - RNA, 642 nt, Artificial Sequence
  derived and/or modified sequence opt11 from Bavituximab_LightChain
gacauccaaaugacccaaucccccuccucccucuccgccucccucggcgaacgcgucucccuaaccugccgagccucccaagacaucggcuccucccuaaacuggcuccaacaaggccccgacggcaccaucaaacgccucaucuaugccaccuccucacuagacuccggcguccccaaacgcuucuccggcucccgcuccggcuccgacuacucccucaccaucuccucccucgaauccgaagacuucgucgacuacuacugccuucaauacgucuccuccccccccaccuucggagccggcaccaaacucgaacucaaacgcgcugacgcagcccccuccgucuucaucuucccccccucugacgaacaacucaaauccggcaccgccuccgucgucugccuccucaacaacuucuacccacgcgaagccaaaguccaauggaaagucgacaacgcccuccaauccggcaacucccaagaauccguaacagaacaagacucaaaagacucaacuuauagccucuccuccacccucacccucuccaaagcagacuacgaaaaacacaaagucuacgcaugcgaagucacccaccaaggccucuccucccccgucaccaaaucauucaaccgcggcgaaugc

SEQ ID NO: 53564 - RNA, 624 nt, Artificial Sequence
  derived and/or modified sequence opt11 from Bavituximab_LightChain_variant_8734_L
gacauccagaugacccaaucacccuccucccucuccgcaucccucggcgaacgcgucagccucaccugccgcgccagccaggacaucggcuccagccucaacuggcuccaacaaggccccgacggcacaaucaaacgccucauauacgccaccucaucccucgacuccggcguccccaaacgauucuccggcucccgcuccggcuccgacuacucccucaccaucuccucccucgaauccgaagacuucgucgacuacuacugccuccaauaugucuccuccccccccacauucggcgccggaaccaaacucgaacucaaacgcgccgacgccgcccccuccgucuucaucuucccccccuccgacgaacaacucaaauccggcacagccucagucgucugccuccucaacaacuucuacccccgcgaagccaaaguccaauggaaagucgacaacgcccuccaaucaggcaacucccaagaaucaguaaccgaacaagacuccaaagacuccaccuacagccucuccaaagccgacuacgaaaaacacaaagucuacgccugcgaagucacccaccaaggccucuccucacccguaaccaaauccuucaaccgcggcgaaugc

SEQ ID NO: 53565 - RNA, 1368 nt, Artificial Sequence
  derived and/or modified sequence opt11 from Begelomab_HeavyChain1
cagguccaacuccaacaauccggagcagaacuaguaaaacccggcgcauccguaaaacucucaugcaaagccuccggcuacaccuuccgcuccuacgacauuaacuggguccgccaacgccccgaacaaggccuagaauggaucggcuggaucuuccccggagauggaucuaccaaauacaacgaaaaauucaaaggcaaagccacccucaccaccgacaaaucuagcucaacugccuacaugcaacuaucacgacucaccucugaggacuccgcugucuacuucugcgcgcguuggacagucgucggacccggcuacuuugacgucuggggcgcaggcacaaccgucaccgucuccuccgccaaaacaacaccccccuccguuuacccacucgcacccggaugcggcgacacuacaggcuccuccgucacccucggcugccuagucaaaggcuacuuccccgaauccguaacuguuacguggaacuccggcucacucuccuccuccguccacacuuucccagcccuccuccaauccggccuauacaccauguccagcagcgucaccgucccauccuccacauggccaucacagaccguaaccugcuccguugcacaccccgccucaagcaccaccgucgacaaaaaacucgaaccauccggccccaucagcaccauaaaccccugcccccccugcaaagaaugccacaaaugccccgcccccaaccuugaaggaggaccauccgucuucauauucccacccaacaucaaagacguacucaugaucucccuaacccccaaagucacuugcgucgucgucgacguaucggaagacgacccugauguccaaauauccugguucgucaacaacgucgaaguacacaccgcccaaacacaaacccaccgcgaagacuauaacuccacaauccgcgucgucuccacacuacccauacaacaccaagauuggauguccggcaaggaauuuaaaugcaaagucaacaacaaagaccuccccucccccaucgaacgcacaaucuccaaaaucaaaggccucguacgcgcuccccaagucuacauacuacccccccccgccgaacaacucucccgcaaagacgugucucucacuugccucguugucggcuucaaccccggagacaucuccgucgaauggacgucaaacggacacacagaagaaaacuauaaagacaccgccccaguccucgacagcgacggcuccuacuucaucuacuccaaacucaacaugaaaacaagcaaaugggaaaaaacagacucauucucuugcaacguccgccacgagggacucaaaaacuacuaccucaaaaaaaccaucucccgcucccccggcaaa

SEQ ID NO: 53566 - RNA, 639 nt, Artificial Sequence
  derived and/or modified sequence opt11 from Begelomab_LightChain1
caaaucguccuaacccaauccccagccaucauguccgcaucccccggcgaaaaaguaaccaucacaugcuccgccuccucauccgucuccuacaugaacugguuccaacaaaaacccggcaccucacccaaacuauggaucuacucaaccuccaaccucgccuccggcguacccgcccgauucuccggcuccggcuccggcaccuccuacucccucaccaucucccgcauggaagccgaagacgccgcaaccuacuacugccaacaacgcuccuccuaccccaacaccuucggcggcggcaccaaacuagaaaucaaacgcgccgacgccgcccccaccgucuccaucuucccacccuccuccgaacaacucaccuccggcggcgcaucagucgucugcuuccucaacaacuucuaccccaaagacaucaacgucaaauggaaaaucgacggcuccgaacgccaaaacggcguccucaacucauggaccgaccaagacuccaaagacuccaccuacuccauguccuccacccucacccucaccaaagacgaauacgaacgacacaacagcuacacaugcgaagccacccacaaaaccuccaccucccccaucgucaaaucauucaaccgcaacgaaugc

SEQ ID NO: 53567 - RNA, 1353 nt, Artificial Sequence
  derived and/or modified sequence opt11 from Benralizumab_HeavyChain1
gaaguucagcuaguccaauccggcgccgaaguaaagaaaccaggcgccucagucaaagucuccugcaaagccagcggcuacaccuucacaucauacgucauacauuggguacgacaacgcccaggccaaggccucgcauggauggguuacaucaaccccuacaacgacggaacaaaauacaacgaacgauucaaaggcaaagucacaaucacaucagaccgcuccacauccaccgucuauauggaauuaagcucacuccgcagcgaagacacagccgucuaccucugcggccgcgaaggcauccgauauuacggccuccuuggcgacuacuggggccaagguacccuagucacugucucgucagccucaacuaaaggccccuccgucuuuccccucgcgcccagcuccaaauccaccuccggaggcacugccgcacuaggaugccucgucaaagacuacuuccccgaacccgucacugucuccuggaacucaggcgcacucaccuccggaguucacacuuuccccgccguccuccaauccuccggccucuauucccuauccagcgucgucaccguccccagcuccucacucggcacccaaaccuacauaugcaacgucaaccacaaacccagcaacaccaaagucgacaaaaagguugaaccuaaauccugcgacaaaacucacacaugcccacccugccccgcccccgaacuccucggcggccccuccguauuccucuuucccccuaaaccuaaagacacccugaugaucucccgaaccccagaagucacaugcgucguagucgacguaucacacgaagaccccgaagucaaauucaacugguacguagacggcguagaaguccacaacgccaaaaccaagccccgcgaagaacaauacaacuccaccuaccgcgucgucuccguccucaccguacuacaccaagauuggcucaacggaaaggaauacaaaugcaaagucagcaacaaagcacugccagcccccaucgagaaaaccauauccaaagccaaaggccaaccacgcgaaccccaaguauacacacucccacccucacgcgacgaacuaaccaagaaccaagucucacugacaugccuaguaaaaggcuucuauccgucagacaucgccguugaaugggaauccaacggccaacccgaaaacaacuacaaaacaacacccccaguccucgacucagauggcucuuucuuccucuacagcaaacugacugucgacaaaucccgcuggcaacaaggcaacguauucagcugcuccguaaugcaugaagcacuccacaaccacuacacucaaaaaucccucucccucucacccggcaaa

SEQ ID NO: 53568 - RNA, 642 nt, Artificial Sequence
  derived and/or modified sequence opt11 from Benralizumab_LightChain1
gacauccaaaugacccaaucccccuccucccucuccgccucagucggcgaccgcgucaccaucaccugcggcaccucagaagacaucaucaacuaccucaacugguaccaacaaaaacccggcaaagcacccaaacuccucaucuaccacaccucccgacuccaauccggcguccccucccguuucucaggauccggcuccggcaccgacuucacccucaccaucuccucccuccaacccgaagacuucgccaccuacuacugccaacaaggcuacacccuccccuacaccuucggccaaggcacaaaaguagaaaucaaacgaaccgucgccgcccccuccgucuucaucuucccccccuccgacgaacaacucaaauccggcaccgccucagucgucugccuccucaacaacuucuacccccgagaagccaaaguccaauggaaaguagacaacgcccuccaauccggaaacucccaagaauccgucaccgaacaagacuccaaagacucaaccuacucccucuccuccacccucacccucagcaaagccgacuacgaaaaacacaaagucuacgccugcgaagucacccaccaaggccuauccucccccgucaccaaauccuucaaccgcggcgaaugc

SEQ ID NO: 53569 - RNA, 1329 nt, Artificial Sequence
  derived and/or modified sequence opt11 from Betalutin_HeavyChain1
gaaauccaauuacaacaauccggccccgaacucgucaaaccaggcgcauccgucaaaguaucaugcaaagccucaggcuacuccuucaccgacuacaacauguacugggucaaacaaucccacggcaaaucccuggaauggaucgguuacaucgaccccuacaacggcgacacaacauacaaucaaaaauucaaaggcaaagccacccucaccguagacaaaucuuccuccaccgccuucauacaucucaacucacucaccucagaagacucugccgucuacuacugcgcacgaucccccuacggccacuacgcgauggacuacuggggacaaggcacguccguaaccguauccuccgccaaaacaacacccccaucagucuacccccucgcccccggcuccgccgcccaaaccaacuccauggucacccucggcugccuugucaaaggcuacuuccccgaaccagucaccgucacguggaacucaggaucccucuccucaggcguccauaccuucccagccguccuccaaucugaucuauacacucucuccucguccgucacaguuccauccucuaccuggcccuccgaaaccguuaccugcaacgucgcccaccccgccuccuccaccaaggucgacaaaaagauagucccgcgagacugcggcugcaagcccuguaucugcaccguacccgaagucuccuccguauucaucuucccucccaaacccaaggacguccucaccaucacucuaacacccaaagucacaugcgucguagucgacaucuccaaagaugaccccgaaguccaauucuccugguucguugacgacgucgaaguacacaccgcccaaacucaaccccgcgaagaacaauucaacucaacguuccgcuccguuuccgaacuuccaaucaugcaccaagacuggcucaauggcaaagaguucaaaugccgcguaaacuccgccgccuuccccgcccccaucgagaaaaccaucuccaaaaccaaaggccguccaaaagcaccccaaguauacaccaucccuccacccaaagaacaaauggccaaagacaaagucucccuuaccugcaugauuacagacuucuuccccgaagacauaaccgucgaauggcaauggaacggccaacccgccgaaaacuacaaaaacacccagcccaucauggacaccgacggcucuuacuucgucuacucaaaacuaaacguccaaaaauccaacugggaagccggcaacacauuuaccugcuccguucuacacgaaggacuacacaaccaccacaccgaaaaaucccuaucucacucccccggcaaa

SEQ ID NO: 53570 - RNA, 642 nt, Artificial Sequence
  derived and/or modified sequence opt11 from Betalutin_LightChain1
gacaucgucaugacccaaucccacaaacuccucuccaccuccgucggcgaccgcgucuccauaaccugcaaagccucccaagacgucuccaccgccguagacugguaccaacaaaaacccggccaaucaccaaaacuccucaucaacugggccucaacccgccacaccggaguccccgaccgcuucacuggcucaggcuccggcaccgacuacacccuaacaaucuccucaaugcaagccgaagaccucgcccucuacuacugcagacaacacuacuccacccccuucaccuucggcuccggcaccaaacucgaaaucaaacgcgccgacgcagcccccaccguauccaucuucccacccuccuccgaacaacucaccucuggcggcgccuccgucguaugcuuccuaaacaacuucuaccccaaagacaucaacgucaaauggaaaaucgacggcuccgaacgccaaaacggcguacucaacuccuggaccgaccaagacuccaaagacuccaccuacuccauguccuccacccucacccuaaccaaagacgaauacgaacgccacaacucauacacaugcgaagccacccacaaaaccucaaccucucccaucgucaaauccuucaaccgcaacgaaugc

SEQ ID NO: 53571 - RNA, 1344 nt, Artificial Sequence
  derived and/or modified sequence opt11 from Bevacituzuab_HeavyChain1
gaaguacaacucgucgaauccggcggaggccuaguccaacccggcggcucccuccgccucuccugcgccgccucaggcuacaccuucaccaacuacggcaacuggguccgacaagcacccggcaaaggcuuagaaugggucggauggaucaacaccuacaccggcgaacccacauacgcagccgacuucaaacgccgcuucaccuucucccuagacaccuccaaaucaaccgcauaccuccaaaacucgcuccgcgcugaagacacagcagucuacuacugcgccaaauacccccacuacuacgggucaucacacugguacuucgacgucuggggccaaggaacacuggucaccguauccagcgcauccaccaaaggccccuccgucuucccccuagcccccagcuccaaaucaaccuccggaggaacagcagcccucgguugccuagucaaagauuacuucccugaacccgucaccguaagcuggaacuccggcgcccugaccaguggaguacacaccuucccagccguccuccaauccucaggccucuacucacuuuccuccgucgucaccgucccaucaucaucacucggaacacaaaccuauaucugcaacgucaaccacaaacccagcaacaccaaggucgacaagaaaguugaacccaaauccugcgacaaaacacacaccuguccaccaugcccggccccggaacuccuagguggcccuuccgucuuccuauucccgcccaaacccaaagacacccucaucagccgcacccccgaaguaacuugcgucgucguugacgucucccacgaggacccugaaguaaaauucaacugguacgucgacggcgucgaaguacacaacgccaaaacaaaaccccgagaagaacaauacaacuccaccuaccgugucgucuccguccuaaccguccuacaccaagacuggcucaacggaaaagaauacaaaugcaaagucucaaacaaagcccuacccgcccccauugagaaaaccaucucaaaagccaaaggccaaccccgagaaccccaagucuacacacucccacccuccagagaagaaaccaaaaaccaagucucccuaaccugccuagucaaaggauucuaccccuccgacaucgccguugaaugggaauccaacggucaaccagaaaacaacuacaaaaccaccccacccguccuagacucagacggcuccuucuuccuuuacucaaaacuuaccgucgacaaaucacgcuggcaacaagguaacguauucucuugcuccguccacgaagcacuccacaaccacuacacccaaaaaucacucucccucagccccggaaaa

SEQ ID NO: 53572 - RNA, 639 nt, Artificial Sequence
  derived and/or modified sequence opt11 from Bevacituzuab_LightChain1
gacauccaaacccaaucacccuccucccucuccgccuccguaggcgaccgcgucaccauaaccugcuccgccucacaagacaucucaaacuaccucaacugguaccaacaaaaacccggcaaagcccccaaaguccuuaucuacuucaccuccucacuccacuccggcguccccucacgcuucuccggcuccggcucaggcaccgacuucacccucaccauauccucccuccaacccgaagacuucgccaccuacuacugccaacaauacucuaccgucccauggaccuucggccaaggcaccaaagucgaaaucaaacgcaccgucgccgcccccuccguauucauauucccucccuccgacgaacaacucaaauccggcaccgcaucagucgucugccuccucaacaacuucuacccccgcgaagccaaaguccaauggaaagucgacaacgcccuccaauccggaaacucacaagaaucagucaccgaacaagacuccaaagacuccaccuacucccucuccucaacccuuacccucucaaaagccgacuacgaaaaacacaaaguauacgccugcgaagucacccaccaaggccuaucaucccccgucaccaaauccuucaaccgcggcgaaugc

SEQ ID NO: 53573 - RNA, 639 nt, Artificial Sequence
  derived and/or modified sequence opt11 from Bevacizumab_154-aspartic_acid_LightChain
gacauccaaaugacacaaucccccucaucccucuccgccuccgucggcgaccgagucaccauaaccugcuccgcaucccaagacaucuccaacuaccuaaacugguaccaacaaaaacccggcaaagcccccaaaguccucaucuacuucacauccucccuccacuccggcguccccucccgcuucuccggauccggcucaggcaccgacuucacccuuaccaucuccucccuacaacccgaagacuucgccaccuacuacugccaacaauacuccacaguccccuggaccuucggccaaggcaccaaagucgaaaucaaacgcaccgucgccgcccccuccgucuucaucuucccacccuccgacgaacaacucaaauccggcaccgccuccgucgucugccuccucaacaacuucuacccccgcgaagccaaaguacaauggaaagucgacaacgccgaccaauccggcaacucccaagaaucagucaccgaacaagacuccaaagacucaaccuacucccucuccuccacccucacccucuccaaagcagacuacgaaaaacacaaagucuacgccugcgaagucacccaccaaggccucuccucccccgucaccaaauccuucaaccgaggcgaa

SEQ ID NO: 53574 - RNA, 639 nt, Artificial Sequence
  derived and/or modified sequence opt11 from Bevacizumab_154-substitution_deriv_LightChain
gacauccaaaugacccaaucccccucaucucucucugccucagucggcgaccgagucaccauaaccugcuccgccucccaagacaucucaaacuaccucaacugguaccaacaaaaacccggcaaagcccccaaaguccucaucuacuucaccuccucccuccacuccggaguccccucccgcuucucaggcucaggcuccggcaccgacuucacccucaccaucuccucccuccaaccagaagacuucgcuaccuacuacugccaacaauacuccacaguccccuggaccuucggccaaggcacaaaagucgaaaucaaacgcaccgucgccgccccauccgucuucauauucccacccuccgacgaacaacucaaaucaggcaccgccuccgucguaugccuccucaacaacuucuacccccgcgaagccaaaguccaauggaaagucgacaacgccgaccaauccggaaacucccaagaauccgucaccgaacaagacuccaaagacuccaccuacucacucuccuccacccucacccucuccaaagccgacuacgaaaaacacaaagucuacgcaugcgaagucacccaccaaggccucuccucccccguaaccaaauccuucaaccgaggcgaa

SEQ ID NO: 53575 - RNA, 672 nt, Artificial Sequence
  derived and/or modified sequence opt11 from Bevacizumab_180-serine_HeavyChain
gaaguccaacucgucgaauccggcggcggccucguccaacccggcggcucacuccgccucuccugcgccgccuccggcuacaccuucaccaacuacggcaugaacuggguccgccaagcccccggaaaaggccuagaaugggucggcuggaucaacaccuacaccggagaacccacuuacgccgccgacuucaaacgccgcuucaccuucucccucgacaccuccaaaucuacugccuaccuacaaaugaacucccuccgcgccgaagacaccgccgucuacuacugcgccaaauacccccauuacuacggcuccucacacugguacuucgacguuuggggccaaggcacccucgucaccgucuccucagccuccacaaaaggccccuccgucuucccccucgcacccucauccaaauccaccuccggcggcaccgccgcccuaggaugccucgucaaagacuacuuccccgaacccgucaccgucuccuggaacuccggcgcccucaccuccggcguccacaccuucccugccgucucucaaucauccggccucuacucccucuccucagucgucaccguccccuccuccagccuaggcacccaaacauacaucugcaacgucaaccauaaacccucuaacaccaaagucgacaaaaaagucgaacccaaa

SEQ ID NO: 53576 - RNA, 672 nt, Artificial Sequence
  derived and/or modified sequence opt11 from Bevacizumab_180-substitution_deriv_HeavyCahin
gaaguccaacucgucgaauccggcggaggccucguccaacccggcggcucccuccgccuauccugcgcagccucaggcuacaccuucaccaacuacggcaugaacuggguccgccaagcccccggcaaaggacucgaaugggucggcuggaucaacaccuacaccggcgaacccaccuacgccgccgacuucaaacgccgcuucaccuucucccuagacaccuccaaauccaccgccuaccuccaaaugaacucccuacgugccgaagacacagccgucuacuacugcgccaaauauccccacuacuacggcucaucacacugguacuucgacgucuggggccaaggcacccucgucaccgucuccuccgccuccacaaaaggccccuccgucuucccacucgcacccuccuccaaauccaccuccggcggcaccgccgcccucgguugccucgucaaagacuacuuccccgaacccgucaccgucuccuggaauucaggcgcccuaaccuccggcguccacaccuuccccgccgucucucaauccuccggacucuacucccuaucauccgucgucaccguccccuccuccucccuaggcacccaaaccuacaucugcaacguaaaccacaaacccucaaacaccaaagucgacaaaaaagucgaacccaaa

SEQ ID NO: 53577 - RNA, 1359 nt, Artificial Sequence
  derived and/or modified sequence opt11 from Bevacizumab_beta_HeavyChain1
gaaguacaacucgucgaauccggggguggccucguccaacccggcggcucacuaagacucucaugcgccgccuccggauacaccuucaccaacuacggaaugaacuggguacgccaagcccccggcaaaggucucgaaugggucggcuggauaaacaccuacaccggagagcccaccuacgccgccgacuucaaacgacgcuucaccuucucccucgacaccuccaaaagcaccgcauaccuccagaugaacucacuacgcgccgaagacaccgcagucuacuacugcgcgaaauacccccacuauuacgguuccucccacugguacuucgacgucuggggccaaggcacccuagucacagucuccuccgccuccaccaagggacccucagucuucccccucgccccuuccucaaaauccaccuccggcggaaccgccgcacuuggaugccucgucaaagacuacuucccagaaccaguaaccgucuccuggaacuccggugcccuaacaucaggaguccacacauuccccgccguacuccaauccuccggucuuuacucccuaucaucagucguaaccguacccuccagcagccucggaacacaaaccuacauaugcaacgucaaccacaaacccuccaacaccaaagucgacaagaaagucgaacccaaauccugcgacaaaacacacacaugcccacccugccccgcccccgagcuacucggcggccccucagucuuccucuucccuccaaaaccaaaagacacccucaugaucucacgaacaccugaaguaaccugcguagucgucgacgucucccacgaagaccccgaagucaaauuuaauugguacguagacgggguugaaguccacaacgcaaaaaccaaaccucgagaagaacaauacaacaguaccuaccggguuguauccguucucaccguccuccaccaagacuggcuaaacggaaaggaauacaaaugcaagguauccaacaaagcccuccccgcccccaucgagaaaaccaucuccaaggccaaaggccaaccaagagaaccacaagucuacacacucccacccucccgcgaagaaaugaccaaaaaccaagucagccuaacaugccucgucaaaggcuucuaccccuccgacaucgcaguagaaugggaauccaacggacaacccgaaaacaauuacaaaaccacuccacccguccucgacuccgacggcuccuucuuccucuacucuaaacucaccgucgacaaaucccgauggcaacaaggaaacguguucuccugcagcgucaugcacgaagcccuccacaaucacuacacucaaaaaucccucucccuaucccccggcaaa

SEQ ID NO: 53578 - RNA, 642 nt, Artificial Sequence
  derived and/or modified sequence opt11 from Bevacizumab_beta_LightChain1
gacauccaaaugacccaaucccccuccucccucuccgcauccgucggcgaccgcgucaccaucacaugcuccgccucccaagacaucuccaacuaccuaaacugguaccaacaaaaacccggcaaagccccaaaaguacucaucuacuucaccuccucccuccacuccggcguacccucccgcuucuccggcucaggcucaggcacagacuucacccuaaccaucuccucacuccaacccgaagacuucgccaccuacuacugccaacaauacucaaccguucccuggaccuucggacaaggcaccaaagucgaaaucaaacgcaccgucgcagcccccuccgucuucaucuucccaccaucagacgaacaacuaaaauccggcaccgcaucagucgucugccuucucaacaacuucuacccacgcgaagccaaaguccaauggaaagucgacaacgcccuccaauccggcaacucccaagaauccgucaccgaacaagacuccaaagacuccaccuacucccucuccuccacccucacccucucaaaagccgacuacgaaaaacacaaagucuacgccugcgaagucacccaccaaggccucucaucccccgucaccaaauccuucaaccgcggcgaaugc

SEQ ID NO: 53579 - RNA, 687 nt, Artificial Sequence
  derived and/or modified sequence opt11 from Bevacizumab_FcDomain
uccugcgacaaaacccacaccugcccccccugcccagcccccgaacuccuuggcggccccuccgucuucuuauuccccccaaaaccuaaagacacccucaugaucucccgcacccccgaagucaccugcgucgucgucgacgucucccacgaagaccccgaagucaaauucaacugguacguagacggcgucgaaguacacaacgccaaaaccaaaccccgcgaagaacaauacaacuccaccuaccgagucgucuccguacucaccguccuccaccaagacuggcuaaacggcaaagaauacaaaugcaaagucuccaacaaagcccuccccgcccccaucgaaaaaaccaucuccaaagccaaaggccaaccccgcgaaccccaagucuacacccucccacccucccgcgacgaacucaccaaaaaccaagucucccucaccugccuagucaaaggauucuaccccucagacaucgccgucgaaugggaauccaacggucaacccgaaaacaacuacaaaaccacccccccaguccucgacucagacggcucauucuuccucuacuccaaacucaccgucgacaaaucccgcuggcaacaaggcaacgucuucuccugcucagucaugcacgaagcacuccacaaccacuacacccaaaaaucccucucacucuccccaggaaaa

SEQ ID NO: 53580 - RNA, 672 nt, Artificial Sequence
  derived and/or modified sequence opt11 from Bevacizumab_HeavyChain
gaaguccaacucgucgaauccggcggcggacucguccaacccggcggaucccuccgccucuccugcgccgccuccggcuacaccuucaccaacuacggcaugaacuggguccgccaagcccccgggaaaggccucgaaugggucggcuggauaaacacauacaccggugaacccaccuacgccgccgacuucaaacgccgcuucaccuucucacucgacaccuccaaauccaccgccuaccuacaaaugaacucccuacgagccgaagacacagccgucuacuacugcgccaaauacccccacuacuacggcuccucccacugguacuucgacguauggggccaaggcacccuagucaccguauccucagccuccaccaaaggccccuccgucuucccccuagcccccucuucaaaauccaccuccggcggcaccgccgcccucggcugccucgucaaagacuacuuccccgaacccgucaccgucuccuggaacuccggcgcccucacauccggcguccacaccuuccccgccguccuccaauccuccggacucuacucccucuccuccgucgucaccguccccucaucaucacucggcacccaaaccuacaucugcaacguaaaccacaaacccucaaacaccaaagucgacaaaaaagucgaacccaaa

SEQ ID NO: 53581 - RNA, 1428 nt, Artificial Sequence
  derived and/or modified sequence opt11 from Bevacizumab_HeavyChain_variant1
gcaucagccacgaugggcugguccugcaucauccucuuccuagucgccaccgcaaccggaguacacucagaaguacagcucguagaauccggcggcggacucguacaacccggcggcucccuacgcuuaucaugcgccgcauccgguuacacauucaccaacuacggcaugaacuggguucgccaggcccccggcaagggccucgaaugggucggcuggaucaacaccuacaccggugaacccaccuacgccgcagauuucaaacgccgauucaccuucucucucgacaccuccaaaucaaccgccuaccuccaaaugaacucacuucgagcagaagacaccgccgucuacuacugcgcaaaauacccccacuacuacggaucaagccacugguacuucgacgucuggggccaaggcaccuuagucaccgucucauccgcgagcacaaaaggccccagcgucuucccccucgcacccucaagcaaaucaaccuccggcggcaccgcagcccuaggaugccucgucaaagacuacuuccccgaacccgucaccgucagcuggaacagcggagcccucaccucuggaguccacaccuuccccgcgguccuacaaucauccgggcuauacucccucuccuccgucgugaccgucccuucaucaucccucggaacccagacauacaucugcaacgucaaucacaaaccaagcaacacaaaagucgauaagaaagucgaaccgaaaucaugcgacaaaacccacacaugcccacccugccccgcgcccgaacuccucggaggucccucugucuuccucuuucccccaaaaccaaaagauacccuaaugauaucacgaacccccgaagugaccugcgucgucguagacguaucgcacgaagaccccgaagucaaauucaacugguacguugacggcgucgaaguccacaacgccaaaaccaaacccagagaagaacaauauaacucaaccuaccgcgucgucuccguccuuaccguccuccaccaagacuggcuaaacggcaaagaauacaaaugcaaaguaucaaacaaagcccuccccgcccccaucgagaaaacaaucuccaaagcaaaaggccaaccccgcgaaccacaaguauacacccucccacccucccgagaagaaaugaccaaaaaccaagucagccucacaugccucgucaaaggcuucuaccccuccgacauagccgucgaaugggaauccaacggccaacccgaaaacaacuacaaaaccaccccacccguucucgacucugacggcucauucuuccuauacuccaaacucaccguugacaaaucacgcuggcaacaaggcaacgucuucucaugcucaguaaugcacgaagcccuccacaaccacuacacacaaaaaucgcucucacuaagccccggaaaa

SEQ ID NO: 53582 - RNA, 369 nt, Artificial Sequence
  derived and/or modified sequence opt11 from Bevacizumab_HeavyChain_V-Region
gaagugcaauuggucgagagcgggggcgggcucgugcaaccgggcgggagcuugcgcuugagcugugccgcgagcggguacacguucacgaacuauggcaugaacugggucaggcaagcgcccgggaaagggcucgagugggugggcuggaucaauaccuauaccggggaaccgaccuaugccgcggacuuuaaaaggcgcuuuacauuuagcuuggacacgagcaagagcacggccuaucuccagaugaauagccugcgcgcggaagauaccgcggucuauuacugugccaaguacccgcacuauuacgggagcucgcacugguacuuugacgugugggggcaagggaccuuggucacggucucgagc

SEQ ID NO: 53583 - RNA, 717 nt, Artificial Sequence
  derived and/or modified sequence opt11 from Bevacizumab_LightChain1
gccuccaaacucgcaaccaugggcuggucaugcaucauccuuuuccucgucgccaccgccaccggcguccacuccgacauacaaaugacccaaucccccucaucacuauccgccuccgucggcgaccgugucaccauaaccugccgcgccucacaagacauauccuccuaccuuaacugguaccaacaaaaacccggcaaagcccccaaacuccuaaucuacuacaccucccgacuccacucaggcgucccaucccgauucuccggcuccggcucaggcacagacuucaccuucaccaucuccucacuccaaccagaagacaucgccacauacuacugccaacaaggcaacacccuccccuacaccuucggccaaggcaccaaagucgaaaucaaacgcaccgucgccgcccccuccgucuucaucuucccacccucugacgaacaacucaaauccggcaccgccucagucgucugccuacucaacaacuucuacccccgcgaagccaaaguacaauggaaagucgacaacgcccuccaaucuggcaacucccaagaauccguuaccgaacaagacuccaaagacucaaccuacucccuauccuccacccucacccuaucaaaagccgacuacgaaaaacacaaagucuacgccugcgaaguaacacaccaaggccucucaucucccgucacaaaauccuucaaccgcggcgaaugc

SEQ ID NO: 53584 - RNA, 711 nt, Artificial Sequence
  derived and/or modified sequence opt11 from Bevacizumab_LightChain2
gccuccgcaaccaugggcugguccugcaucauccucuuccucgucgccaccgccaccggcguacacucagacauccaaaugacacaaucacccuccucccuauccgccuccguaggcgaccgcgucaccaucacaugcucagccucccaagacaucuccaacuaccucaacugguaccaacaaaaacccggcaaagccccaaaaguccuaaucuacuucaccuccucacuacacuccggcguccccucccgcuucucaggcucaggcuccggcaccgacuucacccucaccaucuccucacuccaacccgaagacuucgccaccuacuacugccaacaauacuccaccguccccuggaccuucggccaaggaaccaaagucgaaaucaaacgcaccgucgccgcccccuccgucuucaucuucccacccuccgacgaacaacuaaaaucaggcaccgccucagucgucugccuucuaaacaacuucuacccccgcgaagccaaaguccaauggaaagucgacaacgcccuccaauccggcaacucccaagaauccgucaccgaacaagacuccaaagacuccaccuacucccuauccuccacccuaacccucucaaaagccgacuacgaaaaacacaaagucuacgccugcgaagucacccaccaaggccucucuuccccagucaccaaauccuucaaccgaggcgaaugc

SEQ ID NO: 53585 - RNA, 642 nt, Artificial Sequence
  derived and/or modified sequence opt11 from Bevacizumab_LightChain
gacauccagaugacccaaucccccuccucccuaucagccuccgucggagaccgcgucaccaucacaugcuccgccagccaagacaucuccaacuaccucaacugguaccaacaaaaacccggcaaagcccccaaaguccucaucuacuucaccuccucccuccacuccggcguccccucccgcuucuccggcucaggcuccggcaccgacuucacccuaaccaucucuucacuccaacccgaagacuucgccaccuacuacugccaacaauacuccaccguccccuggaccuucggccaaggaaccaaagucgaaaucaaacgaaccgucgcagcccccuccguauucaucuucccacccuccgacgaacaacucaaauccggcaccgccuccgucguaugccuccucaacaacuucuacccccgcgaagccaaaguccaauggaaagucgacaacgcccuccaauccggcaacucacaagaauccgucaccgaacaagacuccaaagacuccaccuacucacucucauccacccuaacccucuccaaagccgacuacgaaaaacacaaaguauaugccugcgaagucacccaccaaggccucuccucccccgucaccaaauccuucaaccgaggcgaaugc

SEQ ID NO: 53586 - RNA, 324 nt, Artificial Sequence
  derived and/or modified sequence opt11 from Bevacizumab_LightChain_VJ-Region
gacauccaaaugacccaaucccccuccucccucuccgccuccgucggcgaccgcgucaccauaaccugcuccgccucccaagacaucuccaacuaccucaacugguaccaacaaaaacccggcaaagcccccaaaguccucaucuacuucaccuccucccuccacuccggcguccccucccgcuucuccggcuccggcuccggcaccgacuucacccucaccaucuccucccuccaacccgaagacuucgccaccuacuacugccaacaauacuccaccguccccuggaccuucggccaaggcaccaaagucgaaaucaaacgc

SEQ ID NO: 53587 - RNA, 321 nt, Artificial Sequence
  derived and/or modified sequence opt11 from Bevacizumab_LightChain_V-Region
gacauccaaaugacacaaucccccuccucccucuccgccuccgucggcgaccgcgucaccauaaccugcuccgcaucccaagacaucuccaacuaccucaacugguaccaacaaaaacccggcaaagcccccaaaguccuaaucuacuucaccuccucccuccacuccggcguccccucccgcuucuccggcuccggcuccggcaccgacuucacccucaccaucuccucccuccaacccgaagacuucgccaccuacuacugccaacaauacuccaccguccccuggaccuucggccaaggcaccaaagucgaaaucaaa

SEQ ID NO: 53588 - RNA, 369 nt, Artificial Sequence
  derived and/or modified sequence opt11 from Bevacizumab-rhuMAb-VEGF_HeavyChain_gamma1-Chain_VDJ-Region
gaaguacaacucgucgaauccggcggcggccucguccaacccggcggcucccuccgccuauccugcgccgccuccggcuacaccuucaccaacuacggcaugaacuggguccgccaagcccccggcaaaggccucgaaugggucggcuggaucaacaccuacaccggcgaacccaccuacgccgccgacuucaaacgccgcuucaccuucucccucgacaccuccaaauccaccgccuaccuccaaaugaacucccuacgcgccgaagacaccgccgucuacuacugcgccaaauacccccacuacuacggcuccucccacugguacuucgacgucuggggccaaggcacccucguaaccgucuccucc

SEQ ID NO: 53589 - RNA, 321 nt, Artificial Sequence
  derived and/or modified sequence opt11 from Bevacizumab-rhuMAb-VEGF_LightChain_VJ-Region
gacauccaaaugacccaaucccccuccucccucuccgccuccgucggcgaccgcgucaccaucaccugcuccgccucccaagacaucuccaacuaccucaacugguaccaacaaaaacccggcaaagcccccaaaguccucaucuacuucaccuccucccuccacuccggcguccccucccgcuucuccggcuccggcuccggcaccgacuucacccucaccaucuccucccuccaacccgaagacuucgccaccuacuacugccaacaauacuccaccguccccuggaccuucggccaaggcaccaaagucgaaaucaaa

SEQ ID NO: 53590 - RNA, 1341 nt, Artificial Sequence
  derived and/or modified sequence opt11 from Bevacizumab_gamma1-Chain
gagguccaacucgucgagagcggcggcggccucguccaacccggcggcucccuucgccuaagcugcgccgccuccggcuacaccuucaccaacuacggcaugaacuggguccgccaagcaccaggaaaaggacucgaaugggucggcuggauuaacaccuacaccggcgaaccaacauacgcugcagacuucaaacgacguuucaccuucucacuagacaccuccaaaagcacugcauaccuccaaaugaacucccuccgagccgaagacaccgcaguauacuacugcgcaaaauacccacacuacuauggcucaucccacugguacuucgacgucuggggccaaggaacacucgucaccgucagcucagccuccaccaagggccccagcguauucccucucgccccaucaucaaaauccaccucagguggcaccgcagcccucggcugccuagucaaggacuacuuccccgaacccguaaccgucucauggaacuccggcgcacuaacauccgguguccauacuuuccccgcaguucuucaaagcucuggaucccuaucaagcguugucaccgucccauccuccucccucggcacccaaacguacaucugcaacgucaaccacaaaccaagcaacaccaaaguagacaagaaagucgaaccaaaaucgugcgacaaaacccacacaugcccacccugccccgcccccgaacuucucggaggacccuccgucuuccucuucccacccaaacccaaagacacacuaaugaucagucgcacccccgaggucacaugcgucgucgucgacgucucucacgaggacccagaaguaaaguucaacugguacgucgacggcgucgaaguccacaacgccaaaaccaaaccacgcgaagaacaauacaacucguaugucgucuccguccucaccguccuccaccaagacuggcucaacgguaaagaauacaaaugcaaaguaucaaacaaagcccuccccgccccaauagagaaaaccauuucaaaagcuaaaggccaaccccgcgaaccccaaguauacacccuaccacccagccgcgacgaacuaaccaaaaaucaaguaagccucacgugccucgucaaaggauucuaccccucagacaucgccgucgaaugggaauccaacggccaacccgaaaacaacuacaaaaccacaccacccguccuagacuccgacggcucauucuucaaaaagcucacagucgacaaaagccgcuggcaacaaggcaacgucuucuccugcuccgucaugcacgaagcccuacacaaccacuacacccaaaaaucccucucacuuucccccggcaaa

SEQ ID NO: 53591 - RNA, 1359 nt, Artificial Sequence
  derived and/or modified sequence opt11 from Bevacizumab_gamma1-Chain_CH3-Region_mutein
gaaguccagcucgucgaaucaggcggcggccucguacaaccaggcggaucccucagacucuccugcgccgccuccggcuacaccuucacaaacuauggaaugaacuggguccgccaagcaccaggcaaaggccuagaauggguaggcuggaucaacacguacaccggagaacccaccuacgcagccgacuucaaacgcagguucaccuucucccuagacaccuccaaaucaaccgcguaccuccaaaugaacagccuccgcgccgaagauacagccgucuacuacugcgcaaaauacccacacuacuacggcuccucccacugguacuucgacgucuggggccaaggaacacucguaaccgucuccuccgcauccacuaaagguccguccgucuucccgcucgcccccuccuccaaaucaacaucuggcggcacagcagcccuagguugccucgucaaagacuacuuucccgaaccaguaaccgucuccuggaacagcggcgcccucacaagcggcguccacacauucccagccguccuacaaucaucaggacuauacagccucuccucaguagucaccguccccuccuccucccuaggaacccagacauacaucugcaacgucaaccacaaacccuccaacaccaaagucgacaagaaagucgaacccaaaucaugugacaaaacccacacaugcccucccugccccgcccccgaacuccuaggcggcccaucagucuuccucuucccacccaaacccaaagacacccuaaugaucuccaggacccccgaaguaaccugcgucguaguagacgucucacacgaagacccagaaguaaaauucaacugguacgucgacggcguagaaguccacaacgcaaaaacaaaaccgcgcgaagaacaauacaacagcaccuaccgcgucguaagcgugcuaaccguccuacaccaagacuggcucaacggcaaagaauacaaaugcaaaguaagcaacaaagcccuaccagccccaaucgaaaagaccauuuccaaagccaaaggacaaccccgcgaaccacaaguaugcacccucccgcccucacgcgacgaacucaccaaaaaccaagucucccucagcugcgccguuaaaggguucuaccccuccgauaucgcgguugaaugggaauccaacggccaacccgaaaacaacuacaaaaccaccccacccguccuagacuccgacggcucauucuuccucguguccaaacucaccgucgacaaaucacgcuggcaacaaggcaacgucuucucaugcuccgucaugcacgaagcccuacacaaccacuacacccaaaaaucacucucccucucacccgguaaa

SEQ ID NO: 53592 - RNA, 1347 nt, Artificial Sequence
  derived and/or modified sequence opt11 from Bezlotoxumab_HeavyChain1
gaaguccaacucguccaaucgggagccgaagucaagaaauccggagaaucccuaaaaauauccugcaaaggcuccgguuacuccuucaccagcuauuggauaggcuggguacgccaaaugccaggcaaaggacucgaauggaugggcaucuucuaccccggcgacucuuccacccgcuacucccccuccuuccaaggccaagucacaauauccgcagauaaauccgugaacaccgccuaccuacaaugguccucucuuaaagcaucagacacagcaauguacuacugcgcccgccgccgcaacuggggcaacgccuucgacaucuggggccaaggcaccaugguaacagucuccuccgccuccacaaaaggacccucugucuuuccccucgcucccuccuccaaguccaccucgggcggaaccgccgcccucggcugccucguaaaagacuacuuccccgaacccgucaccgucucauggaacuccggcgcccucaccucagguguacacaccuuccccgccguccuacaguccuccggacuauacucccucucguccguagucacaguccccuccagcagcuuaggaacccaaacauacauaugcaacgucaaccacaaacccuccaacaccaaagucgacaaaagaguagaacccaaaucuugcgacaagacacacaccuguccacccugccccgcccccgaacuacucggcggccccuccgucuuucucuucccucccaaacccaaagacacacucaugauaucuagaacccccgaagucacaugcgucgucguagacgucucacacgaagaccccgaaguaaaauucaacugguacgucgacggcguagaaguccacaacgcaaaaaccaaaccccgcgaagaacaauacaacuccaccuaccgcgucgucuccgucuuaaccguacuccaccaagauuggcucaauggcaaagaauauaaaugcaaagucucgaacaaagcccuccccgcccccaucgaaaagaccaucagcaaagcuaagggccaaccccgcgaaccccaagucuacacccucccacccagcagagaagaaaugaccaaaaaccaagucucccuaaccugccucgucaaaggauucuaccccucugacaucgccgucgaaugggaaagcaacggccaacccgaaaacaacuacaaaaccaccccacccguccucgacagcgacggcucuuucuuccucuacuccaaacucaccgucgacaaaucgcgauggcaacaagguaacgucuucuccugcagcgucaugcacgaagcgcuccacaaccacuacacccaaaaaucccucucccucagccccggcaaa

SEQ ID NO: 53593 - RNA, 645 nt, Artificial Sequence
  derived and/or modified sequence opt11 from Bezlotoxumab_LightChain1
gaaaucguacucacccagagccccggcacccucucccuaucacccggcgaaagagccacccuauccugccgcgccucacaauccgucuccuccucauaccucgccugguaccaacaaaaacccggccaagcaccccgccuccuuaucuacggagccuccucccgcgccacaggcaucccagaccgcuucucaggcuccggcuccggaaccgacuucacccucaccaucucccgacuugaacccgaagacuucgccgucuacuacugccaacaauacggcuccucaaccuggaccuucggacaaggcaccaaagucgaaauaaaacgcaccgucgcagcccccuccgucuucaucuucccacccuccgacgaacaacuaaaauccggcaccgccucagucguaugccuccucaacaacuucuacccccgcgaagccaaaguccaauggaaagucgacaacgcccuccaauccggaaacucccaagaauccgucaccgaacaagacuccaaagacucaaccuacucccucucauccacccucacccucuccaaagcagacuacgaaaaacacaaagucuacgccugcgaagucacccaccaaggccucuccucccccgucaccaaauccuucaaccgaggcgagugc

SEQ ID NO: 53594 - RNA, 1335 nt, Artificial Sequence
  derived and/or modified sequence opt11 from Bimagrumab_HeavyChain1
caaguccaacucguccaauccggcgccgaaguaaaaaaaccaggagcaucaguuaaagucaguugcaaagccuccggauacaccuucacauccucauacaucaacuggguccgacaagcaccaggccaaggacucgaauggauggguaccaucaaccccguauccggcuccaccuccuacgcccaaaaauuccaaggccgagucaccaugaccagagacaccuccauaagcacggccuacauggagcucucccgccuacgaucagacgacaccgccguauacuacugcgcccguggcggaugguuugacuacuggggucaaggaacccucgucaccguauccuccgccagcaccaaaggccccuccgucuucccccucgcccccuccuccaaauccaccucaggaggaaccgccgcacucggcugccuagucaaagacuacuucccagaaccagucaccguauccuggaacuccggcgcccucaccucaggcguacauaccuuccccgccguccuacaaucuuccggccucuacucacuauccagcgucgucaccguccccuccucaucacucggcacccaaaccuacaucugcaacgucaaccacaaacccuccaacaccaaagucgacaaacgcgucgaaccaaaaucaugcgacaaaacccacacaugcccaccauguccagcccccgaagccgccggcggcccaucagucuuccucuucccaccaaaacccaaagacacccucaugaucagucgcacccccgaaguaacaugcgucgucgucgauguaucacacgaagaccccgaaguuaaauucaacugguacguugacggcguagaaguacacaacgccaaaaccaaaccccgagaagaacaauacaacuccaccuaccgagucgucagcguccucacaguccuccaccaagacugguuaaacggaaaagaauacaaaugcaaagucuccaauaaagcucuacccgcccccaucgaaaaaaccaucuccaaagcuaaaggccagccccgagaaccacaaguauauacccuccccccaucccgagaagaaaugaccaaaaaccaaguaucccuuaccugcuuagucaaaggcuucuaucccuccgacaucgccgucgaaugggaaucaaacggccaacccgaaaacaacuacaaaacaacaccacccguccuggacuccgacggcucauucuuccuauacuccaaacuuaccguagacaaaucccgcuggcaacagggcaacgucuucucgugcuccgucaugcacgaagcacuccacaaccacuacacccaaaaaucccucucccucucccccggcaaa

SEQ ID NO: 53595 - RNA, 1332 nt, Artificial Sequence
  derived and/or modified sequence opt11 from Bimagrumab_HeavyChain
caaguacagcuaguacaaucaggcgcagaagucaagaaacccggagcaucagucaaaguauccugcaaggcuuccggcuacaccuucacuuccucauacauaaacuggguccgacaagcccccggccaaggucucgaauggaugggcaccauaaaccccguaagcggcuccacuucauaugcacaaaaauuccaaggccgcguaacaaugacccgcgacaccuccaucuccacugcauacauggaacucucccgacuccgcuccgacgacaccgccguauacuacugcgcacgaggcggcugguucgacuacuggggccaaggcacccuuguaacagucuccuccgccucuacgaaaggucccuccgucuucccccucgccccgagcuccaaauccacaucaggcggcaccgcagcccuaggcugccucgucaaagacuacuuccccgaaccagucaccgucuccuggaacagcggcgcacucacauccggcguccacaccuuccccgcuguccuccaaucauccggccucuacucccuuuccagcgucgucacaguccccuccucaucccucggcacgcaaacauacaucugcaacgucaaucacaaaccaucaaacacaaaaguagacaaacgcguagaacccaaauccugcgacaaaacccacaccugucccccaugcccagcacccgaagccgccggagggcccucaguauuccuguucccacccaaacccaaagacacacuaaugaucucgcguaccccugaaguaaccugcgucguagucgacguuucccacgaagaccccgaagucaaauucaacugguacgucgacggcgucgaaguacacaacgccaaaaccaaaccccgcgaagaacaguacaacuccacauaccgcgucgucuccguacucaccguacuacaccaagacuggcucaacggaaaagaauacaaaugcaaaguuuccaacaaagcccuccccgcccccauagagaaaaccaucuccaaagccaaaggccaaccacgcgaaccacaagucuacacccuuccacccucacgcgaagaaaugaccaaaaaccaagucagccucacaugccucgucaagggcuucuaccccucagacaucgcagucgaaugggaauccaacggacaacccgaaaacaacuacaaaacaacaccacccguccucgacucagacggcagcuucuuccuauacuccaaacucacaguagacaaaagccguuggcagcaaggaaacgucuucucaugcucagucaugcacgaagcacuacacaaccauuacacccaaaaaucccuaucccucucccccggc

SEQ ID NO: 53596 - RNA, 651 nt, Artificial Sequence
  derived and/or modified sequence opt11 from Bimagrumab_LightChain1
caauccgcccucacccaaccagccuccgucuccggaucaccaggccaauccaucaccaucuccugcaccggcaccuccuccgacgucggcuccuacaacuacgucaacugguaccaacaacaccccggaaaagcacccaaacuaaugaucuacggagucuccaaacgccccucaggagucuccaaccgauucuccggcucaaaauccggcaacaccgccagccucaccaucuccggacuccaagccgaagacgaagccgacuacuacugcggcaccuucgccggcggcuccuacuacggcgucuucggcggcggcaccaaacuaaccguccucggacaaccaaaagccgcccccuccgucacccucuucccacccuccuccgaagaacuccaagccaacaaagccacacucgucugccucaucuccgacuucuacccaggcgccgucaccgucgccuggaaagccgacuccucccccgucaaagccggcgucgaaaccaccacccccuccaaacaauccaacaacaaauacgccgccuccucauaccucucccucaccccagaacaauggaaaucccaccgauccuacuccugccaagucacccacgaaggcuccaccgucgaaaaaaccgucgcccccacagaauguucc

SEQ ID NO: 53597 - RNA, 1365 nt, Artificial Sequence
  derived and/or modified sequence opt11 from Bimekizumab_HeavyChain1
gaaguacagcuaguagaaagcggcgguggccuaguccaacccgguggaucccuccgacucagcugcgccgccuccggcuuuaccuucuccgacuacaacauggccuggguccgccaagcacccggcaaaggacucgaaugggucgcaaccaucaccuacgaaggacgcaacaccuacuaucgggacuccgucaaaggccgcuucaccaucuccagagacaacgccaaaaacucccucuaccuccaaaugaacucucuccgcgcagaagacaccgcagucuacuacugcgccucgccaccccaauacuacgaaggcuccauauaccgccucugguucgcccacuggggacaaggaacccuagucaccgucucuagcgccucaaccaaaggcccuuccgucuucccccucgcccccucaucuaaauccacuucaggcggcacagccgcccucggcugccucguaaaagacuacuuccccgaacccgucacagucagcuggaacucuggcgcucucacuucaggcguacacaccuucccugcaguccuccaaucuucaggacucuacucccuaucauccgucguaaccguccccuccucaucccucggcacacaaaccuauaucugcaacgucaaccacaaaccauccaacaccaaagucgacaagaaagucgaacccaaauccugcgacaaaacccacacaugcccucccugccccgcccccgaacuacucggaggccccuccgucuuccuauucccaccaaaacccaaagacacccucaugauaucccgaaccccugaaguuaccugcgucgucgucgacgucucccacgaagaccccgaagucaaauucaacugguacgucgacggcguagagguccacaaugccaaaaccaaaccccgagaagaacaauacaacucuacauaccgcgucguauccguccucaccguccuacaccaagacuggcucaacgggaaagaauacaaaugcaaagucuccaacaaagcacugccagcacccaucgagaaaacaauauccaaagccaaaggccaaccccgagaaccccaagucuacacacuacccccuucccgcgacgaacucaccaaaaaucaaguaucacuaaccugccuagucaaaggcuucuacccauccgacauagccgucgaaugggaauccaacggccaaccagaaaacaacuacaaaaccacacccccaguccuagacuccgacggcuccuucuuccuauacucaaaacucaccgucgauaaaucccgauggcaacaaggcaacgucuuuuccugcuccgucaugcacgaagcccuacacaaccacuacacccaaaaaucccucucucuaucacccggcaaa

SEQ ID NO: 53598 - RNA, 642 nt, Artificial Sequence
  derived and/or modified sequence opt11 from Bimekizumab_LightChain1
gcuauccagcucacgcaaucacccucgagcuugagcgcgagcgucggcgaucgcgugaccauaaccugccgcgcggacgagagcguacgcacacucaugcacugguaccagcaaaagcccggaaaagcacccaagcucuuaaucuaucucgugagcaacagcgaaaucggggucccggacagguucuccggcucaggcucgggaacggacuuccgccugaccauauccucgcuacagcccgaggacuucgccacguacuacugccagcaaacguggucggacccguggacguucgggcaagggaccaaggucgagaucaagcgcacagucgcggccccaagcguguucauauucccgcccucggacgaacaauugaaaucgggcacggccucagucguaugccuacucaauaacuucuacccgcgcgaggccaagguccaguggaaggucgacaacgcacuccagagcgggaacucacaagagagcgugaccgagcaagauagcaaggacucgaccuacagccuaagcucgacccugaccuugaguaaggccgacuacgagaaacauaaaguguacgcaugcgaggucacgcaccagggccuaagcucgccagugaccaagagcuuuaacagaggcgagugc

SEQ ID NO: 53599 - RNA, 1344 nt, Artificial Sequence
  derived and/or modified sequence opt11 from Bleselumab_HeavyChain1
caacuccaacuccaagaaucaggcccaggccuccucaaacccucugagacccucagccucaccuguaccgucuccggaggcucaaucagcucccccggcuacuacggaggauggauccgccaaccacccggaaaaggccucgaauggaucggcuccaucuacaaauccggcuccaccuaccacaaccccucccucaaaucccgugucacuauauccgucgacacgagcaaaaaccaauucucccucaaacucucuuccgucaccgccgcagacaccgccgucuacuacuguacacgccccgugguccgcuacuucggaugguucgaucccuggggccaaggaacccuaguaaccgucucaucagcauccaccaaaggucccuccgucuucccacucgccccuugcucccgauccaccucagaaagcaccgccgcacucgggugccucgucaaggauuacuucccagaacccgucaccgucucauggaacuccggagcccuaaccucaggcguucacaccuucccagccguccuccaaagcuccggacucuacucacuaucauccguaguaacagucccaucuuccuccuuaggaacaaaaacauacacaugcaacgucgaccauaaacccucaaacaccaaagucgacaaacgcgucgaauccaaauacggaccacccugcccacccugcccagcccccgaauuugaaggcggucccuccgucuuccuguucccacccaaacccaaagauacccucaugauaagccgcacccccgaaguaaccugcgucgucguagacgucucccaagaagaucccgaaguccaauucaacugguacguagacggcgucgaaguccacaacgcuaaaaccaaaccccgcgaagaacaauucaacucaaccuaccgcguagucuccguacucaccguccuccaccaagacuggcuaaacggcaaggaauacaaaugcaaagucucaaacaagggccuaccauccuccaucgaaaagacaauaucuaaagccaaaggacaaccacgugaaccccaaguauacacccuucccccaucgcaagaagaaaugaccaaaaaccaaguaucccuaaccugccucgucaaaggauucuaccccuccgacaucgcaguagaaugggaauccaacggacaacccgaaaacaacuacaaaacuacacccccaguacucgacuccgacgguucuuucuuccucuacucccgacuaacugucgacaaaucccgauggcaagaagguaacguauucuccugcuccgucaugcacgaagcccuacacaaccauuacacucaaaaaucacuuucacuuucacucggcaaa

SEQ ID NO: 53600 - RNA, 639 nt, Artificial Sequence
  derived and/or modified sequence opt11 from Bleselumab_LightChain1
gccauccaacucacccaaucccccuccucccuauccgccuccgucggcgaccgcgucaccaucaccugccgcgccucccaaggcaucucauccgcccuagccugguaccaacaaaaacccggcaaagcccccaaacuacuaaucuacgacgccuccaaccucgaauccggcguccccucccgcuucuccggcuccggcuccggcaccgacuucacacucaccaucuccucccuccaacccgaagacuucgcaaccuacuacugccaacaauucaacucauaccccacauucggccaaggcaccaaagucgaaaucaaacgcaccgucgcagcccccuccgucuucaucuucccccccuccgacgaacaacuaaaauccggcaccgccuccgucguaugccuccuaaacaacuucuacccccgcgaagccaaaguccaauggaaagucgacaacgcccuacaauccggaaacucccaagaauccgucaccgaacaagacucaaaagacucaaccuacucccuauccagcacccuaacacucuccaaagccgacuacgaaaagcacaaagucuacgcaugcgaagucacccaccaaggccucuccucacccgucaccaaauccuucaacagaggcgaaugc

SEQ ID NO: 53601 - RNA, 1512 nt, Artificial Sequence
  derived and/or modified sequence opt11 from Blinatumomab_HeavyChain1
gacauccaacucacacaaucacccgcaagccuagccguaagccuaggccaacgcgcaaccaucagcugcaaagccagccagagcgucgacuacgacggagacuccuaccucaacugguaccaacaaauacccggacaacccccaaaacuccuaauauacgacgccuccaaccucgucagcggcauaccaccacgauucucaggcucgggauccggaacagacuucaccuugaacauacaccccgucgaaaaagucgacgccgcgacauaccacugccagcaaucaacagaagacccauggaccuucggcggcggaaccaaacucgaaaucaagggaggcggaggaaguggcgguggcggcagcggaggcggaggaagccagguccaacuccagcaaucaggcgcagagcuaguccggcccggaagcuccgucaagaucuccugcaaggcuuccggauacgccuucagcucauacuggaugaacuggguaaaacagagaccaggacaaggacucgaauggaucggacaaauauggcccggagacggagacacgaacuacaacggcaaauucaaaggcaaagccacucucacagccgacgaaucgagcucgaccgcguacaugcaacuaagcucacuagcguccgaagacucagcaguauacuucugcgcucgccgagaaaccaccacaguaggaagauacuacuacgccauggacuacuggggccagggaacaacggucacggucucgagcggcggcggcggcucggacaucaaacuacaacaauccggggcagaacucgccagaccaggcgccucaguaaaaaugaguuguaaaacgagcggauacaccuucacacgcuacaccaugcacugggucaaacaaagacccggccaaggccucgaguggauaggauacauuaaccccagccgaggauacacaaacuauaaccaaaaauucaaagacaaagcgacccucacaacagacaaaagcucaagcacagccuacaugcaacuaagcagccuaacaucagaagacagcgcaguauacuacugcgcccgcuacuacgacgaccacuacugccucgacuacuggggacaagggaccacccuaacgguuucuagcguggaaggaggcucaggcggcagcggcggcucaggagggagcggcggcgucgacgacauucaacuaacccaaucacccgccauaaugagcgcaagccccggagaaaaagucaccaugaccugccgagcaaguucaagcguaagcuacaugaauugguaccagcaaaaauccggcacauccccaaaaagauggaucuacgacaccucaaaaguagcgucaggcguccccuaccgauucagcggguccggaaguggaaccuccuacucccucaccaucuccagcauggaagcagaagacgccgccacuuacuacugccaacaauggucauccaacccacuaacauucggagcaggcacgaagcuagaauuaaaacaucaccaccaccaccac

SEQ ID NO: 53602 - RNA, 1512 nt, Artificial Sequence
  derived and/or modified sequence opt11 from Blinatumomab_SingleChain
gacauccaacucacccaaucacccgcgucccuagccguuagccuaggccaacgcgccaccauaagcugcaaagccagccaaagcgucgacuacgacggcgacucauacuuaaacugguaccaacaaauacccggacaaccacccaaacuccugaucuacgacgcaucaaaucucguaagcggaaucccgccccgguucuccggaucaggcuccggcacggacuucacacuaaacauacacccagucgaaaaggucgacgccgcgaccuaccacugccaacaauccacugaagacccauggacguucgggggaggaacgaagcucgaaaucaaaggaggaggcggaagcggaggaggcggcagcggaggaggcggaagccaaguacaacuccagcaaucgggagcagagcuaguccgaccaggcagcucagucaaaauaucaugcaaagcaucaggcuacgcauucuccucauacuggaugaacugggucaaacaaagaccaggccaaggacucgaauggaucggacaaaucuggcccggcgacggcgacacaaacuacaacggcaaguucaagggcaaagcaacccucacagcagacgaaagcagcuccaccgcauacaugcaacuaagcucacuagcaagcgaagauucagcaguauacuucugugcacggcgagaaacgaccaccguaggccgauacuacuacgccauggacuacuggggccaaggcacaacaguuacgguaagcucaggaggcggaggcagcgacaucaaacuacaacaaucaggagcagaacucgcucgccccggcgccuccgucaaaaugagcuguaaaaccagcggauacacauucacccgauacaccaugcacuggguaaaacaaaggcccggacaagggcucgaauggauaggcuacaucaaccccagccgcggauacacaaacuacaaccaaaaauucaaagacaaagccacacuaacaacggacaaaagcuccucaacagccuacaugcaacucagcagccuaacaucagaagacucagcaguauacuacugcgcccgauacuacgacgaccacuacugccucgacuacugggggcaaggaacaacacucacaguauccagcguggaaggcggaucaggcggauccggaggcucaggagggagcggaggcguggaugacauccaacucacccaauccccugccaucaugagcgccagccccggagaaaaaguaaccaugaccugccgcgcaagcucaagcguaagcuauaugaacugguaccagcagaagucaggcacaagcccaaaaagauggauauacgacaccagcaaaguagccagcggcguacccuaccgauucagcggaagcgggagcggaaccuccuacucccucacgauaucaaguauggaagccgaagacgccgccaccuacuacugccaacaauggucaagcaacccccuaaccuucggcgccggcacgaaacucgaacucaaacaccaccaccaccaccac

SEQ ID NO: 53603 - RNA, 1512 nt, Artificial Sequence
  derived and/or modified sequence opt11 from Blinatumumab_SingleChain_variable_fragment_fusion_protein_(bite)
gacauccagcuaacccaaucaccagcaagccuggccgugagccugggacagcgagcaaccauaagcugcaaagcaagccagagcguggacuaugacggcgacucauacuugaacugguaccaacagauccccggacaaccgcccaagcuccuaauauaugacgcaaguaaccucguaagugggaucccacccagauucucuggcuccggcucgggcacggacuucacccuaaacauacaccccgucgaaaaaguagacgccgcaacauaccacugccaacaaucaaccgaggacccauggacauucggaggcgggaccaagcucgaaaucaaaggcgggggcgggucugggggcggcggaucgggagggggaggcucccaaguucagcuccaacaaucaggcgccgaacugguccgacccgggagcucagucaaaauauccugcaaagcaucaggcuacgccuuuagcucauacuggaugaacuggguaaaacaacgcccaggccaaggccucgaauggauaggacaaauauggccaggcgacggcgacacaaacuacaacggcaaauucaaaggcaaggcaacacucacggccgacgaaucguccucaaccgcuuacaugcaacuaagcucccucgcaucagaagacucggccguauacuucugcgcgcgaagagaaacaaccacaguaggacgauacuacuaugccauggacuauuggggccaaggaaccacagucaccguaucaagcgggggcgggggcucggacaucaaacuacaacaaagcggggccgaacucgcccgcccgggagcgagcgucaaaaugaguuguaaaacaagcggauacacauucacgcgcuacaccaugcacuggguaaaacaaaggccagggcaagggcuagaguggaucggcuauauaaaucccucacgcggauacacaaacuacaaccaaaaauuuaaagauaaagcaacccucaccacggacaagaguucaagcacagccuacaugcaacugucgagccuaaccucggaagacagcgcggucuauuacugcgccagguacuacgacgaccacuacugucuagacuacugggggcaagggaccacgcuaacagucuccagcguagaaggagguucgggagggagcgggggcucuggcgggagcggggguguagacgacauccaacucacacaaucgcccgcaaucaugagcgcuagcccaggcgaaaaagucaccaugaccugccgagcgagcagcagcguauccuacaugaacugguaccaacaaaaauccggcacgaguccgaaacgauggauauacgacaccucgaaaguggccucaggcguacccuacagauuuagcggaagcgggaguggaaccucauacucccucacgaucucaagcauggaagccgaagacgccgcaaccuacuacugccaacaauggucaagcaacccccucacuuuuggugcaggaacgaaacuagagcugaaacaccaccaccaccaccac

SEQ ID NO: 53604 - RNA, 1344 nt, Artificial Sequence
  derived and/or modified sequence opt11 from Blontuvetmab_HeavyChain
caaguccaacuccagcaaucccgcgccgaacucgucagacccggcgccuccgucacccucucaugcaaaccauccggcuacaccuucaccgacuacgaaguacacugggucaaacaaacccccguacacggccucgaauggaucggcgcuauagaccccgaaacuggcgggaccgccgauaaccaaaaauucaaaggaaaagccauacucaccgccgacaaaucuagcagcacagccuacauggaacugcgaucacucaccuccgaagacuccgccgucuacuauugcacuaacuucguagacguaugggguaccggcaccaccgucaccgugucaucugccuccaccaccgcccccuccgucuucccccucgcaccaucuugcggaucccaaucaggcucaaccgucgcgcucgccugccucguauccggcuacuucccugaacccguaaccgucucauggaacuccggcucacucaccuccggaguccacaccuucccuucaguacuacaaucauccggccucuacucccucucuucuauggucaccguccccagcucacgcuggccauccgaaaccuucacaugcaacguagcccacccagcaucaaaaaccaaagucgacaaaccuguccccaaaagagaaaacggucgcgucccccgacccccagacugccccaaaugccccgcaccagaaaugcucggaggaccuuccgucuucauauucccuccuaaaccaaaagacacccuacucauagcacgcacucccgaaguuaccugcgucgucgucgaccucgaucccgaagacccagaaguccaaaucucaugguucgucgacggcaaacaaaugcaaaccgccaaaacccaaccccgcgaagaacaauucaacggcacuuaccgagucgucucuguccuccccauaggccaccaagacugguuaaaaggcaaacaauucaccuguaaggucaauaacaaagcacuacccucgcccaucgaacgcacuauaucaaaagcccgcggccaagcccaccaaccaucugucuacguacuaccacccucccgagaagaacuauccaaaaacaccgucucacuaaccugccucaucaaagacuucuucccacccgauaucgacgucgaauggcaaucaaauggccaacaagaacccgaguccaaauacagaaccacacccccucaacucgacgaagacgguucauacuuccucuacucaaaacucuccgucgacaagucccgauggcaacgcggagacaccuucauaugcgcugucaugcacgaagcccuccacaaccacuacacccaaaaaucacucucacacucccccggaaaa

SEQ ID NO: 53605 - RNA, 657 nt, Artificial Sequence
  derived and/or modified sequence opt11 from Blontuvetmab_LightChain
gacgucgucaugucacaaucccccuccucacucgccgucuccgucggcgaaaaagucaccauguccugcaaauccucccaaucccuccuauacucuggcaaccaaaaaaacuaccucgccugguaccaacaaaaacccggccaaucuccccgacuccucauuuacugggccuccacccgcgaauccggcgucccagaccgcuucaccggcuccggaucaggcaccgacuucacccucaccaucucaucugucaaagccgaagaccuagccgucuucuacugccaacaauacuacaacuacccacucaccuucggaggcggcacccaccuaacaguccucggccaacccaaggccucacccuccgucacccucuucccccccuccuccgaagaacucggcgcaaacaaagcaacccuuguuugccucaucuccgacuucuaccccucaggcgucaccgucgccuggaaagccgacggcucccccaucacccaaggagucgaaacaaccaaacccucaaaacaaucuaacaacaaauacgccgccucuuccuaccuaucccuaacccccgacaaauggaaaucccacuccuccuucuccugccuagucacccacgaaggcuccaccgucgaaaaaaaagucgccccagccgaaugcucc

SEQ ID NO: 53606 - RNA, 1332 nt, Artificial Sequence
  derived and/or modified sequence opt11 from Blosozumab_HeavyChain1
caaguacaacucguccaauccggggccgaagucaagaaacccggcgcauccguaaaagucagcugcaaagucagcggcuuccccaucaaagacacauuccaacauuggguccgacaagcccccggcaaaggccucgaauggaugggcuggucagaccccgaaaucggagacaccgaauacgcauccaaauuccaaggccgagucaccaugaccgaagacaccuccaccgacaccgccuacauggaacuaucaagccugcguuccgaagacacagccgucuacuacugcgccaccggcgacaccacuuacaaauucgacuucuggggccaaggcacaaccguaacugucuccuccgcaucaaccaaaggccccuccguuuucccccucgccccaugcucccgcuccaccuccgaaucaacagccgcacucggaugccugguuaaagacuacuuuccagaacccgucaccguauccuggaacuccggcgcccuuaccucuggcguacacacauuccccgccguccuacaauccuccggccucuacucucucucauccgucgucacaguacccuccucuucacuaggcacaaaaacauacacaugcaacgucgaccacaagcccuccaacacuaaagucgacaaacgcgucgaauccaaauacggcccacccugcccaccaugcccagccccggaguuccucggcggcccaucggucuuccucuucccucccaagcccaaagacacacucaugaucucacgcacccccgaagucacaugcguagucgucgacguaucccaggaagauccugaaguccaauucaacugguacgucgacggcgucgaaguacacaacgcaaaaaccaaaccacgagaagaacaauucaacucaaccuaucgagucgucuccguccuaaccguccuccaccaagacuggcucaacggcaaagaauacaaguguaaagucaguaacaagggacuacccuccuccaucgaaaagaccauauccaaagccaagggccaaccccgcgaaccccaagucuacacccuacccccaucacaagaagaaaugaccaaaaaccaagucucacucacaugccucgucaaaggcuucuaccccuccgacaucgccguagaaugggaaagcaauggacaacccgaaaacaacuacaaaaccacucccccaguacucgacuccgacggcagcuucuuccucuacucaagacucaccgucgacaaaucccgcuggcaggaaggcaacgucuucagcugcuccgucaugcacgaagccuuacacaaccacuacacccaaaaaucccuuucccuaucacuagga

SEQ ID NO: 53607 - RNA, 642 nt, Artificial Sequence
  derived and/or modified sequence opt11 from Blosozumab_LightChain1
gacauccagaugacucaaagcccauccucccucuccgccuccgucggcgaccgcguaaccaucacuugcaaagcuagccaagacguccacaccgccgucgccugguaccaacaaaaacccggaaaagcacccaaacuccucaucuacugggccucaacccgcuggaccggcguaccaucccgcuucuccggcuccggcucaggcaccgacuucacccucaccaucuccucccuacaacccgaagacuucgccaccuacuacugccaacaauacuccgacuaccccuggaccuucggcggaggaaccaaagucgaaaucaaacgcaccgucgccgcccccucagucuucaucuucccacccuccgacgaacaacucaaauccggaacagccuccgucgucugccuacucaacaacuucuacccccgcgaagccaaaguccaauggaaagucgacaacgcccuccaauccggcaacucacaagaauccgucaccgaacaagacuccaaagacuccaccuacucccucucauccacccucacccuauccaaagccgacuacgaaaaacacaaagucuacgccugcgaagucacccaccaaggccucuccucccccgucaccaaauccuucaaccgcggcgaaugc

SEQ ID NO: 53608 - RNA, 1332 nt, Artificial Sequence
  derived and/or modified sequence opt11 from Bococizumab_HeavyChain1
caaguccaacucguccaaucaggagccgaagucaagaaacccggcgccuccgucaaagucuccugcaaagcauccggcuacaccuucaccuccuacuacaugcauugggucagacaagcccccggccaaggccucgaauggaugggcgaaaucuccccauucggcggucgcaccaacuacaacgaaaaauucaaaucccgcgugaccaugacccgagacacaagcaccuccacuguauacauggaacucuccucacuccgcucagaagacaccgccgucuacuacugcgcccgagaacgcccacucuacgcauccgaucucuggggccaaggcaccacaguuaccgucuccuccgcauccacaaaaggcccuagcgucuucccccucgcacccugcucacguuccacaucagaaagcaccgccgcgcuaggcugccucgucaaagacuacuuccccgaaccaguuacagucucauggaacucaggcgcccucacaucgggcguacacaccuucccagccguccuacaaucauccggccucuacagccuauccagcgucguaaccguccccuccuccaacuucggcacccaaaccuacacgugcaacgucgaccacaaacccuccaacacaaaagucgacaaaacagucgaacgaaaauguugcgucgaaugcccacccugccccgcaccacccgucgccggacccucuguauuccucuucccacccaaacccaaagacacccucaugaucucccgaacccccgaaguaaccugugucguagucgacgucucccacgaagaccccgaaguacaauucaacugguacguggacggcguugaaguccacaacgccaaaacaaaaccccgcgaagaacaauucaacucaaccuucagagucgucucaguccucaccgucguacaccaagacuggcucaacggcaaagaauacaaaugcaaaguauccaacaaaggccuccccucauccaucgagaaaaccauauccaaaaccaaaggccaaccccgagaaccccaagucuacacacucccacccagucgcgaagaaaugaccaaaaaccaaguaucacugacaugccucgucaaaggcuucuaccccuccgacauagcuguagaaugggaauccaacggccaacccgaaaacaacuacaaaaccaccccacccaugcucgacuccgacggcucauucuuccuauacagcaaacuaaccguagacaaaucccguuggcaacaagguaacguauucucgugcucagucaugcacgaagcacuccacaaucacuacacacaaaaaucacuuucacucucacccggaaaa

SEQ ID NO: 53609 - RNA, 642 nt, Artificial Sequence
  derived and/or modified sequence opt11 from Bococizumab_LightChain1
gacauccaaaugacucaaucccccuccucccuauccgcuuccgucggcgaccgcgucaccaucacaugccgcgcuucccaaggcaucucaucggcccucgccugguaccaacaaaaacccggcaaagcccccaaacuccucaucuacuccgccuccuaccgcuacaccggaguccccucccgauucuccggcuccggcucaggcaccgacuucaccuucaccaucucuucacuccaacccgaagacaucgccaccuacuacugccaacaaagauacucccucuggcgaaccuucggacaaggaaccaaacucgaaaucaaacgcacagucgccgcccccuccgucuucaucuucccacccuccgacgaacaacucaaauccggcaccgccuccgucgucugccuccucaacaacuucuacccccgagaagccaaaguccaauggaaagucgacaacgcccuccaauccggcaacucccaagaauccgucaccgaacaagacuccaaagacuccaccuacucccucuccucaacccucacccucuccaaagccgacuacgaaaaacacaaagucuacgccugcgaagucacacaccaaggccuauccucccccguaaccaaaucauucaaccgaggcgaaugc

SEQ ID NO: 53610 - RNA, 1338 nt, Artificial Sequence
  derived and/or modified sequence opt11 from Brentuximab_vedotin_HeavyChain1
caaauucaacuccagcaaucaggcccagaaguggucaagcccggagccagcgucaaaaucuccugcaaagccagcggcuacaccuucaccgauuacuacaucacaugggucaaacaaaaacccggccaaggccucgaauggaucggcuggaucuaccccggcuccggcaacacuaaauacaacgaaaaauucaaaggcaaagcaacccuaaccguagacaccuccucauccacagcauucaugcaacugucaucccucaccucagaagauaccgcugucuacuucugcgcaaacuacggcaacuacugguucgcauacuggggccagggcacacaagucacaguaucagcagcaucaacaaaaggccccuccguauucccacuagcccccucgagcaaauccacgucuggcggaacagcagcccucggcugccucgucaaagacuacuucccagaaccugucaccgucucguggaacuccggagcgcucaccucaggcguacacacauuccccgcuguccuccaauccuccggccuguacucacucucauccgucguuaccguacccagcuccucacucggaacccaaaccuacaucugcaacgucaaccacaaacccuccaacacaaaagucgacaagaaagucgaacccaaauccugcgacaaaacacacacaugcccucccugccccgcccccgaacuucuaggcggucccucaguauuccucuuucccccuaaacccaaagacacacucaugauuagccgaaccccagaaguaaccugcgucgucguagacgucucgcacgaggaccccgaaguaaaauucaacugguacgucgacggagucgaaguccacaacgcaaaaaccaaaccacgagaagaacaauacaacuccaccuacagagucgucagcguccucacaguccuacaccaagacuggcuuaacggaaaagaauacaaauguaaagucucaaacaaagcccucccugccccaaucgagaaaaccaucuccaaagcaaaaggccaaccgcgagaaccccaggucuacacacucccacccucccgugacgaacuaaccaaaaaccaagucucacuaaccugccucgucaaaggcuucuaccccuccgacauagcaguagaaugggaauccaacggucaacccgaaaacaacuacaaaaccacaccacccguccucgacuccgacggauccuucuuccucuacuccaaacucaccgucgacaaaucacgcuggcaacaaggcaacguauuuuccugcucggucaugcacgaagcccuccacaaccacuacacccaaaaaucccucucccucucccccggc

SEQ ID NO: 53611 - RNA, 654 nt, Artificial Sequence
  derived and/or modified sequence opt11 from Brentuximab_vedotin_LightChain1
gacaucguccucacucaaucccccgcuucccucgccguaucccucggccaacgagcgaccaucuccugcaaagccucccaauccgucgacuucgacggcgacuccuacaugaacugguaccaacaaaaacccggccaaccccccaaaguccuaaucuacgccgccuccaaccucgaauccggaauccccgcccgauucuccggcuccggcuccggcacagacuucacccucaacauccaccccgucgaagaagaagacgccgccaccuacuacugccaacaaucaaacgaagaccccuggacauucggaggcggcaccaaacucgaaaucaaacgcaccgucgccgcccccuccgucuucaucuucccucccuccgacgaacaacucaaaucaggcaccgccuccgucgucugccuacucaacaacuucuacccccgcgaagccaaaguccaauggaaaguagacaacgcccuccaauccggcaacucacaagaauccgucaccgaacaagacuccaaagacuccaccuacucccucuccucaacccucacccucuccaaagccgacuacgaaaaacacaaagucuacgccugcgaagucacccaccaaggccuuuccucacccgucaccaaauccuucaaccgcggcgaaugc

SEQ ID NO: 53612 - RNA, 1335 nt, Artificial Sequence
  derived and/or modified sequence opt11 from Briakinumab_HeavyChain1
caaguucaacucguagaguccggcggcggaguuguccaacccggccgaucgcuccgccucuccugcgccgccuccggcuuuaccuucuccagcuacggcaugcacuggguccgacaagcccccggcaaaggccucgaaugggucgccuuuauacgauacgacggcuccaacaaauacuacgccgacucagucaaaggccgauucaccaucucccgcgacaacuccaaaaacacccuauaccuacaaaugaacucacuccgagcagaagacaccgcagucuacuacugcaagacccacggcucccacgacaacuggggccaaggcaccaugguaaccgucucuagcgcauccaccaaaggccccuccguauucccccuagcccccuccagcaaauccaccuccggcggcacagcagcacucggcugccucguaaaagacuacuuccccgaaccggucacugucucguggaacuccggcgcccucaccuccggcguccacacguuccccgcaguccuccaauccaguggacucuacucucucagcuccgucguaaccguccccuccucaucccucggaacucaaaccuacaucugcaacgucaaccacaaaccauccaacaccaaagucgacaagaaagucgaacccaaaucaugcgacaaaacccacaccuguccacccugccccgcccccgaacuacuaggcggccccucagucuuccuauucccacccaaacccaaagacacccucaugaucucccgcacacccgaaguaacuugcgucgucgucgauguaucccacgaagaccccgaagucaaauucaacugguacguagacggcgucgaaguccacaacgccaaaaccaagccccgcgaagaacaauauaacuccaccuaccgcgucgucuccguccucacuguccuacaccaagacuggcucaacggaaaagaauacaaaugcaaaguauccaacaaagcucuccccgccccaaucgaaaagaccaucagcaaagcaaaaggccagccccgagaaccccaggucuacacccucccacccagccgugaagaaaugaccaaaaaccaaguaucccuaacaugccuagucaaaggcuucuaccccuccgacaucgccgucgaaugggaauccaacggccaacccgaaaacaacuacaaaacgaccccacccguccuugacucagacggauccuucuuccuauacuccaaacucaccgucgacaaaucccgauggcaacaaggcaacgucuucucuugcuccgucaugcacgaagcccuccacaaccauuacacccaaaagucacuaucccuaucacccgguaaa

SEQ ID NO: 53613 - RNA, 651 nt, Artificial Sequence
  derived and/or modified sequence opt11 from Briakinumab_LightChain1
caauccguccuaacccaacccccauccgucagcggagcccccggccaacgcguaaccaucuccugcuccggcucccgcucaaacaucggcuccaacaccgucaaaugguaccaacaacuccccggaaccgcccccaaacuccucaucuacuacaacgaccaacgccccuccggcgucccagaccgcuucuccggauccaaauccggcaccuccgcaucccucgccaucaccggccuacaagccgaagacgaagcagacuacuacugccaauccuacgaccgcuacacacacccugcccuccuauucggcaccggcaccaaagucacaguccucggccagcccaaagccgcccccuccgucacacucuuccccccauccuccgaagaacuacaagccaacaaagccacccuagucugccucaucuccgacuucuaccccggcgccgucaccgucgccuggaaagccgacuccucccccgucaaagccggcgucgaaacaaccacccccuccaaacaauccaacaacaaauacgccgcaucauccuaccucucccuaacaccagaacaauggaaaucccaccgaucuuacuccugccaagucacccacgaaggauccacagucgaaaaaaccgucgcccccaccgaaugcucc

SEQ ID NO: 53614 - RNA, 1326 nt, Artificial Sequence
  derived and/or modified sequence opt11 from Brodalumab_HeavyChain1
caaguccaacucguacaaucaggagcagaagucaagaaacccggcgccuccgucaaagucucauguaaagccucgggcuacaccuucacccgcuacggcaucucauggguccgccaagcccccggccaaggccucgaauggaugggcuggaucagcaccuacucagguaacacuaauuacgcacaaaaacuacaaggaagagucaccaugacaaccgacacaucaaccucaaccgccuacauggaacuccggucccuccguucggacgacaccgcaguauacuauugcgcccgucgccaacucuacuucgacuacuggggccagggaacacucguaaccgucuccagcgccagcaccaaaggaccaucagucuucccccucgccccaugcucccgauccacaucagaauccaccgcagcccucggcugccucgucaaagacuacuuccccgagcccguuaccguaucauggaacuccggcgcccuaaccuccggcguccacacauuuccagccguccugcaauccuccggccucuauucccuguccucaguagucaccguccccucaagcaacuucggcacccaaaccuauaccugcaacgucgaccacaaacccuccaauaccaaagucgacaaaaccgucgaacgcaaaugcugcguagaaugcccacccugccccgccccacccgucgcuggccccuccguauuucucuuucccccaaaacccaaagacacgcucaugauaucccgcacacccgaaguuaccugcgucgucgucgacguaucccacgaagacccugaaguccaauucaauugguacgucgacggcguugaaguacacaacgccaaaaccaaaccccgcgaggaacaauucaacucaaccuuccgcgucguauccguccucaccgucguucaccaagacuggcucaacgguaaagaauacaaaugcaaagucuccaacaaaggccuaccagcacccaucgagaaaaccauauccaaaacaaaaggacaaccccgagaaccccaaguauacacacuaccacccucacgagaagaaaugaccaaaaaccagguuucccuaacuugccucguaaaaggcuucuaccccuccgauaucgccgucgaaugggaauccaacggccaaccagaaaacaacuacaaaaccaccccacccaugcucgacuccgacggcagcuucuuccuauacucuaaacucaccgucgacaaaagcagauggcaacaaggaaacgucuucucaugcuccgucaugcacgaagcccuccacaaccacuacacacaaaaaucacuaucccuaucacccggaaaa

SEQ ID NO: 53615 - RNA, 642 nt, Artificial Sequence
  derived and/or modified sequence opt11 from Brodalumab_LightChain1
gaaauagucaugacccaaucccccgccacccuuuccguauccccaggcgaacgcgccacccuauccugccgcgccucccaaagcgucagcuccaaccucgccugguuccaacaaaaacccggacaagcaccccgaccacuaaucuacgacgccuccacccgcgccaccggcguccccgccagauucuccggcuccggcuccggaaccgacuucacccucaccaucuccucccuccaaucagaagacuucgccgucuacuacugccaacaauacgacaacuggccccucaccuucggcggcggaaccaaaguagaaaucaaacgcaccgucgccgcccccuccgucuuuaucuucccacccuccgacgaacaacucaaaucaggcaccgccucagucgucugccuacucaacaacuucuacccccgcgaagccaaaguccaauggaaagucgacaacgcccuccaauccgguaacucacaagaauccgucaccgaacaagacuccaaagacuccaccuacucccucuccuccacccucacccucuccaaagccgacuacgaaaaacacaaagucuacgcaugcgaaguaacccaccaaggccucagcucccccgucacaaagagcuucaaccgcggcgaaugc

SEQ ID NO: 53616 - RNA, 756 nt, Artificial Sequence
  derived and/or modified sequence opt11 from Brolucizumab_HeavyChain1
auggagauagugaugacgcaaucgccaucaaccuugagcgcaagcgugggcgaucgagugaucauaaccugucaagcgagcgagaucauacacucguggcuggcaugguaccagcaaaagcccgggaaagcgcccaagcuauugauauaucuagcgaguacgcuugcgagcggggucccgagcagguucucgggcucgggcucgggagcggaauuuaccuugaccauaagcucgcuccagcccgaugacuucgcaacguacuauugccagaacguguacuuggccucaaccaauggcgcaaacuuuggccagggcacgaaauugaccguacuagggggaggaggcgggagcggaggcgggggcucgggcgggggugggagcgggggcgggggaucggaagugcaauuggucgagagcgggggcgggcucgugcaaccgggcggaagccuacgcuugagcuguaccgcgaguggguucucacucacggacuauuacuauaugacgugggugcgccaggcaccgggcaagggcuuggaaugggucggguucauagacccggacgaugacccguacuaugccacgugggcgaaagggcgauuuaccauaagcagggacaauagcaagaacacgcucuaccuccagaugaacagcuuaagagcggaagauaccgcggucuauuacugugccgggggcgaucacaauagcgggugggggcucgauaucuggggccagggcacauuggugaccgugagcuca

SEQ ID NO: 53617 - RNA, 756 nt, Artificial Sequence
  derived and/or modified sequence opt11 from Brolucizumab_scFv_fragment
auggagaucgugaugacgcaaucgcccucgacauugagcgcaagcguaggcgaucgagugauaauaaccugucaagcgagcgagaucauacacucaugguuggcaugguaccagcaaaaacccggaaaagcgcccaagcuccugauauaccuagcgagcacgcuagcaagcggggucccgagcagguucucgggaucgggcucaggcgcggaauuuaccuugaccauaagcucgcuccagccagaugacuuugcaacauacuacugccagaacguguaccuggccucgaccaacggcgcaaacuucggccagggcacgaaacugacugugcucgggggcgggggcgggagcgggggcggaggcucgggcgggggcgggagcggaggcgggggcucggaagugcaauuggucgagagcggaggcgggcucgugcaaccgggcgggagccugcgauugagcugcaccgcgagcggguucucacucacggacuauuacuauaugacaugggugcgccaggccccgggcaagggcuuagaaugggucggauucauagacccggacgaugacccauacuaugccacaugggcgaaagggcgauuuacaauuaguagggacaauagcaaaaacacgcuauaccuacagaugaacagccugcgcgcagaagauaccgcgguauauuacugugccgggggcgaucacaauagcggaugggggcuagauaucuggggccagggcacacucgugaccgugagcuca

SEQ ID NO: 53618 - RNA, 1341 nt, Artificial Sequence
  derived and/or modified sequence opt11 from Brontictuzumab_HeavyChain1
caaguccagcuaguccaaagcggagccgaagucaagaaacccggcgccagcguaaaaaucucaugcaaagucuccggcuacacccuacgcggauacuggauagaauggguccgccaagcccccggcaaaggccucgaauggaucggacaaauccuucccggaacgggccgcacaaacuacaacgaaaaauucaaaggccgcgucaccaugaccgcagacaccuccacagacaccgccuacauggaacucucaucacuacgcagcgaagacacagccgucuacuacugugcacgcuucgacggcaacuacggauacuacgccauggacuacuggggacaaggaaccaccgucacggucuccuccgcuagcaccaaaggccccucaguauucccccucgcccccugcucacgcucgaccucggaauccaccgcagcccuaggcugucuagucaaagacuacuucccagaacccgucaccguaagcuggaacagcggcgcauuaacaucaggcguccauaccuuccccgcgguacuacaauccagcggacucuacagccucucaagugucgucaccguacccagcagcaauuucggcacccaaaccuauaccugcaacguagaccacaaaccaucaaacacaaaaguagacaaaaccguagaacgcaaaugcugcgucgaaugcccacccugccccgcaccucccgucgcaggccccuccgucuuccucuucccacccaaacccaaagacacccucaugaucucccgcacccccgaagucacaugcgucgucguggacguaucccaugaagaccccgaaguccaauucaacugguacguagacggcgucgaaguccacaaugccaaaaccaaaccccgagaagaacaauucaacuccacauuccgagucgucuccguccucacagucguccaucaagacuggcucaacggcaaagaauacaagugcaaagucuccaacaaaggccuccccgcccccauagagaaaaccaucuccaagaccaaaggccaaccacgcgaaccacaaguuuacacccuuccacccucccgagaagaaaugaccaaaaaccaaguuucacuaaccugccuaguaaaagguuucuaccccuccgacauagcagucgaaugggaauccaauggacaacccgaaaacaacuacaaaaccaccccgcccaugcuugacuccgacggcaguuucuuccuuuacagcaaacuuaccguagacaaguccagauggcaacaaggcaacgucuucucaugcuccgucaugcacgaagcccuacacaaccacuacacacaaaagucucucucccucagccccggaaag

SEQ ID NO: 53619 - RNA, 645 nt, Artificial Sequence
  derived and/or modified sequence opt11 from Brontictuzumab_LightChain1
caagcagucgucacccaagaacccucccucaccgucucccccggcggcaccguaacccucaccugccgcucauccaccggcgccgucaccaccuccaacuacgccaacugguuccaacaaaaacccggccaagccccccgcacccuaaucggcgguacaaacaaccgagcccccggcgucccagcccgauucuccggcucccuccucggcggcaaagcagcccucacccuauccggcgcacaaccagaagacgaagccgaauacuacugcgcccucugguacuccaaccacugggucuucggcggcggcaccaaacuuacaguccucggccaacccaaagccgccccauccgucacacucuucccccccuccucagaagaacuccaagccaacaaagccacccucgucugccuugucuccgacuucuaccccggcgccgucaccgucgccuggaaagccgacggcucccccgucaaagucggcguagaaaccaccaaacccuccaaacaauccaacaauaaauacgccgccuccuccuaccucucccucacccccgaacaauggaaaucccaccgcuccuacuccugcagagucacccacgaaggcuccaccgucgaaaaaaccgucgcccccgccgaaugcucc

SEQ ID NO: 53620 - RNA, 1332 nt, Artificial Sequence
  derived and/or modified sequence opt11 from BTT-1023_HeavyChain1
caaguccaacucguagaaucaggcggcggcgucguccaacccgggcgaucccuccgccucuccugcgccgcuucaggauucaccuucuucuccuacgcaaugcacuggguccgccaaacacccggcaaaggccucgaauggguagcaguaauaugguucgacggcuccaacgaaaacuacguggacucagucaaaggccgcuucaccauaucacgagacaacuccaaaaacacccuauaccuccaaaugaauacccuccgagcagaagacacagccgucuacuacugcgcccgcgacgccugguccuacuucgacuacuggggacaaggaacccuagucacaguauccagcgccucaacuaaaggacccucaguauuuccccucgcccccugcucacgcuccacauccgaauccaccgcagcccucggcugccuugucaaagacuacuuccccgaaccggucacagucuccuggaacuccggcgcacuuaccucuggcguacacacguucccagcaguacuacaauccucaggccucuacucacuauccuccgucgucaccguacccagcagcucacucggaacaaaaacauacacaugcaacguagaccacaaacccuccaacacaaaagucgacaaacgaguugaauccaaauacggcccucccugcccacccugccccgcccccgaguucgccgguggacccucgguauuccuauucccacccaaacccaaagacacgcucaugauaagccgcacccccgaagucacaugcgucgucgucgacgucucccaggaagaccccgaaguacaauucaacugguacgucgacggcgucgaaguccacaacgccaaaaccaaaccacgcgaagaacaauuuaauuccaccuaccgcgucgucucaguccucaccguccuacaccaagacuggcucaacggcaaagaauacaaaugcaaggucuccaacaaaggccuacccagcuccauugaaaagaccaucuccaaagcgaaaggccaaccccgcgaaccccagguauacacacucccgcccucccaagaagaaaugaccaaaaaccaagucucccucacaugccuagucaaaggauuuuaccccuccgacaucgcagucgaaugggaauccaacggccaacccgaaaacaacuacaaaaccacaccacccguccucgacucagacgguagcuucuuccucuacucccgccucacagucgacaaaagccgauggcaggaaggaaacgucuucuccugcuccgucaugcacgaagcccuccacaaccacuacacccaaaaaucacugagccucucccucggcaaa

SEQ ID NO: 53621 - RNA, 642 nt, Artificial Sequence
  derived and/or modified sequence opt11 from BTT-1023_LightChain1
guaauccagcucacccaaucacccucuucccucuccgccuccgucggcgaccgcgucaccauaaccugccgcgccucccaaggcaucucccgcgcccucgccugguaccagcaaaaacccggcaaaggccccaaacuccucaucuacgacgccuccucccucgaauccggcguacccucccgcuucucaggcucaggcuccggcacagacuucacccuuaccauauccucccuccaacccgaagacuucgccaccuacuacugccaacaauucaacucauacccccucacauucggcggcggaaccaaagucgaaaucaaacgcacagucgcggcccccuccguauucaucuucccacccuccgacgaacaacuaaaaucaggcacagccuccguagucugccuccucaacaacuucuacccccgcgaagccaaaguccaauggaaagucgacaacgcccuccaauccggcaacucccaagaauccgucaccgaacaagacuccaaagacuccaccuacucccuguccucaacccucacccuauccaaagccgacuacgaaaaacacaaaguauacgcaugcgaagucacccaccaaggccucucaucucccgucaccaaauccuucaaccgaggcgaaugc

SEQ ID NO: 53622 - RNA, 1341 nt, Artificial Sequence
  derived and/or modified sequence opt11 from Burosumab_HeavyChain1
caaguccaacucguccaauccggcgccgaagucaagaaacccggcgcuuccguaaaagucucaugcaaagccuccggauacacauucaccaaccacuacaugcacuggguccgccaagccccaggccaaggccuagaauggauggguauaauaaaccccauauccggauccaccuccaacgcccaaaaauuccaaggacgcgucaccaugacacgcgacaccucuaccuccacagucuacauggaacuuuccucacugcgcagcgaagacaccgccguauacuauugcgcccgagacaucgucgacgcauucgacuucuggggccaaggcacaauggucacagucuccucagccucaaccaaaggcccaucagucuucccccuagcccccuccuccaaauccacauccggcggcaccgccgcccuuggaugccucgucaaagacuauuuccccgaacccgucaccgucuccuggaacuccggagcccucacauccggcguccacaccuuccccgcaguacuccaaucauccggacucuauucccucuccuccgucguuaccguucccuccuccucccucggcacccagaccuacauaugcaacguaaaccacaaaccaucaaacacaaaagucgacaagaaagucgaacccaaaucaugcgacaaaacacacacaugcccacccugccccgccccagaacuccucggaggccccuccguauuccuguucccucccaaaccuaaagacacccuaaugaucucccggacaccagaaguaaccugcguagucgucgacgucucacacgaagacccugaagucaaauucaacugguacguagacggcguagagguacacaacgccaaaaccaaaccacgcgaagaacaauacaacuccaccuaccgcguagucuccguccuuaccguccuccaccaggacuggcucaacggaaaagaauacaaaugcaaagucuccaacaaagcacuccccgcccccaucgagaaaacuaucucaaaggccaaaggacaaccccgagaaccccaagucuacacccucccacccucccgcgacgaacucaccaaaaaccaagucagccuaaccugccucguaaaaggauucuacccuuccgacaucgccgucgaaugggaaucaaacggucaacccgaaaacaacuacaaaacaacgcccccaguccuagacuccgacggauccuucuuccucuauuccaaacucaccguagacaaaucacgcuggcaacaagguaaugucuucuccugcucaguaaugcacgaagcccuacacaaccacuacacccagaaaagccuaucccuaucccccggcaaa

SEQ ID NO: 53623 - RNA, 639 nt, Artificial Sequence
  derived and/or modified sequence opt11 from Burosumab_LightChain1
gccauccaacucacacaaucacccuccucacucuccgccucagucggcgaccgcgucaccaucacaugccgcgccucccaaggcaucuccuccgcccucguaugguaccaacaaaaacccggcaaagcccccaaacuccucaucuacgacgccuccucacuagaauccggcguccccucacgcuucuccggcuccggaucaggcaccgacuucacccucaccaucuccucccuucaacccgaagacuucgcuaccuacuacugccaacaauucaacgacuacuucaccuucggccccggcaccaaagucgacaucaaacgcaccgucgccgccccauccgucuucaucuucccacccucagacgaacaacucaaauccggaaccgccuccguagucugccuccuaaacaacuucuacccccgcgaagccaaaguccaauggaaagucgacaacgcacuccaauccggcaacucccaagaauccgucaccgaacaggacuccaaagacucaaccuacucccucuccuccacccuaacccucuccaaagccgacuacgaaaaacacaaagucuacgccugcgaagucacccaccaaggccuaagcucccccgucaccaaaucauucaaccgcggcgaaugc

SEQ ID NO: 53624 - RNA, 1344 nt, Artificial Sequence
  derived and/or modified sequence opt11 from Canakinumab_HeavyChain1
caaguccaacucgucgaaucagguggcggcgucguacaacccggacguagccuccgccucucaugcgccgccucaggauucacauucuccgucuacggcaugaacuggguccgccaagcccccggcaaaggacucgaauggguagccauaaucugguacgacggcgauaaccaauacuacgcagauagcgucaagggacgcuucaccauauccagagacaacagcaaaaacacccuguaccuccaaaugaacggccuccgcgccgaagauaccgccgucuacuacugcgcccgcgaccugcgcacaggucccuucgacuacuggggacagggcacccuagucaccgucuccuccgccuccaccaaaggccccagcgucuucccccuugcgcccucaucaaaaagcaccuccggcggcaccgccgcacucggcugccuagucaaagacuacuuccccgaacccgucaccguuuccuggaacuccggugcccuuaccuccggaguccauaccuucccagccguacuacaaagcucaggccucuacucccucuccagcguaguuacuguccccuccucuucccucggcacacaaacauacauaugcaacguaaaccacaagcccagcaacaccaaagucgacaagcgcguagaaccaaaaucaugcgacaaaacccacacauguccaccuugcccagcacccgaacuacucgguggccccucagucuuccucuucccacccaaacccaaagacacccucaugauuagccgcacacccgaaguaacaugcgucgucgucgacgucucacacgaagacccagaaguuaaauucaacugguacgucgacggagucgagguccacaaugcaaagaccaaaccacgagaagaacaauacaacuccaccuaccguguaguauccguucuuaccguccuccaccaagacuggcucaacggcaaagaauacaaaugcaaagucuccaacaaagcccuccccgcccccaucgagaagaccauauccaaagccaaaggccaacccagagaaccccaggucuacacacuuccucccucccgcgaagaaaugaccaaaaaccaaguaagccuaaccugccuaguaaaaggcuucuaccccuccgacaucgccguagaaugggaauccaacggccaacccgagaacaacuacaaaacaacaccacccguccucgauucugacggcucauucuuccucuacucaaaacuaaccgucgacaaaucccgcuggcaacaggggaaugucuucagcugcuccgucaugcacgaagcccuccacaaccacuacacccaaaaauccuugucacucucacccggcaaa

SEQ ID NO: 53625 - RNA, 1344 nt, Artificial Sequence
  derived and/or modified sequence opt11 from Canakinumab_HeavyChain
caaguccaacucgucgaauccggaggaggcgucguccaacccggaagaagccuuagacucagcugcgccgcguccggcuucacauucucgguauacggcaugaauugggucagacaagcacccggcaaaggccuagaaugggucgccaucaucugguacgacggcgacaaccaauacuacgcagacucagucaaaggcagauucaccauaagcagagacaacuccaaaaacacauuauaucuccaaaugaauggacuccgcgccgaagacaccgcagucuacuacugcgccagagaccuacgaaccggccccuucgacuacuggggacaaggaacccuaguaaccgucucuuccgccuccacuaagggccccuccgucuucccacuagcaccaucaucaaaauccaccucaggcggcacugccgcccucggcugccuaguaaaggacuacuucccagaaccugucaccgucucuuggaacuccggcgcccucacauccggcguccacacauuccccgccguccuccaaagcuccggccuguacucccuaagcuccgucgucaccgucccauccuccagccucggcacccaaaccuacaucugcaacgucaaucacaaaccauccaacaccaaaguagacaaacgugucgaacccaaauccugcgacaaaacccacacaugcccgcccugcccagccccugaacuccucgguggccccuccguauuccuuuucccacccaaaccuaaagacacccuuaugaucagccgaacacccgaagucacaugcguagucgucgacgucucacacgaagacccagaagucaaguucaacugguacguagacggcgucgaaguucacaacgcuaaaaccaaaccccgcgaagaacaauauaacuccaccuaccgagucguaucgguccucacaguccuccaccaagacuggcuuaacggcaaagaauacaaaugcaaagucuccaacaaagcccuacccgcccccauagagaaaacaaucuccaaagccaaaggacaacccagagaaccccaagucuacacccucccacccuccagagaagaaaugaccaaaaaccaaguaucacuuaccugccuagucaaaggcuucuaccccucggacaucgccgucgaaugggaaucaaacggacaaccagaaaacaacuacaaaaccacaccacccguccucgacuccgacggcuccuucuuccucuacuccaaacuaaccguagacaaaucccgcuggcaacagggcaacgucuucucuugcuccgucaugcaugaagcacuccacaaccacuacacccagaaaagccuaucccucagccccggaaaa

SEQ ID NO: 53626 - RNA, 642 nt, Artificial Sequence
  derived and/or modified sequence opt11 from Canakinumab_LightChain1
gaaaucguccucacacaaucccccgacuuccaauccgucaccccaaaagaaaaaguaaccauaaccugccgcgccucccaauccaucggcuccagccuccacugguaccaacaaaaacccgaccaaucccccaaacuccucaucaaauacgcaucccaauccuucuccggcguccccucacgcuucuccggcucaggcuccggcaccgacuucacccuaaccaucaacucccucgaagccgaagacgcagccgccuacuacugccaccaauccuccucacuccccuucaccuucggccccggcaccaaagucgacauaaaacgcacagucgccgcccccuccgucuucaucuucccacccuccgacgaacaacucaaauccggcaccgccuccguagucugccuacucaacaacuucuacccccgcgaagccaaaguccaauggaaaguugacaacgcccuccaauccggcaacucacaagaauccgucaccgaacaagacucuaaagacuccacauacucacucagcucaacccucacccuuuccaaagccgacuacgaaaaacacaaagucuacgccugcgaagucacccaccagggccucuccucacccgucaccaaauccuucaaccgcggcgaaugc

SEQ ID NO: 53627 - RNA, 642 nt, Artificial Sequence
  derived and/or modified sequence opt11 from Canakinumab_LightChain
gaaaucguccucacccaaucccccgacuuccaaagcgucacccccaaagaaaaaguuaccaucacaugccgcgccucccaauccaucggcuccucccuacacugguaccaacaaaaacccgaccaaucccccaaacuccucaucaaauacgccucccaauccuucuccggcguccccucccgcuucucaggcuccggcuccggcaccgacuucacccucaccaucaacucccuugaagccgaagacgccgccgccuacuacugccaccaauccuccucccuccccuucaccuucggccccggcaccaaagucgacaucaaacgcaccgucgccgcccccagcgucuucaucuucccacccucagacgaacaacucaaauccggcaccgccuccgucgucugccuccucaacaacuucuacccccgcgaagccaaaguccaguggaaagucgacaacgcacuccaauccggcaacucacaagaauccguaaccgaacaagacuccaaagacuccaccuacucccucuccuccacccucacccuauccaaagccgacuacgaaaaacacaaagucuacgccugcgaagucacgcaccaaggccuauccucccccgucaccaaauccuucaaccgaggcgaaugc

SEQ ID NO: 53628 - RNA, 1182 nt, Artificial Sequence
  derived and/or modified sequence opt11 from Canakinumab_LightChain_variant_8836_L
caaguccaacucgucgaaucuggaggaggcgucguccaaccuggccgcucccuccgacucuccugcgccgccuccggcuucacuuucagcguauacggaaugaacuggguacgccaagcacccggaaaaggccucgaauggguagccaucaucugguacgacggagacaaccaauacuacgccgacucugucaaaggccgauucaccaucucccgagacaacuccaaaaacacacucuaccuacaaaugaacgggcuccgagccgaagacaccgccguauacuacugcgcaagagaucuccgcaccggccccuucgacuacuggggccaaggcacacucgucaccguaucaagcgcuagcaccaaaggcccaagugucuuuccacucgcccccuccuccaaauccaccucaggcggcaccgcagcucuuggcugccucgucaaagacuauuuccccgaacccguaaccgucuccuggaacuccggcgcccuaaccucaggcguccauaccuucccggcgguacuccaaucuagcggccucgaaaucguacuaacacaaucacccgacuuucagucagucacacccaaagaaaaagucaccaucaccugucgcgccucacaauccaucggcuccagccuccacugguaccaacaaaagcccgaccaaucccccaaacuccuaaucaaauacgccucccaauccuucucaggcguccccucccgauucuccggcuccggcucaggcacagacuucacccuaaccauaaacucucucgaagcugaagacgccgccgcuuacuacugccaccaauccucuucacucccuuucacguucggccccggaaccaaaguagauaucaaacgcaccguagcugcccccucgguauucaucuucccacccucagacgaacaacucaaauccggcaccgccuccgucgucugccuacucaacaauuucuacccccgugaagccaagguccaauggaaaguagacaacgcccuccaauccggcaacucccaagaaagcguaacagaacaagacuccaaagacuccaccuacucccucucauccacccucacacucuccaaagccgacuacgaaaaacauaaagucuacgccugcgaaguaacccaccaaggccuauccucccccgucacuaaguccuuuaaccgcggagaaugc

SEQ ID NO: 53629 - RNA, 1197 nt, Artificial Sequence
  derived and/or modified sequence opt11 from Cantuzumab_HeavyChain1
aucgacaccaccaccggcgaacccacauacgcccaaaaauuccagggccgaaucgccuucucgcucgaaaccucagccucaaccgcuuaccuccaaauaaaaucacucaaaucagaagacacagcuacauauuucugugcccgacgcggacccuacaacugguacuucgacgucuggggccaaggaaccacuguaaccguauccucugccucaaccaaaggccccuccguauucccccuagcacccuccucaaaauccaccuccggcggcacagccgcacucggcugccucgucaaagacuacuuucccgaacccgucacugucucauggaacucaggcgcccucacuucuggcguccacaccuuccccgccguccuacaaucauccggccucuacucccucucauccgucguaacuguacccagcuccagccucgguacacaaaccuacauaugcaacgucaaccacaagcccaguaacacuaaagucgacaagaaagucgaacccaaaucaugcgacaaaacccacacuugcccacccugccccgcaccagaacuccuaggcggcccauccgucuuccuauucccacccaagcccaaagacacccuaaugaucucucguacaccagaaguuaccugcguaguugucgauguaagccacgaagaccccgaagucaaauucaacugguacgucgacggagucgaaguccacaacgcaaaaaccaaaccccgcgaagaacaauauaacuccacauaccgcgucguuuccguacucaccguccuucaccaagacuggcucaacgguaaagaauacaaaugcaaagucuccaacaaagcgcuccccgccccaaucgagaaaaccauauccaaagccaaaggccaaccccgagaaccucaagucuacacacuaccacccagcagagacgaacucaccaaaaaccaagucucacuaaccugccucgucaaaggcuucuaccccucagacaucgcagucgaaugggaauccaacggccaacccgaaaacaacuacaaaaccacucccccaguccucgacuccgacggcucguucuuccucuacagcaagcucaccgucgacaaaucacgauggcaacaaggaaacgucuucucuugcucagucaugcacgaagcacuccacaaccacuacacccaaaaaucccucucccucucccccggcaaa

SEQ ID NO: 53630 - RNA, 1347 nt, Artificial Sequence
  derived and/or modified sequence opt11 from Cantuzumab_HeavyChain
caaguccaauugguccaauccggagccgaaguuaagaaaccaggcgaaacaguaaaaauauccugcaaagccagcgacuacaccuuuaccuacuacggaaugaauuggguaaaacaagcccccggccaaggacucaaauggaugggguggauagacaccacuaccggcgaaccaaccuacgcccaaaaauuccaaggccgcaucgccuucucccuagaaaccuccgcaucaacugccuaccuccaaaucaaaucccucaaauccgaagacaccgccacauacuucugcgcccgccgaggcccauacaacugguacuucgacgucuggggacaaggcaccaccguuaccguaucaucagccuccacaaaaggaccguccgucuucccccucgccccuucaucaaaauccaccuccggugguaccgcagcccucggcugucucguaaaagacuacuuccccgaacccguaaccgucuccuggaacuccggcgcccucaccuccggcguacacaccuucccagcugugcuccaauccuccgggcucuacucacuauccuccguagucacaguacccucaagcucacucggcacacaaacauauaucugcaacguaaaccacaaaccuuccaacaccaaaguggacaagaaaguggaacccaaaagcugcgacaaaacacauaccugcccacccugccccgcccccgaacuacuuggcggccccucugucuuccuuuucccacccaaacccaaagacacccuaaugaucucccgcaccccagaagucacaugcgucgucgucgacgucucgcacgaagaccccgaagucaaauucaacugguacgucgacggagucgaaguucacaacgccaaaaccaaaccucgcgaggaacaauacaacuccacuuacagagucguaucaguccucacaguccuccaccaagacuggcuaaacggcaaagaauacaaaugcaaaguauccaacaaagcccugccagcccccauugagaaaaccaucagcaaagccaaaggacaaccccgcgaaccccaaguuuauacacucccacccucccgagacgaacucaccaaaaaccaagucucauuaaccugccucgucaaaggcuucuacccauccgacauugccgucgaaugggaauccaacggccaacccgaaaacaacuacaaaacaaccccacccguccucgacucugacggcuccuucuuccucuauuccaaacucaccguugacaaaucccgcuggcaacaagggaaugucuucuccugcuccgucaugcacgaagcccugcacaaccacuacacccaaaaaucacucucacucucccccggcaaa

SEQ ID NO: 53631 - RNA, 657 nt, Artificial Sequence
  derived and/or modified sequence opt11 from Cantuzumab_LightChain1
gacaucgucaugacccaauccccucucuccgucccagucacccccggcgaacccgucuccaucucaugccgcuccuccaaaucacuccuccacuccaacggcaacaccuaccucuacugguuccuccaacgacccggccaauccccacaacuacucaucuaccgcauguccaaccucgucuccggaguccccgaccgcuucuccggcuccggcuccggcaccgccuucacccuccgcaucucccgcgucgaagccgaagacgucggcgucuacuacugccuccaacaccucgaauaucccuucaccuucggccccggcaccaaacucgaacucaaacgcaccgucgccgcccccuccgucuucaucuucccacccucagacgaacaacucaaauccggaaccgccuccgucgucugccuccuaaacaacuucuacccccgcgaagccaaaguccaauggaaagucgauaacgcccuccaauccgguaacucccaagaauccgucaccgaacaagacuccaaagacuccaccuacucucucuccuccacccucacccucuccaaagccgacuacgaaaaacacaaagucuacgccugcgaagucacacaccaaggccucuccuccccaguuaccaaaucauucaaccgcggcgaaugc

SEQ ID NO: 53632 - RNA, 1344 nt, Artificial Sequence
  derived and/or modified sequence opt11 from Cantuzumab_mertansine_HeavyChain1
guccagcucguucaaagcggagccgaagucaaaaaacccggcgaaacagucaagaucuccugcaaagccucggacuacacauucaccuacuacggcaugaacugggucaaacaagccccuggccaaggccugaaauggaugggcuggaucgacaccaccacaggcgaacccaccuacgcccaaaaauuucaaggccgcaucgccuucucacucgaaaccuccgcuucaaccgccuaccuccagaucaaaucucucaaaucagaagacacagccaccuacuucugcgcccgacgcggacccuacaacugguauuucgacgucuggggccaaggaaccaccgucacagucuccuccgccucuaccaaaggccccuccgucuucccacucgccccauccucgaaaucuaccuccggcggcaccgcugcccucgggugccuggucaaagacuacuuccccgaaccagucaccgucucauggaacuccggagcccucaccuccggaguacacaccuuccccgccguccuccaaucuuccggacucuacucccuauccuccgucgucaccguccccuccagcucccucggcacccaaaccuacaucugcaacgucaaccacaaacccucaaacacaaaagucgacaaaaaagucgaacccaaaagcugcgacaaaacccacaccuguccccccugcccagcccccgaacuccuaggaggccccuccgucuuccucuuccccccaaaaccaaaagacacccucaugauaucccgaaccccugaagucaccugcgucgucgucgacgucucacacgaagaccccgaaguuaaauucaacugguacgucgacggcgucgaaguucacaaugccaaaaccaagccccgcgaagaacaauacaacucaaccuaccgcgucgucuccguccucaccguccuacaccaagacuggcucaacggaaaagaauacaaaugcaaaguauccaacaaagcccuccccgcaccaaucgaaaaaaccaucucaaaagccaaaggccaaccccgagaaccccaagucuacacccuaccaccaucacgcgacgaacuuacaaaaaaccaagucucacucaccugccucgucaaaggauucuaccccuccgacauagcagucgaaugggaauccaacggccaacccgaaaacaacuacaaaaccaccccccccguccuagacuccgacgguagcuucuuccucuacucuaaacucaccguugacaaaagccgcuggcaacaggguaacgucuucagcugcuccgucaugcacgaagcccuccacaaccacuacacccaaaaaucacucucccucucaccaggaaaa

SEQ ID NO: 53633 - RNA, 657 nt, Artificial Sequence
  derived and/or modified sequence opt11 from Cantuzumab_mertansine_LightChain1
gacaucgucaugacccaaucaccccucuccguccccgucacccccggcgaacccgucuccauaucaugccgcucaucaaaaucgcuccuccacuccaacggaaacacauaccuauacugguuccuccaacgcccaggacaaucaccccaacuccucaucuaccgcauguccaaccucgucuccggcgucccagaccgcuucuccggauccggauccggcacagccuucacccuccgcauaucccgagucgaagccgaagacguaggcgucuacuacugccuccaacaccucgaauaccccuucaccuucggccccggcaccaaacucgaacucaaacgcaccgucgccgcccccuccguauucauauucccacccuccgacgaacaacuaaaaucuggcaccgccucagucgucugccuccucaacaacuucuacccccgcgaagccaaaguccaauggaaagucgacaacgcccuccaauccggaaacucccaagaaucagucaccgaacaagacuccaaagacuccaccuacucccucuccucaacccucacccucuccaaagccgacuacgaaaaacacaaagucuacgccugcgaagucacccaccaaggccucuccucccccgucaccaaauccuucaaccgcggcgaaugc

SEQ ID NO: 53634 - RNA, 1347 nt, Artificial Sequence
  derived and/or modified sequence opt11 from Cantuzumab_ravtansine_HeavyChain1
caaguccaacucguccaauccggcgcagaagucaagaaacccggcgaaaccgucaaaaucagcugcaaagccuccgacuacacauucaccuacuacggaaugaacugggucaaacaggcacccggccaaggccugaaauggaugggcuggaucgacacaaccaccggugaaccaacauacgcacaaaaauuccaaggccgcaucgccuucagucuugaaacaucagccuccaccgccuaccuccaaauaaaaucccucaaaagcgaggacacagccacauacuucugcgcccgccgcggucccuacaacugguacuucgacgucuggggccaaggcacaaccgucacagugucauccgcauccacaaaaggcccaagcgucuucccccuagcccccuccuccaaaagcaccuccggcggaacagccgcccucggcugccuagucaaagacuacuuccccgaacccgucaccguuucauggaacucaggcgcccuaaccuccggaguacacacauuccccgccguacuccaaucaucaggccucuacucccucagcuccgucguaaccguacccucauccucccucggaacccaaacauacauaugcaacgucaaccacaaaccauccaacaccaaagucgacaagaaaguagaacccaaaucgugcgacaaaacccacacaugcccacccugccccgcccccgaacuccucggcggacccuccgucuuccucuucccacccaaacccaaagacacccuaaugaucucccgaacacccgaaguaaccugcgucgucgucgacgucagccacgaagacccagaaguaaaauucaacugguacgucgacggcgucgaaguccacaacgcgaagaccaaaccccgcgaagaacaauacaacuccacauaccgcgucgucuccguucucaccguccuccaccaagacuggcuuaacggcaaagaauacaaaugcaaagucucaaacaaggcccuccccgcucccaucgagaaaaccaucucgaaagcuaaaggccaaccccgugaaccacaagucuacacccucccgcccucccgcgacgaacucaccaaaaaccaagucucccuuaccugccucguaaaaggcuucuaccccuccgacaucgcagucgaaugggaauccaacggccaacccgaaaacaacuacaaaaccaccccucccguucucgacucagacggcucauucuuccucuacuccaaacuaacaguugacaaaucccgcuggcaacaaggcaacguuuucuccugcuccgucaugcacgaagcauuacacaaccacuacacucaaaaaucccucucccuuucccccggcaaa

SEQ ID NO: 53635 - RNA, 657 nt, Artificial Sequence
  derived and/or modified sequence opt11 from Cantuzumab_ravtansine_LightChain1
gacaucgucaugacccaaucaccccucucaguccccgucacccccggcgaacccguauccauaucaugccgcuccuccaaaucacuccuccacuccaacggcaacaccuaccucuacugguuccuacaacgacccggccaauccccccaacuccucaucuaccgaaugucaaaccuagucuccggcguccccgaccgcuucuccggcuccggcucaggaaccgccuucacccuccgcaucucacgcgucgaagccgaagacgucgguguauacuauugccuccaacaccucgaauaccccuucaccuucggccccggaaccaaacucgaacucaaacgcaccgucgcagcccccuccgucuucaucuucccccccuccgacgagcaacucaaauccggcaccgccucagucgucugccuacucaacaacuucuacccccgcgaagccaaaguccaauggaaagucgacaacgcccuccaauccggaaacucacaagaauccgucaccgaacaagacuccaaagacuccacuuacucccuauccucaacccucacccuauccaaagccgacuacgaaaaacacaaagucuacgccugcgaagucacccaccaaggccucuccucccccgucaccaaauccuucaaccgaggcgaaugc

SEQ ID NO: 53636 - RNA, 777 nt, Artificial Sequence
  derived and/or modified sequence opt11 from Caplacizumab
gagguacagcuaguggaaagcgggggagggcugguacagccaggagggucgcuaaggcuaucgugcgcggcaucggggaggacguuuucguauaacccgauggggugguuuagacaggcaccgggaaaaggaagggaguugguagcggcgauaagcaggacaggaggaagcacguauuacccggacucgguagagggaagguucacgauaucgagagauaacgcgaaaaggaugguguacuugcaaaugaacucacugagggcggaggacacggcaguguacuauugcgcagcagcgggagugagagcagaagauggaaggguaaggacguugcccucagaauauacauuuugggggcaagggacacagguaacaguaaguagcgcggcggcggaagugcaauugguagagagcgggggagggcuggugcaaccgggagggaguuugagauugagcugugcggcaagugggagaacguucagcuacaauccgaugggaugguucaggcaagcaccggggaaagggcgagagcugguggcagcgauaucgagaacaggagggagcacguacuauccagacagcguggaagggagguuuacaauaagcagggacaaugccaagagaaugguauaucuacagaugaauagcuugagggcggaagauacagcgguauauuacugugcagcagcggggguaagggcagaggacgggagagugagaacgcucccgagcgaauacacauucuggggacagggaacacaagugacagugaguagc

SEQ ID NO: 53637 - RNA, 777 nt, Artificial Sequence
  derived and/or modified sequence opt11 from Caplacizumab_HeavyChain1
gaggugcagcugguggagagcgggggagggcuggugcagccgggagggagucugaggcuaagcugcgcggcgaguggaaggacguuuagcuauaacccgauggggugguucaggcaggcgccggggaaggggagggaguuaguagcggcgauaagcaggacagggggaaguacguauuacccggacagcguggaggggagauucacgauaagcagggacaacgcgaagaggaugguguaccugcagaugaacaguuugagggcggaggacacggcgguguacuauugcgcggcagcgggggugagagcagaggaugggagaguaagaacacugccaagugaauauacauuuugggggcagggaacacaggugacggugaguagcgcggcggcggaggugcaguugguggagagcgggggagggcuagugcagccgggagggagcuuaagguugagcugugcggcgagugggaggacguucaguuacaacccgauggggugguucaggcaggcgccagggaaggggagggaguugguggcagcgauaagcaggacagggggaagcacguauuacccggacagcguggaggggagguucacgauaagcagggacaaugcgaagaggaugguguaucugcaaaugaauagcuugagggcggaggauacggcgguguauuacugugcagcggcggggguaagggcggaggacgggagggugaggacacugccgagcgaguacacguucugggggcagggaacacaggugacggugagcagc

SEQ ID NO: 53638 - RNA, 777 nt, Artificial Sequence
  derived and/or modified sequence opt11 from Caplacizumab_HeavyChain1
gaagugcaacugguagagagcggaggagggcuagugcaaccaggaggaagucugagacugagcugcgcagcgagcgggcgaacauucagcuacaacccaauggggugguucaggcaagcgccaggaaaagggagggagcuaguggcagcaauaagcagaacgggagggagcacguacuaccccgacagcguggaaggaagauucacaauaagcagagacaacgcaaagagaaugguauaccuacagaugaacagccuacgagcagaagacacagcgguauacuacugcgcggcggcagggguaagggcggaggacgggagagugaggacauuaccgagcgaguacacguucuggggacagggaacgcaagugacagugagcagcgcagcagcagaaguacagcuaguggaaagcggagggggauuaguacaaccaggagggagccucaggcucucgugcgcggcaagcgggagaacauucagcuacaacccaauggggugguuccgacaggcaccggggaagggaagagaacugguagcggcaauaagcaggacaggaggaagcacauacuacccggacagcguagaggggagauucacgauaagcagggacaacgccaaaagaaugguguaccugcaaaugaacagccuaagggcggaagacacggcaguguacuacugcgcagcagcgggaguaagagcggaagacggaaggguaaggacacugccaagcgaauacaccuucuggggacaagggacacagguaacgguaaguagc

SEQ ID NO: 53639 - RNA, 1347 nt, Artificial Sequence
  derived and/or modified sequence opt11 from Carlumab_HeavyChain1
caaguccagcuaguccaaucaggcgccgaagucaagaaacccggauccuccgucaaagucuccugcaaagccuccggcggcaccuucuccucguacggcaucucuuggguucgacaagccccaggccaaggccucgaauggaugggaggcaucaucccaaucuucggcacugccaacuacgcacaaaaauuccaaggccgaguuaccaucaccgccgaugaauccaccuccacagccuacauggaacuaagcucccuucgcagcgaagacaccgccgucuacuacugcgcccgcuacgacggaaucuacggcgaacucgacuucuggggccaaggcacgcugguaaccgucucuuccgccuccacaaaaggucccuccguauucccccucgcccccuccuccaaaucaaccuccggcggcacugcugcccucggcugccucgucaaagacuacuucccugaacccguuaccgucuccuggaacucaggcgcccuaaccucaggcguccacaccuuccccgccguccuccaauccuccggucuauacucacucucauccguagucacgguacccucaucuucgcucggcacccagacuuacauaugcaacguaaaccacaaacccucaaacacaaaagucgacaagaaagucgaacccaaaucaugcgauaaaacccacaccugucccccaugcccagcccccgaauuacuaggcggccccucagucuuucucuuuccacccaaacccaaagacacacuaaugauuucccgcaccccagaagucacaugcgucgucguugacgucucccacgaagaccccgaagucaaauucaauugguacgucgauggaguagaaguccacaacgcaaaaaccaaaccccgagaagaacaauacaacucuaccuaccgcguagucucaguccuaacaguccuccaccaagacuggcucaacggaaaagaauacaaaugcaaaguuuccaacaaagcccuccccgcacccaucgagaaaaccaucucaaaagccaaaggccaaccccgcgaaccccaagucuauacccuaccacccucccgcgacgaacuaaccaaaaaccaagucucccuaacaugccucgucaaaggcuucuaccccagcgacaucgcagucgaaugggaaucaaacggacagcccgaaaacaacuacaaaacaaccccacccguccucgacucugacggcuccuucuuccucuacagcaaacucaccguagacaaaucacgcuggcaacaaggaaacgucuucuccugcuccgucaugcacgaagcacuccacaaccacuacacacaaaaaucacuaucccucagucccggcaaa

SEQ ID NO: 53640 - RNA, 648 nt, Artificial Sequence
  derived and/or modified sequence opt11 from Carlumab_LightChain1
gaaaucguacucacccaaucucccgcaacccucucccucucccccggcgaacgcgccacccucuccugccgcgccucccaauccgucuccgacgccuaccucgccugguaccaacaaaaacccggccaagcaccccgccuccucaucuacgacgccuccucccgugccaccggaguacccgcccgauucuccggcuccggcuccggcaccgacuucacccuuaccaucucaucacuagaacccgaagacuucgcagucuacuacugccaccaauacauccaacuccacuccuucaccuucggccaaggcaccaaagucgaaauaaaacgcaccgucgccgcccccuccgucuucaucuucccacccuccgacgaacaacucaaauccggcaccgccuccguaguuugccuccucaacaacuucuacccccgcgaagccaaaguccaauggaaagucgauaacgcacuccaauccggcaacucccaagaauccgucaccgaacaagacuccaaagacuccaccuacucccucuccuccacccucacccucuccaaagccgacuacgaaaaacacaaagucuacgccugcgaagucacccaccaaggccucuccucccccgucaccaaaucauucaaccgaggcgaaugc

SEQ ID NO: 53641 - RNA, 1353 nt, Artificial Sequence
  derived and/or modified sequence opt11 from Cergutuzumab_amunaleukin_HeavyChain1
caaguccaacucguacaaagcggagccgaagucaagaaaccgggcgcauccgugaaaguauccugcaaagccagcggcuacaccuucaccgaguucggcaugaacuggguccgacaagcacccggccaaggacuugaauggaugggcuggauaaacaccaaaaccggcgaagcgaccuacgucgaagaguucaaaggacgcgucacauucaccacggacaccucaaccuccaccgccuacauggaacuacgaucccuccgcuccgacgacaccgcagucuacuacugcgcacgcugggacuucgccuacuacgucgaagcaauggacuacuggggacaaggcaccaccgucaccgucuccuccgccuccaccaaaggucccuccgucuucccccuagcacccuccaguaaaagcaccuccggcggaacagccgcccucggaugccucgucaaagacuacuuccccgaacccgucaccguauccuggaacuccggcgcccuuaccuccggcguacacacauucccggccguccuccaauccagcggccuuuacucacuauccagcgucguaacaguccccuccuccucccucgguacccaaaccuacauaugcaaugucaaccacaaacccucaaacaccaaagucgacaagaaagucgaacccaaauccugcgacaaaacccacacaugcccacccugcccagcaccagaagcggccggcgggcccuccgucuuccucuucccucccaaacccaaagacacccucaugaucucacgcaccccagaaguuaccugcgucgucgucgacguaucacacgaagacccugaagucaaauucaacugguacgucgacggaguagaaguccacaacgcgaaaaccaaaccccgcgaagaacaauacaacucaaccuaccgagucguaaguguccucaccguacuacaccaagacuggcucaacggcaaagaauacaaaugcaaaguuuccaacaaagcccucggcgcccccaucgaaaagaccaucuccaaagcaaaaggccaaccacgagaaccacaaguaugcacacuaccacccucccgcgacgaacucaccaaaaaccaaguaagccucuccugcgccguaaaaggguuuuaccccuccgacaucgcggucgaaugggaauccaacggacaaccugaaaacaacuacaaaaccacacccccaguccuagacuccgacggcuccuucuuccuagucuccaaacugaccguagauaaaucacgauggcaacaaggcaacgucuucagcugcuccgucaugcacgaagcccuccacaaccacuacacccaaaagagccuaucucuauccccaggaaaa

SEQ ID NO: 53642 - RNA, 1794 nt, Artificial Sequence
  derived and/or modified sequence opt11 from Cergutuzumab_amunaleukin_HeavyChain2
caaguacaacuuguccaaucaggagccgaagucaagaaacccggagccagcguaaaagucuccugcaaagcaagcggcuacacauucaccgaguucggcaugaacuggguccgccaagccccaggacaaggccuggaauggaugggcuggauaaacacaaaaaccggcgaagccaccuacgucgaagaguucaaaggccgcgucacauucaccaccgacaccuccacauccacagccuauauggaacuacgcucccuccgcuccgacgacaccgcgguauacuacugcgcccgcugggacuucgcauacuacgucgaagccauggacuacuggggccaaggaacaacuguaaccguaucaagugccagcacuaaaggaccauccgucuucccccucgcccccucguccaaauccaccuccggcggcaccgcugcccuuggcugccucguaaaagacuacuucccggaacccguaaccguaucuuggaacuccggagcccugaccuccggaguccacaccuuccccgccguacuccaguccucuggacucuauucccucuccucaguaguaaccguaccgucauccuccuuaggaacccaaaccuacauaugcaacguaaaccacaaacccagcaacacuaaaguagacaagaaagucgaacccaaaagcugugacaaaacccacacaugcccacccugcccagcccccgaagcagccggcggcccauccgucuuccucuucccaccuaaaccuaaagacacccucaugauaucacgcacaccagaagucacaugcguaguugucgacgucucccacgaagauccugaagucaaauuuaacugguacgucgacggcgucgagguccacaacgccaaaacaaaaccccgcgaagaacaauacaacuccacauaccgagucgucagcguccucacaguacuccaccaagacuggcuuaacggaaaagaguacaaaugcaaagucuccaauaaagcacucggagccccaaucgagaaaaccauaucaaaagcaaaaggacaaccccgagaaccccaaguauacacccuacccccuugccgcgacgagcuaaccaaaaaccaagucucuuuauggugccucguaaaaggcuucuaccccagcgacauagccguugagugggaaucaaacggacaacccgagaacaacuacaaaaccacacccccaguccucgacucggacgggagcuucuuucuauacagcaaacuaaccgucgacaaauccagauggcaacaaggcaacgucuucuccugcucuguuaugcacgaagcccugcacaaccacuacacccaaaagucacucucacuauccccgggcggaggcggcggcuccggagggggcggguccgguggcggagguagcgcacccgcuuccucaucaaccaaaaagacccaacuccaacucgaacaccuacuccucgaccuccaaaugauccucaacggcaucaacaacuacaaaaaucccaaacuaacacggaugcucaccgccaaauucgcaaugccaaagaaagccaccgagcuaaaacaccuccaaugucuagaagaagaauuaaaaccccuagaagaaguauuaaacggcgcccaauccaaaaacuuccaccuccgcccccgcgaccuaauaucaaacaucaacgucaucguucuugaacugaaaggcucugaaaccaccuucaugugugaguacgccgacgaaaccgccaccaucguagaauuucuaaaccgcuggaucaccuucgcacaaagcaucaucuccacacuaacc

SEQ ID NO: 53643 - RNA, 645 nt, Artificial Sequence
  derived and/or modified sequence opt11 from Cergutuzumab_amunaleukin_LightChain1
gacauccaaaugacccaaucccccuccucccucuccgccucagucggcgaccgcgucaccaucacuugcaaagccuccgccgccgucggcaccuacgucgccugguaccaacaaaaacccggcaaagcccccaaacuacucaucuacuccgccuccuaccgcaaacgcggcguccccucacgauucucaggaucuggauccggcaccgacuucacccucaccaucuccucacuccaacccgaagacuucgcaaccuacuacugccaccaauacuacaccuacccccuauucaccuucggccaaggcaccaaacucgaaaucaaacgaaccgucgccgcccccuccgucuucaucuucccucccucagacgaacaacucaaauccggaaccgccuccguugucugccuucucaacaacuucuacccccgcgaagccaaaguccaauggaaaguagacaacgcccuacaaucaggcaacucccaagaauccguaaccgaacaagacuccaaagacuccacauacucccucuccuccacacucacccucuccaaagccgacuacgaaaaacacaaagucuacgccugcgaagucacccaccaaggccucuccucccccgucaccaaauccuucaaccgcggcgaaugc

SEQ ID NO: 53644 - RNA, 687 nt, Artificial Sequence
  derived and/or modified sequence opt11 from Certolizumab_pegol_HeavyChain1
gaagugcaauuggucgagaguggaggcgggcucguacaaccaggcgggagcuugcgccugagcugugccgcgagcggauauguguucacagacuauggcaugaacuggguuaggcaagcgcccgggaaagggcucgaguggaugggcuggaucaauaccuauaucggggaaccgaucuaugccgauagcgugaaagggcgcuucaccuuuagcuuggacacgagcaaaagcacggccuaccuccaaaugaauagcuuacgcgcggaagauaccgcggucuauuacugugcaaggggcuaucgcucauacgcgauggauuacuggggccagggcacgcucgugacaguaagcucggccucgaccaagggcccgagcguguucccgcuagcgcccucgagcaagagcacgagugggggcacggccgcgcuagggugccuggucaaggacuauuucccggaaccggucacggucucauggaauagcggggcccugaccucgggcguacacacguucccagccgugcuacaaagcucgggccuguacucgcucucgagcguggucacggucccaagcucgagcuugggcacgcaaacguacauaugcaaugucaaccacaagccaucaaauacgaaaguggacaagaaaguggaaccgaaaucaugcgauaaaacgcacacgugcgcggcc

SEQ ID NO: 53645 - RNA, 687 nt, Artificial Sequence
  derived and/or modified sequence opt11 from Certolizumab_pegol_HeavyChain
gaaguccaacuagucgaaucaggcggcggccucguccaacccggcggaucucuacgccuauccugcgccgccuccggauacgucuucaccgacuacggcaugaacuggguccgccaagccccaggcaaaggccucgaauggaugggcuggaucaacaccuacaucggcgaaccaaucuacgccgacuccgucaaaggccgauucaccuucucacuagacaccuccaaaagcaccgccuaccuccaaaugaacucccuccgcgccgaagacaccgccgucuacuacugcgcccgcggcuaccgcuccuacgccauggacuacuggggccaaggcacccuagucaccgucagcuccgccuccaccaaaggccccuccguauucccccucgcccccuccuccaaaucaaccuccggcggcaccgccgcccucggcugccuagucaaagacuacuuccccgaacccgucaccgucucauggaacuccggcgcccucaccuccggaguacacacuuuccccgccguccuccaaagcuccggccucuacucccucucguccgucgucaccguccccuccuccagccucggaacccaaaccuacauaugcaacgucaaccacaaacccuccaacaccaaagucgacaaaaaagucgaacccaaaucaugcgacaaaacccacaccugcgccgcc

SEQ ID NO: 53646 - RNA, 642 nt, Artificial Sequence
  derived and/or modified sequence opt11 from Certolizumab_pegol_LightChain1
gacauccaaaugacccaaucccccuccucccuaucggccucaguaggcgaccgagucaccaucacaugcaaagccucccaaaacgucggcaccaacgucgccugguaccaacaaaaacccggcaaagcccccaaagcccucaucuacucagccuccuuccucuacuccggcgucccauaccgcuucucuggcucuggcuccggcaccgacuucacccuaaccaucuccucccuccaacccgaggacuucgcaaccuacuacugccaacaauacaacaucuacccccucaccuucggacaaggcaccaaagucgaaaucaaacgcaccguagcugcccccuccguauucaucuucccacccucagacgaacaacucaaaucaggcaccgccuccgucgucugccuccuaaacaacuucuacccccgcgaagccaaaguccaguggaaagucgacaacgcccuccaauccggaaacucccaagaauccgucaccgaacaagacuccaaagacuccaccuacucccucagcuccacccucacccucucaaaagccgacuacgaaaaacacaaaguuuacgccugcgaagucacccaccaaggccucuccucccccgucaccaaauccuucaaccgcggcgaaugc

SEQ ID NO: 53647 - RNA, 642 nt, Artificial Sequence
  derived and/or modified sequence opt11 from Certolizumab_pegol_LightChain
gacauccaaaugacacaaucccccuccucccucagcgccagcguaggcgaccgcgucaccaucaccugcaaagcaucccagaacgugggcacaaacgucgccugguaccaacaaaaacccggaaaagcccccaaagcccucaucuacucagccuccuuccucuacuccggaguccccuacagauucuccggcuccggcuccggcaccgacuucacccucaccauauccucacuccaacccgaagacuucgccacauacuacugccaacaauacaacaucuacccccucacauucggccaaggcaccaaagucgaaaucaaacgcaccgucgccgcccccuccguauucauauucccccccuccgacgaacaacucaaauccggcaccgccuccgucgucugccuccuuaacaacuucuacccccgcgaagcaaaaguccaauggaaagucgacaacgcccuacaauccggcaacucucaagaauccgucaccgaacaagacuccaaagacuccaccuacagccuauccucaacccucacccuauccaaagccgacuacgaaaaacacaaagucuacgccugcgaagucacccaccaaggccucuccucacccguaaccaaauccuucaaccgcggcgaaugc

SEQ ID NO: 53648 - RNA, 1356 nt, Artificial Sequence
  derived and/or modified sequence opt11 from Cetuximab_HeavyChain
caaguacaacucaaacaauccggcccaggccucguccaaccaucccaaucccucucuaucacaugcacagucucaggauucucacucaccaacuacgggguccacuggguccgccaauccccuggaaaaggccuagaauggcuaggagucauaugguccggcggcaauaccgacuacaacacccccuucaccucacgccuaucaaucaacaaagacaacuccaaaucacaagucuucuucaaaaugaacucacuccaaucuaacgacaccgccauauacuacugcgcccgugcccucacuuacuacgacuacgaauuugcauacuggggucaaggcacacucgucacaguauccgccgccucaaccaaaggcccauccgucuucccccucgcacccucaucaaaaagcacauccggcgguaccgccgcccuaggcugccucgucaaagacuacuucccagaacccgucaccgucagcuggaacagcggcgcccucaccuccggaguccacaccuucccagccguccuacaauccuccggccucuacucccuaucaagcgucgucacuguacccucauccucccuuggcacccaaacauacaucugcaacgucaaccacaaacccucaaacaccaaagucgacaaacgaguagaacccaaaucgcccaaguccugcgacaaaacacacaccuguccacccugccccgcacccgaacuccucggaggccccagcgucuuccuuuucccucccaaacccaaagacacccuaaugaucucccgaacccccgaaguaaccugcgucgucguagauguaucgcacgaagaccccgaagucaaguucaacugguaugucgacggcgucgaaguucacaacgccaaaaccaaaccccgcgaagaacaauauaacuccaccuaccgagucgucuccguccugaccguccuacaccaagacuggcucaacggcaaagaauacaaaugcaaagucuccaacaaagcccuccccgcccccauagagaaaaccaucucuaaagccaaaggccaacccagagaaccccaagucuacacacuaccacccucacgagacgaacuaaccaaaaaccaagucucccucacaugccuggucaaaggcuucuaucccucagacaucgccgucgaaugggaauccaacggccaacccgaaaacaacuacaaaacaacacccccaguccucgacuccgacggguccuucuuccucuacuccaaacucacugucgacaaaucacgcuggcaacaagggaacgucuucuccugcuccgucaugcacgaagcccugcacaaccauuacacccaaaaaucacucucccucucccccggcaaa

SEQ ID NO: 53649 - RNA, 1347 nt, Artificial Sequence
  derived and/or modified sequence opt11 from Cetuximab_HeavyChain_variant
caaguccaacucaaacaaucaggccccggccuaguccaaccaagccagucccuguccauuaccugcaccgucuccggcuucucccuaaccaacuacggaguucacuggguacgccagucccccggaaaaggccuagaauggcuuggcgucaucuggucuggcggaaacaccgacuacaacacaccauucaccucacgacuaucaaucaacaaagacaacuccaaaucacaagucuucuucaaaaugaacucacuacaaagcaacgacacugcaaucuauuacugcgcccgcgcccucacauacuaugacuacgaguucgcauacuggggccaaggcacccucgucaccgucagcgccgccuccaccaaaggcccauccguauucccacucgcccccuccuccaaaucaaccagcggcggcacagccgcccucggcugccucgugaaagauuacuucccagaacccgucaccgucuccuggaacagcggcgcccuaacuuccggaguacacaccuuccccgccgugcuccaauccuccggccuauacuccuuaucgagcgucgucaccguccccuccucaagccugggaacccaaaccuacaucugcaacgugaaccacaaacccuccaacaccaaagucgacaagaaagucgaacccaaauccugcgacaaaacgcacacaugcccucccugccccgcccccgaacuccuuggcggacccucugucuuccucuucccucccaaacccaaagacacccuaaugauaucccgcacccccgaaguaaccugcgucgucgucgacgucucacacgaagaccccgaaguuaaauuuaacugguacguagacggcgucgaagugcacaacgccaaaaccaaaccccgcgaagaacaauacaacuccacuuaccgaguagucuccguccuaaccguccuccaccaagacuggcucaacggcaaggaauacaaaugcaaaguauccaacaaagcacuacccgcacccaucgaaaagaccaucuccaaagccaaaggucaaccccgcgaaccccaagucuacacccuucccccaucccgcgacgaacuaaccaaaaaccaagucucccuuaccugccuagucaaaggcuucuaccccuccgacauagcagucgaaugggaaucaaacggccaacccgaaaacaacuacaaaaccaccccacccguccucgauuccgacggaucuuucuuccucuacucaaaacuaaccgucgacaaaagccgauggcaacaaggaaacgucuucagcugcuccgucaugcacgaagcccuccacaaccacuacacccaaaaaucacuuagccuaagccccgguaaa

SEQ ID NO: 53650 - RNA, 639 nt, Artificial Sequence
  derived and/or modified sequence opt11 from Cetuximab_LightChain
gacauccuccucacccaaucccccgucauccucuccgucagccccggcgaacgcgucuccuucuccugccgcgccucccaauccaucggcaccaacauccacugguaccaacaacgcaccaacggcucaccccgacuccucaucaaauacgccuccgaauccaucuccggcauacccucccgauucuccggcucuggcuccggcaccgacuucacccucuccaucaacuccgucgaauccgaagacaucgccgacuacuacugccagcaaaacaacaacuggccaaccaccuucggcgccggcaccaaacuagaacucaaacgcacagucgccgcccccuccguauucauauucccacccucagacgaacaacucaaauccggcaccgccucugucguaugccuccucaacaacuucuacccccgcgaagccaaaguccaauggaaagucgacaacgcccuccaauccggcaacucacaagaauccgucaccgaacaagacucaaaagacuccaccuacucccucuccuccacccucacucuaucaaaagccgauuaugaaaaacacaaagucuacgccugcgaagucacacaccaaggccucuccucccccgucacaaaauccuucaaccgcggcgcc

SEQ ID NO: 53651 - RNA, 642 nt, Artificial Sequence
  derived and/or modified sequence opt11 from Cetuximab_LightChain_variant
gacauccugcucacccaaucccccguaauccuaagcguauccccaggcgaacgcgucagcuucuccugccgcgcaagccaaagcauaggcaccaacauacacugguaccaacaacgaaccaacggcucacccagacuccucaucaaauacgcauccgaaagcauaagcggcaucccaagccgauucucaggcucaggcucaggcacggacuucacccuaagcauaaacucagucgaaucagaagacauagccgacuacuacugccagcaaaacaacaacuggccaaccacauucggagccggaaccaaacuagaacucaaacgcacagucgcagccccauccguauucauauucccacccucagacgaacaacuaaaaucaggcacagccucagucgucugccugcucaacaacuucuacccccgcgaagccaaaguccaauggaaagucgacaacgcccuccagagcgggaacucacaagaaagcgucaccgaacaagacagcaaagacucaaccuacagccuaagcuccacccuaacccuaagcaaagccgacuacgaaaaacacaaagucuacgccugcgaagucacccaccaaggccuaagcucgcccguaaccaaauccuucaaccgaggcgaaugc

SEQ ID NO: 53652 - RNA, 675 nt, Artificial Sequence
  derived and/or modified sequence opt11 from Citatuzumab_bogatox_HeavyChain1
caccaccaccaccaucacgaaguacaacucguacaauccggccccggccucguccaacccggcggauccguccgcaucucaugcgccgccuccggcuacacauucacaaacuacggcaugaacuggguaaaacaagcccccggcaaaggccucgaauggaugggcuggaucaacacauacaccggcgaaucaaccuacgccgacuccuucaaaggccgauucaccuucucacuagacaccuccgcauccgccgccuaccuccaaaucaacucccuacgcgccgaagacaccgccgucuacuacugcgcccgcuucgccaucaaaggcgacuacuggggccaaggcacccuccucaccgucucaucagcauccaccaaaggccccuccgucuucccccucgcccccuccuccaaaucaaccuccggcggaaccgccgcccucgguugccucgucaaagacuacuucccagaacccgucaccgucuccuggaacuccggcgcccucaccuccggcguccacaccuuccccgccguccuccaaucauccggccuuuacucucucuccuccgucgucaccgucccauccuccucucucggcacccaaaccuacauaugcaacgucaaccacaaacccuccaacacaaaagucgacaaaaaaguagaaccaaaauccugc

SEQ ID NO: 53653 - RNA, 1443 nt, Artificial Sequence
  derived and/or modified sequence opt11 from Citatuzumab_bogatox_LightChain1
gacauacaaaugacccaauccccauccucacucuccgccucagucggcgacagagucacaauuaccugccgaagcaccaaaucccuccuccacucaaacggcaucacauaccuguacugguaccaacaaaaacccggcaaggcccccaaacuccucaucuaccaaauguccaaccuugccuccggaguacccucccgcuucucgagcucaggcucuggcaccgacuuuacccucaccaucuccucucuccaacccgaggacuucgccacauacuacugcgcccaaaaccucgaaaucccccggacauucggucaaggaaccaaagucgagcucaaacgaacagucgccgcccccagcgucuucaucuucccacccucggacgaacaacucaaauccggaacagccucuguagucugccuccucaacaacuucuacccccgagaagccaagguacaauggaagguagacaacgcccuccagucaggaaacucacaagagucagucacagaacaagacuccaaagacucuaccuacucccucaguucgacccuuacccuaagcaaagccgacuacgaaaaacacaaagucuacgccugcgaaguaacccaucaaggccuauccucgccagugacaaaauccuucaaccgcggcgaaugcacccgccaucgccaaccucgaggcugggaacaacucuacaacaccguaucauucaaccuaggggaagccuacgaguaccccacauucauccaagaccuacgcaacgaacucgccaaagguaccccagucugccaacuaccagucacacuccaaaccaucgccgacgacaaacguuucguccuagucgacaucaccaccaccagcaaaaagaccguuaaaguugccaucgacgucaccgacgucuaugucgucggcuaccaagacaaaugggacggcaaagaccgcgccguauuccucgacaaaguccccaccgucgccaccagcaaacucuuccccggaguuaccaaccgcgucacacucaccuucgacggaucguaccaaaagcucgucaacgccgcaaaagcggaccggaaagcccuagaacuuggagucaauaaacuggaauuuuccauagaagccauccauggcaaaaccauaaacggacaagaagccgccaaauucuuccuaaucgucauccaaauggucagcgaagcugcccgauucaaauacaucgaaacagaagucguagaccgcgggcucuacggguccuucaaacccaacuuuaaaguccucaaccuagaaaacaacuggggcgacaucagcgacgccauccacaaauccucuccacaaugcaccacaaucaaccccgcccuccaacucaucucacccuccaacgaccccugggucgucaacaagguaucccaaaucagcccugacaugggcaucuuaaaguucaaaagcucaaaa

SEQ ID NO: 53654 - RNA, 1380 nt, Artificial Sequence
  derived and/or modified sequence opt11 from Cixutumumab_HeavyChain1
gaaguccaacucguccaaagcggcgcagaagucaagaaacccggaucuucaguaaaagucuccugcaaagccagcggcggcacauucuccucauacgccauaucaugggugaggcaagcccccggccaaggccuagaauggaugggcggcaucauccccaucuucggaacagccaacuacgcacaaaaauuccagggacgcgucacaaucaccgcagacaaauccaccuccacagcauacauggaacucuccucccucagauccgaggacaccgccguauacuauugcgcgcgcgcaccacuccgguuccuagaaugguccacccaagaccacuacuacuacuacuacauggacgucuggggcaaaggcacaacagucacugucuccuccgccagcaccaaaggacccagcguauucccccucgcaccgagcucaaaauccacauccggcggaaccgccgcccucggcugccuaguaaaagacuacuucccagaacccgucaccgucuccuggaacucaggcgcccucacaucaggaguacacacauuccccgcgguccuacaaucuagcggccucuacucucucuccucagucguaacgguccccucuuccucccucgggacacaaaccuacauaugcaacguaaaccauaaacccagcaacaccaaaguagacaagaaagucgaacccaaaagcugcgacaaaacccacaccugucccccaugcccagcacccgaacuacuaggaggacccuccgucuuccuauucccacccaaaccaaaagacacccucaugaucucacgcacacccgaaguaaccugcgucgucgucgacgucagccacgaggaccccgaagucaaauucaacugguaugucgauggcgucgaaguacacaacgccaaaaccaaaccacgagaagaacaauacaacucaaccuaucgugucgucuccguucuaaccguauuacaccaagacuggcucaacggaaaagaguacaaaugcaaagucagcaacaaagcccuccccgcccccaucgagaaaaccauauccaaagcgaaaggccaacccagggaaccacaagucuacacucucccgccaucaagagaagaaaugaccaaaaaccaaguaucacuaaccugccuagucaagggcuuuuacccgagcgacaucgccgucgaaugggaauccaacggccaaccagaaaauaacuacaaaaccaccccacccguccuagacagcgacggauccuucuuccucuacuccaaacucaccgucgacaaaucccgauggcaacaaggcaacgucuucuccugcuccguaaugcacgaagcccuccacaaccacuacacccagaaaagccucucacucucucccggcaaa

SEQ ID NO: 53655 - RNA, 642 nt, Artificial Sequence
  derived and/or modified sequence opt11 from Cixutumumab_LightChain1
ucaucagaacuaacacaagaccccgccgucuccgucgcccucggacaaaccguccgaaucaccugccaaggcgacucccuacgcucauacuacgcaaccugguaccaacaaaaaccaggacaagccccaauccucgucauauacggcgaaaacaaacgccccuccggcaucccagaccgcuucuccggcuccuccucuggcaacaccgccucacucacaauaaccggcgcacaagccgaagacgaagccgacuacuacugcaaaucccgcgacggcuccggccaacaccuagucuucggcggcggcacaaaacucaccguccucggccaaccaaaagccgcccccuccguaacccucuucccccccuccuccgaagaacuccaagccaacaaagccacccucgucugccucaucuccgacuucuaccccggagccgucaccgucgcauggaaagccgacagcucccccguaaaagccggcguagaaaccaccacccccuccaaacaaucaaacaacaaauacgccgccuccuccuaccuaucccucacccccgaacaauggaaaucccaccgcuccuacuccugccaagucacacacgaaggcuccacagucgaaaaaacagucgcccccgccgaaugcucc

SEQ ID NO: 53656 - RNA, 1350 nt, Artificial Sequence
  derived and/or modified sequence opt11 from Clazakizumab_HeavyChain1
gaaguccaacucgucgaaucagggggaggccucgugcagcccggaggcucccuacgccucagcugcgccgccucgggcuucucccucuccaacuacuacgucaccuggguccgccaagcacccgggaaaggucuggaaugggucggaauaaucuacggcucagacgaaacagccuacgccacaucagccaucgggagauucaccauuucccgcgacaacuccaaaaacacccucuaccuccaaaugaacagccuccgcgcagaagacacagccgucuacuacugcgcccgagacgacucaagcgacugggacgccaaguucaaccuauggggccaaggcacacuugucaccguaucauccgccucuaccaaaggaccauccgucuucccacucgccccauccuccaaaagcaccuccggcggcaccgcagcccucggaugccuaguaaaggacuacuuccccgaacccgucaccgucuccuggaacucuggagcccuaacauccggcguacauacauucccagcaguccuccaaucauccgggcucuacucacuaagcucagucgucacuguccccagcuccucgcucggcacccaaacauacaucugcaacgucaaccacaaacccucaaacaccaaagucgacaaacgcguagaacccaaauccugcgacaaaacccacacaugcccacccugccccgcccccgaacuucucggcggcccuucagucuuccucuuucccccaaaaccaaaagauacacucaugaucucacgcaccccagaaguaaccugcgucgucgucgacgucucacacgaagaccccgaaguaaaauucaacugguacgucgacggcguagaaguacacaacgccaaaacaaagccccgagaagaacaguacgccucaacauaccgcguagucucaguccucacaguccuccaccaagacuggcugaacggaaaagaauacaaaugcaaagucuccaacaaagcccucccagcccccauagagaaaacaaucuccaaagccaaaggccaaccccgcgaaccccaagucuacacccucccacccucacgcgaagaaaugaccaaaaaccaagucucccuaaccugccucguaaaaggcuucuaccccuccgauauagcagucgaaugggaaagcaacggccaacccgaaaacaacuacaaaacaaccccacccguacucgacuccgacggauccuuuuuccuuuacuccaaacuaacagucgacaaaucacgcuggcaacaaggcaacguauucucaugcuccgucaugcacgaagcccuacacaaccacuacacacaaaaaucccucagucucucccccggcaaa

SEQ ID NO: 53657 - RNA, 651 nt, Artificial Sequence
  derived and/or modified sequence opt11 from Clazakizumab_LightChain1
gccauacaaaugacccaaucccccuccucccucuccgccuccgucggcgaccgcgucaccauaaccugccaagccucacaauccaucaacaacgaacucucaugguaccaacaaaaacccggcaaagcccccaaacuccucaucuaccgcgccucaacccucgccucaggaguccccucccgcuucuccggcuccggcuccggcaccgacuucacccucaccaucuccucccuccaacccgacgacuucgccacauacuacugccaacaaggcuacucccucagaaacaucgacaacgccuucggaggcggcaccaaagucgaaaucaaacguaccgucgccgcccccuccguauuuaucuucccacccuccgacgagcaacucaaauccggcaccgccuccgucgucugccuacuaaacaacuucuacccccgcgaagccaaaguccaauggaaagucgacaacgcccuacaauccggaaacucccaagaauccgucaccgaacaagacuccaaagacuccacauacucacucuccucaacccucaccuuaucuaaagccgacuacgaaaaacacaaaguauacgccugcgaagucacccaccaaggccucuccucccccgucaccaaauccuucaaccgcggcgaaugc

SEQ ID NO: 53658 - RNA, 1347 nt, Artificial Sequence
  derived and/or modified sequence opt11 from Clivatuzumab_tetraxetan_HeavyChain1
caaguccaauuacaacaauccggcgccgaagucaagaaacccggagccucugucaaagucuccugcgaagccagcggauacaccuuccccuccuacguccuccacugggucaaacaagcaccaggacaaggccucgaauggaucggcuacaucaacccuuacaacgacggaacucaauacaacgagaaauucaaaggcaaagccacccucacccgagacaccuccaucaacaccgccuacauggaacucucccgccuacgauccgacgacacagccgucuacuacugcgcacgcgguuucggaggcucauaugguuucgcauacuggggccaaggcacccucgucaccgucuccuccgccuccaccaaaggccccucagucuucccccucgcccccagcuccaaauccacgucaggaggaaccgccgcccucggaugccucgucaaagacuacuuccccgaaccugucaccgucucauggaacuccggcgcgcugaccucaggcguacacacauuccccgccguccuccaauccucaggccucuauucucucucgucagucgucaccguccccuccuccucacugggcacccaaaccuacaucugcaacguaaaccacaaaccauccaacaccaaggucgacaaacgugucgaaccaaaaagcugcgacaaaacccacacaugcccacccugccccgccccugaacuccuaggaggccccuccgucuuccuauuucccccaaaaccaaaagacacccucaugauaucccgcacccccgaagucacuugcgucgucgucgacgucagccacgaagacccagaaguaaaauucaacugguacgucgauggcgucgaaguccacaacgcaaaaaccaaaccccgggaagaacaauacaacuccacguaucgcgucguaucgguacucacaguccuccaccaagacuggcucaacggaaaagaauauaaaugcaaaguuuccaacaaagcccuccccgcaccaauugagaaaaccaucucaaaagcaaaaggccaaccacgcgaaccacaagucuacacacuacccccuucacgggaagaaaugaccaaaaaccaagucagccucacaugccuaguaaaagguuucuaccccucagacauugccgucgaaugggaaucaaacggccaacccgaaaauaacuacaaaaccaccccaccaguccuagacuccgacgguucauucuuccuuuacuccaaacuaacaguagacaaaagccgcuggcaacaaggcaacgucuucuccugcuccguaaugcacgaggcucuccacaaccacuacacccaaaaaucacuaucacucuccccaggcaaa

SEQ ID NO: 53659 - RNA, 645 nt, Artificial Sequence
  derived and/or modified sequence opt11 from Clivatuzumab_tetraxetan_LightChain1
gauauacaacucacccaaucccccuccucccuuuccgccucaguaggcgaccgcgucaccaugaccugcuccgccuccuccuccgucuccuccuccuaccucuacugguaccaacaaaaacccggcaaagcccccaaacuauggaucuacuccaccuccaaccucgccuccggcguccccgcccgcuucuccggcucuggcuccggcacagacuucacccucaccaucuccucccuacaacccgaagacucagcauccuacuucugccaccaauggaaccgcuaccccuacaccuucggcggcggcacccgccucgaaaucaaacgaaccgucgccgcccccuccgucuucaucuucccacccuccgacgaacaacucaaauccggcaccgccucagucgucugccuacucaacaacuucuacccccgcgaagccaaaguccaauggaaagucgacaacgcccuccaauccggcaacucccaagaauccgucaccgaacaagacuccaaagacuccaccuacucccucuccuccacccucacccucuccaaagcagacuacgaaaaacacaaagucuacgccugcgaagucacccaccaaggccucuccucccccgucaccaaauccuucaaccgcggcgaaugc

SEQ ID NO: 53660 - RNA, 1335 nt, Artificial Sequence
  derived and/or modified sequence opt11 from Codrituzumab_HeavyChain1
caaguccagcucguccaaagcggcgccgaagucaagaaaccaggcgcuucagucaaagucuccugcaaagccucaggcuauaccuucaccgacuacgaaaugcacuggguccgccaagcuccaggccaaggcuuagaauggaugggcgcacucgaccccaaaaccggcgacaccgccuacucccaaaaauucaaaggccgcgucacccuaaccgccgauaaaucaaccucaaccgccuacauggaacucuccucccuaaccuccgaggacaccgccgucuacuacugcaccagauucuacagcuacaccuacuggggacaaggcacacucgucacagugucauccgccuccaccaaaggcccuucagucuucccacucgcccccuccuccaaauccaccucgggcggaaccgccgcucucggaugccucgucaaagacuacuuccccgaacccguaacagucuccuggaacuccggcgcccuaaccuccggaguccacacauuccccgccguccuccaauccuccggccucuacucccucuccuccguuguaaccguccccucauccucccucggcacccaaacauacaucugcaaugucaaucacaaacccucuaacaccaagguggauaaaaaggucgaaccuaaaucaugcgacaaaacccacaccuguccacccugccccgcccccgagcuccucggcggcccuagcguuuuccucuucccucccaaacccaaagacacccuaaugaucucacgcacccccgaaguaaccugcgucgucgucgaugucagccacgaagaccccgaagucaaauucaacugguacgucgacggugucgaaguccacaacgccaaaacuaaaccccgcgaagaacaguauaacuccaccuaccgcgucguauccguccucaccguacuccaccaggacuggcuaaauggcaaagaauacaaaugcaaagucagcaacaaagcccuacccgcacccauugagaaaaccaucuccaaagcuaaaggucaaccccgggaaccccaagucuacacauuaccacccucuagagacgaacucaccaaaaaccaagucucacuaaccugccucgugaaaggcuucuaucccuccgauaucgccgucgaaugggaauccaacggccaacccgaaaacaauuacaaaacuacacccccaguccucgacuccgacggcuccuucuuccucuacuccaaacucaccgucgacaaaucccgcuggcaacaaggcaacgucuucucaugcuccgucaugcacgaagcgcuccacaaccacuacacccaaaaaucacucucccucuccccaggcaaa

SEQ ID NO: 53661 - RNA, 657 nt, Artificial Sequence
  derived and/or modified sequence opt11 from Codrituzumab_LightChain1
gacgucgucaugacccaaucaccccucucccuccccgucacccccggcgaacccgccuccaucuccugccgcuccucccaaucccucguccacucgaacagaaacacauaccuccacugguaccuccaaaaacccggacaauccccacaacuccucaucuacaaagucuccaaccgcuucuccggcguccccgaccgauucuccggcuccggcuccggcaccgacuucacccuuaaaaucucccgcgucgaagccgaagacgucggcgucuacuacugcucccaaaacacccacgucccacccaccuucggacaaggcaccaaacucgaaaucaaacgcaccgucgcagcacccuccgucuucaucuucccacccuccgacgagcaacucaaauccggcacagccuccgucgucugccuccucaacaacuucuacccccgcgaagcaaaaguccaauggaaagucgacaacgcccuccaauccggcaacucccaagaauccgucaccgaacaagacuccaaagauuccaccuacucccuauccuccacccucacccuauccaaagccgacuacgaaaaacacaaagucuacgccugcgaagucacccaccaaggccucuccucccccgucaccaaauccuucaaccgcggcgaaugc

SEQ ID NO: 53662 - RNA, 1350 nt, Artificial Sequence
  derived and/or modified sequence opt11 from Coltuximab_ravtansine_HeavyChain1
caaguacagcuaguccagccaggcgccgaaguaguuaagccaggagccuccguaaaacuauccugcaaaaccuccggcuacacauucaccucaaacuggaugcacugggucaaacaagcccccggccaaggccuugaauggaucggagaaaucgaucccucagacuccuacaccaacuacaaccaaaacuuccaaggcaaagcuaaacucaccguagacaaaucuaccagcaccgccuacauggaagucuccucccuccgcuccgacgacacggcagucuacuacugcgcccgcggauccaacccuuacuacuacgccauggacuacuggggacaaggcaccuccgugaccguuuccuccgcaucuaccaaaggccccuccgucuuccccuuagcccccucauccaaguccacaucuggcggaaccgccgcacucggcugccucgucaaagacuacuuccccgaacccgucacugucucauggaacucaggcgcacuuacuucaggcguacacaccuuccccgcugugcuccaauccucaggccucuacucccucuccucagucgucaccguuccaucauccagucuaggcacccaaacauauaucugcaacguaaaccacaaacccucuaacaccaaaguggacaagaaagucgaacccaaaucaugugacaaaacccauaccugcccaccgugccccgccccagaacuacucggcggcccauccgucuuccuauucccacccaaaccaaaagacacccucaugauaucccgcacccccgaagucaccuguguaguugucgacgucucacacgaagaccccgaagucaaauucaacugguacguagacggcguagaaguccacaacgcaaaaaccaaaccaagagaagaacaauacaacuccaccuaccgcguagucucuguacucacaguccuccaccaagacuggcucaacggcaaagaauauaaaugcaaaguauccaacaaagcccuccccgccccaaucgagaaaaccaucuccaaagccaaaggccaaccccgagaaccccaagucuacacccuucccccaucccgcgacgaacucaccaaaaaccaggucucccuuaccugccucgucaaaggcuucuacccaucagacaucgcagucgaaugggaaagcaacggccaacccgaaaacaacuacaaaaccacacccccaguacuagacuccgacggauccuucuuccucuacuccaaacucaccgucgauaaaucacgcuggcaacaaggaaacgucuucucuugcucagucaugcacgaagcacuccacaaccacuacacccaaaaaucccucucccuuaguccuggcaaa

SEQ ID NO: 53663 - RNA, 633 nt, Artificial Sequence
  derived and/or modified sequence opt11 from Coltuximab_ravtansine_LightChain1
gaaauaguccucacccaaucccccgccaucauguccgccucucccggcgaacgcguaaccaugaccugcuccgccuccuccggcgucaacuacaugcacugguaccaacaaaaacccggcaccucaccccgacgcuggaucuacgacaccuccaaacuagccuccggcgucccagcccgcuucucaggcuccggcuccggcaccgacuacucccucaccauauccucaauggaacccgaagacgccgccacauacuacugccaccaacgaggaucauauaccuucggcggcggcaccaaacucgaaaucaaacgcaccgucgccgcccccuccgucuucaucuucccacccuccgacgaacaacucaaaucaggcaccgccuccgucgucugccuacucaacaacuucuacccccgcgaagcaaaaguccaauggaaagucgacaacgcccuacaauccggcaacucccaagaauccgucaccgaacaagacuccaaagacucaacauacucacucuccuccacccucacccuauccaaagccgacuacgaaaaacacaaagucuacgccugcgaagucacccaccaaggccuauccucccccguaaccaaauccuucaaccgaggcgaaugc

SEQ ID NO: 53664 - RNA, 1356 nt, Artificial Sequence
  derived and/or modified sequence opt11 from Conatumumab_CV_HeavyChain
caaguucaacuacaagaauccggccccggucucgucaaaccuucacaaacccucucccucacauguacugucucaggcggaucaaucuccucaggagacuacuucuggagcuggauccgccaacuccccggcaaaggccucgaguggaucggccacauacacaacuccggcaccaccuacuacaacccaucccucaaaucccgcgucacaauauccguagacacaucaaagaaacaauucucccugcgccuuucgucagucaccgcagccgacaccgccguauacuacugcgcccgcgaccgaggaggcgauuacuacuacggcauggacgucuggggccaaggaaccacugucaccgucucaucagccuccaccaaaggacccucaguauucccccuagcacccagcuccaaaucuacguccggcggcaccgcagcccucggcugccucgucaaagacuacuuccccgaacccguaaccgucuccuggaacucaggagcgcucaccuccggaguccacacauucccagccguacuccaauccuccggccucuacucucucuccuccgucguaacggucccauccucuucccuuggcacccaaaccuacaucugcaacgucaaucacaaacccucaaacaccaaagucgacaagcgcgucgaacccaaauccugcgacaaaacacacacaugcccacccugccccgccccagaacuacucggaggccccagcguuuuccucuucccgcccaaacccaaagacacccuaaugaucucacguacucccgaaguaaccugcgucgucgucgacgucucccacgaagaccccgaaguaaaguucaacugguacgucgacggugucgaagugcacaacgcuaagaccaaaccacgagaagaacaauacaacucaaccuacagagucgucuccguacucaccguccuccaucaagacuggcucaacggcaaagaauacaaaugcaaagucuccaacaaagcucucccagccccaaucgagaaaaccauaucaaaagccaaaggccaaccucgugaaccacaagucuacacacucccacccuccagagaagaaaugaccaaaaaccaagucucccucacaugccucgucaaaggcuucuaucccagcgacauugccgucgaaugggaaucuaacggccaacccgaaaacaacuacaaaaccacaccgccaguucuugacuccgacggcucauucuuccucuacuccaaacucaccgucgacaaaucccgguggcaacaaggcaacguauuuuccuguagugucaugcacgaagcccuccacaaccacuacacccagaaaagccucucucuaucacccggcaaa

SEQ ID NO: 53665 - RNA, 645 nt, Artificial Sequence
  derived and/or modified sequence opt11 from Conatumumab_CV_LightChain
gaaaucguccucacccaaucccccggcacccucucccucucccccggcgaacgcgcaacccucuccugccgcgccucacaaggcaucucccgcucauaccucgccugguaccaacaaaaacccggccaagcccccucccuccucaucuacggcgcauccucccgcgccaccggcauccccgaccgcuucuccggcuccggcuccggcaccgacuuuacccucaccaucucccgccucgaacccgaagacuucgccgucuacuacugccaacaauucggcuccucccccuggaccuucggccaaggcacaaaagucgaaaucaaacgcaccgucgccgcccccagcgucuucaucuucccacccuccgacgaacaacuaaaaucaggcaccgccuccgucgucugccuccucaacaacuucuacccccgcgaagcaaaaguccaauggaaagucgacaacgcccuccaauccggcaacucccaagaauccguaaccgaacaagacuccaaagacuccaccuacucccucuccuccacccucacccuguccaaagccgacuacgaaaaacacaaagucuacgcaugugaaguaacccaccaaggccucuccucccccgucaccaaauccuucaaccgaggcgaaugc

SEQ ID NO: 53666 - RNA, 1356 nt, Artificial Sequence
  derived and/or modified sequence opt11 from Conatumumab_HeavyChain1
cagguccaacuccaagagucuggccccggccuagucaaaccaucacaaacccucucccucacaugcaccgucuccggaggcucaaucuccucuggcgauuacuucugguccuggauccgacagcucccuggaaaaggccucgaauggaucggacacauacacaacucagguacaaccuacuacaaccccucccucaaaucccgagucaccauaagcgucgacaccuccaagaaacaauucucccuaagacuauccagcgucaccgcagccgacacagcagucuacuauugcgcccgagacagaggcggcgacuacuacuacggcauggacgucuggggccaggguaccaccgucaccgucuccuccgccuccacuaaaggcccuucagucuucccccucgcccccuccuccaaauccaccuccggcggaaccgccgcccuaggaugccucgucaaagacuauuuccccgaacccgucaccgucuccuggaacuccggcgcacucaccucaggcguccacacauuccccgcaguccuccaauccucaggccucuacucacucagcuccgucgucaccguccccagcucaucacucggcacccaaaccuacauaugcaacgucaaccauaaacccuccaacaccaaagucgacaaacgaguagaacccaaaagcugcgacaaaacacacaccuguccucccugccccgcacccgaacuccucggaggccccuccguauuccucuucccacccaaacccaaagacacacuaaugaucucccgcacccccgaaguaacaugcgucguaguagacgucucucacgaggaccccgaagucaaauucaacugguacgucgacggagucgagguacacaacgcaaaaacaaaaccccgcgaggaacaauacaacuccaccuaccgcguaguaagcguccuaacagucuuacaccaagacuggcucaacgguaaagaauacaaauguaaaguuucaaauaaagcacuacccgcuccaauagagaaaaccauaucuaaagcuaaaggucaaccccgugaaccccaagucuacacacucccacccucucgcgaagaaaugaccaaaaaccaagucucccucaccugucuagucaaaggcuucuaccccuccgacauagccgucgaaugggaaucaaacggccaacccgaaaacaacuacaaaacuacaccaccaguccucgacuccgacggcucauucuuccucuacagcaaacucaccgucgacaaaucacgcuggcaacaaggcaacgucuucuccugcuccguaaugcacgaagcccuccacaaccauuacacccaaaaaucccuaagccucuccccaggcaaa

SEQ ID NO: 53667 - RNA, 1356 nt, Artificial Sequence
  derived and/or modified sequence opt11 from Conatumumab_HeavyChain
cagguccaacuccaagaauccggccccggccucgucaaacccucccaaacacugucccucacaugcacaguuuccggaggcuccauaucaucaggagacuacuucuggucauggauaagacaacuccccggcaaaggacucgaauggaucggccacauccacaacuccggcacaacauacuacaaccccucccucaagucacgcguaaccaucucagucgacaccuccaagaaacaauucagccuacgacuauccucugucacagccgccgacacagccgucuacuacugcgcccgcgaccgcggcggcgacuacuacuacggcauggacgucuggggccaaggcaccaccgucacugucagcuccgccuccaccaaaggccccuccgucuucccacuugcacccuccuccaaaagcaccucaggcggaacagccgcccucggcugccucgucaaagacuacuuccccgaacccgucaccguaucauggaacucgggagcacucaccuccggcguccacacauuccccgccgugcuccaauccucgggccuauacucccucuccuccgucgucacagucccauccucuucuuuaggaacccaaacuuacaucugcaacgucaaccacaaaccaucaaacaccaaagucgacaaacgcgucgaacccaaaucaugcgacaaaacccauaccugcccacccugccccgcacccgaacuacuaggcggucccucagucuucuuauucccacccaaacccaaagacacacucaugaucucccgcacccccgaaguuaccugcgucguagucgacgucucacacgaagacccagaagucaaauucaacugguacguagacggaguagaaguacacaacgccaaaacaaaaccccgcgaagaacaauacaacuccacauaccgagucguuuccguacucaccguacuccaccaagacuggcucaacggcaaagaauacaaaugcaaaguaagcaacaaagcacucccugccccaaucgagaaaacuauauccaaagcaaaaggccaaccucgcgaaccccaggucuacacccucccacccucacgcgaagaaaugaccaaaaaccaaguaucauugaccugccucguuaaaggauucuaccccuccgacaucgccguggaaugggaauccaacggacaacccgaaaacaacuacaaaaccacacccccaguccucgacagcgacggcuccuucuuucuauacagcaaacucacagucgacaaaucacgcuggcaacaaggcaaugucuucucuugcuccgucaugcacgaagcccuacacaaccauuacacacaaaaaucccuuucccuauccccaggcaag

SEQ ID NO: 53668 - RNA, 645 nt, Artificial Sequence
  derived and/or modified sequence opt11 from Conatumumab_LightChain1
gaaauaguccuuacccaaucccccggcacccuaucccucucgcccggcgaacgugccacccucuccugccgcgccucacaaggcaucucccguucauaccucgccugguaccaacaaaaacccggccaagcucccucccuacuaaucuacggcgccuccucacgagccaccggaauccccgaccgcuucuccggcuccggcuccggcaccgacuucacccucaccaucucccgccuagaacccgaagacuucgccgucuacuacugccaacaauucggcucauccccauggacauucggccaaggcacaaaaguagaaaucaaacgaaccgucgccgcccccuccgucuucaucuucccacccuccgacgaacaacucaaauccggcaccgccuccgucgucugccuacucaacaacuucuacccccgcgaagccaaaguccaauggaaagucgacaacgcccuccaauccggcaacucccaagaauccgucaccgaacaagacuccaaagacuccaccuacucccuauccuccacccuaacccuaucaaaagccgacuacgaaaaacacaaaguauacgccugcgaagucacccaccaaggccucuccucaccaguaaccaaauccuucaaccgcggagaaugc

SEQ ID NO: 53669 - RNA, 645 nt, Artificial Sequence
  derived and/or modified sequence opt11 from Conatumumab_LightChain
gaaauaguacucacccaaucccccggaacccucucccucucacccggcgaacgcgccacccucuccugccgagccucccaaggcaucucccgcuccuaccucgccugguaccaacaaaaaccaggccaagcccccucccuacuaaucuacggagcauccucccgcgccaccggcauccccgaccgcuucuccggcuccggcuccggcaccgacuucacccucaccaucucccgccucgaaccagaagacuucgccguauacuacugccaacaauucggcuccucccccuggacauucggccaaggcaccaaagucgaaaucaaacgcaccgucgccgcccccucagucuucaucuucccacccuccgacgaacaacuaaaauccggcaccgccuccgucguaugccuacucaacaacuucuacccccgcgaagccaaaguacaauggaaagucgacaacgcccuccaauccggcaacucccaagaauccguaaccgaacaagacucuaaagacuccaccuacagccucuccuccacacuaacccucuccaaagccgacuacgaaaaacacaaagucuacgccugcgaagucacccaccaaggccucuccucccccgucaccaaauccuucaaccgcggcgaaugc

SEQ ID NO: 53670 - RNA, 1344 nt, Artificial Sequence
  derived and/or modified sequence opt11 from Concizumab_HeavyChain1
gaaguccaacucgucgaaucaggcggcggccuaguaaaacccggaggaucccuccgucucucaugcgccgccuccggauucaccuucuccaacuacgccaugucuuggguacgccaaaccccagaaaaacgccucgaauggguagcaaccaucuccagauccgguuccuacuccuacuuucccgacuccguccaaggccgcuucaccaucucccgcgacaacgcuaaaaacucccucuaccuacaaaugaacucacuaagagcagaggacacagcagucuacuacugcgcccgacuaggaggcuacgacgaaggcgacgcuauggacuccuggggccaaggcaccaccgucaccguaucaagcgccucaaccaaaggaccuuccgucuucccacucgcccccugcucacgcuccacaucagaauccacagccgcccuuggcugucucguaaaagacuacuucccagagccagucaccguauccuggaacagcggggcccuaaccucaggcgugcacaccuuccccgccguccuccagucuucaggccucuacucccucucauccgucgucaccguacccagcuccucacucggcaccaaaaccuacacaugcaacgucgaccacaagcccuccaacaccaaaguagauaaacgcgucgaaucaaaauacggcccaccaugcccucccugccccgcaccagaguuccuaggaggcccuucugucuuccuauuucccccaaaacccaaagacacccuaaugauaucccgcacccccgaaguaaccugcgucgucgucgaugucucccaagaagaccccgaaguccaauucaacugguacgucgacggcgucgaaguccacaaugcaaaaaccaagccacgcgaagaacaauucaacuccacauaccgugucgucuccguccuuaccguccuccaccaagacuggcuaaacggaaaagaauacaaaugcaaaguauccaacaaaggccuccccucuucaauagagaaaaccauaucuaaagcaaaaggccagccacgcgaaccacaaguguacacccuuccucccucccaagaagaaaugaccaaaaaccaagucucccuaaccugccuagucaagggcuucuaccccucagacauagcagucgaaugggaauccaacggccaacccgaaaacaacuacaaaacaacacccccuguucuagacuccgacggaucauucuuccucuacucccgucucaccguagacaaaucacgauggcaagagggcaacgucuucuccugcucaguaaugcacgaagcacuccacaaccacuacacccaaaaaucccuaucccucucccucggaaaa

SEQ ID NO: 53671 - RNA, 657 nt, Artificial Sequence
  derived and/or modified sequence opt11 from Concizumab_LightChain1
gacauagucaugacccaaacaccccucucacucuccgucaccccaggccaacccgcaucaaucuccugcaaauccucccaaucacuccuagaauccgacggcaaaaccuaccucaacugguaccuccaaaaacccggccaaucuccccaacuacucaucuaccucgucuccauccucgacuccggaguccccgaccgauucuccggcuccggauccggcaccgacuucacccucaaaaucucccgagucgaagcagaagacgucggcguauacuacugccuccaagccacacacuucccccaaaccuucggcggcggcaccaaagucgaaaucaaacgcacagucgccgcccccuccgucuucaucuucccacccuccgacgaacaacuaaaaucaggcaccgccuccgucgucugccuccucaacaacuucuacccccgugaagccaaaguccaauggaaagucgacaacgcccuccaauccggcaacucccaagaauccgucaccgaacaagacuccaaagacuccaccuacucccucuccuccacccucacccucuccaaagccgacuacgaaaaacacaaagucuacgccugcgaagucacccaccaaggccucuccucccccgucaccaaaucauucaaccgcggcgaaugc

SEQ ID NO: 53672 - RNA, 1314 nt, Artificial Sequence
  derived and/or modified sequence opt11 from Crenezumab_HeavyChain1
gaagugcaacuuguugaauccggcggaggccucguccaacccggcggguccuugcgacucagcugcgccgcauccggcuuuacauucucauccuacgguaugagcuggguccgacaagcgcccggcaaaggacucgaacuugucgccagcauaaacuccaacggcggcucaacauacuaccccgacuccgugaaaggacgcuucacaauaucccgagacaaugccaaaaacucacuauaccuacaaaugaacucccuccgcgccgaagacaccgcagucuacuacugcgcauccggcgacuacuggggccaaggaaccacggucacagucagcucggcuucuaccaaaggacccagcgucuucccccuagcccccugcucacgcagcacauccgaauccaccgccgcccucgguugccuagucaaagacuacuucccggaacccgucacggucuccuggaacuccggagcccuuaccuccggcguccacaccuuccccgccguauuacaguccucaggacuauacucacucucgagcguggucaccguacccagcuccagccuaggcaccaaaaccuacacgugcaacgucgaccacaaacccuccaacaccaaaguggacaaacgcguggaaucaaaauacggcccacccugucccccaugcccagccccugaauuucucggaggccccucaguauuccucuucccacccaaacccaaagacacccucaugaucuccagaacacccgaaguaaccugcgucgucguagacguaucccaagaagaccccgaaguccaauucaacugguacguagacggcguggaaguccacaacgccaaaacaaaaccucgcgaagaacaauucaacuccacauaccgcgucgucuccguccuuaccguacuccaccaagacuggcucaacggaaaagaauacaaaugcaaagucucaaacaagggacuacccucaagcaucgaaaagaccaucuccaaagccaaaggccagccacgagaaccacaagucuacacacuaccacccucccaagaagaaaugaccaaaaaccaggucucgcucacaugccucgucaaaggcuucuaccccuccgacauagcagucgaaugggaauccaacggucaacccgaaaacaacuacaaaaccacaccacccguccuagacuccgacggcagcuucuuccucuacucccgacugaccgucgacaaaucacgcuggcaggaaggcaacguauucucuugcuccgucaugcacgaagcccuacauaaccacuauacccaaaaaucccuaucacucucacucgga

SEQ ID NO: 53673 - RNA, 657 nt, Artificial Sequence
  derived and/or modified sequence opt11 from Crenezumab_LightChain1
gacaucguaaugacccaauccccacucucccuccccgucacacccggcgaacccgccuccaucuccugccgcuccucccaaucacucguauacuccaacggcgacacuuaccuccacugguaccuacaaaaacccggccaaucaccccaacuccuaaucuacaaagucuccaaccgauucuccggcguccccgaccgcuucuccggcucaggcuccggcacagacuucacccucaaaaucucccgaguagaagccgaagacgucggcgucuacuacugcucccaauccacccacguccccuggacauucggccaaggcaccaaagucgaaaucaaacgcacagucgcagcccccuccgucuucaucuucccacccuccgacgaacaacuaaaauccggcaccgccuccgucgucugccuccucaacaacuucuacccccgcgaagcaaaaguccaauggaaagucgacaacgcccuccaauccggcaacucacaagaguccguaaccgaacaagacuccaaagacuccaccuacucccucucauccacccucacccuuuccaaagccgacuacgagaaacacaaagucuacgccugcgaagucacacaccaaggccuaagcucccccgucacaaaauccuucaaccgaggcgaaugc

SEQ ID NO: 53674 - RNA, 1365 nt, Artificial Sequence
  derived and/or modified sequence opt11 from Crotedumab_HeavyChain1
gaaguccaacucgucgaaucaggcggaggccucguacaacccggcgggucacuccgccuaagcugcgccgccuccggcuucaccuucuccaauuaccucaugaacuggguaagacaagcccccggcaaaggccucgaauggcuagcaaauauccaggaagacggcauagaaaaauacuacgucgacuccgucaaaggccgcuucacaauaagccgcgacaacgccaaaaacucacucuaccuacaaaugaacucacuacgcgccgaagacaccgccgucuacuacugcgccagggaacccucccacuacgacauucuaacaggauacgacuauuacuacggaauggacgucuggggacaaggaacaaccgucacagucucauccgcaucuacaaaaggucccuccguauucccccuagcacccugcucccgcucaacaucagaaucgaccgcagcacugggcugccucguaaaagacuacuuccccgaaccuguuaccguuagcaacaacuccggcgcucuaacaagcggcguacacaccuucccagcaguacuccaaagcuccggccuuuauucccuauccucgguagucaccguccccuccuccucccuuggcaccaaaacauacacaugcaacguagaccacaagccaagcaacaccaaagucgauaagcgcguggaaagcaaauacggaccacccugcccgcccugccccgcccccgaguuccucggaggccccagcgucuuccucuucccaccaaaacccaaagacacccucaugaucucacgaacccccgaaguaaccugcguagucgucgacguaucacaagaagaccccgagguccaauucaacugguacgucgacggcguagagguccacaacgcuaaaaccaaaccccgagaagaacaauucaacuccaccuaccgcgucgugucaguacuaacuguccuacaccaagacuggcucaacggaaaagaauacaaaugcaaagucagcaacaagggccuccccaguuccaucgagaaaaccauaagcaaagccaaaggccaaccccgagaaccccaagucuacacccuaccacccucccaagaagaaaugaccaaaaaccaagucucccuaacaugccuagucaagggcuucuaccccucagacauugcagucgaaugggaauccaacggccagcccgaaaacaacuacaaaaccaccccacccguccuagacucagacggcuccuucuuccuauacucccgacucacagucgacaaaucaagauggcaagaaggcaacgucuucuccugcucagucaugcacgaagcccuccacaaccacuacacccaaaaaucccucucccucucacucggcaaa

SEQ ID NO: 53675 - RNA, 1365 nt, Artificial Sequence
  derived and/or modified sequence opt11 from Crotedumab_HeavyChain2
gaaguccagcucgucgaauccggcggaggccuaguacaacccggaggcucccuccaccucucaugcgccgcauccggcuucaccuucuccaacuaccucaugaacugggucagacaagcccccggcaaaggccucgaauggcuagccaacauacaggaagacggaaucgaaaaauacuacguugacagcguaaagggcagauucaccaucuccagagacaacgccaaaaauucccucuaccuucaaaugaacucccuacgcgccgaagacacagccgucuacuacugcgcccgcgaacccucacacuacgacauacugacgggcuacgacuacuacuacggcauggacgucuggggccaaggcaccaccguaacggucuccuccgcaagcaccaaaggaccaucugucuuuccccuagcccccugcucacgguccaccucagaaucaaccgcugcccugggcugccucgucaaagacuacuucccagaacccgucacaguauccaacaacucuggcgcccucaccucuggcguacauacauuccccgcgguccuccaaucauccggucucuacucccuaagcucagucgucaccgucccaagcuccucccucggcaccaaaacauacacaugcaacgucgaccacaaacccucaaacaccgaagucgacgaacgcguagaauccaaauacggacccccgugucccccaugccccgcccccgaauuucuaggaggccccagcgucuuccucuucccacccaaacccaaagacacacucaugaucagccgaaccccagaaguaaccugcgucgucgucgacgucucacaagaagaccccgaaguccaauucaacugguacgucgacggcgucgaaguccacaacgccaaaaccaaaccccgcgaagaacaauucuggucaaccuaccgggucgucucaguccuaacaguccuucaccaagacuggcucaauggaaaagaauacaaauguaaagucuccaacaaaggacucccauccucaaucgagaaaaccaucucaaaagccaaaggccaaccacgcgaaccccaaguauacacccugcccccuucacaagaagaaaugacuaagaaccaaguaucccuaaccugccucgucaaaggcuucuaccccuccgacaucgccgucgaaugggaaagcaacggccaaccagaaaacaacuacaagaccacucccccaguccucgacucugacggcuccuucuuccucuacucccgacucaccgucgaugaaagccgauggcaagaacacaacgucuucuccugcagcgucaugcacgaagcccugcacaaccacuacacacaaaaaucacuaucacucucacuaggaaaa

SEQ ID NO: 53676 - RNA, 642 nt, Artificial Sequence
  derived and/or modified sequence opt11 from Crotedumab_LightChain1
gacauccaaaugacacaaucccccuccucccucuccgccuccgucggcgaccgcgucaccaucaccugccgcgcaagccaaggcaucagaaacgaccucggcugguaccaacaaaaacccggcaaagcacccaaacgccucauauacgccgccuccucacuccaauccggcguccccucccgcuucuccggcuccggcuccggcaccgaauucauccucaccgucucaucccuccaacccgaagacuucgccaccuauuacugccuccaauacaacgaaaaccccuucaccuucggccccggcaccaaagucgacaucaaacgcaccgucgccgcccccagcgucuucaucuucccccccuccgacgaacaacucaaauccggcaccgccuccgucgucugccuccucaacaacuucuacccccgcgaagccaaaguacaauggaaagucgacaacgcacuccaaucaggcaacucacaagaauccgucaccgaacaagacuccaaagacucaaccuacucccucuccucaacccucacccuauccaaagccgacuacgaagaacacaaagucuacgccugcgaagucacacaccaaggccucuccucacccguaaccaaauccuucaaccgcggcgaaugc

SEQ ID NO: 53677 - RNA, 642 nt, Artificial Sequence
  derived and/or modified sequence opt11 from Crotedumab_LightChain2
gacauccaaaugacccaaucccccuccucccuuagcgcauccgucggcgaccgcgucaccaucaccugccgcgccucacaaggcauccgcaacgaccucggaugguaccaacaaaaacccggcaaagccccaaaacgccucaucuacgccgccuccucccuccaaagcggcguccccucccgcuucuccggcuccggcuccggcaccgaauucauccuaaccgucuccucccuacaaccagaagacuucgccaccuacuacugccuacaauacaacuccaaccccuucacauucggccccggaaccaaagucgacaucaaacgcacagucgcagcccccuccgucuucauauucccacccuccgacgaacaacuaaaaucaggaaccgccuccgucgucugccuacuaaacaacuucuacccccgcgaagcaaaaguccaaaacaaagucgacaacgcccuccaauccggcaacucccaagaauccgucaccgaacaagacuccaaagacuccaccuauucccucuccuccacccuaacccuauccgaagccgacuacgaaaaacacaaaguauacgccugcgaaguaacccaccaaggccucuccucacccguaaccaaauccuucaaccgaggcgaaugc

SEQ ID NO: 53678 - RNA, 1332 nt, Artificial Sequence
  derived and/or modified sequence opt11 from Dacetuzumab_HeavyChain1
gaaguccaacucgucgaauccggcgggggccugguccaacccggaggaucucuccgccuaucaugcgccgccucaggcuacuccuucacaggcuacuauauccacuggguacgccaagcacccggaaaaggacuagaauggguagcccgcgucaucccaaacgccggcggcaccucauacaaccagaaauucaaaggucguuucacacuaucaguagacaacagcaaaaacacagccuaccuccaaaugaacucacucagagccgaggacaccgcagucuacuacugcgccagagaagguauauacugguggggccaagguacacucgucaccgucucauccgcaaguaccaaaggcccuuccgucuucccccuagcccccuccucaaaaucuacauccggcggaaccgccgcccucggcugccucgucaaagacuacuuccccgagcccguaaccgucuccuggaacucaggcgcccucacauccggaguccacacuuucccagccguacuccaaagcuccggccucuacagccucagcucagucgucaccguccccucauccagcuuaggaacccaaaccuacaucugcaacguaaaccacaaacccucaaacaccaaaguugacaagaaaguagagcccaaauccugcgauaaaacccacacuugcccaccaugcccagccccagaacuccuaggaggccccuccguauuccucuucccucccaaacccaaagacacccuaaugaucucacguacaccagagguaaccugcgucgucgucgacgucagccacgaagaccccgaggucaaauucaacugguacguggauggcgucgaaguacacaaugccaaaacaaaaccucgggaagaacaauacaacucaaccuacagagucgucuccguccucaccguucuacaccaagacuggcucaauggcaaagaauacaaaugcaaagucuccaacaaagcucuccccgcccccaucgagaaaaccauaucaaaagcaaaaggccaacccagagaaccccaagucuacacccucccacccucccgcgaagaaaugaccaaaaaccagguaucccuaacaugccucguaaaaggcuucuacccaagcgacaucgccguagaaugggaaagcaacggucagccagaaaacaacuacaaaaccacaccacccguccucgacuccgacggauccuucuuccuauacuccaaacucacaguagacaaaagccgcuggcaacaaggaaacgucuucagcugcucagucaugcacgaggcccuccacaaucacuacacccaaaaaucccucucccucucccccgggaaa

SEQ ID NO: 53679 - RNA, 657 nt, Artificial Sequence
  derived and/or modified sequence opt11 from Dacetuzumab_LightChain1
gacauccaaaugacucaaucacccuccucccuaucagccuccgucggagaccgcgucaccaucacaugccgcuccucccaaucccuaguccacuccaacggaaacaccuuccuccacugguaccaacaaaaacccggcaaagcccccaaacuccucaucuacaccgucucuaaccgcuucuccggaguucccucccgcuucuccggcuccggcuccggaaccgacuucacccucaccaucucaucccuacaacccgaagacuucgccaccuacuucugcucccaaaccacccacguccccuggaccuucggccaaggcaccaaggucgaaaucaaacgcaccgucgccgcccccuccguauucaucuucccaccaucagacgaacaacucaaaucaggcaccgccuccgucguaugccuccucaacaacuucuacccccgagaagccaaaguccaauggaaagucgacaacgcacuccaauccggcaacucacaagaaucgguaaccgaacaagacuccaaagacuccaccuacucccucuccuccacccucacccuauccaaagccgacuacgaaaaacacaaagucuacgccugcgaagucacccaccaaggccucuccucccccgucaccaaauccuucaaccgaggcgaaugc

SEQ ID NO: 53680 - RNA, 318 nt, Artificial Sequence
  derived and/or modified sequence opt11 from Dacliximab_LightChain_VJ-Region
gacauccaaaugacccaaucccccuccacccucuccgccuccgucggcgaccgcgucaccaucaccugcuccgccuccuccuccaucuccuacaugcacugguaccaacaaaaacccggcaaagcccccaaacuccucaucuacaccaccuccaaccucgccuccggcguccccgcccgcuucuccggcuccggcuccggcaccgaauucacccucaccaucuccucccuccaacccgacgacuucgccaccuacuacugccaccaacgcuccaccuacccccucaccuucggccaaggcaccaaagucgaagucaaa

SEQ ID NO: 53681 - RNA, 348 nt, Artificial Sequence
  derived and/or modified sequence opt11 from Dacliximab_gamma2-Chain_VDJ-Region
caagugcaauugguccagagcggggccgaggucaagaaaccgggcucgagcgugaaagugagcuguaaagcgagcggguacacguucacgagcuaucgcaugcacugggucaggcaagcacccgggcaagggcucgaguggauaggcuauaucaaucccucgaccggguacacggaauauaaccagaaauuuaaagauaaagcgaccauaaccgcggacgagagcacgaacacggccuauauggagcucucgagcuugcgcucggaagauaccgcggucuauuacugugccagaggcgggggcguguucgauuacuggggccagggcacgcucgugaccgugagcucg

SEQ ID NO: 53682 - RNA, 1326 nt, Artificial Sequence
  derived and/or modified sequence opt11 from Daclizumab_HeavyChain
caaguccaacucguccaauccggcgccgaagucaaaaagcccggcagcuccgucaaagucagcugcaaagccagcggcuacacauucaccucuuaucgaaugcacuggguccgccaagcacccggccaaggcuuagaauggaucggcuacaucaaccccucaacaggcuacaccgaauauaaccaaaaauucaaagacaaagccacaaucaccgccgaugaaucaacaaacacagccuacauggaacuauccucccuccgcuccgaagacaccgcugucuacuacugcgcacgaggaggcggaguauucgacuacuggggacaaggcacaacccucaccgucuccucaggccccuccguuuucccccuagccccauccuccaaauccaccucaggcggcaccgcagcgcucggcugccucguaaaagacuacuucccugaacccgucaccgucuccuggaacucaggcgcgcuuaccuccggaguccacaccuuccccgcaguccuccaaucauccggccucuacucacucuccucaguagucaccguccccucaucaucccucggcacccaaacauacauaugcaacguaaaccacaaaccaucaaacaccaaagucgacaagaaagccgagcccaaauccugcgacaaaacacacacuugcccacccugccccgcccccgaacuccucggcggccccucagucuuccucuucccaccaaaacccaaagacacccucaugauaucacgcacccccgaaguaaccugcgucgucguagacgucucucacgaagacccagaaguuaaauucaacugguauguagacggagucgaaguccacaacgccaaaaccaagccccgcgaagaacaguacaacucaacauaccgcgucguaucaguccucaccguacugcaccaagacuggcuuaacggaaaggaauacaaaugcaaaguauccaauaaagcgcuccccgcccccaucgagaaaaccaucuccaaagccaaaggccaaccccgagaaccccaagucuacacccuaccaccaucccgcgacgaacucaccaaaaaccaagucucccucaccugucuugucaaaggcuucuaccccuccgacauagcaguugaaugggaauccaacggacaaccagaaaauaacuacaaaacaaccccacccguccucgacucagacgguagcuucuuccucuacuccaaacucacugucgacaaaucacgauggcagcagggcaauguauucucuugcuccgucaugcacgaagcacuccacaaccacuacacacaaaaaucccucucccuuucccccggcaaa

SEQ ID NO: 53683 - RNA, 630 nt, Artificial Sequence
  derived and/or modified sequence opt11 from Daclizumab_LightChain
gacauccaaaugacccaaucccccucaacccucuccgccuccgucggcgaccgugucaccaucaccugcuccgccuccuccuccaucuccuacaugcacugguaccaacaaaaacccggcaaagcccccaaacuccucaucuacaccaccuccaaccuagccuccggcguccccgcccgcuucuccggcucaggcuccggcacagaauucacccucaccaucuccucacuccaacccgacgacuucgcuaccuacuacugccaccaacgcuccacauacccccucaccuucggcuccggcaccaaagucgaagucaaacguaccgucgccgcccccucagucuucaucuucccccccuccgacgaacaacucaaauccggcaccgccuccguagucugccuccucaacaacuucuacccccgcgaagcaaaaguccaauggaaagucgacaacgcccuccaauccggcaacucacaagaauccgucaccgaacaagacuccaaagacuccaccuacucccuauccucaacacuaaccuuauccaaagccgacuacgaaaaacacaaagucuacgccugcgaagucacccaccaaggucucuccucccccguaaccaaaucuuucaaccgc

SEQ ID NO: 53684 - RNA, 1341 nt, Artificial Sequence
  derived and/or modified sequence opt11 from Dalotuzumab_HeavyChain1
caaguccaacuucaacaaucaggacccggacucgucaagccaucccaaacauuaucccuaacuugcaccgucuccggauggucaaucuccggcggcuggcuauggaacuggauacgccaaccacccggcaaaggccuccaguggauuggauggaucuccugggacgguaccaacaacuggaaacccucacucaaagaucguguaaccaucuccguagacacuucgaaaaaccaauucucucuaaaacuuuccagcgucaccgccgccgacaccgcuguaugguggugcgcccgcuggggccgcguuuucuucgacugguggggacaaggcacacucgucaccgucuccuccgccuccacuaagggccccuccguauucccccuagcacccucauccaaaucaacaucaggagggaccgccgcccuaggcugccucguaaaagacuacuuccccgaaccagucacaguaucauggaacucaggagcacugaccuccggaguccacacauuccccgccguccuacaaucaagcggacucuacagccugucuagcgucgucaccguccccucauccucacucggcacacaaaccuacaucugcaacguaaaccacaaacccucaaacaccaaagucgacaaacgcgucgaacccaaauccugcgacaaaacacauaccugcccacccugccccgccccugaacuacucggcggacccuccguauuucuguucccacccaaacccaaagacacacucaugaucucccgaacgcccgaaguaaccugcgucguaguagacgucucccacgaagaccccgaaguaaaauucaacugguacgucgacggcguagaaguacacaacgccaaaacaaaaccucgcgaagaacaauacaacuccaccuacagaguagucuccguucucacaguccuacaccaagauuggcucaauggaaaagaauacaaaugcaaaguauccaacaaagcccuccccgcccccaucgaaaagacaaucagcaaagccaaaggacaaccccgcgaaccccaagucuacacccuuccacccucacgcgaagaaaugaccaagaaccaagucucccuuaccugccucguaaaaggauucuaccccuccgacaucgccgucgaaugggaauccaacggccaacccgaaaacaauuacaaaacaacuccacccguccucgacucagacggaucauucuuccucuacuccaaacucaccgucgacaaaucgcgauggcaacaaggcaacgucuucuccugcuccguaaugcacgaagcccuccacaaccacuacacccaaaaaucucuaucacuaucccccggcaag

SEQ ID NO: 53685 - RNA, 657 nt, Artificial Sequence
  derived and/or modified sequence opt11 from Dalotuzumab_LightChain1
gacaucgucaugacccaaucuccccucucccuccccgucacccccggccaacccgccuccaucuccugccgcuccucccaauccaucguccacuccaacggcaacaccuggcuacaaugguggcuccaaaaacccggccaaucaccccaacuccucaucuggaaagucuccaaccgccucuggggcguccccgaccgauucuccggcucaggcuccggcaccgacuucacccucaaaaucucccgcguccaggcccaagacgucggcgucugguggugcuuccaaggcucccacguccccuggacuuucggccaaggcaccaaaguccaaaucaaacgcaccgucgccgcccccuccgucuucaucuucccacccuccgacgaacaacucaaauccggaacagccuccgucgucugccuccucaacaacuucuacccccgcgaagccaaaguccaauggaaagucgacaacgcccuccaauccggaaacucccaagaauccgucacagaacaagacuccaaagacuccacauacucccucuccuccacccucacccucuccaaagcagacuacgaaaaacacaaagucuacgcuugcgaggucacccaccaaggccucagcucccccgucaccaaaucauucaaccgcggcgaaugc

SEQ ID NO: 53686 - RNA, 687 nt, Artificial Sequence
  derived and/or modified sequence opt11 from Dapirolizumab_pegol_HeavyChain1
gaaguacaacugguagagagcggaggagggcuagugcaaccgggcgggagccugcgccugagcugugccguaagcggguucucaagcacaaacuaucacguacacugggucagacaagcgcccgggaaagggcucgaguggaugggcgugaucuggggcgauggcgauaccucguacaacagcgugcucaagagcagguucacaaucucucgcgauaccucgaaaaauaccguguacuugcaaaugaacucacucagggccgaggacacggccguauacuauugcgcgcgccagcucacgcacuacuacguacuagcggccuggggccagggcacgcucguaaccgugagcucggccucgacaaagggcccgagcguguucccgcucgcgcccucgagcaagagcacgagcgggggcacggccgcacucgggugccuggucaaggacuauuucccggaaccggucacggucucguggaacagcggggccuugaccucgggagugcacacguucccggccgugcuccagagcucgggcuuguacucacuauccagcguggucacggucccaagcucaagccugggcacacaaacguacauaugcaacgucaaucacaaacccucgaacacaaaaguggacaagaaaguggaaccgaaaucgugcgacaaaacgcacacgugcgcggcc

SEQ ID NO: 53687 - RNA, 642 nt, Artificial Sequence
  derived and/or modified sequence opt11 from Dapirolizumab_pegol_LightChain1
gacauccaaaugacccaauccccuuccucccucuccgccucagucggcgaccgcgucaccaucaccugccgcgccuccgaagaccucuacuacaaccucgccugguaccaacgcaaacccggcaaagcacccaaacuccucaucuacgacaccuaccgccuugccgacggcguacccucccgcuucuccggcucaggcuccggcaccgacuacacccuuaccaucuccucccuccaaccagaagacuucgccuccuacuacugccaacaauacuacaaauuccccuucaccuucggccaaggcaccaaagucgaaaucaaacgcaccguagccgcccccucagucuucaucuucccacccuccgacgaacaacuaaaauccggcaccgccucagucguaugccuccucaacaacuucuacccacgcgaagccaaaguccaguggaaagucgacaacgcccuccaaucaggaaacucacaagaaucagucaccgaacaagacagcaaagacuccaccuacucccuuuccucaacccucacccucuccaaagccgacuacgaaaaacacaaagucuacgccugcgaagucacccaccaaggccucuccucacccgucaccaaauccuucaaccgcggcgaaugc

SEQ ID NO: 53688 - RNA, 1356 nt, Artificial Sequence
  derived and/or modified sequence opt11 from Daratumumab_HeavyChain1
gaaguccaacuccucgaaucaggaggcggacucguccaacccggcggcucacuccgccucuccugcgccgucuccggguucacguucaauagcuucgccauguccuggguccggcaagcccccggcaagggccuagaaugggucuccgccaucucaggcuccggaggcggaaccuacuacgccgauuccgucaaaggccgauucaccaucucccgggacaacuccaaaaacacacuguaccuccaaaugaacucacuaagagcagaagacaccgccguauacuucugcgcuaaagacaaaauccucugguucggcgaacccgucuucgacuacuggggacaaggcacacucgucacugucagcuccgcauccaccaaaggucccuccguauucccccuggcccccuccuccaaauccacuucaggaggcaccgccgcccucggcugccuagucaaagauuauuuccccgagcccgucaccguaucauggaacuccggagcccuaaccuccggaguccauaccuuccccgcaguccuccaguccucaggccuauacucccucucaagcgucgucacaguccccuccucgucccucggaacccaaaccuacauaugcaaugucaaccacaaacccagcaacaccaaaguagacaaacgugucgaacccaaaucuugcgauaaaacacacacauguccaccaugccccgcgcccgaacuccuaggugggcccagcgucuuccucuucccacccaaaccaaaagacaccuuaaugauaucccgaacacccgaagucacaugcgucguggucgacgucucacacgaagaccccgaaguaaaauucaacugguacguagacggagucgaaguacauaacgcaaaaaccaaaccaagagaagaacaauacaacuccaccuaccgagucgucagcguccugaccguccugcaccaagacuggcuaaacggcaaagaauacaaaugcaaagucuccaacaaagcccuccccgcccccaucgagaaaaccaucucaaaagccaaaggacaaccacgugaaccccaagucuacacccucccacccucccgcgaagaaaugaccaaaaaccaaguaucgcuaaccugccucgucaaaggauucuaccccuccgacaucgccgucgagugggaaucaaacggccagcccgaaaacaacuacaaaaccaccccacccguccucgacuccgacggauccuucuuccucuacuccaaacucacagucgacaaaucccgcuggcaacaaggcaacgucuucuccugcagcgucaugcacgaagcccuacacaaccacuacacacaaaaaucccuaucccugagccccgguaaa

SEQ ID NO: 53689 - RNA, 642 nt, Artificial Sequence
  derived and/or modified sequence opt11 from Daratumumab_LightChain1
gaaaucguccucacacaaucucccgcaacccucucccuaucccccggcgaacgcgccacucucucaugccgcgcaucccaauccgucuccucuuaccucgccugguaccaacaaaaacccggccaagcaccccgccuccuaaucuacgacgcaagcaaccgcgccaccggcauccccgcccgcuucuccggcucaggcuccggcacagacuucacacucaccaucuccucacucgaacccgaagacuucgccguauacuacugccaacaacgcaguaacuggccacccaccuucggacaaggaacaaaagucgaaaucaaacgcaccgucgcagcccccagcgucuucaucuucccacccuccgacgaacaacucaaauccggcaccgccuccgucguaugccuacucaacaacuucuacccccgcgaagccaaaguccaauggaaagucgacaacgcccuccaauccggcaacucucaagaauccgucaccgaacaagacuccaaagacuccaccuacucucuaagcucaacccucacccucagcaaggccgacuacgaaaaacacaaagucuacgccugcgaagucacccaccaaggccucuccucacccgucaccaaauccuucaaccgcggcgaaugc

SEQ ID NO: 53690 - RNA, 1350 nt, Artificial Sequence
  derived and/or modified sequence opt11 from Dectrekumab_HeavyChain1
gaaguccaacuggucgaaagcggaggaggcgucguacagcccggccgcucccuccgccuauccugcgccgccagcggauucacauucuccuccuacggcaugcacuggguacgucaagcccccggaaagggacuagaauggguggccauuauaugguaugacggcuccaacaaauacuacgcagacagcguaaaaggccgcuucaccaucagccgcgacaacuccaaaaacacccucuaccuccaaaugaacucccuccgcgccgaagacaccgccgucuacuacugcgcccgacucugguucggcgaccuagacgcauucgacaucuggggccaaggcaccaugguaacugucuccuccgccucaacaaaaggccccucagucuucccucuagcccccucgucaaagagcaccuccgguggaaccgcugcgcuaggaugccuggucaaagacuacuucccagaaccagucaccguauccuggaacuccggagcccucacuucaggcguacacaccuuccccgccguccuccaaucauccggccucuacagccuuucguccgucgucacaguccccagcucaucccucggcacccaaacguauaucugcaacgucaaccacaaaccgucaaacaccaaaguugacaaacgcguugagcccaaauccugcgauaaaacccauaccugcccaccaugccccgcacccgaacuccugggcggacccucuguauuccucuuucccccaaaaccaaaggacacccugaugaucucacgaacaccagaaguaaccugcgucgugguagaugucagccacgaagaccccgaaguaaaauucaacugguacguagacggaguagaaguccacaacgccaaaaccaaacccagagaagaacaauacaacagcacauaccgcguagucuccguucucaccguacuacaccaagacuggcucaacggcaaagaauacaaaugcaaagucuccaacaaagcacucccggccccaauugagaaaaccaucuccaaggccaaaggccaaccacgcgaaccccaagucuacacccucccucccagccgagaagaaaugacgaaaaaccaagucucccugaccugccucgucaaaggauucuaccccucagacaucgccguagaaugggaauccaacggccaacccgaaaacaacuacaaaacuacuccgcccguacucgacucugauggcucauucuuccucuacuccaagcucacaguagacaaaucccgauggcaacagggcaacguauucuccugcuccgucaugcacgaagcacuccacaaccacuacacacaaaaaucccuaucccuaagccccggcaaa

SEQ ID NO: 53691 - RNA, 648 nt, Artificial Sequence
  derived and/or modified sequence opt11 from Dectrekumab_LightChain1
gaaaucguccucacccaaucccccgccacccucucccucucccccggcgaacgagccauacucuccugccgcgccggccaauccgucuccuccuaccucgucugguaccaacaaaaacccggccaagccccccgacuccuuaucuacgacgcauccaaccgcgcaaccggaauccccgcccgauucucaggcuccggcucaggcaccgacuucacccucaccaucuccucacucgaacccgaagacuucgccguauacuacugccaacaacgcuccuccuggccccccgucuacaccuuuggccaaggcaccaaacuagaaaucaaacgcaccgucgccgccccaucagucuucaucuucccccccuccgacgaacaacucaaaucaggcaccgccucagucgucugccuccucaacaacuucuacccccgcgaagccaaaguccaauggaaagucgacaacgcccuccaauccgguaacucacaagaauccgucaccgaacaagacagcaaagacucaaccuacucccucuccuccacacucacacucuccaaagccgacuacgaaaaacacaaagucuacgccugcgaagucacccaccaaggccucuccucacccgucaccaaauccuucaaccgcggcgaaugc

SEQ ID NO: 53692 - RNA, 1332 nt, Artificial Sequence
  derived and/or modified sequence opt11 from Demcizumab_HeavyChain1
caaguccaacucguccaaucuggcgcagaagucaagaaacccggcgccucaguaaaaaucagcugcaaagccuccggcuacucauucaccgcauacuacauucacugggucaaacaagcccccggccaaggacucgaauggaucggcuacauauccagcuacaacggcgccacuaacuacaaccaaaaauucaaaggccgcgucacuuucaccaccgacacauccaccuccaccgccuacauggaacuccgaucccugagaucagacgacacugcaguauacuacugcgcccgcgacuacgacuaugacgucggcauggacuacuggggccaaggcacucuaguaaccguauccucagccuccaccaaaggacccuccgucuuuccccucgcccccugcucccgcuccaccagugaauccacagccgcccucggcugccucgucaaagauuacuucccagaacccgucacagucuccuggaacuccggggcccucacuucaggcguacauaccuuccccgccguccuacaauccuccggccucuacucccucucguccgucgucaccguccccucauccaacuucgguacacaaacauacacuugcaaugucgaccacaagcccuccaacacaaaagucgacaaaaccgucgaacgcaagugcugcguagaauguccaccuugccccgccccacccgucgccggccccuccgucuuccuauucccucccaaacccaaagacacacuuaugaucucucgaacacccgaaguaacaugcgucgucgucgaugucucccacgaagaccccgaaguccaauucaacugguacgucgacggcgucgaaguucacaacgccaaaaccaagccccgcgaagaacaauucaacagcaccuuccgcgucgucagcguccucaccgucguccaccaagacuggcucaacggcaaggaauacaaaugcaaagucucaaacaaaggccuaccagcacccaucgagaaaaccaucuccaaaaccaaaggccaaccccgcgaaccccaaguuuacacacuaccaccaucccgcgaagaaaugaccaagaaccaggucucccuaaccugccucgucaaaggcuucuaccccuccgacaucgccgucgaaugggaauccaacggacaacccgaaaacaacuacaaaaccaccccacccaugcuugacucugacggauccuucuuccuauacagcaaacucaccgucgacaaaagccgcuggcaacaaggcaacgucuucagcugcucaguuaugcacgaagcccuccacaaccacuacacccaaaaaucccuaucccucucccccggc

SEQ ID NO: 53693 - RNA, 654 nt, Artificial Sequence
  derived and/or modified sequence opt11 from Demcizumab_LightChain1
gacaucguaaugacacaauccccugacagccucgccgucucccucggcgaacgcgccaccaucagcugccgcgccuccgaauccgucgacaacuacggcaucucauucaugaaaugguuccaacaaaaacccggccaaccacccaaacuccuaaucuacgccgccagcaaccaaggcuccggcguacccgaccgcuucuccggcuccggcuccggcaccgacuucacccuaaccaucuccucccuccaagccgaagacgucgccgucuacuacugccaacaauccaaagaaguccccuggaccuucggcggcggcaccaaagucgaaaucaaacgcaccgucgcagcccccagcguauucaucuucccacccucagacgaacaacucaaauccggcacagccuccgucgucugccuccucaacaacuucuacccacgcgaagccaaaguccaauggaaagucgacaacgcccuccaauccggaaacucacaagaaucagucaccgaacaagacuccaaagacuccaccuacucccucuccuccacccucacccucuccaaagccgacuacgaaaaacacaaaguuuacgccugcgaagucacccaccaaggccucagcucacccgucaccaaauccuucaaccgcggcgaaugc

SEQ ID NO: 53694 - RNA, 1350 nt, Artificial Sequence
  derived and/or modified sequence opt11 from Denintuzumab_mafodotin_HeavyChain1
caaguccaacuccaagaaucaggacccggccuaguaaagcccucacaaacccucucccuaacaugcaccgucuccggcggcuccauauccaccagcggcaugggcguaggauggauccgccaacaccccggaaaaggccucgaauggaucggacacaucuggugggacgacgacaaacgcuacaaccccgcacuaaaaucacgugucaccaucuccgucgacaccuccaaaaaccaauucucacucaaacuuucuuccgucaccgccgccgauacagcuguuuacuacugcgcccgcauggagcuauggucauacuacuucgacuacuggggccaagguacacuugucaccguauccuccgccucaacaaaaggccccuccguauucccccucgccccauccuccaaaucuacauccggcggcaccgccgcucuaggaugccucgucaaagacuacuucccagaacccgucaccgucucuuggaacuccggcgcccucaccucaggcguacacaccuucccagcaguccuacaauccagcggucucuacucucucucauccgucgucacaguacccucauccucacuaggcacccaaaccuacaucugcaacguaaaccacaagcccuccaacaccaaagucgacaagaaagucgaacccaaauccugcgacaaaacccauaccugcccacccugccccgcccccgaacuccuaggaggccccuccgucuuccucuucccacccaaacccaaagacacccuaaugauaucccgaacccccgaaguaaccugcguaguuguagacguaucacacgaggaccccgaagugaaauucaacugguacgucgacggcguagaaguccacaacgcaaaaaccaaaccccgagaagaacaauacaacuccaccuaccgcguaguaagcguucucaccguacuucaccaagacuggcucaaugguaaagaauacaaaugcaaggucuccaacaaagcccuccccgcccccaucgagaaaacaaucuccaaagccaaaggccaaccccgagaaccacaagucuacacccucccacccucacgcgacgaacuaaccaaaaaccaagucucacuuaccugccuggucaaaggcuucuacccuuccgacaucgccgucgaaugggaaucaaacggccaacccgaaaacaacuauaagaccacuccacccguucucgacuccgacggcagcuucuuucuuuacuccaaacucaccgucgacaaaucccgauggcaacaagguaacguguucuccugcuccguuaugcacgaagcccuacacaaccacuacacccaaaaaucacucagccucucucccggcaaa

SEQ ID NO: 53695 - RNA, 639 nt, Artificial Sequence
  derived and/or modified sequence opt11 from Denintuzumab_mafodotin_LightChain1
gaaaucguccucacccaaucccccgccacccucucccucucccccggagaacgcgccacccucuccugcuccgccuccuccuccguauccuacaugcacugguaccaacaaaaacccggccaagcaccccgacuccuaaucuacgacaccucaaaacucgccuccggcauccccgcccgcuucuccggcuccggcuccggcaccgacuucacccucaccaucuccucacucgaacccgaagacgucgccgucuacuacugcuuccaaggauccgucuaccccuucaccuucggccaaggcaccaaacucgaaaucaaacgcaccgucgccgcccccucugucuucaucuucccacccuccgacgaacaacucaaauccggcaccgccuccgucgucugccuacucaacaauuucuacccccgugaagccaaaguccaauggaaaguagacaaugcccuccaguccggcaacucacaagaauccguaaccgaacaagacuccaaagacuccaccuacagccuuuccucaacacuaaccuuauccaaagccgacuacgaaaaacacaaagucuacgccugcgaagucacccaccaaggccucucaucccccgucaccaaauccuucaaccguggcgaaugc

SEQ ID NO: 53696 - RNA, 1356 nt, Artificial Sequence
  derived and/or modified sequence opt11 from Denosumab_HeavyChain
gaaguccaacuacuagaaucaggcggaggccucguccaacccggcggcucccucagacucagcugcgccgccucaggcuucaccuucucuuccuacgccauguccuggguccgccaagcacccggcaaaggacucgaauggguauccggaaucaccggauccggcggauccaccuacuacgcagacucagucaaaggccgcuucaccaucagccgcgacaacuccaaaaacacacuauaccuacaaaugaacucccuccgcgccgaagacaccgcaguauacuacugcgcaaaagaccccgguacuacagucaucauguccugguucgaccccuggggccaagguacccucgucaccgucuccuccgccucgaccaaaggcccaagcgucuucccacucgcaccauccagcaaaucuaccagcggcggaaccgccgcccucggcugccucgucaaagacuacuuccccgaacccgucaccgucuccuggaacuccggcgccuuaaccuccggaguacacaccuucccugccguccuccaguccagcggucuauacucccuaucaucagucguaaccgucccaagcucaucccugggaacccaaaccuacaucugcaacgugaaccacaagcccuccaacaccaaaguugacaaaaaggucgagcccaaauccugcgacaaaacccacacaugcccucccugccccgcccccgaacuucucggcggccccucugucuuucucuuucccccaaaacccaaagacacccuaaugaucucgcgcacccccgaaguaaccugcgucguagucgacgucucacacgaagaccccgaagucaaguucaacugguacgucgacggcguagaaguucacaacgccaaaaccaaaccccgggaagaacaauauaacucaaccuaucgcgucguauccguccuaaccguccuacaccaagacuggcucaacggaaaagaauacaaaugcaaagucuccaacaaagcacucccggcccccauagagaaaaccaucuccaaagccaaaggacaaccacgcgaaccccaagucuacacccucccacccucacgggacgaacucaccaaaaaccaaguaucacucacaugccuaguaaaaggauucuaucccucagacaucgcggucgaaugggaauccaacggccaacccgaaaacaacuacaaaacaaccccucccguccuagacuccgacggcuccuucuuccuauauucaaaacucacaguagacaaaucucgcuggcaacaaggcaacgucuucucaugcagcgucaugcacgaagcccuacacaaccacuacacccagaaaucacucucccuaucccccggcaaa

SEQ ID NO: 53697 - RNA, 645 nt, Artificial Sequence
  derived and/or modified sequence opt11 from Denosumab_LightChain
gaaaucguccucacccaaagccccggcacccucucacucucccccggcgaacgcgccacccucuccugccgcgccucccaauccguacgaggccgcuaccucgccugguaccaacaaaaacccggccaagcaccccgccuccucauuuacggcgccucaucccgagccaccggcauccccgaccgcuucuccggcucaggcuccggcaccgacuucacccucaccaucucccgacucgaacccgaagacuucgccguauucuacugccaacaauacggcuccucaccccgcaccuucggacaaggcacaaaagucgaaaucaaacgcaccgucgccgcccccuccguauucaucuucccacccuccgacgaacaacuaaaaucaggcacagccagcgucgucugccuacucaacaacuucuacccccgcgaagccaaaguccaauggaaagucgacaacgcccuccaauccggcaacucccaagaauccgucaccgaacaagacuccaaagacuccacauacucccuauccuccacccucacacucuccaaagccgacuacgaaaaacacaaaguauaugccugcgaagucacccaccaaggccucuccucccccgucacaaaaucauucaaccgcggcgaaugc

SEQ ID NO: 53698 - RNA, 1338 nt, Artificial Sequence
  derived and/or modified sequence opt11 from Depatuxizumab_HeavyChain1
caagugcaacuacaagaauccggacccggacucgucaaacccucccaaacccucucccuaaccugcaccgucuccggcuacuccaucuccuccgacuucgccuggaacuggauccgacaaccacccggaaaaggccuagaauggaugggcuacaucuccuacuccggcaacacccgcuaccaacccucccucaaaucacgcaucacaauaucccgagacacuuccaaaaaccaauucuuccuaaaacucaacagcgucaccgcagccgacaccgccaccuacuacugcgucaccgccggccgcggcuuccccuacuggggccagggcacccucguaacagucuccuccgccuccaccaaaggcccauccgucuucccgcucgcuccauccuccaaauccacgagcggcggcaccgccgcacucggcugccucgucaaagacuacuucccagaacccguaaccguguccuggaacagcggagcccugaccucaggcguccacacauuccccgcagugcuccaguccuccggacucuacucacucuccuccgucgugacaguccccucuuccucccuuggcacccaaaccuacaucugcaacguaaaccacaaacccuccaacaccaaagucgacaaaaagguugaaccaaaauccugcgacaaaacccacaccuguccacccugccccgcccccgaacuccuaggcggacccuccguauuccuauucccacccaaacccaaagacacccucaugauaucaagaaccccagagguaaccugcgucgucgucgacgucucccacgaagaccccgaaguaaaauucaacugguacgucgacggcguugaaguucacaacgccaaaaccaaaccacgcgaagaacaauacaacucaacguaccgcguagucuccgugcucaccguccuacaccaagacuggcuaaacggaaaagaauacaaauguaaaguauccaacaaagcccuacccgcccccauagagaaaaccauaucaaaagccaaaggucaaccccgugaaccccaagucuacacacuaccaccaucccgcgacgaacucaccaaaaaucaagucucccuaaccugccucgucaaaggcuucuaccccucugacaucgccguagaaugggaaucaaauggccaacccgaaaacaacuacaaaaccaccccaccuguccucgacuccgacggcucauucuuccucuacuccaaacuaaccguggacaaaucucguuggcaacaaggcaacgucuucuccugcuccgucaugcaugaagcacuccauaaccacuacacccaaaaaucccuaucccucagccccggaaaa

SEQ ID NO: 53699 - RNA, 642 nt, Artificial Sequence
  derived and/or modified sequence opt11 from Depatuxizumab_LightChain1
gacauccaaaugacccaaucccccucauccaugucagucucaguaggcgaccgcgucaccaucaccugucacuccucccaagacaucaacucaaacaucggcuggcuccaacaaaaacccggcaaaucauucaaaggccucaucuaccacggcaccaaccucgacgacggcguacccucccgcuucuccggaucaggcuccggcaccgacuacacccucacuaucuccucccuccaacccgaagacuucgccacauacuacugcguacaauacgcccaauucccauggaccuucggcggcggcaccaaacucgaaaucaaacgcaccgucgcagcccccuccgucuucauauucccacccuccgacgaacaacuaaaauccggcacggcauccgucgucugccuccucaacaacuucuacccccgagaagccaaaguccaauggaaagucgacaacgcccuccaaucaggcaacucccaagaauccgucaccgaacaagacagcaaagacuccaccuacucccucuccuccacccucacccucuccaaagccgacuacgaaaaacacaaagucuacgccugcgaaguaacccaccaaggccucucaucccccgucaccaaauccuucaaccgcggcgaaugc

SEQ ID NO: 53700 - RNA, 1338 nt, Artificial Sequence
  derived and/or modified sequence opt11 from Depatuxizumab_mafodotin_HeavyChain1
caaguccaacugcaagaauccggacccggccucgucaaacccucccaaacucugucacuaaccugcacaguaucgggcuacucaaucuccuccgacuucgcauggaacuggauccgccaaccuccaggcaaaggccucgaauggaugggauacaucuccuacuccggcaacacacgcuaccaacccucacucaaaucgcgcauaacaaucucucgcgacaccagcaaaaaucaauucuuccucaaacucaacucaguaaccgccgccgacaccgccaccuacuacugugucaccgccggucguggcuucccauacuggggacaaggcacacucgucaccgugagcucugccagcaccaagggccccucuguauucccuuuagcacccucauccaaauccaccuccggcggcacggcagcgcuaggaugccucgucaaagacuacuuccccgaaccaguaaccgucuccuggaacuccggcgcccuuaccuccggcguacacaccuucccagccguccuccaaagcucuggccucuauucccucuccucagucgucacaguccccuccuccucccucggcacccaaaccuacaucugcaacgucaaccacaaaccuucaaacaccaaaguagacaagaaaguagaaccaaaauccugcgacaaaacccacacaugcccacccugccccgcacccgaacuacucggcggacccucaguauuccucuuucccccaaaacccaaagacacccucaugauauccagaacccccgaagucaccuguguaguagucgacgucucccacgaagaucccgaagucaaauucaacugguacgucgacggcgucgaaguacacaacgccaaaaccaaaccccgcgaagaacaauacaacuccaccuaccgggucguuucaguacucaccguacuccaccaagacuggcucaacggaaaagaauacaaaugcaaagucucaaacaaagcacucccagcacccaucgagaaaacaaucucaaaagccaaaggacaaccccgcgaaccccaaguauacacccucccaccuucacgcgacgaacucaccaaaaaccaagucagccucacaugucuuguaaaaggcuucuaccccucugacaucgccgucgaaugggaauccaacggccaacccgaaaacaacuacaaaaccaccccacccguccuagacuccgauggcuccuucuuccuauacuccaaacucaccgucgacaaaucucgauggcaacaaggcaacgucuucuccugcuccguaaugcacgaagcacuccacaaccacuacacacaaaaaucccucucacucucacccggcaaa

SEQ ID NO: 53701 - RNA, 642 nt, Artificial Sequence
  derived and/or modified sequence opt11 from Depatuxizumab_mafodotin_LightChain1
gacauccaaaugacccaaucccccuccuccaugagcgucucugucggcgaccgcgucaccaucaccugccacuccucccaagacaucaacuccaacaucggcuggcuacaacaaaaacccggaaaaucauucaaaggccucauauaccacggcaccaaccucgaugacggcguccccucccgcuucuccggcucgggcuccggcaccgacuacacccucaccaucucaucacuccaacccgaagacuucgccaccuacuacugcguccaauacgcccaauuccccuggaccuucggcggcggaaccaaacucgaaaucaaacgaacagucgccgcccccuccguauucaucuucccccccuccgacgaacaacuaaaauccggcaccgccuccguagucugccuccucaacaacuucuacccccgcgaagccaaaguccaauggaaagucgacaacgcucuccaauccggcaacucccaagaauccguaacagaacaagacuccaaagacuccaccuacucccucuccuccacccuaacccuuuccaaagccgacuaugaaaaacacaaagucuacgccugcgaagucacccaccaaggccucuccucacccgucaccaaauccuucaaccgcggcgaaugc

SEQ ID NO: 53702 - RNA, 1329 nt, Artificial Sequence
  derived and/or modified sequence opt11 from Dinutuximab_beta_HeavyChain1
gaaguucaacuacuacaauccggccccgaacucgaaaaacccggagccuccguaaugaucuccugcaaagccuccggauccuccuucaccggguacaauaugaacuggguccgccaaaacauaggcaaaucucucgaauggauaggagccaucgaccccuacuacggaggcaccuccuacaaccaaaaauucaagggccgcgccacccuuaccgucgacaaauccuccucaacagccuacaugcaccuaaagucgcucaccuccgaagacagcgccguuuacuauugcguaucaggaauggaauacuggggccaaggcacauccgucaccgucuccucagccucaaccaaaggccccagugucuucccauuagcuccauccucaaaaucaaccucaggcggcacugccgcacuaggcugccucgucaaagacuacuuccccgaaccaguaaccguauccuggaacucaggcgcccuuaccuccggaguccacacauuccccgccguacuccaauccuccggccucuacucccuauccucaguaguaaccguuccuuccuccucccucggaacccaaaccuacauaugcaacgucaaccacaaaccauccaacacuaaaguggacaagcgcguagaacccaaaucaugcgacaagacccacacaugcccacccugccccgcacccgaacuccucggcggccccucggucuuccucuucccacccaaacccaaagacacccuaaugaucucccgcacccccgaaguaaccugcgucgucgucgacguaucucacgaagaccccgaagucaaauucaacugguacguagacggaguagaaguccacaacgcgaaaaccaaaccccgcgaagaacaauacaacucaaccuaccgugucguuuccguccucaccguccuacaccaagauuggcucaacggcaaagaguacaaaugcaaagucucuaacaaagcacugcccgccccaauagaaaagacaaucuccaaagcaaaaggccaaccccgcgaaccacaagucuacacccucccucccucccgcgaagagaugaccaaaaaccaagucucccuaaccugccuugucaaaggcuucuaccccuccgacaucgcaguagagugggaaucaaacggccaacccgaaaacaacuacaaaacaaccccacccguacuagacuccgacggaucauucuuucuauacuccaaacuaaccguggacaaaucccgcuggcaacaaggaaacgucuucagcugcucagucaugcacgaagcccuccacaaccacuacacccaaaaaucccugucccucucgcccggaaaa

SEQ ID NO: 53703 - RNA, 660 nt, Artificial Sequence
  derived and/or modified sequence opt11 from Dinutuximab_beta_LightChain1
gagaucgucaugacccaaagccccgccacccuuuccgucucccccggcgaacgcgccacccucagcugccgcuccucccagucccuaguccaccgcaacggcaacaccuaccuccacugguaccuccaaaaacccggccaaucccccaaacuccucauccacaaagucuccaaccgauucuccggaguacccgaccgcuucuccggcuccggcuccggcaccgacuucacccucaaaaucucccgcgucgaagccgaagaccucggcgucuacuucugcucccaguccacccacgucccaccccucaccuucggcgccggcaccaaacucgaacucaaacgcaccgucgcagcccccuccgucuucaucuucccacccucagacgaacaacuuaaauccggcaccgccucagucguaugccuccucaacaacuucuacccccgcgaagccaaaguccaauggaaagucgacaacgcccuccaguccgguaacucacaagaauccgucaccgaacaagacucaaaagacuccaccuacagccucuccucaacccucacccucuccaaagccgacuacgaaaaacacaaagucuacgccugcgaagucacccaccaaggccucagcucacccgucaccaaaucauucaaccgcggugaaugc

SEQ ID NO: 53704 - RNA, 1329 nt, Artificial Sequence
  derived and/or modified sequence opt11 from Dinutuximab_HeavyChain1
gaaguccaacuccuccaauccggccccgaacucgaaaaacccggugccuccgugaugaucucuugcaaagccucaggauccuccuucaccggcuauaacaugaacuggguccgccaaaacaucggcaaaucacucgaauggauuggcgcaauagacccauacuacggcggaaccuccuacaaccaaaaauucaaaggcagagccacccucacaguagacaaaucauccuccaccgcauacaugcaccucaaaucacucaccuccgaagacuccgcagucuacuacugcgucuccggcauggaauacuggggucaaggcaccuccgucaccguauccuccgccucaacuaaaggccccuccguauucccccucgcccccuccucaaaauccaccuccggcggcaccgccgcacuuggcugccucguaaaggacuacuuucccgaacccgucaccgugucauggaacucaggagcccugaccucaggcguacacaccuuccccgccguccuacaaucuucaggacuguacucccucuccucaguagucaccguccccagcucaucacuagguacacaaacuuacaucugcaacgucaaucacaaacccuccaacaccaaagucgacaaacgcgucgaaccaaaaucgugcgacaaaacccauaccugcccacccugcccagcacccgaacuccucggcggcccaucuguuuuccucuucccucccaaacccaaggacacacucaugaucucccgaacuccagaaguuaccugcgucgucgucgacgucagucacgaagacccagaaguaaaauucaacugguacgucgacggcgucgaaguucacaacgccaaaacgaaacccagagaagaacaauacaacucaaccuaccgcgucguauccguacuaaccguccuccaccaagacuggcuaaacggcaaagaauacaaaugcaaagucuccaacaaagcacucccagcucccaucgagaaaacaaucucaaaagccaaaggacaaccacgcgaaccccaagucuacacacucccucccucccgcgaagaaaugaccaaaaaccaaguaucccuaacaugccuagucaaaggauuuuaccccuccgacaucgccgucgaaugggaauccaacggacaacccgaaaacaacuacaaaacaacaccgcccguccuagacuccgacggaucauucuuccuuuacuccaaacuaaccguagacaaaucucgauggcaacaagggaacgucuucuccugcucagucaugcacgaggcccuacacaaccacuacacccaaaaaucccucucucuaagccccggaaaa

SEQ ID NO: 53705 - RNA, 660 nt, Artificial Sequence
  derived and/or modified sequence opt11 from Dinutuximab_LightChain1
gaaaucgucaugacccaaucccccgccacccucagcguaagccccggcgaacgcgccacccucagcugccgcuccagccagucccucguccaccgcaacggcaacacauaccuccacugguaccuacaaaaaccaggccaaucccccaaacuccucauacacaaagucuccaacagauucuccggcguacccgaccgcuucuccggcagcggcuccggcaccgacuucacccucaaaauaucacgcgucgaagccgaagaccucggcgucuacuucugcucccaauccacccacguacccccccucaccuucggagccggcaccaaacucgaacucaaacgcaccgucgcagcccccucagucuucaucuucccccccuccgacgaacaauuaaaauccggcaccgccuccgucgucugccuccuaaacaacuucuacccccgcgaagccaaaguccaauggaaagucgacaacgcccuccaguccggcaacucccaagaauccguaaccgaacaagacuccaaagacuccaccuacucccuauccucaacccucacccuaagcaaagccgacuacgaaaaacacaaagucuacgccugcgaagucacccaccaaggccucuccucacccgucaccaaauccuucaaucgaggcgaaugc

SEQ ID NO: 53706 - RNA, 660 nt, Artificial Sequence
  derived and/or modified sequence opt11 from Dinutuximab_LightChain
gaaaucguaaugacccaaucccccgcaacccucuccgucucccccggcgaacgcgcaacccucuccugccgcuccucccagucccucguccaccgcaacggcaacaccuaccuccacugguaccuucaaaaacccggccaaucccccaaacuccucauccacaaagucuccaaccgauucuccggcguacccgaucgcuucuccggcuccggcuccggcaccgacuucacccucaaaaucucccgcgucgaagccgaagaccucggcgucuacuucugcucccaauccacccacguacccccacucaccuucggcgccggaaccaaacucgaacucaaacgcaccgucgccgcccccuccgucuucauauucccccccuccgacgaacaacucaaauccggcacagccucagucguaugccuccucaacaacuucuacccccgcgaagcaaaaguccaauggaaagucgacaacgcccuccaauccggaaacucucaagaaucugucaccgaacaagacuccaaagacucaaccuacucccucucauccacccucacccucucaaaagcagacuacgaaaaacacaaagucuacgccugcgaagucacccaccaaggccuauccucccccgucaccaaauccuuuaaccgaggcgaaugc

SEQ ID NO: 53707 - RNA, 1350 nt, Artificial Sequence
  derived and/or modified sequence opt11 from Diridavumab_HeavyChain1
gaaguccaacuggucgaauccggcgccgaagucaagaaacccggcucaagcgucaaagucucaugcaaagccucaggagggcccuuccggucauacgcaauaucaugggucagacaagcccccggccaaggccccgaauggaugggaggcauaauacccaucuucggcaccaccaaauacgcuccaaaauuccaaggcagaguaacaauaaccgcugacgacuuugcaggcacagucuauauggaacucucaagccuccgaucagaagacaccgccauguacuacugcgccaaacacaugggauaccaaguccgcgaaaccauggacgucuggggcaaagggacaaccgucacaguuuccucagccuccaccaaaggccccucagucuucccccucgcacccuccucaaaaagcaccagcggcggcaccgccgcucuaggaugccucguaaaagacuacuucccagagcccgucaccgucagcuggaacuccggcgcccucaccuccgguguucacaccuuccccgcaguacuccaauccuccggccucuacucccuaagcuccgucguaaccguaccauccucaucccucggcacacaaaccuacaucugcaacgugaaccauaaacccuccaacaccaaagucgacaaaagaguagaaccaaaauccugcgacaaaacccacacaugcccacccugccccgcccccgaacuacuaggcggcccauccguauuccuguucccacccaaacccaaagacacccucaugaucucccgcacucccgaagucacaugugucgucgucgacgucucacacgaagaccccgaagucaaauucaacugguacgucgacggcguagaaguccacaacgcgaaaacaaaaccccgcgaagaacaauacaacucaaccuacagaguagucagcguccucacaguacuccaccaggauugguugaacggcaaagaauacaaaugcaaaguaucaaacaaagcccuccccgcccccauugagaaaacaauuuccaaagccaaaggccagccccgcgaaccccaggucuacacccuaccacccucccgcgaagaaaugaccaaaaaccaagucucacuaaccugccucgucaagggauucuaccccucagacaucgccguugaaugggaauccaacggccagcccgaaaacaacuacaagaccaccccacccguccucgacucagacggcucauucuuccucuacuccaaacuaacaguagacaaaucucguuggcaacaaggcaacgucuucucaugcuccgucaugcacgaagcccuccacaaccacuacacccaaaaaucccucagccuaucacccggc

SEQ ID NO: 53708 - RNA, 651 nt, Artificial Sequence
  derived and/or modified sequence opt11 from Diridavumab_LightChain1
caauccguccucacccaaccccccuccgucucagccgcccccggccaaaaagucaccaucuccugcuccggcuccucauccaacaucggcaacgauuacgucuccugguaccaacaacuccccggcaccgcccccaaacuccucaucuacgacaacaauaaacgcccauccggcauccccgaccgcuucucaggcuccaaaucaggcaccuccgcaacccuaggcaucaccggccuccaaaccggcgacgaagccaacuacuacugcgccaccugggaccgccgccccaccgcauacguagucuucggcggaggcaccaaacucaccguccucggccaacccaaagccgcacccuccgucacccucuucccccccuccuccgaagaacuccaagccaacaaagccacccucgucugccucaucuccgacuucuaccccggcgccguaaccgucgcauggaaagccgacuccucccccguaaaagccggcgucgaaacaaccaccccauccaaacaaucaaacaacaaauacgcagccuccuccuaccucucccuaaccccagaacaauggaaaucccaccgcuccuacuccugccaagucacccacgaaggcuccacagucgaaaaaaccgucgcacccaccgaaugcucc

SEQ ID NO: 53709 - RNA, 1338 nt, Artificial Sequence
  derived and/or modified sequence opt11 from Domagrozumab_HeavyChain1
gaaguccaacuccucgaaucaggcggaggccuaguccaacccggcggcucacuccgccuuuccugcgcagccuccggcuuuaccuucuccuccuacgcaauguccuggguccgccaagccccaggcaaaggccucgagugggucucaaccaucucauccggcggcuccuacaccuccuaccccgacucagucaaaggaagauucacaaucucccgcgacaacagcaaaaacacccucuaccuccaaaugaacucacuccgugcugaagauaccgcagucuacuacugcgccaaacaagacuacgccaugaacuacuggggccaaggcacccuagucaccgucuccucagccucaacaaaaggccccuccgucuucccacuagccccguccucaaaaucaaccuccggcggcaccgccgcccuaggcugccucgucaaagacuacuuccccgaaccaguaacugucuccuggaacuccggcgcccuaaccucaggcguccacaccuucccagcaguccuccaaucauccggccuauacucacucagcuccguagucaccguccccagcuccucccugggcacucaaaccuacaucugcaaugucaaccacaaacccucuaacaccaaagucgacaagaaagucgaaccaaaaagcugcgacaaaacucacacaugcccacccugcccagccccggaagcagcuggagcccccagcgucuuucucuucccaccaaaaccaaaagacacacuaaugaucagccgcacaccagaagucacaugcgucguagucgacgucucccacgaagaccccgaaguaaaauucaacugguacgucgacggcgucgaaguccacaacgcuaaaacaaaaccccgcgaagaacaauacaacucaacauacagaguagucuccguucuaaccguacuacaccaagacuggcucaacggaaaagaauacaaaugcaaaguauccaacaaagcacuacccgcucccaucgagaaaaccaucucaaaagcaaaaggacaaccccgagaaccacaaguuuacacccuaccacccucacgcgaagaaaugaccaaaaaccaagucucacuaaccugccucgucaaaggcuucuaccccagcgauaucgcggucgaaugggaauccaacggccagcccgaaaacaacuauaaaacaacaccacccguacucgacuccgacggcucauucuuccucuauucaaaacuaaccgucgacaaaucccgcuggcaacaaggaaacgucuucuccugcuccgucaugcacgaggcccuccacaaccacuacacucaaaaaucccucagccucucucccggaaaa

SEQ ID NO: 53710 - RNA, 1335 nt, Artificial Sequence
  derived and/or modified sequence opt11 from Domagrozumab_HeavyChain
gaaguccaacugcucgaguccggcgggggccucguacaacccggcggaucacuccgccucucaugcgcagccucaggauucacauucuccagcuacgccauguccuggguccgacaagcccccggcaaaggacucgaaugggucucaacaaucuccucagggggcucauacaccuccuaccccgacucagucaaaggacgcuuuaccauaagccgcgacaacagcaaaaacaccuuauaccuccaaaugaacucccuccgcgccgaagacaccgccgucuacuacugcgccaaacaagacuacgccaugaacuacuggggccaaggaacccuuguaaccgucucuuccgcaucgacaaaaggccccuccgucuucccccucgcacccuccuccaaaagcacauccggcggaaccgcagcccucggaugccuagucaaggacuacuucccggaacccguaacagucuccuggaacuccggagcccuuaccucgggcguccauacuuuccccgccguccuccaaucguccggccucuacucacucuccucagucguaacagucccauccuccucccuuggcacccaaacauacaucugcaaugucaaucacaaacccucaaacaccaaaguugacaaaaaggucgaacccaaauccugcgacaaaacucauaccugcccacccugccccgcccccgaagccgccggagcucccuccguauuccucuucccucccaaacccaaagacacccucaugauaagccgcaccccagaagugaccugugucguagucgacguaucacacgaagauccugaaguuaaauucaacugguacgucgacggcguagaaguccacaacgccaaaacaaaaccacgugaagaacaauacaacucaacauaccgcgucguauccguccucaccguccuccaccaagacuggcuaaacggcaaagaauacaaaugcaaaguauccaauaaagcccuccccgcaccgaucgagaaaaccauauccaaagccaaaggccaaccccgcgaaccucaaguuuacacccucccacccucucgagaagaaaugaccaaaaaccaaguuucccuaaccugccucgucaaaggcuucuaccccucugacauagccgucgaaugggaaucaaacggccaacccgaaaacaacuacaaaaccaccccacccguccucgacuccgacggcaguuucuuccucuacucaaaacucaccgucgacaaaucccgcuggcaacaaggcaauguauucucaugcuccgucaugcacgaagcacuccacaaccacuacacccagaaaagccucucccucucccccgga

SEQ ID NO: 53711 - RNA, 642 nt, Artificial Sequence
  derived and/or modified sequence opt11 from Domagrozumab_LightChain1
gacauccaaaugacccaaucccccuccuccuuauccgcauccgucggcgaccgcgucaccaucacaugcaaagccucccaagacguauccaccgccguagccugguaccaacaaaaacccggaaaagcccccaaacuccuaaucuacucagccuccuaccgauauaccggcguccccucccgcuucucaggcuccggcuccggcaccgacuucacccucaccaucuccucacuccaacccgaagacuucgccaccuacuacugccaacaacacuacuccacccccuggaccuucggcggcggcaccaaagucgaaaucaaacgcacagucgccgcccccuccgucuucaucuucccacccucagacgaacaacucaaaucgggcaccgccuccgucgucugccuccucaacaacuucuacccccgcgaagccaaaguccaauggaaagucgacaacgcccuccaauccggcaacucccaagaauccgucaccgaacaagacuccaaagacuccaccuacucccucucauccacacugacccucuccaaagccgacuacgaaaaacacaaagucuacgccugcgaagucacucaccaaggccucuccucccccgucaccaaaucauucaaccgcggcgaaugc

SEQ ID NO: 53712 - RNA, 1335 nt, Artificial Sequence
  derived and/or modified sequence opt11 from Drozituab_HeavyChain1
gaaguccaacucguccaauccgguggcggaguagaacgccccggaggcucccuccgccucucaugcgcggccucaggauucaccuucgacgacuacgcuagcuggguccgacaagcccccggcaaaggccucgaauggguaucuggcaucaacuggcaaggcggauccaccggcuaugcagacuccgucaaaggacgcgugaccaucucaagagacaacgccaagaacucccucuaccuacaaaacucccuccgagccgaagacaccgccgucuacuacugcgccaaaauccuaggggcaggacgaggcugguacuuugacuacuggggcaagggcacuaccgucaccgucuccuccgcauccacgaaaggccccuccgucuucccccucgcucccucguccaaauccaccucaggcggcacagccgcccucggcugccuagucaaagacuacuuccccgaacccgucaccgucuccuggaacuccggcgcccucaccuccggcguacacacauuccccgccguacuccaaucaucaggacuauacucccucucguccgucgucaccguccccuccuccagccucggcacccaaaccuacauaugcaacgucaaccacaaacccuccaacaccaaaguagacaagaaaguagaacccaaaucaugugacaaaacccacaccuguccacccugccccgcucccgaacuacuaggaggccccucuguauuccucuuucccccaaaacccaaagacacccuaaucucccgcacacccgaaguuacuugcguaguagucgacguaucccacgaagacccagaagucaaauucaacugguacguugacggaguagaaguacacaacgcuaaaaccaaaccccgcgaagaacaauacaacucaacauaccgagucguuuccguccucacaguccuccaccaagauugguuaaacggaaaagaauacaaaugcaaaguauccaacaaagcccuaccagcaccaaucgaaaagaccaucagcaaagccaaaggccaaccccgcgaaccccaaguauacacccucccacccucucgcgaagaaaccaaaaaucaagucagccuuaccugccucguaaaaggcuucuaccccuccgacaucgccgucgaaugggaaagcaacggccaacccgaaaacaacuacaaaaccaccccacccguccucgacuccgacggcucauucuuccucuacucuaaacucaccgucgacaaaucacgauggcaacaaggcaacguauucagcugcuccgugcacgaagcccuccacaaccacuacacccagaaaucccuaucucucucgcccggc

SEQ ID NO: 53713 - RNA, 639 nt, Artificial Sequence
  derived and/or modified sequence opt11 from Drozituab_LightChain1
uccgaacucacccaagaccccgccgucuccguagcccucggacaaaccguccgaaucaccugcucaggagacagccuccgauccuacuacgccuccugguaccaacaaaaacccggccaagccccuguccucgucaucuacggcgcaaacaaccgucccuccggcauccccgaccgauucucaggcucauccuccggcaacaccgccucccucaccaucaccggcgcccaagccgaagacgaagccgacuacuacugcaacuccgcagacuccuccggcaaccacgucgucuucggaggcggcaccaaacucaccguccucggccaacccaaagccgcccccuccgucacccuauuccccccauccuccgaagaacuccaagccaacaaagccacccuagucugccuaaucuccgacuucuacccuggcgccgucaccgucgccuggaaagccgacuccucaccagucaaagccggcgucgaaacaacaacccccuccaaacaauccaacaacaaauacgccgccuccuccuaccuaucccucacccccgaacaauggaaaucccacaaaagcuacuccugccaagucacccacgaaggauccacagucgaaaaaaccgucgcccccacagaaugcuca

SEQ ID NO: 53714 - RNA, 1353 nt, Artificial Sequence
  derived and/or modified sequence opt11 from Drozitumab_HeavyChain1
gaaguacagcucguccaguccggcggcggagucgagcgaccaggcggaucccucagacucucaugcgcagcauccggcuucaccuucgacgacuacgcaauguccuggguccgccaagcacccggcaaaggacucgaaugggucuccggcaucaacuggcaaggcggaagcaccggcuacgcagacuccguaaaaggaagagucaccaucucccgcgacaacgccaaaaacucccuauaccuccagaugaauagccuccgcgccgaagacaccgccguauacuacugcgccaaaauccucggcgccggccgcgguugguauuucgacuacuggggaaaaggcaccaccguaaccguaagcuccgccuccaccaaaggccccuccgucuucccacuugcaccuuccucaaaaagcaccuccggcggaacagccgcccucggcugccucgugaaagacuacuuccccgaaccagucacugucuccuggaacuccggcgcccuaaccuccggcguacacaccuuccccgcaguccuccaauccuccggccuauacucacucuccuccgucguaacagucccauccuccucccucggaacccaaaccuacaucugcaacgucaaccacaaacccuccaacacaaaagucgacaagaaaguagaacccaaaucuugcgacaaaacacauaccugcccacccugcccagcccccgaacuuuuagguggucccagcguauuccuauuuccacccaaacccaaagacacccucaugauaucucgaacccccgaaguaaccugcgucguugucgacgucagccacgaagaccccgaagucaaauuuaacugguacgucgacggcguugaaguccacaacgccaaaacuaaacccagagaggaacaauacaacucaaccuaccgcgucgucuccguccucaccguacuucaccaagacuggcucaacggcaaagaauacaaaugcaagguguccaacaaagcacuacccgcccccaucgagaaaaccaucagcaaagccaaaggacaaccacgcgaaccccaagucuacacacucccacccucccgcgaagaaaugaccaaaaaccaagucucacuaaccugccucgucaaaggcuucuaccccuccgacauagccgucgaaugggaaagcaacggccaacccgaaaauaacuacaaaaccacucccccaguacucgacucagacggcagcuucuucuuauacuccaaacuaacggucgacaaaucccgauggcagcaaggaaacguauucuccugcagcgucaugcacgaagcucuccacaaucacuacacccaaaaaucacucucccucucccccggcaaa

SEQ ID NO: 53715 - RNA, 639 nt, Artificial Sequence
  derived and/or modified sequence opt11 from Drozitumab_LightChain1
uccgaacucacccaagaccccgccgucuccgucgcccucggccaaaccguccgcaucaccugcuccggcgacucccuccgcuccuacuacgccuccugguaccaacaaaaacccggccaagcccccguacucgucaucuacggcgccaacaaccgcccauccggcauccccgaccgcuucuccggcucaucaucaggcaacaccgccucccucaccaucaccggagcccaagccgaagacgaagccgacuacuacugcaacuccgccgacuccuccggcaaccacgucguuuucggcggcggaaccaaacucaccguccucggccaacccaaagccgcccccucagucacacucuucccccccuccuccgaagaacuucaagccaacaaagccacccucguaugccuaaucuccgacuucuaccccggcgccgucaccguagccuggaaagccgacuccucccccgucaaagccggcgucgaaacaaccacccccuccaaacaauccaacaacaaauacgccgccuccuccuaccuaucccuuacccccgaacaauggaaaucccacaaauccuacucaugccaaguaacccacgaaggcucaaccgucgaaaaaaccgucgcccccaccgaaugcucc

SEQ ID NO: 53716 - RNA, 1353 nt, Artificial Sequence
  derived and/or modified sequence opt11 from Duligotumab_HeavyChain1
gaaguacagcuaguagaaucaggaggcggccucguccaacccggcggcagccuaagacuauccugcgcggccucaggauucacacuaucaggcgacuggauccacuggguccgccaagcucccggcaaaggccucgaaugggucggcgaaaucuccgccgccggcggcuacaccgacuacgccgacuccgucaaaggacgcuucaccaucuccgccgacaccuccaaaaacaccgccuaucuccaaaugaacucccuccgcgccgaagacacagccgucuacuacugcgcccgggaaucacgcguauccuucgaagcagccauggacuacuggggccaaggcacccuagucaccguuagcuccgccuccaccaaaggacccagcguauuuccccuagcucccuccuccaaauccaccuccggaggcaccgccgcccucggaugccucgugaaagacuacuuccccgaacccgucaccgucaguuggaacuccggagcacucacauccggcguccacacauuccccgccguacuacaaagcuccggccucuacucacucucaucaguaguaaccgugcccucaagcucccuaggcacccaaacauacauaugcaaugucaaucacaaaccauccaacaccaaagucgacaagaaagucgaaccaaaauccugcgacaaaacccacacaugcccaccaugcccagcacccgaacuccucggcggcccauccguauuccucuucccaccgaaacccaaagacacccugaugaucucacgcacacccgaagucacaugcgucguagucgaugucucccacgaagaccccgagguaaaauucaacugguacgucgacggcgucgaaguacacaacgccaaaacaaaaccccgcgaggaacaauacaacagcaccuaccgcguagugagcguccucacaguacugcaccaagacuggcucaacggcaaagaauacaaaugcaaagucucgaacaaagcgcuccccgcacccaucgagaaaaccauaucaaaagccaagggccaaccccgugaaccccaagucuauacucucccacccucacgcgaagaaaugaccaaaaaccaagucucccuaacaugccuagucaaaggauucuaccccuccgacaucgccgucgaaugggaaucaaacggccaacccgaaaacaacuacaaaacaaccccucccguccuagacucagacggcagcuucuuucuauacuccaagcuaaccgucgacaaaucccgauggcaacaaggcaacguauucuccugcagcgucaugcacgaagcccuccacaaccacuacacccaaaaaucgcucucccuuucccccggaaaa

SEQ ID NO: 53717 - RNA, 642 nt, Artificial Sequence
  derived and/or modified sequence opt11 from Duligotumab_LightChain1
gacauccaaaugacccaaucaccauccucccucuccgcauccgucggcgaccgaguaaccauaaccugccgcgcaucccaaaacaucgccaccgacgucgccugguaccaacaaaaacccggcaaagcccccaaacuccucaucuacuccgccuccuuccucuacuccggcguccccucccgcuucuccggcucaggcuccggcaccgacuucacccuaaccaucuccucccuccaacccgaagacuucgccaccuacuacugccaacaauccgaacccgaacccuacaccuucggccaaggcaccaaagucgaaaucaagcgcaccguagcagcccccucagucuucaucuucccacccuccgacgaacaacucaaaucaggcaccgccuccgucgucugccuacuuaacaacuucuacccccgagaagccaaaguccaauggaaagucgacaacgcccuccaguccggcaacucccaagaauccgucacagaacaagacuccaaagacucgaccuacucccuauccucaacccucacccucucaaaagccgacuacgaaaaacacaaagucuacgccugcgaagucacccaccaaggccucuccucccccgucaccaaaucauucaaccgcggcgaaugc

SEQ ID NO: 53718 - RNA, 1353 nt, Artificial Sequence
  derived and/or modified sequence opt11 from Duligotuzumab_HeavyChain1
gaaguccagcuagucgaauccggcggcggccucguccaacccggcgggucucucagacucagcugcgcagcaagcggcuucacccucuccggcgacuggauccacuggguacgccaagcccccggaaaaggacucgaaugggucggagaaaucuccgccgccggaggauacaccgacuacgcagacuccguaaagggacgauucaccaucuccgcugacaccuccaaaaacaccgccuaccuacaaaugaacagcuuacgcgcugaagacacagcagucuacuacugcgcccgcgagucaagaguauccuucgaggccgcaauggacuacuggggccaaggcacccuagucaccgucagcucugcaucaaccaaaggccccucaguauucccccucgcccccagcuccaaaucaacauccggcggcaccgccgcccuaggcugccucgucaaagacuauuuccccgaacccgucaccguguccuggaacucaggcgcccucaccucaggcguucacaccuuccccgcaguccuccaaucaucuggccuauacucccuaucauccgucguuaccguacccucgagcucccugggcacgcaaacauacauaugcaacgucaaccacaaaccaucuaauaccaaagucgacaagaaaguagaacccaaauccugcgacaaaacccacaccuguccacccugccccgcccccgaacuccucggcggucccucaguauuucucuucccacccaaacccaaagacacauuaaugaucucccgcacacccgaaguuaccugcgucgucgucgacgucagccacgaagaccccgaagucaaauucaacugguacgucgauggcgucgaaguccacaacgccaaaacaaaaccccgagaagaacaauauaacucuacauaucgcgucgucagcguccuaaccgugcuacaccaagacuggcucaacggaaaagaauacaaaugcaaagucucaaacaaagcccuacccgcccccaucgagaaaaccauauccaaagccaaaggccaaccccgcgaaccccaagucuacacucucccucccucucgcgaagaaaugaccaaaaaccaagucucccuaaccugccucguaaaaggcuucuaccccuccgacauagcagucgaaugggaauccaacggccaacccgaaaacaacuacaaaaccaccccgcccguccucgacuccgacggcucauucuuccucuacuccaaacucacaguagacaaaucccgcuggcaacaggguaacgucuucuccuguuccgucaugcaugaagcccuccacaaccacuacacccaaaaaucccuuucacuuucccccggaaaa

SEQ ID NO: 53719 - RNA, 642 nt, Artificial Sequence
  derived and/or modified sequence opt11 from Duligotuzumab_LightChain1
gacauccaaaugacccaaucccccuccucccuauccgccuccgucggcgaccgcgucaccauaaccugccgcgccucacaaaacaucgcaaccgacgucgccugguaccaacaaaaacccggcaaagcccccaaacuccucaucuacuccgccuccuuccucuacuccggcguccccucccgcuucucaggcucaggcuccggcaccgacuucacccuaacaaucucaucccuccaacccgaagacuucgccaccuacuacugccaacaauccgaaccagaaccauacaccuucggccaaggaaccaaagucgaaaucaaacgcacagucgccgcccccucaguauucaucuucccacccuccgacgaacaacucaaauccggaacagccuccgucgucugccuccucaacaacuucuacccccgagaagccaaaguccaauggaaagucgacaacgcacuccaauccggcaacucccaagaauccgucaccgaacaagacucaaaagacuccaccuacucccucuccucaacccuaacccucuccaaagccgacuacgaaaaacacaaaguauacgccugcgaagucacccaccaaggccuauccucccccgucacaaaauccuucaacagaggcgaaugc

SEQ ID NO: 53720 - RNA, 1353 nt, Artificial Sequence
  derived and/or modified sequence opt11 from Dupilumab_HeavyChain1
gaaguccagcuaguagaaucaggcggcggccucgaacaaccaggaggcucccuccgccucucaugcgcaggcuccggcuucaccuuccgcgacuacgccaugaccuggguacgccaggccccaggcaagggacucgaaugggucucaagcaucuccggauccggaggcaacaccuacuacgccgacucagucaaaggacgcuucaccaucucacgugacaacuccaaaaacacccuauaccuccaaaugaacucccuacgagcugaagacaccgccgucuacuacugcgccaaagaccgcuuauccaucacaauccgcccacgcuacuacggacuagacguauggggccaaggcacaaccgucaccgugagcucagcaucaaccaaaggccccuccgucuucccccucgcucccugcucccgaucaaccuccgaaucaacagccgcccuaggaugccucgucaaagacuacuuccccgaacccguaaccguaucauggaauagcggggcccucaccuccggcgugcacacauuccccgccguacuccaauccucaggccucuacucccucuccucugucgucaccguuccgagcuccucccugggcacaaaaaccuauaccugcaacgucgaccacaaacccucgaacaccaaagucgacaaacgcgucgaaucaaaauacggacccccaugcccacccugccccgcccccgaauuucucggcggccccuccgucuuccuauucccaccaaaacccaaagacacacucaugaucucucgcacuccagaaguaaccugcgucguugucgacgucagccaagaagaucccgaaguccaguucaacugguacgucgacggcguagaaguccacaacgcuaaaaccaagccaagagaagaacaauucaacucaaccuaccgugucguauccguccucacaguacuacaccaagacuggcucaacggcaaagaauacaaaugcaaaguaucgaacaagggucugccaucaucuauagagaaaacaaucuccaaagccaaaggacaaccccgcgaaccccaaguuuacacccucccacccucacaagaagaaaugaccaaaaaccaaguaucccuaacaugccuagucaaaggauucuacccaagcgacaucgcaguggagugggaauccaacggccaaccugaaaacaacuacaaaaccacacccccgguccuagacuccgacggauccuucuuccuauacagccgccucaccgucgacaagucccgcuggcaagaaggaaacguauucucaugcuccgucaugcacgaagcauugcacaaucacuacacccaaaaaucccuuucccuaucacucggc

SEQ ID NO: 53721 - RNA, 657 nt, Artificial Sequence
  derived and/or modified sequence opt11 from Dupilumab_LightChain1
gacaucgucaugacccaaucaccccucucucuccccgucacccccggcgaacccgccucaaucuccugccgcuccucacaaucccuccucuacuccaucggcuacaacuaccuagacugguaccuccaaaaauccggccaaucaccccaacuccucaucuaccucggcuccaaccgcgccuccggagucccagaccgauucuccggcuccggcucaggcaccgacuucacccucaaaaucucccgcgucgaagccgaagacgucggauucuacuacugcaugcaagcccuacaaacccccuacaccuucggccaaggcaccaaacucgaaaucaaacgcaccgucgcagcacccuccgucuucaucuucccacccucagacgaacaacucaaauccggcaccgcauccgucgucugccuccucaacaacuucuacccccgugaagccaaaguccaauggaaagucgacaacgcccuccaauccggcaacucccaagaaucagucaccgaacaagacuccaaagacuccaccuacucccuaucaucaacccucacccucuccaaagcagacuacgaaaaacacaaaguauacgcaugcgaagucacccaccaaggccucuccucccccgugaccaaauccuucaaccgcggcgaaugc

SEQ ID NO: 53722 - RNA, 1353 nt, Artificial Sequence
  derived and/or modified sequence opt11 from Durvalumab_HeavyChain1
gaaguacagcuagucgaaucaggcggcggacucguccaacccggaggcucacuucgccucucaugugccgccucgggauucaccuucucccgauacuggaugucuuggguccgccaagcacccgguaaaggacuggaaugggucgccaacaucaaacaggacggauccgaaaaauacuacguagacagcgucaaaggccgcuucacaaucucgcgcgacaacgccaaaaacucccuauaccuccaaaugaacucacuccgagcagaagacaccgccguauacuacugcgcccgagaaggcgguugguucggcgagcuagccuucgacuacuggggccaaggcacccucguuaccgucuccuccgccuccaccaaaggccccagcgucuucccacuagcgcccuccagcaaaucaacaagcggcggaaccgccgcacucgguugccucgucaaagacuacuuccccgaacccgucaccguguccuggaacagcggagcccugacaucaggaguccacaccuucccagcaguccuccagagcucaggcuuauacucccuuagcuccguagucaccguccccuccucuucacuaggaacacaaacauacaucugcaacgucaaccacaagccauccaacaccaaaguagacaaacgcgucgaaccgaagucgugcgacaaaacccacacuugcccacccugccccgcacccgaguucgaaggaggacccucagucuuccuauucccacccaaacccaaagacacacugaugauaucacgcacacccgaaguaaccugugucguaguugacguaucccacgaggaccccgaaguaaaauucaacugguacguagacggagucgaaguccacaacgccaaaacaaaaccucgcgaagaacaauacaacuccaccuaccgagucgucuccguccuaacuguacuccaccaagacuggcucaacggcaaagaauacaaaugcaaagucuccaacaaagcccuccccgccuccaucgagaaaaccaucucaaaagccaaaggccaaccccgcgaaccccaagucuacaccuugccucccagccgcgaagaaaugaccaaaaaccaaguaucucuuaccugccucgucaaaggcuucuaccccuccgauaucgcagucgaaugggaaucuaauggccaacccgaaaacaacuacaaaaccaccccacccguccucgacagcgacggcuccuucuuccuauacagcaaacuaaccgucgacaaaucuagauggcaacaaggaaacgucuucuccugcucaguaaugcacgaagcccuccacaaccacuacacucaaaagagccugucccucucacccggcaaa

SEQ ID NO: 53723 - RNA, 645 nt, Artificial Sequence
  derived and/or modified sequence opt11 from Durvalumab_LightChain1
gaaaucguccucacccaaucccccggcacccucucccuaucccccggcgaacgagccacccucuccugccgagccucccaacgcgucuccuccuccuaccucgccugguaccaacaaaaacccggccaagccccacgccuacuuaucuacgacgccucaucccgcgccacuggcauccccgaccgcuucucaggcucaggauccggcaccgacuuuacccuaacuaucucccgccucgaacccgaagacuucgccgucuacuacugccaacaauacggcucccuccccuggaccuucggccaaggcaccaaagucgaaauaaaacgcaccgucgccgccccauccgucuucaucuucccacccuccgacgaacaacucaaauccggcacagccucagucgucugccuacucaacaacuucuaccccagagaagccaaaguccaauggaaagucgacaacgcccuccaauccggaaacucccaagaaucagucaccgaacaagacuccaaagacucaacuuacucccucuccucaacccucacccucuccaaagccgacuacgaaaaacauaaagucuacgccugcgaagucacccaccaaggccucuccucacccgucacaaaauccuucaaccgcggcgaaugu

SEQ ID NO: 53724 - RNA, 1338 nt, Artificial Sequence
  derived and/or modified sequence opt11 from Dusigitumab_HeavyChain1
caaguacaacucguccaaucaggcgcagaagugaaaaagcccggagccuccgucaaagucuccugcaaagccucuggauacaccuuuaccuccuacgacaucaacuggguucgacaagcaacaggccaaggccucgaauggaugggcuggaugaaucccaacuccggcaacaccggcuacgcacaaaaauuccaaggccgcgucaccaugacccgcaacaccucaaucuccacugccuacauggaacucucaucccuccggagcgaagacacagccgucuacuacugcgcccgagaccccuacuacuacuacuacggcauggacgucuggggccaaggcaccacaguuaccgucucaagcgccucaaccaaggggcccuccgucuucccccucgccccaugcucacgcucgaccucugaaucaacagccgcccuaggaugccucgucaaagauuacuuccccgaaccagucacagucuccuggaacucuggcgcacucaccuccggcguccacaccuuccccgccguccuacaaucaucaggccucuauucccuguccucaguugucaccguacccucuuccaacuucggcacacaaaccuauaccugcaacgucgaccacaaacccuccaacacaaaaguagacaaaaccgucgaacgcaaaugcugcgucgagugcccucccugcccugcuccucccgucgccggccccuccgucuuccuauucccacccaaacccaaagauacccucaugaucucacgcacacccgaaguaaccugcgucgucgucgacgucagccacgaagaccccgaaguccaauucaacugguacguggacggcgucgagguacacaacgcaaaaaccaaaccccgcgaagaacaauucaauucaaccuuccgcgucgucucuguccuuaccguaguccaccaagacuggcucaacggcaaagaauacaagugcaaggucuccaauaaaggccuccccgcccccaucgagaaaacuaucuccaaaaccaaaggccaaccccgcgaaccccaaguauacacacucccgcccucccgcgaagaaaugacuaaaaaccaagucucccucacaugcuuggucaagggauucuaccccuccgacauagcggucgaaugggaauccaacggccaacccgaaaacaacuacaaaaccacacccccaaugcucgacucagacggauccuucuuccucuacuccaaacucaccgucgacaaaagccgauggcagcaaggaaacgucuucuccugcuccgucaugcacgaagcccuacacaaccacuacacccaaaaaucacuaucccucucacccggcaaa

SEQ ID NO: 53725 - RNA, 651 nt, Artificial Sequence
  derived and/or modified sequence opt11 from Dusigitumab_LightChain1
caauccguccuaacacaaccccccucagucagcgccgccccaggccaaaaaguaaccaucuccugcuccggcuccuccuccaacaucgaaaacaaccacgucuccugguaccaacaacucccaggcaccgcccccaaacuccucaucuacgacaacaacaaacgccccuccggcauccccgaccgcuucuccggcuccaaauccggaaccuccgccacccucggaaucaccggccuccaaaccggcgacgaagccgacuacuacugcgaaaccugggacaccucccuauccgccggccgcgucuucggcggcggcaccaaacucaccguccucggccaacccaaagccgccccauccgucacccucuucccccccucauccgaagaacuacaagccaacaaagccacccucgucugccucaucuccgacuucuaccccggcgcagucaccgucgccuggaaagcagacuccucccccguaaaagcaggcgucgaaaccaccacccccuccaaacaaucuaacaacaaauacgcagccuccuccuaccucucccucacccccgaacaauggaaaucccaccgcuccuacuccugccaagucacccacgaaggcuccaccgucgaaaaaaccgucgcccccaccgaaugcucc

SEQ ID NO: 53726 - RNA, 1347 nt, Artificial Sequence
  derived and/or modified sequence opt11 from Ecromeximab_HeavyChain1
gaagucacccucguagaauccggcggagacuucguaaaacccggcggaagccuaaaaguaagcugcgcagcauccggcuucgcauucucccacuacgccaugucuuggguccgccaaacccccgcaaaaaggcuagaaugggucgcauacaucuccucagguggcuccggcaccuauuacuccgacuccgucaaaggacgcuuuaccaucuccagagacaacgccaaaaacacccuauaccuacaaaugcgaagccuccgcuccgaagacucagcaauguacuuuugcacccgagucaaacucggaaccuacuacuucgacuccuggggccaaggaaccacccucaccgucagcagcgcauccaccaaaggccccuccgucuucccccucgcccccucaucaaaauccaccuccgguggaacagccgcccuuggcugucuagucaaagacuauuuccccgaacccguaacaguauccuggaacagcggagcccucaccucaggaguccacacauuccccgcaguccuccaaucuuccggacucuacucacucuccucaguaguaaccgucccauccuccagcuuaggaacccaaaccuacaucugcaacguaaaccacaaacccucaaacacaaaaguugacaagaaagucgaacccaaaucaugcgacaaaacccauaccugcccacccugccccgcccccgaacuccucggaggccccagcgucuuccucuucccaccaaaaccaaaagacacccucaugaucucccgaacccccgaaguaaccugcgucgucgucgacgucagccacgaagaccccgaggucaaauucaacugguacguagauggcgucgaaguccacaacgccaaaacuaaacccagagaagaacaauacaacagcaccuaccgcgucgucagcguacuaacaguacugcaccaagauuggcuaaauggcaaagaauacaaaugcaaaguaucaaacaaagcccuccccgcccccaucgagaaaaccaucuccaaagccaaaggccaaccacgcgaaccacaagucuacacacuaccucccucccgcgacgaacuaaccaaaaaccaagucucccuaaccugccucgucaaaggcuucuaccccucagacauagccgucgaaugggaauccaacggccagcccgaaaacaacuacaaaacaaccccacccguccucgauucagacggaucauucuuccuuuacuccaaacucaccguagacaaaucccgcuggcaacaaggcaacgucuucucaugcuccgucaugcacgaagcacuccacaaucauuacacccaaaaaucccucucucuaucccccggcaag

SEQ ID NO: 53727 - RNA, 642 nt, Artificial Sequence
  derived and/or modified sequence opt11 from Ecromeximab_LightChain1
gacauccaaaugacccaaacugccucuucccuccccgccucccucggcgaccgcgucaccaucuccugcuccgccucccaagacaucuccaacuaccucaacugguaccaacaaaaacccgacggcaccgucaaacuccuaaucuucuacuccuccaaccuccacuccggcguccccucccgcuucucaggcggcggcuccggcacagacuacucccuaaccaucagcaaccucgaaccagaagacaucgccaccuacuucugccaccaauacuccaaacuccccuggacauucggaggcggcaccaaacucgaaaucaaacgaaccgucgccgcccccagcgucuucauauucccucccucagacgaacaacucaaaucaggcaccgcauccgucgucugccuacucaacaacuucuacccccgcgaagccaaaguccaauggaaagucgacaacgcccuccaauccggcaacucccaagaauccgucaccgaacaagacuccaaagacuccaccuacucccucucauccacccucacccucucuaaagccgacuacgaaaaacacaaagucuacgccugcgaagucacccaccaaggccucuccucccccgucaccaaaucauucaacagaggcgagugc

SEQ ID NO: 53728 - RNA, 1341 nt, Artificial Sequence
  derived and/or modified sequence opt11 from Eculizumab_HeavyChain1
guacaacucguucaaucaggcgccgaagucaagaaacccggagccucagucaaaguaucaugcaaagccuccggcuacauauucagcaacuacuggauccaauggguccgccaagcccccggacaaggccuagaauggaugggcgaaauccucccaggcuccggcucaaccgaauacaccgaaaacuucaaagaccgcgucaccaugacacgugacaccucaaccuccacgguauacauggaacuauccucccuccgauccgaagacacagcaguauacuacugcgcccgcuacuucuucggcucaucacccaacugguacuucgacguaugggggcagggcacccucguaacagucuccuccgcguccacaaaaggccccuccgucuucccccucgcaccaugcucacgcuccaccucugaaucaaccgcagcccuuggcugccucgucaaggauuacuuccccgaacccguuaccgucuccuggaacucaggcgcacuaaccuccggcguccacaccuucccagcuguacuucaauccucaggacucuacucccuuucaucagucgugacaguccccuccuccaacuucggaacacaaaccuacacaugcaacgucgaccacaaaccauccaacacaaaagucgacaaaaccgucgaacgcaaaugcugcguagaaugcccucccugccccgccccucccgucgccggccccucagucuuccuauucccacccaaaccuaaggacacccucaugauuucccgcacacccgaaguuaccugcgucgucgucgacgucucacaagaagacccagaaguacaauucaacugguacgucgacggcgucgaaguccacaacgcaaagaccaaaccccgcgaagaacaauucaacucuaccuaccgcgucgucuccguccucaccguccuccaccaagacuggcucaacggcaaagaauacaaaugcaaagucuccaacaaaggacuacccucguccaucgagaaaaccauauccaaagcuaagggccaaccccgcgaaccccaagucuauacacucccacccucacaagaagaaaugaccaaaaaccaagucucacuaaccugccucgucaaaggcuucuacccaagcgacauagccgucgaaugggaauccaacggccagccugaaaacaauuacaagaccaccccacccguacucgacagcgacggcuccuucuuccucuacucucgucucaccguggacaaaucccgcuggcaagaaggcaacgucuucucgugcucagucaugcaugaagcacuucacaaccacuacacccaaaaaucacucucccucucccucggcaaa

SEQ ID NO: 53729 - RNA, 642 nt, Artificial Sequence
  derived and/or modified sequence opt11 from Eculizumab_LightChain1
gacauccaaaugacccaaucccccucaucccucuccgcaagcguaggcgaccgcgucaccaucaccugcggcgccuccgagaacaucuacggcgcccuaaacugguaccaacaaaaacccggcaaagcccccaaacuccucaucuacggcgccaccaaccucgccgacggaguccccucccgcuucucaggcuccggcucaggcaccgacuucacccuaaccauaucaucccuucaacccgaagacuucgccaccuacuacugccaaaacguccucaacaccccccucaccuucggccaaggcaccaaagucgaaauaaaacgcaccgucgccgcccccucaguauucaucuucccccccuccgacgaacaacuaaaauccggcacagccuccgucgucugccuacuaaacaacuucuacccccgcgaagccaaaguccaauggaaagucgacaacgcccuccaauccggcaacucacaagaauccguaaccgaacaagacagcaaagacucaaccuacucccuaagcuccacccucacccuauccaaagccgacuacgaaaaacacaaagucuacgccugcgaagucacacaccaaggccuaagcucccccguuaccaaauccuucaaccgcggcgaaugc

SEQ ID NO: 53730 - RNA, 375 nt, Artificial Sequence
  derived and/or modified sequence opt11 from Efalizumab_HeavyChain
gaagugcaauuggucgagagcgggggcgggcucgugcaaccgggcgggagcuuacgcuugagcugugccgcgagcggguacucguucacgggccauuggaugaacugggucaggcaagcgcccgggaaagggcucgagugggugggcauaaugauacacccgagcgauagcgagaccagguacaaucaaaaguucaaggacauacgcuuuaccauaagcguggacaagagcaagaacacgcucuaucuccagaugaauagcuugcgcgcggaagauaccgcggucuauuacugugccaggaucgggaucuauuucuauggcacgaccuauuucgauuacauaugggggcaagggaccuuggucacggucucgagc

SEQ ID NO: 53731 - RNA, 324 nt, Artificial Sequence
  derived and/or modified sequence opt11 from Efalizumab_LightChain
gacauccaaaugacccaaucccccucaucccucuccgccuccgucggcgaccgcgucaccaucaccugccgcgccuccaaaaccaucuccaaauaccuagccugguaccaacaaaaacccggcaaagcccccaaacuccuaaucuacuccggcuccacccuccaauccggcguccccucccgcuucuccggcuccggcuccggcaccgacuucacccucaccaucuccucccuccaacccgaagacuucgccaccuacuacugccaacaacacaacgaauacccccucaccuucggccaaggcaccaaagucgaaaucaaacgc

SEQ ID NO: 53732 - RNA, 768 nt, Artificial Sequence
  derived and/or modified sequence opt11 from Efungumab_SingleChain_variable_fragment
auggcagaagugcaacuggucgaaagcggggccgaggucaagaaaccgggcgagagcuugcgcauaagcugcaaaggaagcgggugcauaaucucgagcuauuggauaagcugggucagacaaaugcccgggaaagggcucgaguggaugggcaagaucgaucccggggacucguacauaaacuauagcccgagcuuucaaggacacgugaccauaagcgcggacaagagcauaaacacggccuaucuccaauggaauagcuugaaagcgagcgauaccgcgauguauuacugcgccaggggcgggcgcgauuucggggacucguucgacuacuggggccagggaacacucgugaccgugagcucaggcggaggaggcagcgggggcgggggcucgggaggaggaggaagcgacgucgugaugacacaaucacccucguuccugagcgcauucgugggcgaccgcauaaccauaacaugccgagcaagcucaggcauaagcagguaccuggccugguaccaacaagcgccagggaaagcgcccaagcucuugaucuacgccgcaagcacgcuccagaccggaguaccaagcagguucucgggaucgggcucgggcacggaguucacccuaaccauaaacucgcuccaacccgaagacuucgccacguacuauugccagcaccugaacucguacccgcucacguucgggggcgggaccaaggucgacaucaagcgcgcggccgcacucgaacaccaccaccaucaccac

SEQ ID NO: 53733 - RNA, 1362 nt, Artificial Sequence
  derived and/or modified sequence opt11 from Eldelumab_HeavyChain1
caaaugcagcuaguagaauccggaggaggcgucguccaacccggacgaucccucagacucuccugcaccgccucaggcuucaccuucucaaacaacgggaugcacuggguacgccaagcccccggcaaaggucucgaauggguagccgucaucugguucgacggaaugaacaaauucuacgucgacucagucaaaggccgauucaccaucucccgagacaacucgaaaaacacccucuaccucgagaugaacucccuacgcgccgaagacaccgccaucuacuacugugcacgcgaaggagacggcagcggcauauacuacuacuacggcauggacgucuggggucaaggcacuacaguaaccguauccucagccagcaccaaaggaccuucggucuucccccucgcccccuccucaaaaucaaccagcggaggcaccgccgcccuaggaugccucgucaaagacuacuucccagaacccgugaccguaucauggaacuccggagcacucacauccggaguccacaccuucccagccguccuacaauccucaggccucuauucucucuccucaguaguaacaguaccuucauccucacucggcacccagaccuacauaugcaacgucaaccacaagccauccaacacaaaggucgacaaacgaguagaaccaaaaagcugcgacaaaacccacacaugcccacccugcccagcccccgaacuccuaggcggacccagcguauuccuauucccacccaaacccaaagacacacuuaugaucucgcgaacccccgaaguaaccugcgucgucgucgacgucucccacgaagaccccgaagucaaguucaacugguacgucgauggcguagaaguccacaacgcaaaaaccaaaccccgcgaagaacaauacaacuccaccuaccgaguagucucaguccuaacuguacuccaccaagacuggcucaauggcaaagaauacaaaugcaaaguauccaacaaagcccucccugcaccgaucgagaaaaccauauccaaagccaaaggccaaccccgcgaaccccaaguauacacucucccacccucucgcgaagaaaugaccaaaaaccaagucucacucaccugucucguuaagggcuucuaccccucagacaucgccgucgaaugggaaucaaacggccagcccgaaaacaacuacaaaaccacaccucccguccuagacucagacggcuccuucuuccuauacuccaaacucaccgucgacaaaucacgcuggcagcaaggcaacgucuucuccugcagcguuaugcacgaagcccuccacaaccacuauacccaaaagucccucucacucagucccggaaaa

SEQ ID NO: 53734 - RNA, 648 nt, Artificial Sequence
  derived and/or modified sequence opt11 from Eldelumab_LightChain1
gaaaucguccucacacaaucccccggcacccucucccuaucccccggcgaacgagccacccuauccugccgagccucccaaucagucuccuccucauaccuagccugguaccaacaaaaacccggccaagcaccccgccuccuaaucuacggcgccuccucccgcgccaccggcauccccgaccguuucucaggauccggcuccggcacagacuucacccuaacaaucucacgccuagaaccagaagacuucgccgucuacuacugccaacaauacggcuccucucccaucuucacauucggacccggcaccaaagucgacaucaaacgcaccgucgccgcccccuccgucuucaucuucccacccuccgacgaacaacuuaaauccggcaccgccuccgucgucugccuccuaaacaacuucuacccccgcgaagccaaaguccaauggaaagucgacaacgcacuccaauccggcaacucccaagaauccgucacagaacaagacuccaaagacuccaccuacucccucuccucaacccucacccucuccaaagccgacuacgaaaaacacaaagucuacgccugcgaagucacccaccaaggacuauccucccccgucaccaaauccuucaacagaggagaaugc

SEQ ID NO: 53735 - RNA, 1341 nt, Artificial Sequence
  derived and/or modified sequence opt11 from Elgemtumab_HeavyChain1
gaaguacaacuccucgaauccggaggcggccucgugcaaccaggagguucacuacgccuauccugcgcagccucaggauucacauucucaucauacgccauguccuggguacgccaagcccccgggaaaggccuggaauggguuagcgcaaucaacucacaaggaaaguccaccuacuacgcagauuccgucaagggcagauucaccauaucccgcgacaacuccaaaaacacccucuaccuccaaaugaacucccuccgcgcugaagacaccgccgucuacuacugcgcccgguggggcgacgaaggcuucgacaucuggggccaaggcacccuagucacagucucaucagcauccaccaaaggccccuccgucuucccacucgccccauccucaaaauccaccuccggcggcaccgccgcacuaggcugccuagucaaagacuauuuccccgagcccguaaccguauccuggaacucaggcgcacucaccucaggcgugcacaccuucccagcaguccuccaaucauccggacucuacucccucuccucugucguuaccguacccuccucaagccuaggcacccaaacuuacaucugcaacgucaaccacaaacccuccaacacaaaagucgacaaacgcguagaaccaaaguccugcgacaaaacccacacaugcccucccugccccgcgccggaacuucucgguggcccaucagucuuccucuucccgccaaaacccaaagacacccucaugaucucccgcacccccgaaguaaccugcgucgucgucgacguaucacacgaagaccccgaagucaaauucaacugguacgucgacggcguagaaguccacaacgccaaaacaaagcccagagaagaacaauacaacuccaccuaccgcguaguauccguccuaacaguucuacaccaagacuggcucaacggaaaagaauacaagugcaaagucuccaacaaagcucuccccgcucccaucgagaaaaccaucagcaaagccaaaggccaaccccgcgaaccccaagucuacacccuucccccaucccgcgaagaaaugaccaaaaaccaggucucucucacaugccuagucaaaggauucuacccuuccgacaucgcagucgaaugggaguccaacggccaacccgaaaacaacuacaaaacaacucccccaguccuagacuccgacggcuccuucuuccuguacuccaagcugaccgucgacaaaucccgcuggcaacaaggaaacguauucucaugcuccgucaugcacgaagcacuccacaaccacuacacccagaaaagccucucccucucacccggcaaa

SEQ ID NO: 53736 - RNA, 642 nt, Artificial Sequence
  derived and/or modified sequence opt11 from Elgemtumab_LightChain1
gacauccaaaugacccaaagccccuccucccucuccgccuccgucggcgaccgagucaccauaaccugccgcgccucccaaggaaucuccaacuggcucgccugguaccaacaaaaacccggcaaagcccccaaacuacucaucuacggcgccuccucccuccaauccggcguccccucccgcuucuccggcuccggcuccggcaccgacuucacccucaccauauccucccuccaacccgaagacuucgccaccuacuacugccaacaauacagcuccuuccccaccaccuucggccaaggaaccaaagucgaaaucaaacgcaccgucgccgcccccuccgucuucaucuucccacccuccgacgaacaacucaaauccggcacugccucagucgucugccuccucaacaacuucuacccccgagaagccaaaguccaauggaaagucgacaacgcccuccaguccggcaacucccaagaaucaguaaccgaacaagacuccaaagacuccaccuacucucuaucuucaacccucacccucuccaaagccgacuacgaaaaacacaaagucuacgccugcgaagucacccaccaaggccucuccucucccgucaccaaaucauucaaccgcggcgaaugc

SEQ ID NO: 53737 - RNA, 1347 nt, Artificial Sequence
  derived and/or modified sequence opt11 from Elotuzumab_HeavyChain1
gaaguucaacucguagaaucaggcgguggacucguccaacccggaggaucccuccgucucuccugcgccgccuccggcuuugacuucucccgcuacuggauguccuggguacgccaagcccccgggaaaggucucgaauggaucggcgaaauaaaccccgacuccucaaccauaaacuacgcccccucacuaaaagacaaauucaucauaucccgcgauaacgccaaaaacucccuauaccuccaaaugaacucucuccgagccgaagacaccgccguuuacuacugcgcccgcccagacggcaacuacugguacuucgacgucuggggccaaggcacccuagucacugucucuuccgccuccaccaaaggacccuccgucuucccccuugcccccucuuccaaauccacauccggcggaaccgccgcacucggcugccucgucaaagacuacuuccccgaaccagucacagucucauggaacagcggcgcccucaccuccggcguccacaccuucccugccguucuccaauccuccggucucuauucccuuucauccgucgucaccguccccucauccucccucggcacccaaacauacaucugcaacguaaaccacaaaccuucaaacaccaaagucgacaagaaaguagaaccaaaaucaugcgacaaaacccauaccugcccucccugccccgcccccgaacuccucggaggacccucagucuuccucuucccacccaaacccaaagacaccuugaugaucucucgcacacccgaagucacaugcgucgucguugacguaucccacgaagaccccgaagucaaauucaacugguacguagacgggguagaaguacacaacgccaaaaccaaaccccgcgaagaacaauacaacagcacauaccgaguugucuccguccucacuguccugcaccaagacuggcucaacggcaaggaauacaaaugcaaagucucaaacaaagcacuccccgcucccaucgaaaagaccaucuccaaagcuaaaggacaacccagagaaccccaagucuacacccucccacccucccgagacgaacucaccaaaaaccaagucucccuaaccugcuuagucaaagguuucuaccccuccgacaucgccgucgaaugggaauccaacggucaacccgaaaacaacuacaaaaccaccccacccguccuagacuccgacggcuccuucuuccuauacagcaaacucaccguagacaaaucacgauggcaacaaggcaacguuuucuccugcagcgucaugcacgaagcacuacacaaccacuacacccaaaaaucccuuucacucucacccgggaaa

SEQ ID NO: 53738 - RNA, 642 nt, Artificial Sequence
  derived and/or modified sequence opt11 from Elotuzumab_LightChain1
gacauccaaaugacccaaucacccuccucccuauccgcauccgucggagaccgcgucaccauaaccugcaaagccucccaagacgucggaaucgccgucgccugguaccaacaaaaacccggcaaaguccccaaacuccucaucuacugggccuccacccgccacaccggcguccccgaccgauucucuggcuccggcuccggcaccgacuucacccucaccaucuccucccuccaacccgaagacguagccaccuacuacugccaacaauacuccuccuacccauacaccuucggccaaggcaccaaagucgaaaucaaacgcaccgucgcagcccccuccgucuucaucuucccacccucagacgagcaacucaaauccggcaccgccuccgucgucugccuccuaaacaacuucuacccccgcgaagccaaaguccaauggaaagucgacaacgcacuccaauccggcaacucccaagaauccgucaccgaacaagacucaaaagacuccaccuauucacuauccuccacccuaacccucuccaaagccgacuacgaaaaacacaaagucuacgccugcgaagucacccaccaaggccucuccucccccgucaccaaauccuucaaccgaggcgaaugc

SEQ ID NO: 53739 - RNA, 1338 nt, Artificial Sequence
  derived and/or modified sequence opt11 from Emactuzumab_HeavyChain1
caaguccagcuaguccaaucaggcgccgaagucaagaaacccggagcuagcgucaaagucagcugcaaagccuccggauacaccuucaccucauacgacaucuccuggguccgacaagcccccggccaaggacucgaauggauggguguaaucuggaccgacggaggcaccaauuacgcccagaaacuucaaggccgcgucaccaugaccaccgacaccuccacuagcacagccuacauggaacuccgaucccuccgaucugacgacaccgccgucuauuacugcgcucgagaccaacgacucuauuuugacguauggggccaaggaaccacagucacagucagcuccgccuccaccaaaggucccucagucuucccccucgcucccuccuccaaaucaacauccggcggcaccgcagcccuaggaugccucgucaaagacuacuuccccgaaccaguaaccgucuccuggaacuccggagcacucacauccggaguccacaccuuccccgccguacuacaaucauccggccucuacucacuauccuccgucguaaccguaccaucaucaucccuuggcacccaaacauacauaugcaacguuaaccacaaacccucaaacaccaaagucgacaagaaagucgaacccaaaucaugcgacaaaacccacacaugcccucccugccccgcccccgaacuccucggcggccccagcgucuuccucuucccacccaaaccaaaagacacccucaugaucucacgcacccccgaagugaccugcgucgucgucgacgucagccacgaagauccugaagucaaauucaacugguacgucgacggcgucgaaguccacaacgccaaaaccaaaccccgagaagaacaauacaacucaaccuaccgcguaguauccgugcucaccguccuccaccaagacuggcuuaacggaaaagaauacaaaugcaaaguaucaaacaaagcccucccagcuccaaucgagaaaacaaucuccaaagccaaaggacaacccagagaaccacaaguauacacccucccgcccucccgcgacgaacucacuaaaaaucaggucagccuaaccugccucguaaaagguuuuuaccccuccgacauagccgucgaaugggaaucaaacggccaaccagaaaacaacuacaaaaccacucccccuguccuagacucagacggcuccuuuuuccuauacuccaaacucaccguagacaaaucccgauggcaacagggcaacgucuucagcugcuccgucaugcacgaagcccuacacaaccacuacacccaaaaaucccucucacucuccccaggcaaa

SEQ ID NO: 53740 - RNA, 639 nt, Artificial Sequence
  derived and/or modified sequence opt11 from Emactuzumab_LightChain1
gacauccaaaugacccaaucccccuccucccucuccgccucagucggcgaccgcgucacaaucacaugccgagccuccgaagacgucaacaccuacguauccugguaccaacaaaaacccggaaaagcccccaaacuacucaucuacgccgccuccaaccgcuacaccggcguccccucccgcuucucaggcucaggcuccggcaccgacuucacccucaccaucucaucccuccaacccgaagacuucgccaccuacuacugccaacaauccuucuccuaccccaccuucggccaaggaaccaaacucgaaaucaaacgcaccgucgccgcccccuccgucuucaucuucccgcccucagacgaacaacucaaauccggcaccgcaucugucgucugccuccucaacaacuucuacccccgugaagccaaaguccaauggaaagucgacaacgcccuccaauccggcaacucacaagaaucagucaccgaacaagacucaaaagacuccaccuacucacucuccuccacccucacccucuccaaagccgacuacgaaaaacacaaagucuacgcaugcgaagucacccaccaaggccuauccucccccgucaccaaauccuucaaccgcggcgaaugc

SEQ ID NO: 53741 - RNA, 1323 nt, Artificial Sequence
  derived and/or modified sequence opt11 from Emibetuzumab_HeavyChain1
caaguccagcucguccaaucaggagccgaaguaaagaaacccggcgccucagucaaagucucaugcaaagcaucaggcuacaccuucaccgacuacuacaugcacugggugagacaggcccccggacaaggccuagaauggauggggcgaguaaacccaaaccgccgcggcaccacauacaaccaaaaauucgagggccgcgucaccaugacgaccgacaccucaacaagcacagcauacauggaacuccgaucccuccgcagcgacgacaccgccgucuacuacugcgcacgcgcaaacuggcucgacuacuggggacaaggcaccaccgucaccgucucauccgccuccacaaaaggcccauccguauucccgcuagcacccugcucccgcagcaccucagaaagcacagccgcacucggcugccuagucaaagacuacuucccagaaccggugaccgucucauggaacuccggcgcacucaccucaggaguacacaccuuccccgccguacuccaauccuccggccuguacucucuaucguccgucguaacagucccguccuccagccuaggaaccaaaacuuacacaugcaacgucgaccacaaaccauccaacaccaaagucgacaaacgcgucgaauccaaauacggucccccaugcccucccugccccgccccugaagcagccggcggccccucagucuuccucuucccacccaaacccaaagacacccucaugaucucaagaacccccgaaguuaccugcgucgucguagacguaagccaagaagaccccgagguccaauucaacugguacgucgacggcgucgaaguccacaacgccaaaaccaaaccccgcgaagaacaguucaacuccaccuaccgagucguuuccgucuuaacagugcuccaccaagacuggcucaacgggaaagaauacaaaugcaaagucuccaacaaaggccuacccuccucaaucgagaaaaccaucucaaaagcaaaaggacaaccccgcgaaccacaggucuacacccuaccacccucccaagaagaaaugaccaaaaaccaagucucccucacuugccuugucaagggcuucuaccccuccgacaucgcagucgaaugggaauccaacggccaacccgaaaacaacuacaaaaccacacccccaguccuggacuccgacggauccuucuuccucuacucccgccucacugucgacaagucacgauggcaggaaggcaacgucuucagcugcuccgucaugcacgaagcccuacauaaccacuacacccagaaaucccucucucuaucucucggc

SEQ ID NO: 53742 - RNA, 645 nt, Artificial Sequence
  derived and/or modified sequence opt11 from Emibetuzumab_LightChain1
gacauccaaaugacccaaucccccuccucccuuucagccuccgucggcgaccgcgucaccaucaccugcuccgucuccuccucagucuccuccaucuaccuacacugguaccaacaaaaacccggcaaagcccccaaacuccucauauacuccaccucaaaccucgccucuggcguccccucccgauucuccggcuccggcuccggcacagacuucacccucaccaucuccucccuacaacccgaagacuucgccaccuacuacugccaagucuacuccggcuacccccucaccuucggcgguggcaccaaagucgaaaucaaacgcaccguagccgcccccuccgucuucauauucccccccucagacgaacaacucaaauccggcaccgccuccgucgucugccuacuaaacaacuucuacccccgagaagccaaaguccaauggaaagucgacaacgcucuccaaucaggaaacucccaagaauccgucaccgaacaagacucaaaagacuccacauacucccucuccuccacccucacccucuccaaagccgacuacgaaaaacacaaagucuacgccugcgaagucacccaccaaggccucucaucccccgucaccaaaucauucaaccgcggcgaaugc

SEQ ID NO: 53743 - RNA, 1344 nt, Artificial Sequence
  derived and/or modified sequence opt11 from Emicizumab_HeavyChain1
caaguacaacucgucgaaucaggaggaggccugguccagccuggaggaucccuccgccucucaugcgcggcauccggauucaccuucagcuacuaugacauacaauggguccgccaagcccccggcaaaggccuagaaugggucucaagcaucagcccgagcggacaguccacauacuaucgcagggaagugaagggccgguucacaauaucacgcgacaacuccaaaaacacacuauaccuccaaaugaacucacuacgggcagaagacacagccguauacuacugcgcccgcagaaccggccgcgaguacggaggcggaugguacuucgacuauuggggccagggcacccuagucacagucagcuccgccucgaccaaagggcccagcgucuucccacucgcccccuguucccgauccaccuccgagagcaccgccgcacuaggaugccucgucaaagacuauuuccccgaacccgucacaguaucauggaacucaggcgcccuaaccuccggcguacacaccuuucccgccguacuacaaagcucaggccucuacucccucucauccgucgucaccguacccagcucgucacugggcacccaaacauauaccugcaacgucgaccacaaacccucgaacaccaaagucgacaaacgaguugaauccaaauacggcccacccugcccacccugccccgcccccgaguuccuaggcggaccguccguauuccuauuucccccaaaaccaaaagacacacuaaugaucucccgcacccccgaaguaaccugcgucgucgucgacgucucacaagaagaccccgaaguccaauucaacugguacgucgacggaguggaaguccacaacgcuaaaacaaaaccucgggaagaacaauacaacuccaccuaccgcguagucuccguccugacaguccuccaccaagacuggcuaaacggcaaagaauacaaaugcaaagucucaaacaaaggccuaccuuccuccauagagaaaaccauauccaaagccaaaggccaaccccgcgaaccacaaguauacacacuacccccaucacaaaaagaaaugaccaaaaaucaagucucccuaacaugccucguaaaaggcuucuaccccagcgacaucgcagucgaaugggaauccaacggccaacccgagaacaacuacaaaacaacacccccaguccuagacuccgacggcagcuucuuccuuuacuccaaacuaaccgucgacaaaagccgcuggcaagaaggaaacgucuucucaugcuccguuaugcacgaagccuugcacaaccgcuacacccaaaaaucccucucacucuccccc

SEQ ID NO: 53744 - RNA, 1332 nt, Artificial Sequence
  derived and/or modified sequence opt11 from Emicizumab_HeavyChain2
caaguacaacucguacaauccggcuccgaacuaaagaaacccggcgccucagucaaagucuccugcaaagccuccggcuacacauucacugacaacaacauggacuggguccgccaggcucccggccaaggacucgaauggaugggcgacauuaacacccguucuggcggcucaaucuacaacgaagaauuucaagaccgagucaucaugacaguagacaaauccaccgauaccgcauacauggaacucuccucccuccgcuccgaagacacagccaccuaccacugcgcacgccguaaaucauacggauacuaucuagaugaauggggagaaggcacacucgucaccguaucauccgcauccaccaaaggccccucagucuucccacucgcccccugcucccgaucaaccucagaaagcacagccgcacuuggcugccucgucaaggacuacuucccagaacccgucaccgucuccuggaacucaggcgcacucacauccggcguccacaccuuccccgccguacuacaaagcucaggacuguacucacucuccucagucgucaccgucccaucauccagccucggcacccaaaccuacacaugcaacgucgaccacaaaccauccaacacaaaagucgacaaacgcguagaaucaaaauacggcccaccaugcccucccugccccgcacccgaguuccucggcggccccuccguauuccucuucccacccaaacccaaagacacccuuaugaucucccgcacccccgaaguuacaugcgucgucgucgauguaucucaagaagaccccgaaguccaauucaacugguacguagacggcgucgaaguacacaacgccaaaacaaaacccagggaagaacaauacaacuccaccuaucgagucgucuccguccuuacaguccuacaccaagacuggcucaauggcaaagaauacaagugcaaagucuccaacaagggccuccccuccagcaucgagaaaaccaucuccaaagccaaaggacaaccccgagaaccccaagucuauacccucccacccucacaagaagaaaugaccaaaaaccaagucucccucacaugccuaguaaaaggcuucuaccccuccgacaucgcagucgaaugggaauccaacggacaacccgaaaauaacuacaaaaccacaccuccaguccucgacagcgacggcagcuucuuccuguacuccaaacuaaccgucgauaaaucccgcuggcaggaaggcaacgucuucagcugcucugucaugcacgaagcccuacacaaccacuacacccaggaaucccucagccuauccccc

SEQ ID NO: 53745 - RNA, 642 nt, Artificial Sequence
  derived and/or modified sequence opt11 from Emicizumab_LightChain1
gacauccaaaugacccaaucacccuccagccuauccgcaagcgucggagaccgcgucaccauaaccugcaaagccucccgaaacaucgaacgacaacucgccugguaccaacaaaaacccggccaagcccccgaacuccuaaucuaccaagccagccgaaaagaauccggcguccccgaccguuucucaggcucccgcuacggcaccgacuucacccuaaccaucagcucccuccaacccgaagacaucgccacauacuacugccaacaauacuccgacccgccccucaccuucggcggcggcaccaaagucgaaaucaaacgcacagucgccgccccguccgucuucaucuucccacccuccgacgaacaacuaaaauccggcacagccuccgucgucugccuccucaacaacuucuacccccgugaagccaaaguccaauggaaagucgacaacgcccuccaauccggcaacucccaagaauccguaaccgaacaagacagcaaagacuccaccuacucccucuccuccacccucacccucuccaaagccgacuacgaaaaacacaaaguauacgcaugcgaagucacccaccaaggccuaagcucccccgucaccaaauccuucaaccgcggcgaaugc

SEQ ID NO: 53746 - RNA, 1347 nt, Artificial Sequence
  derived and/or modified sequence opt11 from Enavatuzumab_HeavyChain1
gaaguccaacuugucgaauccggaggcggccucguacagccaggcggcucccuacgccuaucaugcgccgccuccggcuuuaccuucuccagcuacuggaugucauggguccgucaggcccccggcaaaggccucgaaugggucgccgaaauccgacuaaaauccgacaacuaugccacacacuacgccgaaucggucaaaggccgauucaccaucagccgugacgacuccaaaaacucccucuaccuccaaaugaacucucuccgcgcagaagacacugccgucuacuacugcaccggauacuacgccgacgccauggacuauuggggacagggcacucugguaacuguaagcuccgccucaacgaaaggacccuccgucuucccccucgcccccuccuccaaauccacuuccggcggcaccgccgcccuaggaugccucguaaaagacuacuuccccgaaccuguuaccguuuccuggaacucaggcgcccucaccucgggcguccacaccuuucccgccguccuacaaagcuccggccucuacucacuauccucagucgucaccguacccuccagcucacucggaacccaaacauacaucuguaacgucaaccacaaaccaucaaacacaaaaguugacaaaaaagucgaacccaaaaguugcgacaaaacacauaccugcccccccugccccgcccccgaacuccuaggcggaccuucagucuuccuauucccccccaaacccaaagacacccucaugaucagccgcaccccagaagucacaugcgucgucguugacgucagccacgaagaccccgaagucaaauucaacugguacguagacggcgucgaaguacacaacgccaaaacaaaaccccgagaagaacaauacaauuccaccuacagaguagucuccguccuaaccguacuacaccaagacuggcucaacggcaaagaauacaaaugcaaagucuccaacaaagcccuccccgcacccaucgaaaaaaccauuuccaaagcaaaaggccaacccagagaaccacaggucuacacacuccccccaucccgagaagaaaugaccaaaaaucaagucucccucaccugccucguaaaaggcuucuaccccuccgacaucgccgucgaaugggaauccaacggccaaccagaaaacaacuacaaaacaaccccaccuguccucgauuccgacggaucauucuuccuauacuccaagcucaccguagacaaaucacgcuggcaacaaggaaacguauucuccugcuccguaaugcacgaagcgcuacacaaccacuacacccagaaaucccuaucccuaucaccaggcaaa

SEQ ID NO: 53747 - RNA, 654 nt, Artificial Sequence
  derived and/or modified sequence opt11 from Enavatuzumab_LightChain1
gacauccaaaugacacaaucgcccucaucccucagcgccuccgucggcgaccgcguaaccauaaccugccgagccagccaauccgucagcacaagcucauacucauacaugcacugguaccaacaaaaacccggcaaagcacccaaacucuuaaucaaauacgccuccaaccuagagagcggcgucccaagccgauucuccggcucaggcucaggcaccgacuucacccucaccaucagcucccuccagcccgaagacuucgccaccuacuacugccaacacuccugggaaauccccuacacauucggcggcggcaccaaagucgaaaucaaacgcaccgucgcagcccccuccguguucaucuucccacccuccgacgaacaacucaaaucaggcaccgccuccgucgucugccuacucaacaacuucuacccccgcgaagccaaaguccaauggaaaguagacaacgcacuccaauccggcaacucacaagaauccguaaccgaacaagauuccaaagacucaaccuacucccuguccucaacccuaacccuauccaaagccgacuacgaaaaacacaaaguauacgcaugcgaagucacccaccaaggccucuccucaccagucaccaaauccuucaacagaggcgaaugc

SEQ ID NO: 53748 - RNA, 1341 nt, Artificial Sequence
  derived and/or modified sequence opt11 from Enfortumab_HeavyChain
gaaguccagcuuguagaauccggcgguggacucguccaaccaggcggcucccuacgccucuccugcgccgccuccggcuucaccuucuccuccuacaacaugaacuggguccgccaagcccccggaaagggccucgaauggguaucauacauauccuccuccuccuccaccaucuauuacgcagacuccgucaaaggacgcuucacgauaucccgggacaacgcuaaaaacagccugucccuccaaaugaacucauuacgcgacgaagacaccgcaguuuacuacugcgcacgcgccuacuacuacggcauggacgucuggggccaggguacuacuguaaccgucuccuccgcauccaccaaaggacccagcgucuucccccucgcccccuccuccaaauccaccucaggcggcaccgccgcacucggcugccucgucaaagacuacuucccagagccaguuaccgucagcuggaacuccggugcgcucacauccggcguccacacauucccagcaguacuccaauccuccggccuuuacucccucuccuccguugucaccguucccuccuccagccuuggcacacaaacauacaucugcaaugucaaccacaaacccucuaacaccaaaguggacaaaagagucgaacccaaauccugcgauaaaacccacacaugcccacccugccccgcaccagaacuccucggcgggccaucaguauuccucuucccacccaaacccaaagacacccucaugauaucuagaacccccgaagucacaugcgucguagucgacguaagccacgaagacccagaagucaaauucaacugguacgucgacggugucgaaguccacaacgcaaaaaccaaaccacgcgaagaacaauacaauucaacauaccgcgucgucucaguacucaccguccuccaccaagacuggcucaacggcaaagaauacaaaugcaaaguauccaauaaagcucuaccugcacccaucgagaaaaccaucuccaaggccaaaggccaaccccgugaaccccaggucuauacccuucccccaucccgcgaagaaaugaccaaaaaccaagucucacuaaccugccucguaaaaggcuucuacccauccgacauagccguagaaugggaauccaacggacaaccagaaaacaacuacaaaaccacacccccaguccucgacucagacgguuccuucuuccucuacucgaagcucaccgucgauaaaucacgcuggcaacagggcaacgucuucuccugcuccgucaugcacgaagcccuccacaaccacuauacccaaaaaucacuaagccuaucucccggaaaa

SEQ ID NO: 53749 - RNA, 642 nt, Artificial Sequence
  derived and/or modified sequence opt11 from Enfortumab_LightChain
gacauccaaaugacccaauccccaucauccgucuccgccuccgucggcgaccgcgucaccaucacuugccgcgccucccaaggcaucuccgguuggcucgcaugguaccaacaaaaacccggcaaagcccccaaauuccucaucuacgccgccuccacccuacaauccggcguccccucccgcuucuccggcuccggcucaggcaccgacuucacccuaaccaucuccucacuccaacccgaagacuucgccaccuacuacugccaacaagccaacuccuucccacccaccuucggcggcggcaccaaagucgaaaucaaacgcaccguagcagcccccuccguauucaucuucccucccuccgacgaacaacuaaaaucaggcaccgccuccgucgucugccuucucaacaacuucuacccccgcgaagccaaaguccaauggaaagucgacaacgcauuacaauccggaaacucacaagaauccgucaccgaacaagacuccaaagacucaaccuacucccucucuucuacccucacccucuccaaagccgacuacgaaaaacacaaagucuacgccugcgaggucacccaccaaggccucuccucacccgucaccaaauccuucaaccgaggagaaugc

SEQ ID NO: 53750 - RNA, 1341 nt, Artificial Sequence
  derived and/or modified sequence opt11 from Enfortumab_vedotin_HeavyChain1
gaaguacaacucgucgaauccggcggcggccucguacaacccggcggcucguuacgccucuccugcgccgccuccggauucaccuuuucaagcuauaacaugaacugggucagacaagcacccgguaaaggccucgaauggguauccuacaucagcagcuccaguucuaccaucuacuacgcagauucgguuaaaggccgcuucaccauuucccgcgacaacgccaaaaauucacucucccuccaaaugaacucacuccgcgacgaagacacugccgucuacuacugcgccagagccuacuacuacggcauggacgucuggggacaaggcaccaccgucaccguaucaucugccuccaccaaagguccaucagucuucccccucgcccccuccuccaaauccaccagcggaggcaccgccgcccucggcugccucguaaaagacuacuuucccgaaccggucaccguaucauggaacuccggcgcccucaccuccggcguucacaccuuuccugccguucuccaaucauccgggcuuuacucacucaguuccgucguaaccguucccuccuccucccucggcacucaaacguacauaugcaacgucaaccacaaaccaucaaacaccaaagucgacaaacgugucgaacccaaaagcugcgacaaaacccauaccugcccacccugccccgccccagaacuccuaggcggccccuccguauuccuuuucccuccaaaacccaaagacacccuuaugaucucccgcaccccagagguaaccugcgucgucgucgacgucucccacgaagaccccgaagucaaauucaacugguacgucgacggcgucgaaguccacaacgcaaaaaccaaaccacgugaagaacaauacaacuccacauaccgagucgucuccguucucaccguccuccaccaagacuggcuaaacgguaaagaauacaaaugcaaaguaagcaacaaagcccuucccgcucccaucgagaaaaccaucuccaaagcaaaaggacaaccccgcgaaccccaagucuauacccucccacccucgagagaagaaaugacuaaaaaccaaguaucccuuaccugccucgucaaaggcuucuaccccuccgacaucgcagucgaaugggaaucuaauggccaacccgaaaacaacuacaaaaccacaccacccgugcucgacucggacggcuccuuuuuccucuacuccaaacucaccguugacaaaucccgcuggcaacaaggcaacgucuucuccugcuccguaaugcacgaggcacuucacaaccacuauacccagaaaucccucucccucucccccgguaaa

SEQ ID NO: 53751 - RNA, 642 nt, Artificial Sequence
  derived and/or modified sequence opt11 from Enfortumab_vedotin_LightChain1
gacauccaaaugacacaaucccccuccuccgucuccgccucagucggcgaccgcgucaccauaaccugccgcgccucccaaggcaucuccggcuggcuagccugguaccaacaaaaacccggaaaagcccccaaauuccucaucuaugccgcaucaacccuccaaagcggcguccccucccgcuucuccggaucaggcucaggcaccgacuucacccuaaccaucucaucccuccaacccgaagacuucgccacauacuacugccaacaagcaaacucauucccacccaccuucggcggcggcaccaaagucgaaaucaaacgcacagucgccgcccccuccguauucaucuucccacccuccgacgaacaacucaaaucaggcaccgccuccgucgucugccuccucaacaacuucuacccccgcgaagccaaaguccaauggaaagucgacaacgcccuccaaagcggaaacucucaagaaagcguaaccgaacaagacuccaaagacuccaccuacucccucuccuccacccucacccuauccaaagccgacuacgaaaaacacaaagucuacgccugcgaagucacccaccaaggccuauccucccccgucaccaaauccuucaaccgaggcgaaugc

SEQ ID NO: 53752 - RNA, 1356 nt, Artificial Sequence
  derived and/or modified sequence opt11 from Enoblituzumab_HeavyChain
gaaguacaacucguagaaucagguggaggccucguccaacccggcggcucccuccgacucucaugcgccgccuccggauucaccuucucguccuucggaaugcacuggguccgccaagccccaggcaaaggucucgaauggguagccuacaucucaucugacuccuccgcaaucuauuacgccgacaccgucaaaggccgauucacuauaucccgcgacaacgccaaaaacucacucuaccuacaaaugaacucacuccgcgacgaagacaccgccgucuacuacugcggccgcggucgagaaaacauauacuacggcagccgccucgacuauuggggacaaggaaccaccguaaccgucuccucagccucaaccaaaggaccaucugucuucccccucgccccuuccucaaaauccacuagcggcggaaccgccgcacucggcugccuagucaaagauuacuuccccgagcccgucaccguaucauggaacuccggugcccucaccuccggaguacacaccuuccccgccguccuccaauccagcggccucuacucccuuuccuccgucgucaccgugccuucaagcucacuaggcacccaaaccuacaucugcaacguaaaccacaaacccuccaacaccaaagucgauaaacgcgucgaacccaagagcugcgacaaaacacacacaugcccucccugccccgcuccagaacucgucggcggcccaagcgucuuccuacuaccacccaaacccaaagacacacucaugaucucacgcacacccgaaguaaccugcgucgucgucgacgucucccacgaagacccagaaguaaaauuuaacugguacgucgacggcguggaaguccacaacgccaaaaccaaaccacccgaagaacaauacaacucaacccuccgcgucgucuccguccugaccgucuuacaccaagacuggcucaacggcaaagaauacaaaugcaaagucuccaacaaagccuuacccgcacccaucgaaaagaccaucucuaaagccaaaggccaaccccgcgaaccccaagucuacacccuaccacccucacgagaagaaaugaccaaaaaccaagucucccucacaugccucgucaaaggcuucuaccccuccgauaucgccgucgaaugggaaucaaacggccaacccgaaaauaacuacaaaacaaccccacucguccucgacucugacggauccuucuuucucuacagcaaacuuaccgucgacaaaucccgcuggcaacaaggcaacguauucuccugcuccguaaugcacgaagcccuacacaaccacuacacccagaaaucccucucccucucacccggcaaa

SEQ ID NO: 53753 - RNA, 642 nt, Artificial Sequence
  derived and/or modified sequence opt11 from Enoblituzumab_LightChain
gacauccaacucacccaaucacccuccuuccucuccgccuccguaggcgaccgcgucacaaucaccugcaaagccagccaaaacgucgacaccaacgucgccugguaccaacaaaaacccggaaaagcacccaaagcccucaucuacuccgccuccuaccgcuacuccggcguccccucccgcuucucaggcuccggauccggcacagacuucacccucaccaucuccucucuccaacccgaagacuucgccaccuacuacugccaacaauacaacaacuaccccuucaccuucggacaaggcaccaaacuagaaaucaaacgcaccgucgcagcccccucagucuucauauucccccccuccgacgaacaacucaaauccggcaccgccuccgucguaugccuccucaacaacuucuacccccgcgaagccaaaguccaauggaaagucgacaacgcccuccaauccggaaacucccaagaauccgucaccgaacaagacuccaaagacuccaccuacagccucuccuccacccucacacucucaaaagccgacuacgaaaaacacaaagucuacgcaugcgaagucacccaccaaggccucuccucccccgucaccaaaucuuucaaccgcggcgaaugc

SEQ ID NO: 53754 - RNA, 1356 nt, Artificial Sequence
  derived and/or modified sequence opt11 from Enokizumab_HeavyChain1
caaguacaacucguccaaucuggugccgaggucaagaaaccaggcucauccgucaaagucuccugcaaagccagcggcggaaccuucuccuacuacuggauagaaugggucagacaggccccaggacaagggcucgaauggaugggcgaaauccuacccggaucaggcacaaccaaccccaacgaaaaauucaaaggccgcgucaccaucaccgccgacgagucgaccuccacagccuacauggaacuaucaucacuccgcuccgaagacaccgccguauacuacugcgccagagccgacuacuacggcagcgacuacgucaaauucgacuacuggggacaaggaacccuagucaccgucagcucagccuccaccaaaggaccaucaguauucccacucgcccccuccucaaaaucaaccucuggcggcaccgccgcccucggcugccuugucaaagacuacuuccccgaaccagucaccgucuccuggaacucaggagcacucacaagcggcguccacacuuuccccgccguccuacaauccuccggucucuacucccuguccucagucguaaccguacccuccagcucccucggcacacaaaccuacaucugcaacgucaaccacaaacccagcaauaccaaagucgacaaacgaguagaaccuaaguccugcgacaaaacccacacaugcccacccugccccgcccccgaacuccuaggaggccccucaguauuccucuucccacccaaacccaaagacacucuaaugauaucccgcacccccgaagugaccugcgucgucgucgacguaucccacgaagauccagaagucaaauucaauugguacgucgacggagucgaaguccacaacgcgaagacaaaaccccgcgaagaacaauacaacucaaccuaucgcguugucagcguccucacaguccuacaccaggacuggcucaacgguaaagaauacaaaugcaaaguauccaacaaagcccuccccgccccaauagaaaagacuauaucaaaagccaaaggucaaccccgagaaccacaaguauacaccuuaccacccucccgcgaagaaaugaccaaaaaccaggucucacuaaccugccucguaaaaggauucuaccccuccgacaucgccguagaaugggaaucaaacggccaaccagaaaacaacuacaaaaccacacccccaguacucgacuccgacggcuccuucuuccucuacuccaaacugaccgucgacaaaucccgcuggcaacaaggcaacguuuucagcugcuccgucaugcacgaagcccuacacaaccacuauacccaaaaaucacucucccuguccccaggcaaa

SEQ ID NO: 53755 - RNA, 642 nt, Artificial Sequence
  derived and/or modified sequence opt11 from Enokizumab_LightChain1
gacauccaaaugacccaaucccccuccucccucuccgccuccgucggcgaccgcgucaccaucacaugcaaagccucccaacacguaaucacccacgucaccugguaccaacaaaaacccggcaaagcacccaaacuccuaaucuacggcaccuccuacuccuacuccggaguccccucccgauucucaggcuccggcuccggcaccgacuuuacccuuaccaucuccucccuccaacccgaagacuuugccaccuacuacugccaacaauucuacgaauacccccucacauucggcggcggcaccaaagucgaaaucaaacgcacagucgccgcccccuccgucuucaucuucccacccuccgacgaacaacuaaaauccggcaccgccucagucgucugccuccucaacaacuucuacccccgcgaagccaaaguccaauggaaagucgacaacgcccuccaauccggcaacucacaagaauccgucaccgaacaagacuccaaagacuccaccuauucccucuccucaacccucacccucuccaaagccgacuacgaaaaacacaaagucuacgcaugcgaagucacacaccaaggccuauccucccccgucaccaaauccuucaaccgcggcgaaugc

SEQ ID NO: 53756 - RNA, 612 nt, Artificial Sequence
  derived and/or modified sequence opt11 from Enokizumab_LightChain
gacauccaaaugacccaaucccccuccucccucuccgccuccgucggcgaccgcgucaccauaaccugcaaagccucccaacacgucaucacccacgucacaugguaccaacaaaaacccggcaaagcccccaaacuccuuaucuacggcaccuccuacuccuacuccgguguccccucccgcuucuccggcuccggcuccggcaccgacuucacccucaccaucuccucccuccaacccgaagacuucgccaccuacuacugccaacaauucuacgaauacccccuuaccuucggcggcggcaccaaagucgaaauaaaacgcaccgucgccgcccccuccgucuucaucuucccacccuccgacgaacaacucaaauccggcacagccuccguagucugccuacuuaacaacuucuauccccgcgaagccaaaguccaauggaaagucgaauccguaaccgaacaagacuccaaagacucaaccuacucucucuccucaacccucacccucuccaaagccgacuacgaaaaacacaaaguauacgccugcgaaguaacccaccaaggccucuccucccccgucaccaaaucauucaaccgcggcgaaugc

SEQ ID NO: 53757 - RNA, 1356 nt, Artificial Sequence
  derived and/or modified sequence opt11 from Enoticumab_HeavyChain1
caaguccaacucguagaauccggcggcggcguaguccaaccaggucgcagccuccgccuaucaugcgccgcuuccggcuucaccuucuccucauacggcaugcacuggguacgccaagcucccggcaaaggacucgaauggguaucauuucuaugguaugacgggaccaacaaaaacuaugucgaaagcguaaaaggacgauuuaccaucucacgagacaauuccaaaaacaugcucuaccucgaaaugaacucacuccgcgcugaagacaccgccgucuacuacugcgcacgagaccacgacuuccgcuccggcuacgaaggaugguucgacccguggggccaaggcacccucgucaccgucucauccgcaucuaccaaaggcccuuccgucuucccccucgcccccuccuccaaauccaccaguggcggcaccgccgcccuaggcugccucgucaaagacuacuuccccgagcccgucaccguaagcuggaacucaggagcccucacuucaggcguccacaccuuccccgcuguccuucaauccuccggccuauacucacuaagcucagucgucaccgucccauccuccucccucgguacccaaaccuacauaugcaacguaaaccauaaaccuucaaacaccaaagucgacaaaaaagucgaacccaaaaguugcgacaaaacccacacaugccccccaugucccgccccagaacuccuaggcggcccaagcgucuuccuauucccacccaaacccaaagacacacucaugaucucccgcacccccgaaguaaccugcgucgucgucgacguaucccacgaagaccccgagguaaaauucaacugguacgucgacggagucgaaguccacaacgccaaaacaaaaccccgcgaagaacaauacaacucgaccuaucguguagucucaguccucaccguccuccaccaggacuggcucaacggcaaagaauacaaaugcaaagucucuaacaaagcccuacccgcaccaaucgaaaaaaccauaagcaaagccaaaggccaaccacgagaaccacaagucuacacccucccccccagccgcgacgaacucacaaaaaaccaagucucccuuacaugccuugucaaaggcuuuuaccccuccgacaucgcagucgaaugggaaucgaacggccaacccgaaaacaacuacaaaaccaccccaccaguacucgacuccgacggaucauucuuccuuuacuccaaacuaaccgucgacaaaucucgcuggcaacaagggaacguauucuccugcuccgucaugcacgaagcccuucacaaccacuacacacaaaaaucacucucacucucaccaggc

SEQ ID NO: 53758 - RNA, 642 nt, Artificial Sequence
  derived and/or modified sequence opt11 from Enoticumab_LightChain1
gaaaucguacucacccaaucgcccgcaacccuaucccuaagccccggcgaacgcgccacccucagcugccgcgcaagccaaagcguauccucguaccuagccugguaccaacaaaagcccggccaagcacccagacuacucaucuacgacgcaagcaaccgcgcaaccggaaucccagcccgcuucucaggcucaggcucaggcacagacuucacccucaccauauccucacucgaacccgaagacuucgccgucuacuacugccaacacaggagcaacuggccacccacauucggaggcggaaccaaagucgaaaucaaacgcacagucgcagcccccagcgucuucauauucccacccuccgacgaacaacuaaaaucaggcaccgccuccgucguaugccuacucaacaacuucuacccacgcgaagccaaaguccaauggaaagucgacaacgcacuccaauccggaaacucacaagaaagcgucaccgaacaagacagcaaagacucuaccuacucccucuccucaacccuaacccucagcaaagccgacuacgaaaaacacaaagucuacgcaugcgaagucacccaccaaggccucagcucacccgucaccaaauccuucaacagaggcgaaugc

SEQ ID NO: 53759 - RNA, 1329 nt, Artificial Sequence
  derived and/or modified sequence opt11 from Ensituximab_HeavyChain1
caaguacaacucaaagaaucaggccccgaccucgucgcccccucgcaaagccuauccaucacuugcaccguaucaggauucucccuaucuaaauucggugucaacuggguaagacaaccacccggcaaaggucuagaauggcucggcguaauauggggcgacggcucgaccuccuacaacucaggccucaucucccgacucuccauauccaaagaaaacucaaaaucccaaguauuccucaaacucaacagccuccaagccgaugacaccgcaacauacuacugcguaaaacccggcggcgacuacuggggccacggaacauccgucaccgucuccuccgcgucaacaaaaggccccucagucuucccccucgcucccuccuccaaauccacauccggcgggaccgcagcccuaggcugccucguuaaagacuauuuccccgaacccguaaccgucuccuggaacuccggcgcacucaccuccggcgugcauacauuccccgccguccuacaaucuuccggccccuacucccuuuccuccgucguuacuguccccagcuccucccucggcacccaaaccuacaucugcaacgucaaccauaaacccuccaacaccaaggucgacaagaaagucgaacccaaauccugcgacaaaacccacacaugcccucccugccccgccccggaacugcucggaggccccuccguuuuccucuucccacccaaacccaaagacacccuuaugauaucacgaacccccgaaguaaccugcgucgucguagacgucucacacgaagacccagaagucaaauuuaacugguacguugacggugucgaaguccacaacgccaaaaccaaaccucgagaagaacaauacaacuccaccuacagagucgucuccguccuaaccguacuccaccaagacuggcuaaacggcaaagaguacaaaugcaaagucuccaacaaagcccuaccagcaccaaucgagaaaaccaucuccaaagccaaaggucaaccccgcgaaccccaagucuacacccuaccacccucacgcgacgaacucaccaaaaaccaagucucacucacuugccuugucaaaggcuucuaccccuccgacaucgccguagaaugggaaagcaacggccaacccgaaaacaacuacaaaaccaugccacccguacuagacucugacggcuccuucuuccucuacucuaaacucaccgucgacaaaucccgauggcaacaaggcaacgucuucuccugcucaguuaugcacgaagcccuccacaaccacuacacccaaaaaucccucucacucucccccggaaaa

SEQ ID NO: 53760 - RNA, 639 nt, Artificial Sequence
  derived and/or modified sequence opt11 from Ensituximab_LightChain1
caagucguccucacccaaucccccgucaucauguccgccucccccggcgaaaaagucacaaugaccugcuccgccuccucuuccaucuccuacauguacugguaccaacaaaaacccggcaccucccccaaacgcuggaucuacgacaccuccaaacuagccuccggcguccccgcccgcuucuccggcuccggcucaggcaccuccuacucccucaccaucucaaacauggaagccggcgacgccgccacauacuacugccaucaacgcgacuccuaccccuggaccuucggcggcggcaccaaccucgaaaucaaacgcaccgucgccgcccccuccguauucaucuucccacccucagacgaacaacucaaaucaggcacagccuccgucgucugccuccucaacaacuucuacccccgagaagccaaaguccaauggaaagucgacaacgcacuacaauccggcaacucccaagaaucagucacagaacaagacuccaaagacuccaccuacagccuauccuccacacuaacccucuccaaagccgacuacgaaaaacacaaagucuacgccugcgaagucacccaccaaggccucuccucccccgucaccaaaucuuucaaccgcggcgaaugc

SEQ ID NO: 53761 - RNA, 768 nt, Artificial Sequence
  derived and/or modified sequence opt11 from Ensituximab_SingleChain_variable_fragment
auggcggaagugcaacuggucgagagcggggccgaggucaagaaaccgggcgagagccuacgaauaagcugcaaagggagcgggugcauaaucucaagcuacuggauaagcugggucaggcaaaugcccgggaaagggcucgaguggaugggcaagaucgaccccggagacucauacauaaacuauagccccagcuuccaaggacacguaaccauaagcgcagacaaaaguauaaacacggccuaccuacaguggaacagcuuaaaagcaagcgacaccgccauguacuacugcgccaggggagggcgcgacuucggggacucguucgacuacuggggccagggcacccucguaaccgugagcucaggcggcggcgggagcggaggcgggggcucaggcggaggcggaagcgacgucgugaugacgcaaucaccaucguuccuaagcgcguucgugggcgaccgaauaaccauaaccugccgagcauccucgggaauaagcagguaccuggccugguaccagcaagcgcccgggaaagcacccaagcuccuaaucuacgcagcaagcacacuccaaaccggggucccgagcagguucucaggcucgggcucgggcacagaguucacacuaaccauaaacucacuccagccagaagacuucgccacauacuacugccagcaucugaacuccuacccacucacguucgggggcggaacaaaggucgauaucaagcgcgcagcugcgcuagaacaccaccaccaccaccac

SEQ ID NO: 53762 - RNA, 987 nt, Artificial Sequence
  derived and/or modified sequence opt11 from Entolimod_chain1
augcgcggaucacaccaccaccaccaccacggcauggccuccaugacaggcggccaacaaaugggccgcgaccuauacgacgacgacgacaaagacccaauggcccaaguaauaaacaccaacucccucagccuccucacccaaaacaaccucaacaaaucacaaagcucacucucauccgccaucgaacgccucucaucaggccuccgcauaaacuccgccaaagacgacgccgccggccaagcuaucgccaaccgcuucaccuccaacauaaaaggccucacccaggcuucccgaaacgcaaacgacggcaucagcaucgcacaaaccaccgaaggagcccuaaacgaaaucaacaacaaccuacaacgcguacgagaacuuuccguccaagccaccaacggaacgaacucagacagcgaccucaaauccauccaagacgaaauacaacaacgccucgaagaaaucgaccgagucucaaaccaaacccaauucaacggcgucaaaguccucucccaagacaaccaaaugaaaauacaagucggagccaacgacggcgaaaccaucacaaucgaccuccagaaaaucgacgucaaaucccucggacuugacggauucaacgucaacucccccggcauauccggcggcgggggaggcauccucgacucaaugggaacccuuaucaacgaagaugcagccgcagccaaaaagucaaccgcuaacccccucgccuccaucgacuccgcacuauccaaagucgacgccguccgaucaucacucggagccauacaaaaccgauucgacuccgccauuaccaaccucggaaacaccguuacaaaccuaaacuccgcccgaagccgaaucgaagacgccgacuacgcaacugaagucuccaacaugucaaaagcccaaauacuacaacaagccggcacaagcguauuagcccaagccaaccaagucccccaaaacguccuaucccuacuacgc

SEQ ID NO: 53763 - RNA, 1338 nt, Artificial Sequence
  derived and/or modified sequence opt11 from Epratuzumab_HeavyChain
caaguccaacugguccaauccggagcagaagucaagaaacccggcucauccgucaaaguauccugcaaagccuccggcuacaccuucaccucauacuggcuccacuggguccgacaggcccccggacaaggucucgaauggaucggcuacauaaacccccgaaacgacuacacagaauacaaccaaaacuucaaagacaaagccaccauuaccgccgacgaauccacaaacaccgccuacauggaacucuccagccuccgauccgaagacaccgccuucuacuucugcgcccgacgcgacaucaccacuuucuacuggggccaaggcacccuagucacagucucuagcgcaucaaccaaaggaccaagcgucuucccccuggcgcccucuuccaaaagcaccucuggcggcaccgccgcccucggcugccucgucaaagacuacuucccggaacccguaaccgucuccuggaacuccggcgcccucaccucagguguccacaccuuccccgccguccuccaauccuccggccucuacucacucuccuccgucgucaccguccccagcuccucccuuggcacacaaacauacaucugcaacgucaaccacaaacccuccaacaccaaaguggacaagaaaguugaacccaaaucaugcgauaaaacccacacaugcccuccaugcccggccccagaacuccuagguggcccaucuguuuuccucuuucccccaaaaccgaaagacacccuaaugaucagcagaaccccagaaguaaccugugucguagucgacgucagccacgaagaccccgaagucaaauucaacugguacguagacggcgucgaaguccacaacgccaaaaccaagccccgcgaagaacaauacaacucaacauaccgcguagucuccguccucacaguccuucaccaggacuggcuaaacggcaaagaauacaaaugcaaaguuuccaacaaagcacuucccgcccccaucgagaaaaccaucuccaaggccaaagggcaaccccgcgaaccgcaaguauacacccuacccccaucacgagacgaacucaccaaaaaccaaguaucacucacaugccucgucaaaggcuucuaccccuccgacauagcaguagaaugggaaucgaacggccaacccgaaaacaauuacaaaaccacacccccaguccucgacagcgacggguccuucuuccucuacagcaaacuuaccguagacaaaucccgauggcaacagggcaacguauucucgugcuccgucaugcacgaagcguuacacaaccacuacacccaaaaaucccucucacucucccccggaaaa

SEQ ID NO: 53764 - RNA, 657 nt, Artificial Sequence
  derived and/or modified sequence opt11 from Epratuzumab_LightChain
gacauccaacuaacccaaucccccuccucccucuccgccuccgucggcgaccgcgucaccauguccugcaaaucaucccaauccguccuuuacuccgcaaaccacaaaaacuaccucgccugguaccaacaaaaacccggcaaagcacccaaacuccucaucuacugggccuccacccgcgaaucaggcguccccucccgauucuccggcucaggauccggaaccgacuucaccuucaccauauccucccuccaacccgaagacaucgcaaccuacuacugccaccaauaccucuccucauggaccuucggccaaggcaccaaagucgaaaucaaacgcaccgucgccgcccccuccguauucaucuucccacccuccgacgaacaacucaaauccggaaccgcaagcgucgucugccuccucaacaacuucuacccccgagaagccaaaguccaauggaaagucgacaacgcccuccaauccggcaacucacaagaauccgucaccgaacaagacuccaaagacuccaccuacucccucuccucuacccucacccucuccaaagccgacuacgaaaaacacaaagucuacgccugcgaaguaacccaccaaggccucuccucccccgucaccaaauccuucaaccgcggcgaaugc

SEQ ID NO: 53765 - RNA, 762 nt, Artificial Sequence
  derived and/or modified sequence opt11 from Eptacog_beta_HeavyChain1
aucguaggcggcaaagucugccccaaaggagaaugccccuggcaaguccuccuccucgucaacggcgcccaacucugcggcggcacccucaucaacaccaucugggucgucuccgccgcacacugcuucgacaaaaucaaaaacuggcgcaaccucaucgccguacucggcgaacacgaccucuccgaacacgacggcgacgaacaaucccgccgagucgcccaagucaucauccccuccaccuacguacccggcaccaccaaccacgacaucgcccuccucagacuccaccaaccagucguccucaccgaccacguagucccccuaugccucccagaacgcacauucuccgaacgaacccuagccuucguccgcuucucccucguuuccggcuggggacaacuacuagaccgaggagccaccgcacuagaacucaugguccucaacguaccccgacuaaugacccaagacugccuacaacaaagccgcaaagucggcgacagccccaacaucacagaauacauguucugcgcaggcuacuccgacggcucaaaagacuccugcaaaggcgacagcggcggcccacacgcaacacacuaccgaggcaccugguaccuaaccggcauagucuccuggggccaaggcugcgccaccguaggccacuucggcgucuacaccagagucucccaauacaucgaauggcuccaaaaacucaugcgcucagaaccccgccccggcguacuccuccgcgcccccuucccc

SEQ ID NO: 53766 - RNA, 456 nt, Artificial Sequence
  derived and/or modified sequence opt11 from Eptacog_beta_LightChain1
gccaacgccuuccucgaagaacuacgccccggcucccucgaacgcgaaugcaaagaagaacaaugcuccuucgaagaagcccgcgaaaucuucaaagacgccgaacgaaccaaacucuucuggaucuccuacuccgacggcgaccaaugcgcauccucccccugccaaaacggcggcucaugcaaagaccaacuccaauccuacaucugcuucugccuccccgccuucgaaggccgaaacugcgaaacccacaaagacgaccaacucaucugcgucaacgaaaacggcggcugcgaacaauacugcuccgaccacaccggcaccaaacgaagcugccgcugccacgaaggcuacagccuccucgccgacggcgucuccugcaccccaacagucgaauaccccugcggcaaaauccccauacucgaaaaacgcaacgccucaaaaccccaaggccgc

SEQ ID NO: 53767 - RNA, 708 nt, Artificial Sequence
  derived and/or modified sequence opt11 from Erlizuab_HeavyChain1
gaaguccaacucgucgaauccggcggcggccuaguccaacccggcggcucccuccgccucucaugcgccaccuccggcuacacauucacugaauacacccacuggcgccaagcccccggaaaaggccucgaaugggucgccggcaucaacccaaaaaacggcggcaccucccacaaccaacgcuucgaccgcuucacuaucucagucgacaaauccacaucaaccgccuaccaaaacucccuacgcgccgaagacaccgccgucuacuacugugcccgauggcgaggccucaacuacggcuucgacguccgcuacuucgacgucuggggccaaggcacccuagucaccgucuccuccgccuccacaaaaggccccuccgucuucccccucgcccccucauccaaauccaccuccggcggcaccgccgcacucggcugccuagucaaagacuacuuccccgaacccguaacaguauccuggaacucaggcgcccucaccucaggcguccacaccuuccccgccguccuccaauccucaggccucuacucccucucauccgucgucaccguccccuccuccucccucggcacacaaacauacaucugcaacgucaaccacaaacccuccaacaccaaagucgacaaaaaagucgaacccaaaucaugcgacaaaacccacacuugcccccccugccccgcccccgaacuc

SEQ ID NO: 53768 - RNA, 639 nt, Artificial Sequence
  derived and/or modified sequence opt11 from Erlizuab_LightChain1
gacauccaaacccaaucccccuccucccucuccgcauccgucggcgaccgcgucaccauaaccugccgagccucccaagacaucaacaacuaccuaaacugguaccaacaaaaacccggcaaagcccccaaacuccucaucuacuacaccuccacacuccacagcggcguccccucccgcuucucaggcuccggcucaggcacagacuacacccucaccaucuccucccuccaaccagaagacuucgccaccuacuacugccaacaaggcaacacccucccacccaccuucggccaaggcaccaaagucgaaaucaaacgcacagucgccgcacccuccguauucaucuucccacccuccgacgaacaacucaaauccggcacagccuccgucgucugccuacucaacaacuucuacccccgcgaagccaaaguccaauggaaaguagacaacgcccuccaauccggcaacucccaagaauccgucaccgaacaagacuccaaagacucaaccuacucccuuuccuccacccucacccucuccaaagccgacuacgaaaaacacaaagucuacgccugcgaagucacccaccaaggccucuccucccccgucaccaaauccuucaaccgcggcgaaugc

SEQ ID NO: 53769 - RNA, 1341 nt, Artificial Sequence
  derived and/or modified sequence opt11 from Etaracizumab_HeavyChain1
caaguccagcuagucgaauccggaggcggagucguccaacccggccgcucacuacgccuaucuugcgcagccuccggauucacauucuccuccuacgacauguccuggguaagacaagcccccggcaaaggccuugaaugggucgcaaaagucuccucuggaggcggaucaacauacuaccucgacaccguccaaggccgauucaccaucucacgcgacaacuccaaaaacacccucuaccuacaaaugaacucccuacgagccgaggacacagccgucuauuacugcgcucgccaccuccacggcuccuucgcauccuggggccaaggcaccaccgucaccgucuccagugccuccacaaaaggacccucaguuuuuccccucgcccccucauccaaaucaaccuccggagguacagccgcacucggcugccucgucaaagauuacuucccagaacccgucaccguauccuggaacucaggcgcccucaccuccggaguacacacauuccccgccguacuccaaagcuccggucuauacagcuuauccuccgucgucaccguacccagcuccuccuuaggcacccaaaccuacaucugcaaugucaaccacaaaccaucuaauacuaaagucgacaaacggguagaacccaaauccugcgacaaaacccauaccugcccacccugcccagcccccgaacuccucggaggacccucagucuuccuauucccacccaaacccaaagacacccucaugaucucgcgaacccccgaaguaaccugcgucgucgucgacgucucccacgaagaccccgaagucaaauucaacugguacgucgauggcgucgaaguccacaacgccaaaacaaagccccgcgaggaacaauacaacucaaccuaccgcgucguuuccguccuuacuguccuccaccaggacuggcucaacggcaaagaauacaaaugcaaagucagcaacaaagcacuacccgcaccuaucgagaaaaccaucucaaaagccaaaggacaaccucgcgaaccccaaguauacacccucccaccaucccgagaagaaaugaccaaaaaccaaguaucucucacaugucucgucaaaggcuucuaccccuccgacaucgccgucgaaugggaaagcaauggccaacccgaaaacaacuacaaaaccacacccccaguccucgacuccgacggcuccuucuuccuauacuccaaacucaccguagacaaaucccgcuggcaacaaggaaacguuuucuccugcagcgucaugcacgaagcccuccacaaccacuacacgcaaaaaucccuaagccucuccccaggaaaa

SEQ ID NO: 53770 - RNA, 642 nt, Artificial Sequence
  derived and/or modified sequence opt11 from Etaracizumab_LightChain1
gaaaucguccuuacccaaucccccgccacccuaucccucucccccggcgaacgcgcaacccucucuugccaagccucccaauccaucuccaacuuccuccacugguaccaacaacgccccggccaagcuccccgccuccucauccgcuaccgcucccaauccaucuccggcauccccgcccgauucuccggcuccggcuccggcaccgacuucacccucacaaucuccucucucgaacccgaagacuucgccgucuacuacugccaacaauccggcuccuggccccucacauucggaggcggcaccaaagucgaaaucaaacgcaccgucgccgcccccuccgucuucaucuucccacccuccgacgaacaacucaaauccggcaccgccuccgucgucugccuacuaaacaacuucuacccccgagaagccaaaguccaauggaaagucgacaacgcccuccaaucaggcaacucccaagaauccgucacagaacaagacuccaaagacucgaccuacucccucagcuccacccucacccuguccaaagcagacuacgaaaaacacaaaguauacgccugcgaagucacccaccaaggccuauccuccccaguaaccaaauccuucaaccgcggcgaaugc

SEQ ID NO: 53771 - RNA, 1326 nt, Artificial Sequence
  derived and/or modified sequence opt11 from Etrolizuab_HeavyChain1
gaaguccaacuggucgaauccggcggcggccucguccaaccaggaggcucccuacgucuuucaugcgcagcauccggcuucuucaucaccaacaauuacuggggcuggguccgccaagccccuggcaaaggucuugaauggguaggauacaucagcuacucaggcuccaccagcuacaaccccucccuaaaaucccgcuucacaaucucgcgcgacaccuccaaaaacaccuucuaccuccaaaacucacuccgagccgaagacaccgccgucuacuacugcgcccgcacaggcuccucaggauacuucgacuucuggggccaaggcacccuaguaaccguaagcuccgccucuaccaaaggccccucugucuucccccucgcacccucaagcaaaucaaccucaggcggcacagccgcacucggcugucucgucaaagacuacuucccugaaccagucacugucuccuggaacuccggcgcccucacaagcggcguacacacuuucccggccguccuccaaucaagcggccuuuauucccucucgucggucgucaccguacccuccagcucacuuggcacacaaaccuacaucugcaacgucaaccacaaacccuccaacacaaaagucgacaagaaagucgaacccaaauccugcgacaaaacccauaccugcccacccugcccagcccccgaacuccucggcggaccuucagucuuccuuuucccacccaaaccuaaagauacccuaaucucccgcaccccagaagucacaugcgucguuguagacguuucccacgaagaccccgaaguaaaauucaacugguacgucgacggagucgaaguccacaaugccaaaacaaaaccccgugaagaacaauacaauuccacauaccgcgucguuuccguacucacaguacuccaccaagacuggcuaaacggcaaagaauacaaauguaaagucuccaacaaagcccuccccgcccccaucgagaaaaccaucuccaaagccaaaggccaaccacgagaaccccaagucuacacacuuccacccucacgcgaagagaccaaaaaccaagucucacucacuugccucgucaaaggcuucuaccccagcgacaucgcagucgaaugggaauccaacggccaaccagaaaacaacuauaaaacuaccccacccguccuagacuccgauggcagcuucuuccucuacuccaaacucacugucgacaaaucccgcuggcaacaaggcaacgucuucuccugcucaguccacgaagcacuccacaaccacuauacacaaaaaucccucagccucuccccaggc

SEQ ID NO: 53772 - RNA, 1326 nt, Artificial Sequence
  derived and/or modified sequence opt11 from Etrolizuab_HeavyChain2
gaaguucaacucguagaauccggcggcggacucguacaacccggcgguucgcuccgccucagcugcgcagccuccgguuucuucaucaccaacaacuacuggggcuggguacgacaagccccaggcaaaggccucgaauggguaggauacaucuccuacucaggcuccaccuccuacaaccccuccaaacuaucccgauucaccauaagccgcgacacauccaaaaacacauucuaccuccaaaacucccuccgagccgaagacacagcuguauacuacugcgcccgcacuggcuccuccggguacuucgacuucuggggccaaggcacucucgucacugucucaucagccuccaccaaaggccccucaguauucccccucgcuccauccucuaaauccaccuccggcggcaccgccgcacucggaugucucgucaaagauuacuucccagaaccagucaccgucagcuggaacuccggcgcccucaccucaggcguccacacauucccagcaguccuccaauccucaggccuuuacucccucuccuccgucguuaccguccccucauccucccuaggcacacaaaccuacaucugcaauguaaaccacaaacccaguaacaccaaagucgacaagaaaguagaacccaaaucaugcgacaaaacccacacaugcccaccuuguccagcccccgaacuccucggcggacccucaguauuccuauucccgcccaaacccaaagacacccuaaucucccgaaccccagaaguuacaugcgucguagucgacgucucccacgaagaccccgaagucaaauucaacugguacguagacggugucgaaguccacaacgccaaaaccaaaccccgcgaagaacaauacaacucuaccuaccgagucguaucaguccuaacagugcuccaccaagacuggcucaacggcaaagaauacaaaugcaaaguauccaacaaagcccuccccgccccgaucgaaaagaccaucuccaaagcaaaaggccagccccgagaaccccaagucuacacccuacccccaucccgagaagaaaccaaaaaccaagucucccuaaccugccucguaaaaggcuucuaccccuccgacaucgcagucgaaugggaaagcaauggacaacccgaaaacaacuacaaaacaacaccucccguacuggacuccgacggcuccuucuuccuauacuccaaacucaccguagacaaaucccgcuggcaacaagguaacgucuucagcuguucaguccacgaagcacuccacaaccacuacacccaaaaaucccucucacucucccccggc

SEQ ID NO: 53773 - RNA, 639 nt, Artificial Sequence
  derived and/or modified sequence opt11 from Etrolizuab_LightChain1
gacauccaaacccaaucucccuccucccucuccgccuccgucggcgaccgcgucaccauaaccugccgcgccuccgaauccgucgacgaccuccuacacugguaccaacaaaaacccggcaaagcccccaaacuccucaucaaauacgccucccaauccaucuccggcguccccagccgcuucucaggcuccggcuccggcaccgacuucacccucaccaucuccucccuccaacccgaagacuucgccaccuacuacugccaacaaggcaacucccuacccaacaccuucggucaaggaaccaaagucgaaaucaaacgcaccgucgcagcccccuccguauucaucuucccacccucagacgaacaacucaaaucaggcaccgccuccgucgucugccuacucaacaacuucuacccccgcgaagccaaaguccaauggaaagucgacaacgcccuccaauccggcaacucccaagaauccguaaccgaacaagacucaaaagacuccaccuacucccucuccucaacccucacccuauccaaagccgacuacgaaaaacacaaaguauacgccugcgaagucacccaccaaggccuaucaucacccguaaccaaauccuucaaccgcggcgaaugc

SEQ ID NO: 53774 - RNA, 1338 nt, Artificial Sequence
  derived and/or modified sequence opt11 from Etrolizumab_HeavyChain1
gaaguccagcuagucgaauccggcggaggccucguacaaccuggcggcucccuucgacuuucaugcgccgccagcggcuucuuuaucaccaauaacuacuggggcugggucagacaagcccccgggaaaggccuagaaugggugggcuacauauccuacuccggcuccacuucauacaacccaucccucaaaucccgauucaccaucucccgcgacaccuccaaaaacaccuuuuaccuacaaaugaacucccuccgagcagaagacaccgccgucuacuacugcgcaagaacuggcucauccggcuacuucgacuucuggggccaaggcacccucgucacaguauccuccgcaucaacaaaaggccccuccgucuucccccucgccccauccuccaaaucaacuuccgguggcacagcagcccucggcugccucgucaaagauuacuuucccgaaccagucaccguaagcuggaacuccggagcccucaccuccggaguacacacauuccccgccguccuccaauccuccggccuuuacucacucuccuccgucguaaccguucccuccuccucccuuggcacccaaacauacauaugcaaugucaaccacaaacccucaaacaccaaagucgacaagaaaguugaacccaaauccugcgacaaaacacauaccugcccaccaugccccgccccagaacuccuaggcgguccauccgucuuccuauucccgccaaaaccaaaagacacucuaaugaucucccgcacccccgaaguaacgugcguagucguagacguaucccacgaggacccagaagucaaauucaacugguaugucgacggcgucgaaguccacaaugccaaaacaaaaccacgagaagaacaauacaacuccaccuaucgaguaguauccguccucacaguucuccaccaagacuggcucaacggcaaagaauacaaaugcaaagucuccaacaaggcccucccugcucccaucgagaaaaccaucuccaaagccaaaggccaaccccgcgaaccccaagucuacacgcucccaccauccagagaagaaaugaccaaaaaucaagucucgcucacaugccucguaaaaggcuucuaccccuccgacaucgccgucgaaugggaaagcaacggccaaccagaaaacaacuacaaaaccacaccacccguccucgacagcgacggcuccuucuuucucuacuccaaacucaccgucgacaaaucacgcuggcaacaaggcaacgucuucuccugcucagucaugcacgaagcccuacacaaccacuacacccaaaaaucacucucacuauccccaggc

SEQ ID NO: 53775 - RNA, 642 nt, Artificial Sequence
  derived and/or modified sequence opt11 from Etrolizumab_LightChain1
gacauccaaaugacccaaucccccucaucacuauccgccucagucggcgaccgcguaaccaucacuugccgcgccuccgaauccgucgacgaccuccuccacugguaccaacaaaaaccuggcaaagcccccaaacuccucaucaaauacgccucccaauccaucuccggcguaccaucccgcuucucaggauccggcuccggcaccgacuucacccuuaccaucucaucccuacaacccgaagacuucgccaccuacuacugccaacaaggcaacucccucccaaacaccuucggccaaggcaccaaagucgaaaucaaacgcaccgucgccgcccccuccgucuucaucuucccucccucagacgaacaacucaaaucaggcaccgccuccgucgucugccuccucaacaacuucuacccccgcgaagccaaaguccaauggaaaguagacaacgcccuccaaucaggcaacucacaagaauccgucaccgaacaagacucaaaagacuccaccuacucccucuccuccacccucacccucucaaaagccgacuacgaaaaacacaaagucuacgcaugcgaaguaacccaccaaggccuauccucccccgucaccaaauccuucaaccgaggcgaaugc

SEQ ID NO: 53776 - RNA, 1359 nt, Artificial Sequence
  derived and/or modified sequence opt11 from Evinacumab_HeavyChain1
gaaguacaacucgucgaaucaggaggcggagucauucaacccggcggaucucuucgccucagcugcgccgccucaggcuucacauucgaugacuacgccaugaauuggguccgccaaggucccggcaaaggccucgaauggguaucagccaucuccggggacggcggauccacguacuacgcagacuccgucaaagggcgcuucaccaucucccgcgauaacagcaaaaauucgcucuaccuccaaaugaacucccuccgugccgaagacaccgccuucuucuacugcgccaaagacuuaagaaacaccauauucggcgucgucauccccgacgccuucgauaucuggggccaaggcaccaugguaaccguauccucagccucaaccaaaggucccuccguauucccccuagcgcccugcucucgaucaacaucagaauccaccgccgcccucggcugccuaguaaaagacuacuuccccgaacccgucaccgucucauggaacuccggcgcauuaacauccggcguacacaccuuucccgccguccuccaauccucaggccucuacucccucuccuccguugucaccguccccucaucuucacucggcaccaaaaccuauaccugcaacguagaccacaagcccuccaacaccaaagucgacaaacgaguagaaucaaaauacggcccacccugcccacccugccccgccccugaauuucucggcggccccuccgucuuccucuuuccaccaaaacccaaagacacacuaaugaucucucgcacacccgaagucacaugcguaguaguagacgucucccaagaagacccagaaguccaauucaacugguacguagacggcgucgaaguccacaacgccaaaacaaagccccgugaagaacaauucaacuccacauaccguguagucuccguccucaccguccuacaccaagacuggcuaaacggcaaagaauacaaaugcaaggucucaaacaaaggacuccccucaagcauagagaaaaccaucuccaaagcaaaaggccaaccccgagaaccccaagucuacacacucccacccucccaagaagaaaugaccaaaaaccaaguuucacucacuugccucgucaaaggcuucuacccaagcgacaucgccgucgaaugggaaucaaacggccaacccgaaaacaacuacaagaccaccccacccguccuagacuccgacggcagcuucuuccucuacucccgccuaaccguagacaaaagcagauggcaagaaggaaacgucuucuccugcucagucaugcacgaagcacuacacaaccacuacacccaaaagucacucucccuaucacucggaaag

SEQ ID NO: 53777 - RNA, 642 nt, Artificial Sequence
  derived and/or modified sequence opt11 from Evinacumab_LightChain1
gacauccaaaugacccaaucccccuccacccucucagccuccgucggcgaccgcgucaccaucaccugccgcgccucccaauccauccguuccuggcucgccugguaccaacaaaaacccggcaaagcccccaaacuccucaucuacaaagccuccucccucgaauccggcguacccucucgcuucucaggcucaggcuccggcaccgaauucacccucaccaucuccucacuccaacccgacgacuucgccaccuacuacugccaacaauacaacuccuacucauacacauucggccaaggcaccaaacucgaaaucaaacgaaccgucgccgcccccuccgucuucaucuucccccccuccgacgaacaacuaaaauccggaaccgccuccgucgucugccuccucaacaacuucuacccccgcgaagccaaaguccaauggaaagucgacaacgcccuccaauccggcaacucacaagaauccgucaccgaacaagacucuaaagacuccaccuacucacucagcucaacccuaacccucucuaaagccgacuacgaaaaacacaaagucuacgccugcgaagucacccaccaaggccuaucaucacccgucaccaaauccuucaaccgaggcgaaugc

SEQ ID NO: 53778 - RNA, 1323 nt, Artificial Sequence
  derived and/or modified sequence opt11 from Evolocumab_HeavyChain1
gaaguccaacuagugcaauccggagcagaagucaaaaaacccggcgccuccguaaaagucucaugcaaagccuccggcuacacccucaccagcuacggcaucuccuggguccgccaagcacccggccaaggccucgaauggaugggcugggucagcuucuacaacggaaacaccaacuacgcccaaaaacuucaaggucgcggcaccaugaccacugaccccagcacauccacagcauacauggaacuccgaucacuacgcuccgacgauacugcagucuacuacugcgccagaggcuacgguauggacgucuggggccaaggaaccaccgucacagucucguccgcuucuaccaaaggucccuccgucuuuccauuagcaccaugcucccgcucaaccucggaauccaccgccgcucucggcugccucguaaaagacuacuuccccgaacccgucaccgucucuuggaacuccggcgcccucacaucaggcguccacacauuccccgccgugcuccaauccuccggccucuacucacucucauccgucgucaccguccccucauccaacuucggcacccaaacuuacacuugcaacgucgaccacaaacccucgaacaccaaagucgacaaaaccgucgaacgaaaaugcugcgucgagugcccccccugcccagccccccccguagccggucccuccguuuuccuauuccccccaaaaccaaaagacacacucaugaucucccgcacccccgaagucaccugcgucguagucgacgucucccacgaagaucccgaaguccaauucaacugguacguagacggcgucgaaguccacaacgcaaaaaccaaaccccgcgaggagcaauucaacuccacauuccgagucgucuccguccuaaccgucguccaccaagacuggcugaacggcaaagaauacaaaugcaaagucucaaacaaaggccuuccugccccaaucgagaaaaccauauccaaaaccaaaggccaaccucgcgaaccccaagucuacacucucccccccucucgugaagaaaugacaaaaaaccaagucucacucaccugccuuguuaaaggcuuuuacccauccgacauagccgucgaaugggaaagcaacggucaacccgaaaauaacuacaaaaccacacccccaaugcuggacuccgacggauccuucuuccuauauuccaaacucacggucgacaaaucacguuggcaacaaggcaacguauucuccuguuccguaaugcacgaagcccuacacaaccacuacacccaaaaaucacucucccucuccccaggcaaa

SEQ ID NO: 53779 - RNA, 645 nt, Artificial Sequence
  derived and/or modified sequence opt11 from Evolocumab_LightChain1
gaauccgcccucacccaacccgccuccgucuccggcuccccaggccaauccaucaccaucuccugcaccggcaccucuucagacgucggaggcuacaacuccguauccugguaucaacaacaccccggcaaagcccccaaacucaugaucuacgaagucuccaaccgccccuccggcgucuccaaccgcuucuccggcuccaaauccggcaacaccgccucccucaccauaucaggccuccaagccgaagacgaagccgacuacuacugcaacuccuacaccuccaccucaauggucuucggcggaggcaccaaacucaccguccucggccaacccaaagccgcccccuccgucacucucuuuccccccuccuccgaagaacuccaagccaacaaagccacccuagucugccucauauccgacuucuaccccggcgccgucaccgucgccuggaaagccgacuccucacccgucaaagccggcgucgaaaccaccacccccuccaaacaauccaacaacaaauacgccgccuccuccuaccucucccucacccccgaacaauggaaaucccaccgauccuacuccugccaagucacccacgaaggcuccacagucgaaaaaaccguagcccccaccgaaugcucc

SEQ ID NO: 53780 - RNA, 1353 nt, Artificial Sequence
  derived and/or modified sequence opt11 from Exbivirumab_HeavyChain1
caaguacagcuagucgaaucaggcggcggagucguccaacccggcggaagccuccgccuaucaugcgcccccuccggcuucgucuuccguuccuacggcaugcacuggguccgccaaacacccggcaaaggccucgaaugggucucccucauauggcacgacggcuccaaccgauucuacgcagacuccgucaaaggccgauucacaaucucacgcgacaacuccaaaaauacccucuaccuccaaaugaacucccuccgcgccgaagacaccgcaauguacuucugcgcccgagaacgccucaucgcggcacccgcugccuucgaccucuggggacaaggaacacucgucacuguauccucugccuccaccaaaggccccuccgucuucccacucgcacccuccuccaaaagcaccucaggaggaacugcugccuugggaugccuaguaaaagacuacuuucccgaaccagucacagucuccuggaacuccggagcacucacauccggcguccacacauuccccgcaguacuccaaucuuccggccucuacagccuauccuccgucgucacagucccauccuccucacucggcacccaaaccuacauaugcaacgucaaccacaaacccuccaauacaaaagucgacaaacgcgucgaacccaaaagcugcgacaaaacacacacuugcccacccugccccgcccccgaacuccuuggcggcccaucugucuuccuauucccacccaaacccaaagacacccuaaugauaucacgaacccccgaagugacaugcgucgucgucgacgucucacacgaagaccccgaagucaaauucaacugguacgucgacggagucgaaguucacaacgccaaaaccaaaccacgagaagaacaauacaacuccaccuaucgagucgucuccguacucaccguacuccaccaagacuggcuaaacggaaaagaauacaaaugcaaaguuucaaacaaagcacuccccgccccaaucgagaaaaccaucucuaaagccaaaggacaaccccgcgaaccacaagucuauacauuacccccuucccgggaagaaaugaccaaaaaccaagucucccucacaugccuuguaaaaggcuucuaccccucugacaucgccgucgaaugggaauccaacggccagcccgaaaauaacuacaaaacaacuccacccguccucgacuccgacggcuccuucuuccucuacuccaagcucaccgucgacaaaucacgcuggcaacaaggcaacgucuucuccugcuccgucaugcacgaagccuuacacaaccacuacacccaaaaaucccucucccucuccccaggcaaa

SEQ ID NO: 53781 - RNA, 642 nt, Artificial Sequence
  derived and/or modified sequence opt11 from Exbivirumab_LightChain1
ucuuacguccuaacacaacccccauccgucucagucgcccccggcaaaaccgcccgcaucuccugcggcggcaacaacaucggcaccaaaaacguacacugguaccaacaaaaacccggccaagcccccguccucgucgucuacgccgacucagaccgccccuccggaauccccgaacgcuucucuggauccaacuccggaaacaccgccacccucacaaucucccgcgucgaagccggcgacgaagccgacuacuacugccaaguaugggacuccgucuccuaccacgucguauuuggcggaggcaccacccucaccguccucggacaacccaaagccgcccccuccgucacccucuuccccccuuccagcgaagaacuccaagccaauaaagccacccucgucugccucaucuccgacuucuacccaggcgccgucaccguagccuggaaagccgacuccucccccgucaaagccggcgucgaaaccaccacccccuccaaacaauccaacaacaaauacgcagccucauccuaccucucccucacccccgaacaauggaaaucacaccgcuccuacuccugccaagucacccacgaaggcuccacagucgaaaaaaccgucgcccccaccgaaugcucc

SEQ ID NO: 53782 - RNA, 1347 nt, Artificial Sequence
  derived and/or modified sequence opt11 from Farletuzumab_HeavyChain1
gaagugcaacucgucgaaucaggcggaggaguaguccaacccggucgcucccuucgacucucaugcuccgccuccggcuuuaccuucuccggcuauggccucucauggguccgccaagcccccggaaaaggcuuagaaugggucgcuaugaucucgucgggcggcucauacaccuacuacgcagacagcguaaaaggccgauucgcgaucucacgcgacaacgccaaaaacacccucuuccuccagauggacucccuccggccagaagacaccggcguuuacuucugcgcccgacacggcgacgacccagccugguucgcauauuggggccaaggcacccccgucaccgucuccucagccucaaccaaaggccccucagucuucccccucgccccaucauccaaauccacaucaggaggcaccgccgcccuaggcugccucgucaaagacuacuuccccgaacccgucaccguauccuggaauagcggcgcacucaccagcggcguccacacauucccagcuguccuccaauccuccggacucuacucccucuccuccgucgucacaguccccucauccagccucggcacccaaaccuacauaugcaacgucaaccacaaaccaucaaauacaaaagucgacaagaagguagaacccaaauccugcgauaaaacacacaccuguccacccugccccgcacccgaacuccucggcggccccuccguauuccucuucccgcccaaacccaaagacacccucaugauuucacgcacccccgaagucacaugcgucguagucgacgucucccacgaagaccccgaagucaaguucaauugguacguagacggcgucgaaguccacaacgccaaaacaaaaccccgugaagaacaauacaacuccaccuaccgugucguauccguccucaccguccuccaccaggacuggcucaacggcaaagaauacaaaugcaaagucagcaacaaagcccuccccgcccccaucgagaaaaccaucuccaaagcgaaaggccaaccccgagaaccccaagucuacacccucccaccaucccgcgacgaacucaccaaaaaccaagucucccucacuugccuaguaaaaggauucuaccccuccgacaucgccgucgaaugggaaucuaacggccaacccgaaaacaacuacaaaaccacaccgcccguccucgacucagacggauccuucuucuuauacuccaaacucacaguagauaaaucacguuggcaacagggaaauguuuucuccugcuccgucaugcacgaagcacuccacaaccacuacacucaaaaaucccucucucucucccccggaaaa

SEQ ID NO: 53783 - RNA, 651 nt, Artificial Sequence
  derived and/or modified sequence opt11 from Farletuzumab_LightChain1
gacauccaacucacccaaucacccuccucccuaucagccucagucggcgaccgcgucaccaucacaugcucagucuccuccucaaucucauccaacaaccuacacugguaccaacaaaaacccggcaaagcacccaaacccuggaucuacggcacauccaaccuagccucaggaguccccucacgcuucucaggcuccggcucaggcacagacuacaccuucaccaucuccucacuccaacccgaagacaucgccaccuacuacugccaacaaugguccuccuaccccuacauguacaccuucggccaaggcaccaaagucgaaaucaaacgcaccgucgccgcccccuccgucuucaucuucccacccucggacgaacaacucaaauccggcaccgccuccgucguaugccuccucaacaacuucuacccccgagaagcaaaaguacaauggaaagucgacaacgcacuccaauccggcaacucccaagaauccgucaccgaacaagacuccaaagacuccaccuacucccucuccucaacccucacacucucaaaagccgacuacgaaaaacacaaagucuacgccugcgaagucacacaccaaggccucucuucccccgucaccaaauccuucaaccgcggcgaaugc

SEQ ID NO: 53784 - RNA, 1338 nt, Artificial Sequence
  derived and/or modified sequence opt11 from Fasinumab_HeavyChain1
caaguucaacucguccaaagcggagccgaaguaaagaaacccggagccuccguaaaaguauccugcaaagucucaggcuucacccucaccgaacucagcauccacuggguccgccaagccccaggcaagggccucgaauggaugggcggcuucgaccccgaagacggcgaaaccaucuacgcucaaaaauuccagggccgcgucaccaugaccgaagacaccuccacagacaccgccuacauggaacucaccucccucagaagcgaggacaccgccgucuacuacugcuccaccauauuuggcgucgucaccaauuucgacaacuggggccaaggaacacuugucaccgucuccuccgccuccacaaaaggccccuccgucuucccacuagcccccugcucacgauccacauccgaauccaccgcagcacucggcugccuagucaaagacuacuucccagaacccgucaccgucagcuggaacuccggagcucuaaccuccggaguacacaccuuccccgcuguccuucaauccucaggccucuacagccucuccuccgucgucaccguaccaagcuccucacucggcacaaaaaccuacacaugcaacgucgaccacaaaccaagcaacacgaaagucgacaaacgcguagaaucaaaauacggacccccaugcccacccugcccagcacccgaguuccucggcggacccuccguguuccucuuucccccuaaaccaaaagacacacuaaugaucucacgcacccccgaaguuaccugcguagucgucgacguaagccaagaagaccccgagguccaauucaacugguacgucgacggagucgaaguccacaacgccaaaacaaaaccccgcgaagaacaauucaacuccacguaccgcgucguuagcguccucacaguccuacaccaagacuggcuaaacggcaaagaauacaaaugcaaagucagcaacaaaggacuaccaucgucaaucgagaaaaccaucucuaaagcgaaaggccaaccaagagaaccccaagucuacacccuacccccaagccaagaagaaaugaccaaaaaccaagucucacugaccugccuugucaaaggcuucuaccccucagacaucgccgucgaaugggaaucaaacggccaacccgaaaacaacuacaaaaccaccccacccguacucgauuccgauggauccuucuuccucuauucacgacuaacagucgacaaaucacguuggcaagaaggaaacgucuucuccugcuccgucaugcacgaagcccuccacaaccauuacacccaaaaaucacuaucccucucccucggcaaa

SEQ ID NO: 53785 - RNA, 642 nt, Artificial Sequence
  derived and/or modified sequence opt11 from Fasinumab_LightChain1
gacauccaaaugacccaaucaccauccucccucuccgccuccgccggcgaccgcgucaccaucaccugccgcgccucccaagcaauccgcaacgaccucggcugguaccaacaaaaacccggcaaagcccccaaacgccuaaucuacgccgccuucaaccuucaauccggcguccccucccgauucucaggcuccggcucaggcacagaauucacccuaaccaucuccucccuccaacccgaagaccucgccuccuacuacugccaacaauacaaccgcuaccccuggaccuucggccaaggaaccaaagucgaaauaaaacgaaccgucgccgcccccuccgucuucaucuucccccccuccgacgaacaacuaaaauccggaacagccucagucgucugccuccuaaacaacuucuacccccgcgaagccaaaguccaauggaaagucgacaacgcccuccaauccggcaacucacaagaauccgucaccgaacaagacagcaaagacuccaccuacucccuauccucaacccuaacccucuccaaagccgacuacgaaaaacacaaagucuacgccugcgaaguuacccaccaaggacucuccucccccgucaccaaauccuucaaccgaggagaaugc

SEQ ID NO: 53786 - RNA, 1350 nt, Artificial Sequence
  derived and/or modified sequence opt11 from Fezakinumab_HeavyChain1
caaguccagcuaguacaauccggcgccgaggucaagaaacccggcgccagcgucaaagucagcugcaaagccuccggcuacacauuuacaaacuacuacaugcacuggguucgccaagcccccggccaaggcuuagaauggguaggcuggaucaacccauacaccggauccgccuucuacgcacaaaaauuccgaggcagagucacaaugacccgagacaccuccauuuccaccgccuacauggaacuaucccgccuccgcuccgacgacaccgccgucuauuacugcgcacgugaaccagaaaaauucgacagcgacgacuccgacguauggggccgcggcacccugguaacagucucauccgccuccaccaaaggccccucggucuucccccucgcuccauccucaaaauccaccuccggcggcacagcagcccucggaugccucgugaaagacuauuucccugagccagucaccgucuccuggaacucaggcgcacucacauccggcguccacaccuucccagcaguccuccaauccucuggacucuacucucucuccuccguagucaccgucccuucauccagccugggaacccaaacuuacaucuguaacgucaaccacaaacccagcaacaccaaagucgacaagaaagucgaaccaaaauccugcgacaaaacccacacaugcccucccugucccgcaccagaacuacucggcgggcccuccguauuccuauuucccccaaaaccaaaagacacccucaugauaucccgcacccccgaagucacaugcguaguagucgacgucucccacgaagaccccgaagucaaauucaacugguacgucgacggcgucgaaguccacaacgccaagaccaaaccccgggaagaacaauacaacuccaccuaccgcguagucucaguacucacaguccuccaccaagacuggcuaaaugggaaagaauacaaaugcaaagucuccaacaaagcccuccccgcacccaucgagaaaaccaucuccaaagccaaaggccaaccacgagaaccccaagucuacacauuaccacccucccgcgaagagaugaccaaaaaccaagucagccuuaccugccucgucaagggcuucuaccccucagacaucgccgucgaaugggaauccaacggccaacccgaaaacaacuacaaaacaacuccucccguccucgacuccgacggcuccuucuuccucuacuccaaacuuaccguugacaaaucucgauggcaacaaggaaacgucuucucuugcuccguaaugcacgaagcccuccacaaccacuacacccagaaaucacucucccucucacccggc

SEQ ID NO: 53787 - RNA, 651 nt, Artificial Sequence
  derived and/or modified sequence opt11 from Fezakinumab_LightChain1
caagccguccucacacaaccccccuccgucuccggagcacccggccaacgugucaccaucuccugcaccggcuccuccucaaacaucggcgccggcuacggcguccacugguaccaacaacucccaggcaccgcccccaaacuccucaucuacggcgacuccaaccgacccuccggaguucccgaccgcuucuccgguucaaaaucaggcaccuccgccucccucgccaucaccggccuccaagccgaagacgaagccgacuacuacugccaauccuacgacaacucccucucaggcuacgucuucggaggcggaacccaacuaaccguccuaggccaacccaaagccgcacccuccgucacacucuucccccccuccuccgaagaacuccaagccaacaaagccacccucguaugccuaaucuccgacuucuacccuggcgccgucaccgucgccuggaaagccgacucaucacccgucaaagccggcgucgaaaccaccacacccuccaaacaaucaaacaacaaauacgcagccuccuccuaccucucacucaccccagaacaauggaaaucccaccgcucauacuccugccaagucacccacgaaggcuccaccgucgaaaaaacagucgccccaaccgaaugcucc

SEQ ID NO: 53788 - RNA, 1347 nt, Artificial Sequence
  derived and/or modified sequence opt11 from FG-3019_HeavyChain1
gaaggccaacucguccaauccggcggcggccucguccaccccggcggcucacuccgccuaucuugcgccggcucaggauucaccuucagcuccuacggcaugcacuggguccgccaggccccaggcaaaggccucgaaugggucucaggcaucggcaccggcggcggcaccuacuccaccgacagcguuaaaggccgcuucaccaucucccgagacaacgccaaaaacagccucuaucuccaaaugaacucccuccgagccgaagacauggcaguuuacuacugcgcccgcggcgacuacuacggauccggcucauucuucgacugcuggggacagggaacacucguaaccguaucaucagcuuccaccaaaggccccuccgucuucccacuugcacccucaucuaaaagcaccuccggaggcaccgcagcgcucggaugccuaguuaaagacuauuuccccgaaccugucacaguuucauggaacuccggcgcccuaaccuccggcguccacaccuucccagccguccuacaaucaucuggccuuuacucacucucauccguagucaccguccccuccuccucgcucggcacacaaacauacauaugcaacgucaaccacaaacccagcaacaccaaagucgacaaacgagucgaaccaaaguccugcgacaaaacccacacaugcccacccugccccgcccccgaacuacucggcggacccuccgucuuccucuucccacccaaacccaaagacacccucaugaucuccagaacccccgaaguuaccugcguagucgucgacgucucccacgaagacccagaaguaaaauucaacugguaugucgauggaguagaaguacacaacgccaaaacaaaaccccgcgaagaacaauacaacuccacauaccgcguagucucaguccucaccguccuccaccaagacuggcugaacggcaaagaauacaaaugcaaggucuccaacaaagcccuacccgcccccauagagaaaaccauaucaaaagccaaaggccagccccgcgaaccacaagucuacacacuaccucccucacgcgaagaaaugaccaaaaaccaagucagcuuaaccugccucguuaaaggcuucuaccccuccgacaucgcugucgaaugggaaucaaacggccaacccgaaaacaacuacaaaaccacaccgcccguacucgacuccgacggcucauucuuccucuacucaaaacucacaguagacaaaucccgcuggcaacaaggcaacgucuucuccugcuccguaaugcacgaagcccuccacaaccacuacacccaaaaaucccucucgcucucccccgga

SEQ ID NO: 53789 - RNA, 642 nt, Artificial Sequence
  derived and/or modified sequence opt11 from FG-3019_LightChain1
gacauccaaaugacccaaucacccuccucacucuccgccucagucggcgaccgcgucaccaucacaugccgagccucccaaggcaucuccuccuggcucgccugguaccaacaaaaacccgaaaaagcccccaaaucccucaucuacgccgccuccucccuacaauccggcguccccagccgcuucuccggcucaggcuccggcaccgacuucacccucaccaucuccucccuucaacccgaagacuucgcaaccuacuacugccaacaauacaacuccuacccacccaccuucggacaaggaaccaaacucgagaucaaacgcaccguugccgcccccuccguauucaucuucccacccuccgacgaacaacucaaauccggcaccgccuccgucguaugccuacucaacaacuucuacccccgcgaagccaaaguccaauggaaagucgacaacgcccuccaauccggcaacucccaagaaucagucaccgaacaagacuccaaagacucaaccuacucacuaagcucaacccuaacccuaucaaaagccgacuacgaaaaacacaaagucuacgcaugcgaagucacccaccaaggccucuccucccccgucaccaaauccuucaaccgcggcgaaugc

SEQ ID NO: 53790 - RNA, 1344 nt, Artificial Sequence
  derived and/or modified sequence opt11 from Fibatuzumab_HeavyChain1
caaguacaacucguccaauccggcgcagaagucaagaaaccuggcgcauccgucaaaguuuccugcaaagccagcggcuacacuuucaccggcuacuggaugaacuggguccgccaagcccccgggcaaggccucgaauggaugggagacaucuaccccggauccggcaacaccaacuacgacgaaaaauuccaaggccgagucaccaugacccgagacaccucaaucucaaccgcauacauggaacuuagccgacuccgcuccgacgacaccgcuguauacuacugcgcacgcggcgguuacuacgaagacuucgauuccuggggccaaggcaccacagucaccgucuccuccgccuccaccaaaggccccucagucuucccccuagcccccuccucaaaaagcaccuccggcggaaccgccgcacucggcugccuagucaaagauuacuuuccagagcccguaaccgucagcuggaacuccggcgcccucacguccggcguccacacauucccagccguacuacaaagcagcggucucuacucacucucaucagucgucacaguccccuccagcucacucggaacccaaaccuacaucugcaacguaaaccacaaaccuucuaacaccaaggucgacaagcgcgucgaacccaaauccugcgacaaaacccacaccuguccacccugccccgcccccgaacuccuaggcggccccuccgucuuccucuucccacccaaacccaaagacacacucaugaucucccguacacccgaaguuaccugcgucgucguagacgucucccacgaagaccccgaggucaaauucaacugguacgucgacggcgucgaaguccacaacgccaaaacaaaaccccgagaagaacaauacaacucaacauaccgcguagucucgguccuaacaguccuccaccaagacuggcucaacggaaaagaauacaaaugcaaaguauccaacaaagcccuacccgcccccaucgagaaaaccaucucaaaagcaaaaggccaaccccgcgaaccccaaguauacacccucccacccucaagagaagaaaugaccaaaaaccaaguaucucuaaccugccucgucaaaggauucuaccccuccgacauugccgucgaaugggaauccaacggacaacccgaaaacaacuacaaaaccaccccacccguccucgacucagauggcuccuuuuuccucuacuccaaacuaaccguagacaaaaguagauggcaacaaggcaacgucuucagcugcuccgucaugcacgaagcacuacauaaccacuacacccaaaaaucccuuucacuuucacccggcaaa

SEQ ID NO: 53791 - RNA, 642 nt, Artificial Sequence
  derived and/or modified sequence opt11 from Fibatuzumab_LightChain1
gacauccaaaugacccaauccccaucauuccucucagccucugucggcgaccgagucaccaucaccugccgugccucccaaggcaucaucuccuaccucgccugguaccaacaaaaacccgaaaaagcccccaaacgccucauauacgccgccuccucccuccaaucaggcguccccucucgcuucuccggcuccggcuccggcaccgaauucacccucaccaucuccucccuccaacccgaagacuucgccaccuacuacugcggccaauacgccaacuaccccuacacauucggccaaggcaccaaacucgaaaucaaacgcaccgucgccgcccccuccgucuucauauucccccccuccgacgaacaacucaaauccggcaccgccuccgucgucugccuacucaacaacuucuacccacgcgaagccaaaguccaauggaaagucgacaacgcacuccaauccggcaacucacaagaaagcgucaccgaacaagacagcaaagacuccaccuacucccucuccucaacccucacccuaucaaaagccgacuacgaaaaacacaaagucuacgccugcgaagucacccaccaaggccucuccucccccgucaccaaauccuucaaccgaggagaaugc

SEQ ID NO: 53792 - RNA, 1344 nt, Artificial Sequence
  derived and/or modified sequence opt11 from Ficlatuzumab_HeavyChain1
caaguacaauuaguccaacccggagcagagguaaagaaacccggcaccuccguuaaacucagcugcaaagcauccggauacaccuucacaacguacuggaugcacuggguacgccaagcgcccggccaaggccucgaauggaucggcgaaaucaaccccacaaacggccacacaaacuauaaccaaaaauuccaaggccgagccacccuaaccguggacaaaucaaccuccacggccuacauggaacucuccucccuccgcucagaggacaccgcaguauacuacugcgcccgaaacuacguaggauccaucuucgacuacugggggcaaggcacgcuacucaccgucuccuccgccuccaccaaaggcccuucagucuucccacuugcaccaagcagcaaaagcacaucaggcggaacagccgcucuaggcugccucgucaaagacuacuuccccgaacccgucacugucuccuggaacuccggcgcccuaaccuccggaguccacacauuccccgccguccuucaauccuccggacucuacagccuuucaagcgucgucaccgucccaucaucuucacuaggcacccaaaccuacaucugcaacgucaaccacaaacccucaaacaccaaagucgacaagcgagucgaacccaagagcugcgacaaaacccauaccugcccacccugccccgccccagaacuucuaggcggccccuccguauuccuuuucccacccaaaccaaaagacacccucaugaucucacguaccccagaaguaaccugcgucgucguagacgucucccacgaagacccagaagugaaauucaacugguacguagacggcgucgaaguacacaacgcaaaaacaaaaccccgagaagaacaauacaacuccaccuaccgcguaguguccguccucacaguccuccaccaagacuggcuaaacggcaaagaauacaaaugcaaaguaagcaacaaagcccuccccgcccccauagagaaaaccaucagcaaagccaaaggacaaccccgcgaaccacaagucuacacccuacccccaagcagagaagaaaugaccaaaaaucaagucucccuaaccugccucgucaaagguuucuaccccuccgacaucgcagucgaaugggaaucaaacggacaacccgaaaacaacuacaaaaccaccccacccguacucgacucugacgguuccuucuuccucuacuccaaacucaccguagacaaaucccgauggcaacaaggcaacgucuucuccugcucaguaaugcacgaagcccuacacaaccacuacacacagaaaagccucucucuaucccccggcaaa

SEQ ID NO: 53793 - RNA, 1341 nt, Artificial Sequence
  derived and/or modified sequence opt11 from Ficlatuzumab_HeavyChain
guccagcucgugcaaccaggagcagaagucaagaaacccggcaccuccgucaaacuguccugcaaagccagcggcuacacauucaccacauacuggaugcacuggguccgacaagcacccggacaaggccucgaauggaucggagaaauaaaccccaccaacggccacacaaauuacaaccaaaaauuccagggccgcgccacccucaccgucgacaaaucuacguccacagccuacauggaacuuagcucccuccgcagcgaagacaccgccgucuacuacugcgcacgcaauuacgucggauccaucuucgacuacuggggacaagggacccuccuaaccguauccuccgccuccaccaaaggcccuucuguauucccccucgccccuuccuccaaauccaccuccgguggcacugccgcacuaggcugccucgucaaagacuacuuccccgaacccgucacagucuccuggaacuccggcgcacuaacaagcggcguucacaccuucccagcaguacuccaaucauccggccuauacucucuauccucaguuguuaccgucccuucuuccucccucggcacacaaaccuacaucugcaacguaaaccacaaaccauccaacaccaaaguagacaaaagaguagaacccaaaucaugcgacaaaacacacacaugcccuccuugcccagcccccgaacuacucggcggccccucagucuuccucuucccgcccaaacccaaagacacccuuaugauaucccgaacccccgaaguaaccugcgucgucgucgacgucucccacgaagaccccgaagucaaauucaacugguacgucgacggaguagaaguacacaacgccaaaaccaaaccccgcgaagaacaauacaacuccaccuaccgcgucgucucuguccuaacuguccuacaccaagacuggcucaacggcaaagaauacaaaugcaaagucucgaacaaagcccuccccgcccccaucgagaaaaccauaucuaaggccaaaggccagccccgagaaccccaaguauacacccucccacccucccgagaagaaaugaccaaaaaccaggucucccuaacaugccucgugaaaggcuucuaccccuccgacaucgccgucgaaugggaauccaacggccaaccagaaaacaacuacaaaaccacacccccagucuuagacagcgacggcuccuucuuccuuuacucaaaacugaccgucgacaagagccgcuggcaacaaggcaacgucuucuccugcucagucaugcacgaagcccuacacaaccacuacacacagaaaucccuuucacucucacccggcaaa

SEQ ID NO: 53794 - RNA, 642 nt, Artificial Sequence
  derived and/or modified sequence opt11 from Ficlatuzumab_LightChain1
gacaucguuaugacacaaucacccgacucccuugccaugucccucggcgaacgcguaacccucaacugcaaagccuccgaaaacgucgucuccuacgucuccugguaccagcaaaaacccggccaaucacccaaacuccucaucuacggcgccuccaaccgcgaauccggcguccccgaccgauucucaggcucaggcucagccaccgacuucacccucaccaucuccuccguccaagccgaagacgucgccgacuaccacugcggccaauccuacaacuaccccuacaccuucggccaagguaccaaacucgaaaucaaacgcaccgucgccgcccccuccgucuucaucuucccccccuccgacgaacaacucaaauccggcacggccuccgucgucugccuacucaacaacuucuacccccgcgaagccaaaguccaauggaaagucgacaacgcccuccaaucagguaacucacaagaaagcgucaccgaacaagacuccaaagacucaaccuacucccucuccuccacccucacccucuccaaggccgacuacgaaaaacacaaaguauacgccugcgaagucacccaccaaggccucuccucccccgucaccaaauccuucaaccgcggcgaaugc

SEQ ID NO: 53795 - RNA, 1350 nt, Artificial Sequence
  derived and/or modified sequence opt11 from Figitumumab_HeavyChain1
gaaguacaauuacuagaauccggaggcggacucguccaaccaggcggaucccuccgacuauccugcaccgcaagcggguucacauucucauccuacgccaugaauuggguccgccaagcccccggaaaaggccucgaaugggucucagccauaucaggcucaggcggcaccacauuuuacgccgauucagucaaaggacgcuucaccauaagcagagacaacucccggacaacccuauaccuacaaaugaacucccucagagccgaagacaccgccgucuacuacugugccaaagaccucggcuggucagacagcuacuacuacuacuacggcauggacguauggggccaaggcaccacgguuacaguauccucagcauccacuaaaggcccauccguauucccccuagcccccugcucacgcuccacaucagaaucaaccgccgcccuuggcugccucgucaaagacuacuuccccgaacccgucaccguauccuggaacuccggcgcccucaccuccgguguccacaccuucccagcgguccuccaaucaucugggcucuacucccucuccucagucguaaccguccccagcagcaacuucggaacccaaaccuauaccugcaacgucgaccacaaaccuuccaacaccaaagucgacaaaaccguagaacgcaaaugcugcgucgaaugcccacccugucccgcaccacccgucgccggccccuccgucuuccuguucccacccaaacccaaggauacccucaugaucucccgcacccccgaaguuaccugcgucgucgucgacguaagccacgaagaccccgaaguccaauucaauugguacgucgacggcguggaaguacacaacgccaagaccaaaccccgagaagaacaauucaacuccacauuucgcgucgucuccguccucaccguaguucaccaggacuggcucaacgguaaagaguacaaaugcaaaguauccaacaagggccuccccgcucccauagagaaaacaaucagcaaaacgaaaggccaaccccgcgaaccccaagucuacacccucccgcccucucgagaagaaaugaccaaaaaccaaguaucgcucacaugccucgucaaaggcuucuaccccuccgacauagcagucgagugggaauccaacggccaacccgagaacaacuacaaaaccaccccaccaaugcuagacuccgacggcagcuucuuucuauacuccaaacuaaccgucgacaaaucccgauggcaacaaggcaacgucuucucgugcuccgucaugcacgaagcccugcacaaccacuacacccaaaaaucccucucacucucacccggu

SEQ ID NO: 53796 - RNA, 642 nt, Artificial Sequence
  derived and/or modified sequence opt11 from Figitumumab_LightChain1
gacauccaaaugacacaauuccccuccagccucuccgccuccgucggcgaccgcgucaccaucaccugccgcgcaucccaaggcauacgcaacgaccuuggcugguaccagcaaaaacccggcaaagcaccaaaacgacuaaucuacgccgcaagccgacuccaccgaggcguccccuccagauucuccggcuccggcuccggcaccgaauucacccucaccauauccucccuccaacccgaagacuucgccaccuacuacugccuccaacacaacucauaccccugcuccuucggccaaggcaccaaacucgaaaucaaacgcaccgucgccgccccuuccgucuucaucuucccccccucagacgaacaacucaaauccggcacggccucagucguaugccuacucaacaacuucuacccacgcgaagccaaaguccaauggaaggucgacaacgcgcuccaauccggcaacucacaagaauccguuaccgaacaagacucaaaagacuccaccuacucccucagcuccacccucacccucagcaaagccgacuacgaaaaacacaaaguauacgccugcgaagucacacaccaaggccucuccucacccguaaccaagagcuucaaccgcggcgaaugc

SEQ ID NO: 53797 - RNA, 1359 nt, Artificial Sequence
  derived and/or modified sequence opt11 from Firivumab_HeavyChain1
caaguucaacucguacaauccggcgccgaagugaaaaugcccggaucuucaguaaaagucuccugcaaaaccagcggcgucuucuucuccucccacgccauauccuggguacgucaagcccccggccaaggccuagaauggaugggcggcaucucccccauguucggcaccacccacuacgcccaaaaauuccaaggccgagucaccaucacagccgaccaaucgacaaccacagccuacauggaacucaccucacuuaccuccgaagauacagccgucuacuacugcgccagagacggcgccggcucauacuacccccucaacugguucgaccccuggggccaaggcacccucgucaccgucuccucugccuccacaaaaggcccauccgucuuuccacucgcccccucauccaaaucuaccuccggcggcaccgccgcgcucggcugcuuaguaaaagacuacuuccccgaaccaguaaccgucuccuggaacuccggcgcccucaccucaggcguucacaccuuucccgcaguucuccaaaguucaggccucuacucccucuccucugucgucaccguccccuccuccucccucggcacccagaccuacaucugcaacguaaaccacaaacccucuaacacuaaagucgacaaacgcguagaacccaaaucuugcgacaaaacacacacaugcccacccugccccgcccccgaacuccucggcggaccauccguuuuccuauucccacccaaaccaaaagacacccucaugauaagccgaacuccagaagucacaugcgucgucgucgacgucucccacgaagauccggaaguaaaauucaacugguacguagacggagucgaaguccacaacgcaaaaacaaaaccacgcgaagaacaauacaacuccaccuaccgcguagucuccguccuaaccguacuccaccaagacuggcucaacgguaaagaauacaaaugcaaggucuccaauaaagcucuacccgcccccaucgagaaaacaaucuccaaggcaaaaggacaaccacgcgaaccccaagucuauacucuaccaccaucccgugacgaacucaccaaaaaccaagucucccucacuugccucgucaagggcuucuaccccuccgacaucgccgucgaaugggaguccaauggccaacccgaaaacaacuacaagaccacaccacccguccuagacagcgacggcucauucuuccucuacaguaaacucaccgucgacaaaucccgcuggcagcaaggcaacgucuucucaugcuccguaaugcacgagggacuucacaaccacuacacacaaaaaucccuaucccuaucccccggaaaa

SEQ ID NO: 53798 - RNA, 642 nt, Artificial Sequence
  derived and/or modified sequence opt11 from Firivumab_LightChain1
gaaaucguccucacccaaucccccgcaacccucagccuaucccccggcgaacgcgcaacccucuccugccgcgccuccgaaaacaucuggaacaaccuagccugguaccaacaaaaacccggccaagccccacgccuccucaucucaggcgccuccaccggcgccaccggcguccccucccgauucagaggcuccggcucacgcaccgaauucacccuaacaaucuccucacuccagucagaagacuucgccaucuacuucugccaacaauacaacuccuggccccgcacauucggccccggcacaaaagucgaaaucaaacgcacagucgcagcccccucagucuucaucuucccacccuccgacgaacaacucaaauccggcaccgccuccgucguaugccuccucaacaacuucuacccacgcgaagccaaaguccaauggaaagucgacaacgcccuccaauccggcaacucccaagaaagcgucaccgaacaagacagcaaagacuccaccuacucccucagcuccacccucacccucuccaaagccgacuacgaaaaacacaaagucuacgcaugcgaagucacucaccaaggccuaagcucccccguaaccaaaagcuucaacagaggcgaaugc

SEQ ID NO: 53799 - RNA, 1347 nt, Artificial Sequence
  derived and/or modified sequence opt11 from Flanvotumab_HeavyChain1
caaguacagcuaguacaauccgguucagagcucaagaaacccggcgccagcgucaaaauaucaugcaaagcauccggcuacaccuucacuuccuacgccaugaacuggguccgccaagcccccggccaaggacucgaauccaugggcuggaucaacacaaacaccggaaacccaacauacgcacagggcuucaccggucgcuucgucuucagcauggacaccuccgucuccaccgcauaccuccaaauuagcucccucaaagcugaagauaccgccaucuacuacugcgcuccacgcuacuccucaucaugguaccuggacuacuggggccagggcacccuggucaccgucucgagcgccucaacaaaaggcccgucagucuucccgcuagcccccucauccaaauccaccucaggcggcaccgccgcccucggcugccucgucaaagacuacuuccccgaacccgucacgguaucauggaacucaggcgcacuaaccucuggcguccacaccuucccugcaguccuucaaucauccggccuauauucacucuccuccguagucaccgucccauccuccucacuuggcacccaaaccuacaucugcaacgugaaccacaaaccaagcaacaccaaagucgacaaacgcguugaaccuaaauccugcgacaaaacccacacaugcccacccugucccgcccccgaacuacucggcggacccagcgucuuccucuuuccacccaaacccaaagacacccuaaugaucucgcgcacacccgaaguaaccugcgucgucgucgacgucucccacgaagaccccgaaguuaaauucaacugguacguagauggcgucgaaguccacaacgccaaaaccaaaccccgcgaagaacaauauaacuccaccuaccgcgucgucagcguccuuaccguccuccaccaagacuggcucaacgguaaagaauacaaaugcaaagucuccaacaaagcccuccccgcacccauagagaaaaccauuucaaaagccaaaggccaaccccgcgaaccacaaguauacacccuaccacccucacgcgaagaaaugaccaaaaaccaagucucccugaccugccucguaaaaggauucuaccccuccgacaucgcagucgaaugggaauccaacggacaacccgaaaacaacuacaaaaccacgcccccgguccuagacucagacgguuccuucuuucucuacagcaaacucaccgucgacaaaagccgcuggcaacaaggcaauguauucucaugcucagucaugcacgaagcccuccacaaccacuacacccaaaaaucacucucucuaucccccggaaaa

SEQ ID NO: 53800 - RNA, 645 nt, Artificial Sequence
  derived and/or modified sequence opt11 from Flanvotumab_LightChain1
gaaaucguccuaacccaaucccccgcaacacucucccucucacccggcgaacgcgccacccucuccugccgcgcaucccaaucagucuccuccuaccuugcaugguaccaacaaaaacccggccaagcaccccgccuccucaucuacgacgccuccaaccgagccaccggaauccccgcccgcuucucaggcuccggcuccggaaccgacuucacccucaccaucuccucccuagaacccgaagacuucgccgucuacuacugccaacaacgcucaaacuggcucauguacaccuucggccaaggaaccaaacucgaaaucaaacgcaccgucgccgccccauccgucuucaucuucccacccuccgacgaacaacucaaauccggcacagccuccgucgucugccuccucaacaacuucuacccccgcgaagccaaaguccaauggaaagucgacaacgcccuccaauccggcaacucacaagaauccgucaccgaacaagacuccaaagacuccaccuacucccucuccucuacccucacccucuccaaagccgacuacgaaaaacacaaagucuacgccugcgaagucacccaccaaggccucuccucccccguaaccaaauccuucaaccgcggcgaaugc

SEQ ID NO: 53801 - RNA, 1362 nt, Artificial Sequence
  derived and/or modified sequence opt11 from Fletikumab_HeavyChain1
caaguacagcucguccaauccggcgcugaagucaaacgccccggcgccagcgucaaagucucgugcaaagccuccggcuacaccuucaccaaugacauaauucacuggguacgacaagcccccggacaacgccuagaauggaugggcuggaucaacgccggcuacggcaacacacaauacucacaaaauuuccaagaccgcgucuccaucacacgugacaccuccgccuccaccgccuacauggaauuaaucucccuucgauccgaggauaccgcaguuuacuacugcgcccgcgaaccccucugguucggcgaauccuccccacacgacuacuauggcauggaugucuggggccaaggaacaaccguaaccgucucaucagccucaaccaaaggucccuccgucuucccccuugcccccugcagccgaucuaccuccgaauccaccgcugcccuaggaugccucguaaaagacuacuuccccgaacccgucacagucuccuggaacucaggcgcccucaccuccggcguccacaccuucccagccguccuccaauccuccggacucuacucccucuccuccgucgucacaguccccuccuccucccuuggcacaaaaaccuauaccugcaacgucgaccacaaaccaagcaacaccaaagucgacaaacgcgucgaauccaaauacggcccacccugcccacccugccccgcacccgaauuucuaggcggccccuccgucuuccucuucccacccaaacccaaagacacacucaugaucagccgcacacccgaagucacaugcgucguagucgacgugucccaagaagaccccgaaguucaauucaacugguacgucgacggcgucgaaguccacaacgcaaaaacaaaacccagagaagaacaauucaacuccacauaccguguuguuucaguccucacaguacuccaccaggacuggcuaaacggaaaggaauacaaaugcaaagucuccaacaagggccuccccucuuccaucgagaaaaccaucuccaaggccaaaggucaaccccgagaaccccaagucuacacccucccacccagccaggaagaaaugaccaaaaaccaaguaagccucacuugccuagucaaaggauucuaccccucagacauagccgucgaaugggaauccaauggacaacccgaaaacaauuacaagacaacaccacccguacucgacuccgacggcagcuucuuucucuacucacgccucaccgucgacaaauccagguggcaggaaggcaacguuuucagcugcuccgucaugcacgaggccuuacacaaccacuacacccagaaaucacucagccucucccucggaaaa

SEQ ID NO: 53802 - RNA, 642 nt, Artificial Sequence
  derived and/or modified sequence opt11 from Fletikumab_LightChain1
gccauccaacuaacccaaucacccucaucccucuccgccagcgucggcgaccgcgucaccauaaccugccgcgccucacaaggcaucuccuccgcccuagccugguaccaacaaaaacccggcaaagcccccaagcuccucaucuacgacgccagcucccucgaauccggaguccccuccagauucucaggcuccggcucgggcaccgacuucacccucaccaucuccucacuccaacccgaagacuucgccaccuacuacugccaacaauucaacucauacccccucaccuucggaggcggcaccaaagucgaaaucaaacgcacagucgcagcccccuccguauucaucuucccacccucagacgaacaacucaaauccggcacagccuccgucgucugccuacucaacaacuucuacccccgcgaagccaaaguccaauggaaagucgacaacgcccuccaauccggcaacucacaagaaucagucacagaacaagacagcaaagacucaaccuacucacuauccucaacccuaacacuauccaaagccgacuacgaaaaacacaaagucuacgccugcgaagucacacaccaaggccucuccucccccgucaccaaauccuucaacagaggcgaaugc

SEQ ID NO: 53803 - RNA, 1341 nt, Artificial Sequence
  derived and/or modified sequence opt11 from Fontolizumab_HeavyChain1
caaguccaacucguccaauccggcgccgaacucaaaaagccaggcuccucagucaagguauccugcaaagccuccggcuacaucuucaccucuucuuggauaaacugggucaaacaagcccccggccagggccuagaauggauagggagaaucgaccccuccgacggcgaaguccacuacaaucaagacuucaaagauaaggccacccuaaccgucgacaaauccaccaacacagcauacauggaacucucaucacucagauccgaagacacugccguauacuacugugcccgcggcuuccuccccugguucgccgacuggggccaaggcacgcuaguuaccgucuccuccgccucaaccaaaggaccauccgucuucccccuugcacccuccagcaaaucaaccagcggaggaacagcagcccucggcugccuagucaaagacuauuuccccgaaccagucaccguauccuggaacucaggagcccuaaccuccggaguacacacauuccccgcaguacuccaauccagcggacucuacagccucucaucagucgucaccguacccuccucuagccucggcacccaaaccuacaucugcaacgucaaccacaaaccaucaaacaccaaagucgacaagaaagucgaacccaaauccugcgacaaaacccauaccugcccacccugcccagcccccgaacuccucggcggcccaagcgucuuccuauucccacccaaacccaaagacacccucaugauaucccgaacccccgaaguaaccugcgucgucgucgacgucucccacgaagaccccgaaguaaaauucaacugguacgucgacggagucgaaguccacaacgcaaagaccaaaccaagagaagaacaauacaacuccaccuaccgagucgugaguguccucacaguccuccaccaagacuggcuuaacggcaaagaauacaaaugcaaagucucaaacaaagcccuccccgcaccaaucgaaaagaccaucuccaaagccaaaggccaaccccgcgaaccccaagucuacacccuacccccgagcagggacgaacucaccaaaaaccaagucucucucaccugucuuguaaaaggguucuaucccucggacaucgccguugaaugggaaucgaacggccaaccagaaaacaacuacaaaacaaccccucccguccuagacuccgacggcuccuucuuccucuacuccaaacucacugucgauaaaucucgcuggcaacaaggaaacguauucuccugcuccgucaugcacgaagcacuccacaaccacuacacccaaaaaucccuaagccucagccccggcaaa

SEQ ID NO: 53804 - RNA, 642 nt, Artificial Sequence
  derived and/or modified sequence opt11 from Fontolizumab_LightChain1
gacauccaaaugacccaaagccccucgacccucuccgccuccgucggcgaccgcgucacaauaaccugcaaagccuccgaaaacguagacaccuacgucuccugguaccaacaaaaacccggcaaagcccccaaacuccucaucuacggagccuccaaccgcuacacaggcguccccucccgauucuccggcuccggauccggcaccgacuucacccuuaccaucuccucccuccaacccgacgacuucgccaccuacuacugcggacaauccuacaacuacccuuucaccuucggccaaggaaccaaagucgaagucaaacgcaccgucgccgcccccuccgucuucaucuucccacccuccgaugaacaacucaaaucaggcaccgccuccgucgucugccuccucaacaacuucuacccccgcgaagccaaaguccaauggaaagucgacaacgcccuccaaagcggcaacucccaagaauccguaaccgaacaagacucaaaagacuccaccuacucccucuccuccacccuaacccucuccaaagccgacuaugaaaaacacaaagucuacgccugcgaagucacccaccaaggccucuccuccccagucaccaaaucauucaaccgcggcgaaugc

SEQ ID NO: 53805 - RNA, 1344 nt, Artificial Sequence
  derived and/or modified sequence opt11 from Foralumab_HeavyChain1
cagguacagcucguagaaagcggcggcggcgucguacaacccggccgcucccucagacuauccugcgccgccuccggauucaaauucagcggcuacggaaugcacuggguacgccaagcacccggaaaaggccucgaaugggucgccgucaucugguacgacggcuccaagaaauacuacgucgauuccgugaaaggccgauucacaauaucacgugacaacuccaaaaacacccuauaccuccaaaugaacucacuacgagcagaagacaccgccguauacuacugcgcccgacaaaugggcuacuggcacuucgaccucuggggccguggcacccuagucaccguaagcuccgccuccaccaaaggccccuccgucuucccccucgcaccauccuccaaaucgaccuccggcggcaccgccgcccucggaugccucguaaaagauuacuuccccgaaccagucaccgucuccuggaacuccggugcccucaccuccggcgugcacacauucccugcaguccuccaaucaucuggccucuacucccucucuuccgucguaaccgucccauccagcucccucggcacccaaaccuacaucugcaacgucaaccacaaaccauccaacaccaaagucgacaaacgcgucgaacccaaauccugcgacaaaacccacacaugcccaccaugccccgccccagaggccgaaggcggccccagcgucuuucucuucccucccaaacccaaagacacccuaaugaucuccagaacccccgaagucaccugugucgucgucgacgucucccacgaagacccugaaguaaaauucaacugguauguggacggcgucgaaguccacaacgccaaaaccaaacccagagaagaacaauacaacucaaccuaccgcguagucucaguacuuacaguccuccaccaagacuggcucaacgggaaagaauacaaaugcaaaguaagcaacaaagcccuccccgccccaaucgagaaaaccauuagcaaagccaaaggacaaccccgcgaaccccaagucuacacccuacccccaucccgcgaagaaaugaccaaaaaucaagucucgcuaaccugccucgucaaaggcuuuuaccccagcgacaucgccguagaaugggaauccaacggccaacccgaaaacaacuacaaaaccaccccacccguccucgacuccgacggcagcuucuuccucuacuccaaacucaccguagauaaauccagauggcaacaaggaaacgucuucucaugcuccguaaugcacgaagcccuacacaaccacuacacacaaaaaucacucucacucucccccggcaaa

SEQ ID NO: 53806 - RNA, 645 nt, Artificial Sequence
  derived and/or modified sequence opt11 from Foralumab_LightChain1
gaaaucguccucacacaaucccccgccacccucucccucucccccggcgaacgcgccacccucucaugccgagccucccaauccgucuccuccuaccucgccugguaccaacaaaaacccggccaagccccccgccuccucaucuacgacgccuccaaccgugccaccggcauccccgcccgauucuccggcuccggcuccggcaccgacuucacccucacaaucuccucccucgaacccgaagacuucgccgucuacuacugccaacaacgcuccaacuggcccccccucaccuucggcggcggcaccaaaguagaaaucaaacgcaccgucgccgccccauccgucuucaucuucccccccuccgacgaacaacucaaauccggaaccgccuccgucgucugccuccucaacaacuucuacccacgcgaagccaaaguccaauggaaaguagacaacgcccuccaauccggcaacucccaagaaucagucaccgaacaagacucaaaagacuccaccuacucccucucauccacccucacccucucuaaagccgacuacgaaaaacacaaagucuacgccugcgaagucacccaccaaggacucuccucccccgucacuaaauccuucaaccgcggcgaaugc

SEQ ID NO: 53807 - RNA, 1344 nt, Artificial Sequence
  derived and/or modified sequence opt11 from Foravirumab_HeavyChain1
caaguccaguuagucgaauccggcggaggcgccguccaaccgggccguucccuuagacucuccugcgccgccuccggcuucaccuucuccagcuacggcaugcacugggucagacaagcaccaggaaaaggacucgaaugggucgccguaauccuuuacgacggcuccgacaaauucuacgccgacuccgucaaaggccgcuucaccaucucccgagacaacucuaaaaacacucucuaccuccaaaugaacucccuacgcgccgaggacacugcagucuacuacugcgcuaaagucgccgucgccggcacccauuucgacuacuggggccaaggcacccucgucacagucucauccgccuccacgaaagguccauccguauuuccccucgcccccucauccaaaucuaccuccggcgguaccgccgcccucggcugccuugucaaagacuacuuccccgaacccgucaccguauccuggaacuccggagcccuaaccuccggcguccacaccuuccccgcaguccuccaauccuccggacucuacucccucuccuccguaguuaccgucccauccuccucacuuggaacacaaaccuauaucugcaacgucaaccacaaacccagcaacaccaaaguagacaaacgcguugagcccaaaucaugcgacaaaacccacaccuguccacccugccccgcccccgaacuccucggcggcccaucaguauuccucuucccacccaaacccaaagacacacuaaugaucucgcgcacccccgagguaaccugcgucgucgucgacgucucacacgaagaccccgaagucaaauuuaacugguacguugacggcguagaaguccacaacgcuaaaaccaaaccccgagaagaacaauacaacucaaccuaccgcgucguauccguacuaaccguccuucaccaagacuggcucaauggcaaagaauacaaaugcaaagucucuaacaaagcccuacccgcccccauugagaaaaccaucuccaaagcaaaaggacaaccccgcgaaccccaagucuauacacuaccacccucccgagaagaaaugaccaaaaaccaagucuccuuaaccugccucgucaaaggauucuaccccuccgacaucgccgucgaaugggagagcaacggccaacccgaaaacaacuacaaaaccacaccgcccguacucgacucagacggcucauucuuucuauacuccaaacuaacaguagacaaaucacgauggcaacaaggcaacgucuuuuccugcucagucaugcacgaagcccuacacaaccacuacacccaaaaaucccuaucccucucccccggc

SEQ ID NO: 53808 - RNA, 1344 nt, Artificial Sequence
  derived and/or modified sequence opt11 from Foravirumab_HeavyChain
gaaguacagcuaguugaauccggcggaggagccguccaacccggccgcucccucagacuauccugcgcugccagcggauucaccuucagcucauacggcaugcacugggucagacaagcacccggcaaaggucuggaaugggucgcagucauccuauacgacggcuccgacaaauucuacgcagacuccgucaaaggacgauucaccaucucccgcgacaacuccaaaaacacccuauaccuccaaaugaacucccucagagcagaagacacagccguauauuacugcgccaaagucgccgucgccggaacacacuucgacuacugggggcaaggcacucuagucaccgucucuuccgccuccaccaagggcccaagcgucuucccccuggcacccuccuccaaauccacauccggcggaacagcagcacugggcugccuagucaaagacuacuuccccgaaccugucaccgucagcuggaacucaggagcgcucacauccggcguucacacuuucccugccguacuacaauccucaggccucuacuccuuaucaucagucguaacuguccccuccuccucacuaggcacucaaacauacaucugcaacgucaaccacaagcccucaaacaccaaaguagacaaacgagucgaacccaaauccugcgacaaaacacacacaugcccgcccugccccgccccugaacuccuuggaggccccagcgucuuccucuucccacccaaacccaaagacacacuaaugaucucccguacccccgaaguaaccugcgucgugguagacgucagccacgaagaccccgaagucaaauucaacugguacgucgacgggguagaaguccauaacgccaaaacaaaaccccgcgaagaacaauacaacucaaccuaccgagucgucucagugcucacaguccuccaccaagacuggcucaacggaaaagaauacaaaugcaaaguauccaacaaagcccuacccgcucccaucgaaaagacaauaucaaaagccaaaggccaaccccgagaaccccaaguauacacccucccucccucacgagaagaaaugaccaaaaaccaagucucacucacuugccucgucaaaggauucuaccccuccgacauagcaguagaaugggaauccaacggccaaccagaaaacaacuacaaaacaaccccucccguccucgacuccgacggcuccuucuuccucuacucaaagcuaaccgucgacaaauccagauggcaacaaggcaacguauucucaugcuccguaaugcacgaagcccuccacaaccauuacacccaaaagucccucucccucagccccggc

SEQ ID NO: 53809 - RNA, 642 nt, Artificial Sequence
  derived and/or modified sequence opt11 from Foravirumab_LightChain1
gacauccaaaugacccaaucacccuccucccuauccgcauccguaggcgaccgcgucaccauaaccugccgcgcaucccaaggcauccgcaacgaccuaggcugguaccaacaaaaacccggaaaagcccccaaacuccucaucuacgccgccuccucccuccaauccggcguacccucccgcuucucaggcuccggcuccggaacagacuucacccucaccaucagcucacuccaacccgaagacuucgccaccuacuacugccaacaacucaacucauacccacccaccuucggcggcggcacaaaagucgaaauuaaacguaccguagccgcacccuccgucuucaucuucccacccuccgacgaacaacucaaauccggcaccgccucagucgucugccuacucaacaacuucuacccccgcgaagccaaaguccaauggaaagucgacaacgcccuccaauccggaaacucccaagagagcgucaccgaacaagacuccaaagacucaaccuacucacuauccuccacccuaacccuauccaaagccgacuacgaaaaacacaaagucuacgcaugcgaagucacacaccaaggccucagcucacccgucaccaaauccuucaaccgcggcgaaugc

SEQ ID NO: 53810 - RNA, 1341 nt, Artificial Sequence
  derived and/or modified sequence opt11 from Fresolimumab_HeavyChain1
caaguucaacucguccaaucaggagccgaagucaagaaacccggcucauccgucaaaguuucuugcaaagccagcggauauaccuucuccucaaacgucauauccuggguccggcaagcacccggucaagggcucgaauggaugggcggcguuauacccauagucgacauagcaaacuacgcccaacgcuucaaaggaagagucacaaucaccgccgacgaauccaccucgaccaccuacauggaacucuccucacuacgcuccgaagacaccgccgucuacuacugcgccucaacacucggccuaguccucgacgccauggacuacuggggccagggcacucucgucaccguauccagcgcauccacaaaaggacccagcgucuucccccuagcacccugcagccgaucaaccuccgagucuacagcagcccucggcugccuagucaaagacuacuucccagaaccagucaccgucuccuggaacuccggcgcccucacauccggcguccacaccuucccagccguccuccaaaguuccggccucuacucacuuuccagcguaguaacaguucccuccucaucucuaggcaccaaaaccuacacuugcaaugucgaucacaaaccauccaacaccaaagucgacaaacgcgucgaaucuaaauacggaccacccugucccuccugccccgccccagaguuccucggcggaccaucagucuuccucuucccacccaaaccaaaagacacccucaugaucucccgcaccccagagguaaccugcgucgucgucgacgucagccaagaagacccagaaguccaauucaacugguacguagacggagucgaaguucacaacgcaaaaacaaaaccccgagaagaacaauucaacucaacauaccgcguggucucaguccucacaguccuccaccaagacuggcucaacggcaaagaauacaaaugcaaagucuccaacaaaggccuacccuccuccaucgagaaaaccauaucaaaagccaaaggccaaccccgcgaaccacaagucuacacacucccacccucucaagaagaaaugaccaaaaaccaagugucacucacaugccucgucaagggcuucuaccccuccgacaucgcagucgaaugggaauccaacggccagcccgaaaacaacuacaaaaccacacccccaguccucgacucagacggauccuucuuccucuauucccgccuaacaguagacaaaucccgcuggcaggaagggaacgucuucuccugcuccguaaugcaugaagcccuacacaaccacuacacccaaaaaucccuaucucucucacucgggaaa

SEQ ID NO: 53811 - RNA, 645 nt, Artificial Sequence
  derived and/or modified sequence opt11 from Fresolimumab_LightChain1
gaaacaguccuaacccaaucccccggcacucucucccucucccccggcgaacgcgcaacucucucuugccgcgccucccaaucccucggcuccuccuaccucgccugguaccaacaaaaacccggacaagcaccccgucuccucaucuacggcgccuccucccgcgccccuggcauccccgaccgauucuccggcucaggcuccggcaccgacuucacccucaccaucucccgucuagaacccgaagacuucgccgucuacuacugccaacaauacgccgacuccccaaucaccuucggccaaggcacccgacucgaaaucaaacgcaccgucgccgcccccuccgucuucaucuucccacccuccgacgaacaacucaaauccggcaccgccuccgucgucugccuccucaacaacuucuacccccgagaagccaaaguccaauggaaagucgacaacgcccuccaauccggcaacucccaagaaucagucaccgaacaagacuccaaagacucaacauacucccuauccucaacccucacccucuccaaagccgacuacgaaaaacacaaagucuacgccugcgaagucacacaccaaggccucucaucccccgucacaaaauccuucaaccgcggcgaaugc

SEQ ID NO: 53812 - RNA, 1347 nt, Artificial Sequence
  derived and/or modified sequence opt11 from Fulranumab_HeavyChain1
gaaguacaacucgucgaauccggaggcggccuaguucaacccggaggcucccuaagacuauccugugccgcguccggcuucacccucagauccuacuccaugaacuggguccgccaagcccccggcaaaggccucgaaugggucucauauaucucccgauccagccacaccaucuucuacgcagacagcguaaaaggucgcuucaccaucucccgagauaacgcgaaaaacucacucuaccuucaaauggacucacuucgagacgaagacaccgccauguacuacugcgcccgagucuacucauccggcuggcacguauccgacuacuucgacuauuggggacaaggcauccucgucacagucucauccgccagcaccaaaggaccaagcgucuucccccuagcccccugcucacgcuccacaucugaauccaccgccgcccucggcugccucgucaaagacuauuuccccgaaccagucaccgucucauggaacuccggcgcccuaaccucaggcguacauaccuucccagccguccuccaaucauccggacuuuacucccucuccuccguagucacaguccccucuuccaacuucggaacacaaaccuacacaugcaacgucgaccacaaacccuccaacaccaaagucgacaaaaccguugaacgcaaaugcugcgucgaaugcccacccugcccagccccaccaguugccggccccuccguauuccuauuucccccgaagcccaaagacacacuaaugaucucucgcacccccgaagucaccugugucgucgucgacgucucccacgaagacccagaaguccaauucaacugguacgucgacggcgucgaaguacacaacgcaaaaaccaaaccccgagaagaacaauucaacuccacauuccgaguagucuccguccuaaccgucguccaccaagacuggcucaacggaaaagaauacaaaugcaaagucuccaacaaaggacuaccggccccaaucgagaaaaccauauccaaaacaaaaggccaaccccgcgaaccccaagucuacacacucccacccucccgcgaggaaaugaccaaaaaccaggugucacucacaugcuuagucaaaggcuucuaccccuccgacaucgcagucgaaugggaaucaaacggacaacccgaaaacaacuacaaaacgacaccacccaugcucgacagcgacggaucauucuuccuauacucgaaacuuacugucgacaaaucacguuggcaacaaggcaacguuuucuccuguuccgucaugcacgaagcccuucacaaccacuacacacaaaaaucccucucccucucccccggcaaa

SEQ ID NO: 53813 - RNA, 642 nt, Artificial Sequence
  derived and/or modified sequence opt11 from Fulranumab_LightChain1
gccauccaacuaacacaaucccccuccucccuauccgccuccgucggcgaccgcguaaccaucacaugccgcgccucccaaggcaucuccuccgcccucgccugguaccaacaaaaacccggcaaagcccccaaacuccucaucuacgacgcauccucacucgaauccggcgucccaucucgcuucuccggauccggcucaggcaccgacuucacacuaaccaucuccucccuccaacccgaagacuucgccaccuacuacugccaacaauucaacuccuacccacucaccuucggcggcggcaccaaagucgaaaucaaacgcacagucgccgcccccuccguauucaucuucccacccucagacgaacaacucaaaucaggaacagccucagucgucugccuacuuaacaacuucuacccccgcgaagccaaaguccaauggaaaguagacaacgcccuccaauccggcaacucccaagaauccguaaccgaacaagacucuaaagacucaaccuacucacucucuucaacccucacacucuccaaagccgacuacgaaaaacacaaagucuacgccugcgaagucacacaccaaggccucuccuccccagucaccaaauccuucaaccgcggcgaaugc

SEQ ID NO: 53814 - RNA, 1356 nt, Artificial Sequence
  derived and/or modified sequence opt11 from Futuximab_HeavyChain1
gagguacaacuccaacaacccggcuccgaacugguccgccccggcgccuccgucaaacucagcugcaaagccuccggauacaccuucaccuccuacuggaugcacuggguaaaacaacgccccggccaaggccucgaauggaucggcaacauauaccccggcucucgcagcaccaacuacgacgaaaaauucaagucuaaagcaacccucaccgucgacaccagcucauccaccgcauacaugcaacucagcucacuuaccuccgaagauucagccguauacuacugcacccgaaacggagacuacuacgucucauccggcgacgccauggacuacuggggccaaggaacuuccgucaccguauccuccgcaucaacaaagggcccaucaguauucccccucgcacccucaagcaaauccaccucgggcggaaccgcagcccucggaugccucguaaaagauuacuuccccgaacccgucaccgucuccuggaacagcggcgcccucaccuccggcguccacacauucccagccguccuacaaucaucaggccucuacucccucucauccguagucaccguaccauccucuucccucggcacccaaaccuacauaugcaacguaaaucacaaaccauccaacacaaaggucgacaaacgcguagaaccaaaauccugcgacaaaacccacacaugcccacccugccccgcccccgagcuacuaggcggaccauccgucuuccuauucccacccaaacccaaagacacccucaugaucucacgcacaccagagguaaccugcgucgucgucgauguuagccacgaagaccccgaagucaaauucaacugguacgucgacggcguagaaguacacaacgccaaaaccaagccccgcgaggaacaguacaacucaaccuaccgcguagucuccguccucaccguacuccaccaagacuggcuuaacggcaaagaauacaaaugcaaaguaucaaacaaagcccucccagcacccaucgaaaagacgauaagcaaagcgaaaggccaacccagagaaccccaggucuacacucuaccacccucccgcgaagaaaugaccaaaaaccaagucucccuaaccugccucgucaagggcuucuaccccuccgacaucgcagucgaaugggaaucaaacggacaacccgaaaacaacuacaaaacaacaccacccguccucgacuccgacggauccuucuuccucuacucaaagcucaccguagacaaaucacgcuggcaacaaggaaacgucuucucaugcucugucaugcacgaagcccuccacaaccacuacacccaaaaaucccucucucucucacccgga

SEQ ID NO: 53815 - RNA, 642 nt, Artificial Sequence
  derived and/or modified sequence opt11 from Futuximab_LightChain1
gacauccaaaugacccaaaccaccuccucacucuccgccucccucggcgaccgcgucaccauauccugccgcaccucccaagacaucggcaauuaccucaacugguaccaacaaaaacccgacggcaccgucaaacuccucaucuacuacaccucccgccuccacuccggcguccccucccgcuucucaggcuccggcuccggcaccgacuucucccuaaccaucaacaacgucgaacaagaagacgucgccacauacuucugccaacacuacaacacagucccccccacauucggcggcggcaccaaacucgaaaucaaacgcaccgucgccgcccccuccgucuucaucuucccccccuccgacgaacaacuaaaauccggcaccgccuccguaguaugccuccucaacaacuucuacccccgcgaagccaaaguccaauggaaagucgacaacgcccuucaauccggcaacucccaagaauccgucaccgaacaagacuccaaagacuccaccuacucccucuccuccacccucacccucuccaaagccgacuacgaaaaacacaaaguauacgcaugcgaaguaacccaccaaggccucuccucccccgucaccaaauccuucaaccgcggugaaugc

SEQ ID NO: 53816 - RNA, 1335 nt, Artificial Sequence
  derived and/or modified sequence opt11 from Galcanezumab_HeavyChain1
cagguccaacucguacaaucaggcgcagaaguaaagaaacccgguagcucagucaaagucuccugcaaagccucaggcuacaccuucggcaacuacuggaugcaauggguccgccaagcccccggccagggacucgaauggaugggcgccaucuaugaaggcacgggcaaaaccgucuacauccaaaaauucgccgaccgcgucacaaucaccgcagacaaaucgaccuccaccgccuacauggaacucagcucacucagauccgaagacacagccgucuacuauugcgcgcgccucagcgauuacguauccgguuucgguuacuggggacagggcaccaccgugaccguauccucggcuucaacaaaaggccccagcguauucccccucgcccccugcagccgauccacaucagaauccaccgccgcacuaggaugccuagucaaagacuacuucccagaaccagucaccguaucauggaacagcggagcccuaaccucaggcguacacaccuuccccgcaguccuacaauccuccggccucuacucccucucauccgucgucacagucccaagcuccuccuugggcacgaaaacguauaccugcaacgucgaccacaaacccuccaacacgaaaguggacaaacgcguagaauccaaauacggcccgcccugcccacccugccccgcccccgaagcagccggaggccccagcguauuccucuucccacccaagccaaaggacacccucaugauaucccgaacgcccgaaguaaccugcguagucguggacgugucccaagaagaccccgaaguacaauucaauugguacgucgacggcgucgaaguccacaacgccaaaacaaaaccccgcgaagaacaauucaacucaaccuaccgcguggucucaguccugaccguacuccaccaagacuggcuaaacggaaaagaauacaaaugcaaagucuccaacaaaggccuacccuccagcaucgaaaagaccaucucaaaagccaaaggccaaccacgagaaccccaaguauacacgcucccgcccucucaagaagaaaugaccaaaaaccaagucucacucacaugccuagucaaaggcuucuaccccagcgacaucgccgucgaaugggaauccaacggccagcccgaaaacaacuacaaaaccacaccacccguccuagacuccgacggcuccuucuuccucuauucacgccucaccguggacaaaagccgguggcaggaaggcaacguauuuuccugcuccguaaugcacgaagcacuccacaaccacuacacccagaaaucacuaucccuaucgcucggc

SEQ ID NO: 53817 - RNA, 642 nt, Artificial Sequence
  derived and/or modified sequence opt11 from Galcanezumab_LightChain1
gacauccaaaugacccaaucccccucaagccucuccgccuccgucggcgaccgagucaccaucaccugccgcgccuccaaagacaucuccaaauaccucaacugguaccaacaaaaacccggcaaagcccccaaacuccucaucuacuacaccuccggcuaccacuccggcguccccucccgauucuccggcuccggcuccggcaccgacuucacccuaaccaucuccucccuacaacccgaagacuucgccaccuacuacugccaacaaggcgacgcccucccacccacuuucggcggcggaaccaaagucgaaaucaaacgaaccgucgccgcccccuccgucuucauauucccccccuccgacgaacaacucaaauccggcaccgccuccgucgucugccuccucaacaacuucuacccccgugaagccaaaguccaauggaaagucgacaacgcccuccaauccggaaacucacaagaauccgucacagaacaagacucuaaagacuccaccuacucacucuccuccacccucacccucuccaaagccgacuacgaaaaacacaaagucuacgccugcgaagucacccaccaaggccuauccucacccgucaccaaauccuucaaccgcggcgaaugc

SEQ ID NO: 53818 - RNA, 1371 nt, Artificial Sequence
  derived and/or modified sequence opt11 from Galiximab_HeavyChain1
caaguccaacuccaagaaagcggacccggccuagucaagcccuccgaaacccucucucuaaccugcgccgucucgggcggauccaucucuggcggcuacggcuggggcuggauaagacaaccacccggcaaaggacucgaauggauaggaucuuucuacucaucuuccgguaacaccuacuacaaccccucucucaaaucccaagucacaaucuccacagacaccuccaagaaccaguucucccucaaacucaacuccaugaccgccgcagacaccgcagucuacuacugcguccgagaccgccuauucagcguagucggcauggucuacaacaacugguuugacguauggggccccggcguccuagucacugucuccuccgccuccaccaaagggcccucugucuucccccuagcccccucgagcaaaagcaccuccggcggcaccgcagcccucggcugccuagucaaagacuacuuccccgaacccgucaccguaucuuggaacuccggggcccucacaaguggcguccacaccuuccccgccguacuacaauccuccggccucuacucacucuccuccgucguaacaguccccuccucaucacuagguacccaaacauacauuugcaacguuaaccacaaacccuccaacaccaaagucgacaagaaagccgaacccaaauccugugacaaaacccacaccuguccacccugccccgcccccgaacuccucggcggcccuuccgucuuccucuucccaccaaaacccaaagacacccuaaugaucucccgcacccccgaaguuaccugcgucgucgucgacgucucccacgaagacccagaagucaaauucaacugguacguagacggagucgaaguccacaacgccaaaaccaaaccccgcgaagaacaauacaacucuaccuaccgagucgucucaguacucaccguccuccaccaagacuggcucaacggcaaagaauacaaaugcaaagucucuaauaaagcccucccagccccgauugagaaaacaaucucaaaagccaaaggccaaccacgcgaaccccaaguauacacccuacccccaucccgcgaugaacucaccaaaaaccaagucucccugaccugccucgucaaaggcuucuaccccagcgauauagcagucgaaugggaauccaacggucaacccgaaaacaacuauaaaacaacuccacccguccucgacuccgacggcagcuuuuuccucuacuccaaacucaccgucgacaaauccagauggcaacaaggcaacgucuucagcugcucagucaugcacgaagcccuucacaaccacuacacacaaaaaucacucucucucagccccggcaaa

SEQ ID NO: 53819 - RNA, 648 nt, Artificial Sequence
  derived and/or modified sequence opt11 from Galiximab_LightChain1
gaaucagcccucacccaacccccaagcgucuccggcgcccccggccaaaaagucaccaucuccugcaccggcuccaccucaaacaucggcggcuacgaccuccacugguaccaacaacuccccggcaccgcacccaaacuccucaucuacgacaucaacaaacgccccuccggaaucuccgaccgcuucuccggcuccaaauccggcacagccgccucccucgccaucaccggccuacaaaccgaagacgaagccgacuacuacugccaauccuacgacucaucccuaaacgcccaagucuucggcggaggaacccgccuaaccguccucggccaacccaaagccgcccccaccgucacccucuucccccccuccuccgaagaacuacaagccaacaaagccacccucgucugccuuaucuccgacuucuacccaggcgccgucaccgucgccuggaaagccgacuccucccccgucaaagccggcguagaaaccaccacccccuccaaacaauccaacaacaaauacgcagccuccuccuaccucucacuaacccccgaacaauggaaaucccaccgcuccuacuccugccaagucacacacgaaggcuccacagucgaaaaaaccgucgcccccacagaaugcucc

SEQ ID NO: 53820 - RNA, 1347 nt, Artificial Sequence
  derived and/or modified sequence opt11 from Ganitumab_HeavyChain1
cagguacaacuacaagaauccggccccggucucguuaaaccauccggcacccuaucacuuaccugcgccgucuccgguggauccaucucauccagcaacugguggagcugggucagacaaccucccggcaaaggccucgaauggaucggcgaaaucuaccacagcggaucgaccaacuacaaccccucccucaaaagccgcgucaccauauccguagacaaauccaaaaaccaauucucucucaaacucucaucugucacagccgccgacaccgccgucuacuacugcgcccgcuggaccggccgaaccgaugccuucgacauauggggacaaggcaccaugguaacagucuccuccgcauccaccaaaggaccauccguauucccccucgccccaucauccaaaagcaccagcggaggcaccgccgcacucggcugccucgugaaagacuacuucccagaacccguaaccgucucauggaacuccggagcccuuacauccggcguacacaccuucccugccguccuccaaagcuccggccucuacucacucucaucagucgucaccguccccucuuccucccucggaacccaaacuuacaucugcaacgucaaccacaaacccagcaacaccaaagucgacaaaaaggucgaacccaaaagcugcgacaaaacccacacaugcccacccugccccgcacccgaacugcucggaggcccgucaguauuccuauucccacccaaacccaaagacacccucaugaucucacgaacccccgaaguuacaugcguaguggucgacgucucccacgaagacccagaaguaaaauucaacugguaugucgacggcguagaaguacacaacgcaaaaaccaaaccccgagaagaacaauacaauuccacauaccgagucgugucaguccucaccguccuacaccaagacuggcugaacggaaaagaauacaaaugcaaagucuccaacaaagcccuacccgccccaauagagaaaacaaucagcaaagccaaaggucaaccccgagaaccccaaguauacacccucccacccucacgagacgaacucaccaaaaaccaagucucacuaaccugccuuguaaaaggcuucuacccuuccgacaucgccguagaaugggaauccaauggccaacccgaaaacaacuacaaaaccacacccccuguacucgacucagacggauccuucuuccuuuacucaaaacucaccgucgacaaaucccgcuggcaacagggaaacgucuucuccugcagcgucaugcacgaagcccuccacaaccacuacacccaaaaaucccuaagccuaucaccaggcaaa

SEQ ID NO: 53821 - RNA, 657 nt, Artificial Sequence
  derived and/or modified sequence opt11 from Ganitumab_LightChain1
gacguagucaugacccaaucuccccucucccucccagucacccccggcgaacccgccuccaucuccugccgauccucccaaucccuacuccacuccaacggcuacaacuaccucgacugguaccuccaaaaacccggccaaucaccccaacuccucaucuaccucggcuccaaccgcgcauccggcguccccgaccgcuucuccggcuccggcuccggcaccgacuucacccucaaaaucucccgaguagaagccgaagacgucggcgucuacuacugcaugcaaggcacccacuggccccucaccuucggccaaggcaccaaagucgaaaucaaacgcaccgucgccgcccccuccgucuucaucuucccacccucugacgaacaacucaaauccggcaccgcauccgucgucugccuccucaacaacuucuacccacgcgaagccaaaguacaauggaaagucgacaacgcccuccaaucaggcaacucccaagaauccgucaccgaacaagacuccaaagacuccacauacucccucuccucaacccucacccuaucaaaagccgacuacgaaaaacacaaagucuacgccugcgaagucacccaccaaggccucucauccccagucaccaaauccuucaaccgcggagaaugc

SEQ ID NO: 53822 - RNA, 1368 nt, Artificial Sequence
  derived and/or modified sequence opt11 from Gantenerumab_HeavyChain1
caagucgaacucgucgaauccggcggaggccuuguccaaccaggcggcucucuacgccucuccugugccgccuccggcuucaccuucuccucauacgccaugucauggguacgccaagcccccggcaaaggacucgaauggguaucagcuaucaacgcguccggcacccgcaccuacuacgcagauucugucaaaggcagauucaccauaucccgcgacaacagcaaaaacacccuauaccuacaaaugaacucacuccgcgccgaagacaccgccgucuacuacugcgcgcgcggcaaaggaaacacucacaaaccauacgguuauguccgcuacuucgacguuuggggccaagguacccucgucacagucuccuccgccucaaccaaaggcccauccgucuucccacuugcacccuccucaaaauccaccuccggcggaaccgccgcacucggaugccucgucaaagacuacuuccccgaacccgucaccgucucguggaacuccggagcacuaaccuccggcguccacacauucccagccguccuccaaucaucgggccucuacucacucagcuccgucgucaccguccccagcuccucccuaggcacccaaaccuacaucugcaacgucaaucacaaaccuagcaacacaaaaguagacaaaaagguagagccaaaaagcugcgacaaaacccacacaugcccacccugccccgcaccagaacuccucggcggcccaagcgucuuccucuuuccucccaaaccaaaagacacccucaugaucucccgcacaccugaaguaaccugcguagucgucgacguaucccacgaagacccagaaguaaaguuuaacugguacgucgacggcguagaaguacacaacgcaaaaaccaaaccccgcgaagaacaauacaacucaacauaccgcgucgucuccguccucacaguccuacaccaagacuggcucaacggcaaagaauacaaaugcaaagucuccaacaaagcucuacccgcccccauagagaaaaccaucuccaaagccaagggccaaccucgagaaccacaaguauacacccucccacccucccgagacgaacuaacgaaaaaccaagucucucuaaccugccuagucaaaggcuucuaccccuccgacaucgcagucgaaugggaauccaacggccaacccgaaaacaacuacaaaacaaccccuccaguccuagacucagacggaucauuuuuccucuacucaaaacucaccguggacaaaucccgcuggcagcaaggcaacgucuucagcugcuccgucaugcacgaagcccuacacaaccacuacacccaaaaaucacucucccucucaccaggcaaa

SEQ ID NO: 53823 - RNA, 645 nt, Artificial Sequence
  derived and/or modified sequence opt11 from Gantenerumab_LightChain1
gauaucguccucacccaaucccccgccacccucucccucucacccggcgaacgcgcaacacuauccugccgcgcaucccaaucagucucauccucauaccucgcaugguaccaacaaaaacccggccaagcaccccgccuccucauauacggcgccucaucccgcgccacaggcguccccgcccgauucuccggcuccggcuccggcacagacuucacccucaccauauccucccucgaacccgaagacuucgccaccuacuacugccuccaaauauacaacaugcccaucaccuucggacaaggcacaaaagucgaaaucaaacgcaccgucgccgcccccucagucuucauuuucccucccuccgacgaacaacucaaaucagguaccgccuccgucgucugccuccucaacaacuucuacccccgcgaagcaaaaguccaauggaaagucgacaacgcccuccaauccggcaacucccaagaauccgucaccgaacaagacuccaaagacucaacauacucccucuccuccacccucacccucucaaaagccgacuacgaaaaacacaaaguauacgccugcgaagucacccaccaaggccuuuccucccccgucacaaaauccuucaaccgaggcgaaugc

SEQ ID NO: 53824 - RNA, 348 nt, Artificial Sequence
  derived and/or modified sequence opt11 from Gemtuzumab_HeavyChain1
caaguccaacuccaacaauccggcgccgaacuagccaaacccggcgccuccgucaaaauguccugcaaagccuccggcuacacauucaccuccuaccgcaugcacugggucaaacaacgcccaggccaaggccucgaauggaucggcuacaucaaccccuccaccggcuacaccgaauacaaccaaaaauucaaagacaaagccacccuaaccgccgacaaauccuccuccaccgccuacaugcaacucuccucccucaccuucgaagacuccgccgucuacuacugcgcccgcggcggcggagucuucgacuacuggggccaaggcaccacccuaaccgucuccucc

SEQ ID NO: 53825 - RNA, 351 nt, Artificial Sequence
  derived and/or modified sequence opt11 from Gemtuzumab_HeavyChain2
caaguccaacucguccaauccggcgccgaagucaaaaaacccggcuccuccgucaaagucuccugcaaagccuccggcggcaccuucucccgcuccgccaucaucuggguccgccaagcccccggccaaggccucgaauggaugggcggcaucguccccauguucggcccccccaacuacgcccaaaaauuccaaggccgcgucaccaucaccgcagacgaauccaccaacaccgccuacauggaacucuccucccuccgcucugaagacaccgccuucuacuucugcgccggcggcuacggcaucuacucccccgaagaauacaacggcggccuagucaccgucuccucc

SEQ ID NO: 53826 - RNA, 321 nt, Artificial Sequence
  derived and/or modified sequence opt11 from Gemtuzumab_LightChain2
gacauccaaaugacccaaucccccuccacccuauccgccuccgucggcgaccgcgucaccaucaccugccgcgccucccaauccaucaacaccuggcucgccugguaccaacaaaaaccaggcaaagcccccaaacuccucauguacaaagccuccucccucgaauccggcguccccucccgauucaucggcuccggcuccggcaccgaauucacccucaccaucuccucccuccaacccgacgacuucgccaccuacuacugccaacaauacaacuccgacuccaaaauguucggccaaggcaccaaagucgaagucaaa

SEQ ID NO: 53827 - RNA, 318 nt, Artificial Sequence
  derived and/or modified sequence opt11 from Gemtuzumab_ozogamicin_LightChain1
caaaucguccucacccaaucccccgccaucauguccgccucccccggcgaaaaagucaccaucaccugcucagccuccuccuccaucuccuacaugcacugguuccaacaaaaacccggcaccucccccaaacuauggaucuacaccaccuccaaccucgccuccggcguccccgcccgcuucuccggcuccggcuccggcaccuccuacucccucaccaucucccgcauggaagccgaagacgccgccaccuacuacugccaccaacgcuccaccuacccccucaccuucggcuccggcaccaaacucgaacucaaa

SEQ ID NO: 53828 - RNA, 1335 nt, Artificial Sequence
  derived and/or modified sequence opt11 from Gevokizumab_HeavyChain1
caaguucaacuccaagaaucuggccccggacucguaaaacccucccaaacacuuagccuuaccugcagcuucuccggcuucucccucucaacauccggaaugggcgucggcuggauccgccaaccaucaggcaagggccucgaguggcucgcacacaucuggugggacggcgacgaaagcuacaacccaucccucaaaucacgccucaccauaucaaaagacacuagcaaaaaccaaguuucccucaaaaucaccucuguaaccgcagccgacacugcagucuacuucugcgcccguaaccgguacgacccacccugguucgucgacuggggccaaggcacucuagucaccgucucauccgccaguaccaaaggaccauccgucuucccgcuagcccccugcucccguucaaccuccgaaucaacagccgcccuaggcugccuaguaaaagacuacuuccccgaaccaguaaccgucucauggaacuccggcgcacucaccuccggaguccacaccuuccccgccguccuccaaucauccggccucuacucccuauccuccgucgucaccguaaccucaucaaacuucggcacccaaaccuacacaugcaacgucgaccacaaacccucaaacaccaaagucgacaaaaccgucgaacgcaaaugcugcguagaaugucccccaugcccagcacccccagucgccggaccaucaguauuucucuucccacccaagcccaaagauacacuuaugaucucccgcacacccgaagugaccugcgucguugucgacgucagccacgaagauccagaaguccaauucaacugguacguugacggcauggaaguccauaaugccaaaaccaaaccccgcgaagaacaauucaacuccacauuccgugucgugucaguccucaccgucguucaccaagacuggcucaacggcaaagaauacaaaugcaaagucucgaauaaaggccucccagcacccaucgagaaaacaauauccaaaacaaaaggccaaccccgcgaaccacaagucuacacacucccacccucccgagaagaaaugaccaaaaaccaagucucacuaaccugccucgucaaaggcuucuaccccuccgacauagccguagaaugggaauccaacggccaacccgagaacaacuacaaaacaaccccaccaaugcucgacagcgacggauccuucuuccucuacuccaaacucaccgucgacaaauccagauggcaacaaggcaacgucuucucaugcucagucaugcacgaagcccuacacaaccacuacacccaaaaaucccucucccucucaccugga

SEQ ID NO: 53829 - RNA, 642 nt, Artificial Sequence
  derived and/or modified sequence opt11 from Gevokizumab_LightChain1
gacauccaaaugacacaauccaccuccucacucuccgcauccgucggcgaccgcgucaccaucacaugccgcgccucccaagacaucuccaacuacuuaucaugguaccaacaaaaacccggcaaagccgucaaacuccucaucuacuacaccuccaaacuccacuccggaguccccucccgcuucuccggcucaggcuccggcaccgacuacacccucaccaucuccucccuccaacaagaagacuucgccacauacuucugccuccaaggcaaaaugcuccccuggaccuucggccaaggcaccaaacucgaaaucaaacgcaccgucgccgcccccucagucuucaucuucccacccucugacgaacaacuaaaauccggcaccgccuccgucgucugccuucucaacaacuucuacccccgcgaagccaaaguccaauggaaagucgacaacgcccuccaauccggcaacucccaagaauccguaaccgaacaagacuccaaagacuccaccuacucccucuccuccacccuaacccucuccaaagccgacuacgaaaaacacaaagucuacgccugcgaagucacccaccaaggccucuccuccccagucaccaaauccuucaacagaggcgaaugu

SEQ ID NO: 53830 - RNA, 1347 nt, Artificial Sequence
  derived and/or modified sequence opt11 from Girentuximab_HeavyChain1
gacgucaaacuugucgaauccggcggcggccuaguaaaacuuggcggcagccucaaacuuuccugugccgcaucaggauucaccuucagcaacuauuacauguccuggguacgucagaccccagaaaaacgacucgaacucgucgccgccauaaacucggacggaggcaucaccuacuaccucgacacagucaaaggacguuucaccauaucccgcgauaacgccaaaaacacccucuaccuacaaauguccagccucaaauccgaagacaccgcacucuuuuacugcgcccgccaccgcuccggcuacuucuccauggacuacuggggacaaggcaccuccguaaccguuagcucagccuccacuaaaggccccucagucuucccccucgcccccagcaguaaauccaccagcgguggcaccgccgcgcugggaugccucgucaaagacuacuuccccgaaccagucaccguauccuggaacuccggcgcucuaaccuccggcguccacacauuccccgccguccugcaaagcagcggccuauacucccucucguccgucgugaccguccccuccuccucccuaggcacccaaacuuacaucugcaacgucaaucacaaacccagcaacacuaaagucgacaagaaagucgaaccaaaauccugcgacaaaacacacacuugcccacccugcccagccccagaacuacucggaggcccauccgucuuccuauucccacccaaacccaaagacacccuuaugaucucccguacccccgaagucacaugcgucguaguagacguuucccacgaagacccagaagucaaauucaacugguacgucgaugguguagaaguacacaacgccaaaaccaaaccacgggaagaacaauacaauucaacauaccgagucgucucaguccucaccguacuccaccaagacuggcucaacggcaaagaauacaaaugcaaagucuccaacaaagcacuccccgcacccaucgaaaagaccauauccaaagcgaaaggccaaccacgagaaccccaagucuacacccucccacccucacgggacgaacucaccaaaaaccaagucucacugaccugccucgucaaaggcuucuaccccuccgacaucgccgucgaaugggaauccaacggccaacccgaaaacaacuacaaaaccacaccacccguccucgacuccgacggcagcuucuuccucuacagcaaacucaccgucgacaaaagccgcuggcaacaaggcaacguuuucucuugcagcguaaugcacgaagcacuccauaaccacuacacacaaaaaucacucucucucucacccggaaaa

SEQ ID NO: 53831 - RNA, 642 nt, Artificial Sequence
  derived and/or modified sequence opt11 from Girentuximab_LightChain1
gacaucguaaugacccaaucacaaagauucauguccacaaccgucggcgaccgcgugagcauaaccugcaaagcaagccaaaacguagucucagccgucgccugguaccaacaaaaacccggacaaucgcccaaacuccuaaucuacagcgccagcaaccgcuacaccggagucccagaccgauucaccggcucaggcucgggcacagacuucacccuaaccauaagcaacaugcaaagcgaagaccucgccgacuucuucugccaacaauacagcaacuacccauggacauucggaggcggaaccaaacucgaaaucaaacgcacagucgccgcccccagcguauucauauucccgccaucggacgaacaacucaaauccggcacagccucagucguaugccuacucaacaacuucuacccgcgcgaagccaaaguccaauggaaagucgacaacgcccuccaaagcggaaacucacaagaaagcguaaccgaacaagacagcaaagacuccaccuacagccucagcucaacccugacacucagcaaagccgacuacgaaaaacacaaaguauacgccugcgaagucacccaccaaggccuaagcucacccgucaccaagagcuucaaccgaggcgaaugc

SEQ ID NO: 53832 - RNA, 1335 nt, Artificial Sequence
  derived and/or modified sequence opt11 from Glembatumumab_HeavyChain1
cagguccaacuccaagaauccggccccggccucguaaaacccucccagacccuuucccuaaccuguacagucucaggcggaucgaucuccuccuucaacuacuacugguccuggauccgccaccaccccggcaaaggucucgaauggauuggcuacauauacuacucagguucuaccuacucaaaccccuccuuaaaaucgcgcgucaccauaucagucgacacaucuaaaaaccaauucucccugacccucagcuccguaacagccgcagacaccgccgucuacuacugcgcccguggcuacaacuggaacuacuucgacuacuggggacaaggcacccucguaaccgucuccucagccucaaccaaaggccccuccguuuucccccuagcuccaugcucacgcuccacaucugaauccaccgccgcucucggcugccuagucaaagacuacuuccccgaacccgucaccguaucauggaacuccggcgcccucacuucaggaguacacaccuuccccgccguccuacaaucuuccggucuauacucacucucauccgucgucaccguucccuccagcaacuucggcacacaaaccuauaccugcaacgucgaccacaaacccucuaacaccaaagucgacaaaacagucgaacgcaaaugcugcgucgaaugcccacccugccccgccccaccagucgccggaccauccgucuuccuauuucccccaaaaccaaaagacacccucaugaucagccguacccccgaaguuaccugcgucgucguagacgucucccacgaagacccugaaguccaauucaacugguacguagacggcguagaaguccacaacgccaaaacaaagccccgcgaagaacaauucaacuccaccuuccgcgucgucucuguucuaaccguaguccaccaagauuggcuaaacggaaaagaauacaaaugcaaaguauccaacaagggccuacccgcacccauagagaaaaccaucucaaaaaccaaaggccaaccccgugaaccucaagucuacacccugccgcccucccgagaagaaaugaccaaaaaccaagucucccuaaccugccucguuaaaggcuucuaccccuccgacauagccgucgaaugggaauccaacggccaacccgaaaacaacuacaaaacaaccccacccaugcuugacuccgacggcuccuucuuccucuacuccaaacucaccgucgacaaaucccgcuggcaacaaggaaacgucuucucaugcucagucaugcacgaagcacuucauaaccauuacacccaaaaaucccucagccuaucccccggcaaa

SEQ ID NO: 53833 - RNA, 645 nt, Artificial Sequence
  derived and/or modified sequence opt11 from Glembatumumab_LightChain1
gaaaucgucaugacccaaucccccgccacccucucagucucccccggcgaacgagccacacucuccugucgcgccucccaauccgucgacaacaaccucgucugguaccaacaaaaacccggccaagccccccgccuacuaaucuacggcgccucaacccgcgccaccggcauccccgcccgcuucuccggcuccggcuccggcaccgaauucacccucaccaucuccucccuacaauccgaagacuucgccgucuacuacugccaacaauacaacaacuggcccccauggaccuucggccaaggaacuaaagucgaaaucaaacgcaccgucgcagcccccuccgucuucaucuucccccccucugacgaacaacucaaauccggcaccgccuccgucgucugccuccucaacaacuucuacccccgcgaagccaaaguccaauggaaagucgacaacgcacuccaauccggcaacucccaagaauccgucaccgaacaagacucaaaagacucaacauacucccucagcuccacccucacccucuccaaagccgacuacgaaaaacacaaagucuacgccugcgaagucacccaccaaggccucuccucccccgucaccaaauccuucaaccgaggcgaaugc

SEQ ID NO: 53834 - RNA, 1332 nt, Artificial Sequence
  derived and/or modified sequence opt11 from Goilixiab_HeavyChain1
gaaguccaacucguagaauccggcggcggccuagcaaagcccggaggcucacuacgacucuccugcgccgccuccggcuuccgauucaccuucaacaacuacuacgacuggguacgccaggcccccggccaaggccuugaaugggucucccgcaucucaucaucuggcgaccccacaugguacgcagacuccguaaaaggacgauucaccaucucucgugaaaacgccaaaaacacacucuuccuccaaaacucacuccgugcagaggauacagccgucuacuacugcgccucccucaccaccggcuccgacuccuggggacagggcguccucgucacaguuuccuccgccuccaccaaaggccccuccguauucccccucgcccccuccucaaaauccaccucaggcggcaccgccgcccucggcugccucgucaaagacuacuuccccgaaccugucacugucuccuggaacucaggcgcacuaaccucaggagugcacaccuucccugccguacuccaguccucaggucucuacucacucuccuccgucguuaccguaccauccuccucccucgguacccaaaccuacauaugcaacgucaaccacaaacccucaaacacuaaagucgacaagaaagucgaacccaaauccugcgacaaaacccacacaugcccacccugccccgccccugaacuacucggcggccccuccgucuuccucuuucccccgaaaccgaaagacacacuaaucucccgcacacccgaaguaaccugcgucgucguagacgucagccacgaagaccccgaagucaaauucaacugguacguagacggcgucgaaguccacaacgccaaaaccaaaccacgagaagaacaauacaauucaacauaccgugucgucuccguucucaccgucuuacaccaagacuggcucaacgggaaagaauacaaaugcaaaguuucaaacaaagcccuccccgcccccaucgaaaagacaaucuccaaggccaagggccaaccccgugaaccccaagucuacacccucccaccuucccgugacgaacucaccaaaaaccaagucucacuaaccugccuggucaaaggcuucuacccuucugacauagcugucgaaugggaauccaacggccaacccgaaaacaacuacaaaaccaccccacccguccucgacucggacggauccuucuucuuauacuccaaacucacggucgacaaaucccgcuggcaacaaggcaaugucuucuccugcuccguccacgaagcccuccacaaccacuacacucaaaaaucccucucacuaucccccggcaaa

SEQ ID NO: 53835 - RNA, 639 nt, Artificial Sequence
  derived and/or modified sequence opt11 from Goilixiab_LightChain1
gacauccaaacccaaucacccuccucccucuccgccuccguaggugaccgcgucaccaucaccugccgcgccucccaagacauccgcuacuaccucaacugguaccaacaaaaacccggcaaagcacccaaacuccuaaucuacgucgccuccucacuccaauccggcguacccagccgcuucucaggcucaggcuccggcaccgaauucacccuaaccgucuccucacuccaacccgaagacuucgccaccuacuacugccuccaagucuacucaaccccccgcaccuucggccaaggcaccaaagucgaaaucaaacgcaccgucgccgcccccuccgucuucauauucccccccuccgacgaacaacuaaaauccggcacagccuccgucguaugccuccucaacaacuucuacccccgcgaagccaaaguccaauggaaagucgacaacgcccuccaauccggcaacucacaagaauccgugaccgaacaagacuccaaagacuccaccuacucccuauccucaacccucacccucuccaaagccgacuacgaaaaacacaaaguauacgcaugcgaagucacccaccaaggccuauccucccccgucaccaaauccuucaaccgcggcgaaugc

SEQ ID NO: 53836 - RNA, 1338 nt, Artificial Sequence
  derived and/or modified sequence opt11 from Guselkumab_HeavyChain1
gaaguccaacucguccaaucaggcgcggaagucaagaaacccggcgaaucacucaaaaucucaugcaaaggcucuggcuacuccuucuccaacuacuggaucggcuggguacgccaaaugccaggcaaaggccuagaauggaugggaauaauagaccccagcaacuccuacacacgcuacucacccuccuuccaaggccaagucaccaucuccgccgacaaaagcauauccaccgccuaccuccaaugguccucccuaaaagcaucagacaccgccauguacuacugugcccgcugguacuacaaacccuucgacgucuggggacaaggaacccuugucaccgucucaagcgccuccaccaaaggccccucagucuucccccucgcgccaucaucaaaauccaccuccggcggcaccgcagcacucggcugccucguaaaagacuacuuccccgaacccgucacaguaucauggaacucaggcgcacucaccucaggcguccacaccuucccagccguccuccaauccucaggccucuauucccuaucauccgucguuaccguaccaucauccucccuaggaacucaaacauacauaugcaacgucaaccacaaacccuccaacacuaaaguugacaagaaaguagaacccaaauccugcgacaaaacccacacuugcccacccugccccgcccccgaacuccucggcggcccuucaguauuccuauucccacccaaacccaaagacacucuaaugauaucccgcacccccgaaguaaccugcgucgucgucgacgucucacacgaagaccccgaagucaaauucaacugguacgucgacggcgucgaaguccacaacgccaaaaccaaaccccgcgaagaacaauacaacuccacauaccgcgucguaucgguccucacgguccuccaccaagauuggcucaacggcaaagaauacaaaugcaaaguauccaacaaagcccuccccgcccccaucgagaaaaccaucucaaaagccaaaggucagccccgcgaaccccagguauacacccucccaccgucacgcgacgaacuuaccaaaaaccaagucucucucacaugccucgucaaaggauucuacccaucagacaucgcugucgaaugggaaagcaacggccaacccgaaaacaacuacaaaaccaccccacccguccuagacagcgacggauccuucuuccucuacucuaaacugaccgucgacaaaucccgcuggcaacaaggcaacgucuucagcugcucagucaugcacgaagcccuacacaaccacuacacccagaaaagccugucucucucacccgga

SEQ ID NO: 53837 - RNA, 651 nt, Artificial Sequence
  derived and/or modified sequence opt11 from Guselkumab_LightChain1
caaucaguccucacccaaccccccucaguauccggcgcccccggccaacgcguaaccaucucaugcaccggcuccuccucuaacauaggcuccggcuacgacguccacugguaccaacaacuccccggcaccgcccccaaacuccucaucuacggcaacuccaaacgccccuccggcguccccgaccgcuucuccggcuccaaauccggaacuuccgcaucccucgccaucaccggacuccaauccgaagacgaagcagacuacuacugcgccuccuggacagacggccucucacucgucgucuucggaggcggaaccaaacucaccguccucggccaacccaaagccgccccauccgucacccucuucccccccagcucagaagaacuccaagccaacaaagccacccucgucugccuaaucuccgacuucuaccccggcgccgucaccgucgccuggaaagccgacucaucccccgucaaagccggcgucgaaaccaccaccccauccaaacaauccaacaacaaauacgccgccuccuccuaccucucccucacccccgaacaauggaaaucccaccgauccuacuccugccaagucacccacgaaggauccaccgucgaaaaaaccgucgcccccaccgaaugcucc

SEQ ID NO: 53838 - RNA, 360 nt, Artificial Sequence
  derived and/or modified sequence opt11 from HuMab-001_HeavyChain_VDJ-Region
caaguccaacuccaacaauggggcgccggccuccucaaacccuccgaaacccucucccucaccugcgccgucuacggcggcuccuucuccggcuacuacuggaacuggauccgccaaccccccggcaaaggccuagaauggaucggcgaaaucaaccacuccggcuccaccaacuacaaccccucccucaaaucccgcgucaccaucuccgucgacaccuccaaaaaccaauucucccucaaacucuccuccgucaccgccgccgacaccgccgucuacuacugcgcccgcggcaacuacggcuccggcuacuacuacuucgaccucuggggccgcggcacccaagucaccgucuccucc

SEQ ID NO: 53839 - RNA, 321 nt, Artificial Sequence
  derived and/or modified sequence opt11 from HuMab-001_LightChain_VJ-Region
gacauccaaaugacccaaucccccuccucccucuccgccuccgucggcgaccgcgucaccaucaccugccgcgccucccaaggcaucuccuccuggcucgccugguaccaacaaaaacccgaaaaagcccccaaaucccucaucuucgccgccuccucccuccaauccggcguccccucccgcuucuccggcuccggcuccggcaccgacuucacccucaccaucuccucccuccaaccagaagacuucgccaccuacuacugccaacaauacaucuccuucccaaucaccuucggccaaggcacccgccucgaaaucaaa

SEQ ID NO: 53840 - RNA, 366 nt, Artificial Sequence
  derived and/or modified sequence opt11 from HuMab-005_HeavyChain_gamma-Chain_VDJ-Region
gaagugcaauugguccagagcggggccgaggucaagaaaccgggcgagagcuugaaaauaagcuguaaagcgagcggguacucguuccauuucuauuggauaggcugggucaggcaaaugcccgggaaagggcucgaguggaugggcucgaucuaucccggggacucggacacgcgcuaucgcccgagcuuucaagggcaagugaccauaagcgcggacaagagcauaagcacggccuaucuccaguggacgagcuugaaagcgagcgauaccgcgaucuauuacugugccaggcaaaggggcgauuacuauuacuuuuacgggauggaugucuggggccagggcacgaccgugaccgugagcucg

SEQ ID NO: 53841 - RNA, 321 nt, Artificial Sequence
  derived and/or modified sequence opt11 from HuMab-005_LightChain_VJ-Region
gaaaucguccucacccaaucccccggcacccucucccucucccccggcgaacgcgccacccucuccugccgcgccucccaauccguauccuccuccuaccucgcaugguaccaacaaaaacccggccaagucccccgccuccucaucuacggcgccuccucccgcgccaccggcauccccgaccgcuucuccggcuccggcuccggcaccgacuucacccucacaaucucccgccucgaacccgaagacuucgccgucuacuacugccaacaauacggaucuucccucaccuucggcggcggcaccaaagucgaaaucaaa

SEQ ID NO: 53842 - RNA, 357 nt, Artificial Sequence
  derived and/or modified sequence opt11 from HuMab-006_HeavyChain_VDJ-Region
gagguccagcucuuggaaucgggcgggggcuugguccagcccgggggcucgcucaggcucucgugcgcggccucgggcuuuaccuuuagcaauuacgcgcucauaugggugcgccaggccccgggaaagggcuuggaaugggucucgaucauacgcgggggcgcgggcucgaccuauuacgcggacucggucaagggcagguucacaaucucgcgcgauaacucgaaaaauaccuuguacuugcaaaugaacucgcucagggccgaggacacggccguguacuauugcgcgaaagcgcgcauaugggggcccuuguucgauuacuggggccagggcacgcucgugaccgugagcucg

SEQ ID NO: 53843 - RNA, 324 nt, Artificial Sequence
  derived and/or modified sequence opt11 from HuMab-006_LightChain_VJ-Region
gaaaucguccucacccaaucccccgccacccucucccucucccccggcgaacgcgccacccucuccugccgcgccucccaauccgucuccuccuaccucgccugguaccaacaaaaacccggccaagccccccgccuccucaucuacgacgccuccaaccgcgccaccggcauccccgcccgcuucuccggcuccggcuccggcaccgacuucacccucaccaucuccucccucgaacccgaagacuucgccgucuacuacugccaacaacgcuccaacuggcccccccucaccuucggcggcggcaccaaagucgaaaucaaa

SEQ ID NO: 53844 - RNA, 360 nt, Artificial Sequence
  derived and/or modified sequence opt11 from HuMab-019_HeavyChain_VDJ-Region
caaguccaacuccaacaauggggcgccggccuccucaaacccuccgaaacccucucccuaaccugcgccgucuacggcggcuccuucuccgacuacuacuggaacuggauccgccaaccccccggcaaaggccucgaauggaucggcgaaauccaccacgucggcuccaccaacuacaaccccucccucaaaucccgcgucaccaucuccgucgacaccuccaaaucccaauucucccucaaacuauccuccgucaccgccgccgacaccgccgucuacuacugcgcccgcggcuacuacgacuccggcgucuacuacuucgacuacugggcccaaggcacccucgucaccgucuccucc

SEQ ID NO: 53845 - RNA, 360 nt, Artificial Sequence
  derived and/or modified sequence opt11 from HuMab-021_HeavyChain_VDJ-Region
caaguccaacuccaacaauggggcgccggccuccucaaacccuccgaaacccucucccucaccugcgccgucuacggcggcuccuucuccgacuacuacuggaacuggauccgccaaccccccggcaaaggccucgaauggaucggcgaaauccaccacucaggcuccaccaacuacaaccccucccucaaaucccgagucaccaucuccgucgacaccuccaaaaaccaauucucccucaaacucuccucagucaccgccgccgacaccgccgucuacuacugcgcccgcggcuacuacgccuccggcgucuacuacuucgacuacuggggccaaggcacccucgucaccgucuccucc

SEQ ID NO: 53846 - RNA, 321 nt, Artificial Sequence
  derived and/or modified sequence opt11 from HuMab-021_LightChain_VJ-Region
gacauccaaaugacccaaucccccuccucccucuccgccuccgucggcgaccgcgucaccaucaccugccgcgccucccaaggcaucuccuccuggcucgccugguaccaacaaaaacccgaaaaagcccccaaaucccucaucuacgccgccuccucccuccaauccggcguccccucccgcuucuccggcuccggcuccggcaccgacuucacccucaccaucucaucccuccaacccgaagacuucgccaccuacuacugccaacaauacaacuccuaccccaucaccuucggccaaggcacccgccucgaaaucaaa

SEQ ID NO: 53847 - RNA, 360 nt, Artificial Sequence
  derived and/or modified sequence opt11 from HuMab-025_HeavyChain_VDJ-Region
caaguccaacuccaacaauggggcgccggccuccucaaacccuccgaaacccucucccucaccugcgccgucuacggcggcuccuucuccgacuacuacuggaacuggauccgccaaccccccggcaaaggacucgaauggaucggcgaaauccaccacuccggcuccaccaacuacaaccccucccuaaaaucccgcgucaccaucuccgucgacaccuccaaaaaccaauucucacucaaacucuccuccgucaccgccgccgacaccgccgucuacuacugcgcacgcggcuacuacgacuccggcgucuacuacuucgacuacugggcccaaggcacccucgucaccgucuccucc

SEQ ID NO: 53848 - RNA, 321 nt, Artificial Sequence
  derived and/or modified sequence opt11 from HuMab-025_LightChain_VJ-Region
gacauccaaaugacccaaucccccucaucccucuccgccuccgucggcgaccgcgucaccaucaccugccgcgccucccaaggcaucucccgcuggcucgccugguaccaacaaaaacccgaaaaagcccccaaaucccucaucuacgccgccuccucccuccgcuccggcguccccucccgcuucuccggcuccggcuccggcaccgacuucacccucaccaucuccucccuccaacccgaagacuucgccaccuacuacugccaacaauacaacuccuaccccaucaccuucggccaaggcacccgccucgaaaucaaa

SEQ ID NO: 53849 - RNA, 360 nt, Artificial Sequence
  derived and/or modified sequence opt11 from HuMab-027_HeavyChain_VDJ-Region
caaguccaacuccaacaauggggcgccggccuccucaaacccuccgaaacccucucccucaccugcgccgucuacggcggcuccuucuccgacuacuucuggaacuggauccgccaaccccccggcaaaggccucgaauggaucggcgaaauccaccacuccggcuccaccaacuacaaccccucccucaaaucccgcgucaccaucuccgucgacaccuccaaaaaccaauucucccucaaccucuccuccgucaccgccgccgacaccgccgucuacuacugcgcccgcggccucaucggcuccggcuacuacuacuucgacuacugggaccaaggcacccucgucaccgucuccucc

SEQ ID NO: 53850 - RNA, 360 nt, Artificial Sequence
  derived and/or modified sequence opt11 from HuMab-032_HeavyChain_VDJ-Region
caaguccaacuccaacaauggggcgccggccuccuaaaacccuccgaaacccucucccucaccugcgccgucuacggcggcuccuucuccggcuacuacugguccuggauccgccaaccccccggcaaaggccucgaauggaucggcgaaaucaaccacuccggcgacaccaacuacaaccccucacucaccucccgcgucaccaucuccgucgacaccuccaaaaaccaauucucccucaaacucuccuccgucaccgccgccgacaccgccgucuacuacugcgcccgccucuucuacggcucaggcaucuacuacuucgacuacuggggccaaggcacccucgucaccgucuccucc

SEQ ID NO: 53851 - RNA, 321 nt, Artificial Sequence
  derived and/or modified sequence opt11 from HuMab-032_LightChain_VJ-Region
gacauccaaaugacccaaucccccuccucccucuccgccuccgucggcgaccgcgucaccaucaccugccgcgccucccaaggcaucuccuccuggcucgccugguaccaacaaaaacccgaaaaagcccccaaaucccucaucuacgccaccuuccgccuccaaucaggcguccccucccgcuucuccggcuccggcuccggcaccgacuucacccucaccaucuccucccuccaacccgaagacuucgccaccuacuacugccaacaauacaacuccuucccccccaccuucggccaaggcaccaaagucgaaaucaaa

SEQ ID NO: 53852 - RNA, 363 nt, Artificial Sequence
  derived and/or modified sequence opt11 from HuMab-033_HeavyChain_VDJ-Region
cagguccagcucguggaaucgggcgggggcgugguccagaccgggcgcucgcucaggcucucgugcgcggccucgggcuuuaccuuuagcucgcacgcgaugcauugggugcgccaggccccgggcaagggcuuggaaugggucgcggccauaagcuaugacgggagcaauaaauauuacgcggacucggucaagggcagguucacgaucucgcgcgauaacucgaaaaauaccuuguacuugcaaaugaacucgcucagggccgaggacacggccguguacuauugcgcgcgcggggacuauaucucgagcucaggcguguucgauuacuggggccagggcacgcucgugaccgugagcucg

SEQ ID NO: 53853 - RNA, 360 nt, Artificial Sequence
  derived and/or modified sequence opt11 from HuMab-035_HeavyChain_VDJ-Region
caaguacaacuacaacaauggggcgccggccuacucaaacccuccgaaacccucucccucaccugcgccaucuacggcggcuccuucucaggcuacuacugguccuggauccgccaaccccccggcaaaggccucgaauggaucggcgaaaucaaccacuccggcgacaccaacuacaaccccucccucaccucacgcgucaccaucuccgucgacaccuccaaaaaccaauucucccucaaacucuccuccgucaccgccgccgacaccgccgucuacuacugcgcccgccucuucuacggcuccggcaucuacuacuucgacuacuggggccaaggcacccucgucaccgucuccucc

SEQ ID NO: 53854 - RNA, 360 nt, Artificial Sequence
  derived and/or modified sequence opt11 from HuMab-036_HeavyChain_VDJ-Region
caaguccaacuccaacaauggggcgccggccuccucaaacccuccgaaacccucucccucaccugcgccgucuacggcggcuccuucuccgacuacuacugguccuggauccgccaaccccccggcaaaggccucgaauggaucggcgaaaucaaccacuccggcuccaccaacuacaaccccucccucaaaucccgcgucaccaucuccgucgacaccuccaaaaaccaauucucccucaaacucuccuccgucacagccgccgacaccgccgucuacuacugcgcccgccucuacuacggcuccggcaccuacuacuucgacuacuggggccaaggcacccucgucaccgucuccuca

SEQ ID NO: 53855 - RNA, 321 nt, Artificial Sequence
  derived and/or modified sequence opt11 from HuMab-036_LightChain_VJ-Region
gacauccaaaugacccaaucccccuccucccucuccgccuccgucggcgaccgcgucaccaucaccugccgcgccucccaaggcaucuccuccuggcucaccugguaccaacaaaaacccgaaaaagcccccaaaucccucaucuacgccgccucccgccuccaauccggcguccccucccgcuucuccggcuccggcucaggcaccgacuucacccucaccaucuccucccuccaacccgaagacuucgccaccuacuacugccaacaauacaacuccuucccccccaccuucggccaaggcaccaaagucgaaaucaaa

SEQ ID NO: 53856 - RNA, 366 nt, Artificial Sequence
  derived and/or modified sequence opt11 from HuMab-041_HeavyChain_VDJ-Region
gaaguccaacucguccaauccggcgccgaagucaaaaaacccggcgaaucccucaaaaucuccugcaaaggcuccggcuacuccuucaccuccuacuggaucggcuggguccgccaaaugcccggcaaaggccucgaauggaugggcucaaucuaccccggcgacucccacacccgcuaccgccccuccuuccaaggccaagucaccaucuccgccgacaaaucaaucuccaccgccuaccuccaaugguccucccucaaagccuccgacaccgccauguacuacugcgcccgccaaaaaggcgacuucuacuacuucuucggccucgacgucuggggccaaggcaccgccaucaccgucuccucc

SEQ ID NO: 53857 - RNA, 366 nt, Artificial Sequence
  derived and/or modified sequence opt11 from HuMab-044_HeavyChain_VDJ-Region
gagguccagcuagugcaaucgggcgcggaagugaaaaagcccggggaaucgcucaagaucucgugcaagggcucgggcuaucgcuuuagcucguacuggaucgggugggugcgccagaugccgggcaagggauuggaauggauggggagcauauucccgggcgauagcgauaccagguacucgcccucguuccagggccaggucacgaucucggccgauaaaucgaucacgaccgcguacuugcaauggagcucgcucaaggccucggacacggccauguacuauugcgcgcgccaggccggggacuauuacuauuacaauggcauggacgugugggggcaagggaccacgguaacggucucgagc

SEQ ID NO: 53858 - RNA, 357 nt, Artificial Sequence
  derived and/or modified sequence opt11 from HuMab-049_HeavyChain_VDJ-Region
gagguccagcuauuggaaucgggcggggacuugguccagcccgggggcucgcucaggcucucgugcgcggccucgggcuuuaccuuuagcucguacgcgaugucgugggugcgccaggccccgggcaagggccuggaaugggucucggccauaagcgggcgcgggggcacgaccuauuacgcggacucggucaagggcagguucacgaucucgcgcgauaacucgaaaucgaccuugugcuugcaaaugaacucgcucagggccgaggacacggccguguacuauugcgcgaaagcgcgcgcgaacugggacuauuucgauuacuggggccagggcacgcucgugaccgugagcucg

SEQ ID NO: 53859 - RNA, 321 nt, Artificial Sequence
  derived and/or modified sequence opt11 from HuMab-049_LightChain_VJ-Region
gacauccaaaugacccaaucccccuccuccgucuccgccuccgucggcgaccgcgucaccaucaccugccgcgccucccaaggcaucuccuccuggcucgccugguaccaacacaaacccggcaaagcccccaaacuccucaucuacgccgccuccauccuccaauccggcguccccucccgcuucuccggcuccggcuccggcaccgacuucacccucaccaucuccucccuccgccccgaagacuucgccaccuacuacugccaacaagccaacuccuuccccaucaccuucggccaaggcacccgccucgaaaucaaa

SEQ ID NO: 53860 - RNA, 357 nt, Artificial Sequence
  derived and/or modified sequence opt11 from HuMab-050_HeavyChain_VDJ-Region
gagguccagcucuuggaaucgggcgggggcuugguccagcccgggggcucacucaggcucucgugcgcggccucgggcuuuaccuuuagcucguacgcgaugaauugggugcgccaggccccgggcaagggccuggaaugggucucggccauaagcgggcgcgggggcacgaccuauuacgcggacucggucaagggcagguucacgaucucgcgcgauaacucgaaaaauaccuuguaccugcaaaugagcucgcucagggccgaggacacggccguguacuauugcgcgaaagcgcgcgcgaacugggacuauuucgauuacuggggccagggcacgcucgugacagugagcucg

SEQ ID NO: 53861 - RNA, 321 nt, Artificial Sequence
  derived and/or modified sequence opt11 from HuMab-050_LightChain_VJ-Region
gacauccaaaugacccaaucccccuccuccgucuccgccuccgucggcgaccgcgucaccaucaccugccgcgccucccaaggcaucuccuccuggcucgccugguaccaacacaaacccggcaaagcccccaaacuccucaucuacgccgccuccauccuccaauccggcguccccucccgcuucuccggcuccggcuccggcaccgacuucacccucaccaucuccucacuccaacccgaagacuucgccaccuacuacugccaacaagccaacuccuuccccaucaccuucggccaaggcacccgccucgaaaucaaa

SEQ ID NO: 53862 - RNA, 360 nt, Artificial Sequence
  derived and/or modified sequence opt11 from HuMab-054_HeavyChain_VDJ-Region
caaguccaacuccaacaauggggcgccggccuccucaaacccuccgaaacccucucccuuaccugcgccgucuacggcggcuccuucuccggcuacuacugguccuggauccgccaacccccaggcaaaggccucgaauggaucggcgaaauccaccacucaggcuccaccaacuacaaccccucccucaaaucccgcgucaccaucuccgucgacaccuccaaaaaccaauucucacucaaacucuccuccgucaccgccgccgacaccgccgucuacuacugcgcccgccucugguacggcuccggcuccuacuacuucgacuacuggggccaaggcacccucgucaccguauccucc

SEQ ID NO: 53863 - RNA, 321 nt, Artificial Sequence
  derived and/or modified sequence opt11 from HuMab-054_LightChain_VJ-Region
gacauccaaaugacccaaucccccuccucccucuccgccuccgucggcgaccgcgucaccaucaccugccgcgccucccaaggcaucuccuccuggcucgccugguaccaacaaaaacccgaaaaagcccccaaaucccucaucuacgccgccuccucccuccaauccggcguccccucccgcuucuccggcuccggcuccggcaccgacuucacccucaccaucuccucccuccaacccgaagacuucgccaccuacuacugccaacaauacaacuccuucccccccaccuucggcggcggcaccaaagucgaaaucaaa

SEQ ID NO: 53864 - RNA, 357 nt, Artificial Sequence
  derived and/or modified sequence opt11 from HuMab-055_HeavyChain_VDJ-Region
gagguccagcucuuggaaucgggcgggggcuugguccagcccgggggcucacucaggcucucgugcgcggccucgggcuuuacauuuagcucguacgcgaugaauugggugcgccaggccccgggcaagggcuuggaaugggucucggccauaagcgggcgcgggggcacgaccuauuacgcggacucggucaagggcagguucacgaucucgcgcgauaacucgaaaucgacauugugcuugcaaaugaacucgcucagggccgaggacacggccguguacuauugcgcgaaagcgcgcgcgaacugggacuauuucgauuacuggggccagggcacgcucgugaccgugagcucg

SEQ ID NO: 53865 - RNA, 366 nt, Artificial Sequence
  derived and/or modified sequence opt11 from HuMab-059_HeavyChain_VDJ-Region
caagugcaauugguccagagcggggccgaggucaagaaaccgggcgcgagcgugcgcgugcccuguaaagcgagcggguacacguucacgcgcuauggcauaagcugggucaggcaagcgccagggcaagggcucgaguggaugggcuggaucucggccuauaacgggaaaacguacuaugcccagaaauugcaagggcgcgugaccaugaccacggacacgagcacgagcacggccuauauggagcucaggagcuugcgcucggacgauaccgcggucuauuacugugccaggagcccgcucuugugguuugaggaacucuauuucgauuacuggggccagggcacgcucgugaccgugagcucg

SEQ ID NO: 53866 - RNA, 324 nt, Artificial Sequence
  derived and/or modified sequence opt11 from HuMab-059_LightChain_VJ-Region
gaaaucguccucacccaaucccccggcacccucucccucucccccggcgaacgcgccacccucuccugccgcgccucccaauccgucuccuccaccuaccucgccugguaccaacaaaaacccggccaagccccccgccuccucaucuacggcgccuccucccgcgccaccggcauccccgaccgcuucuccggcuccggcuccggcaccgacuucacccucaccaucucccgccucgaacccgaagacuucgccgucuacuacugccaacaauacggcaccucccucuucaccuucggccccggcaccaaagucgacaucaaa

SEQ ID NO: 53867 - RNA, 366 nt, Artificial Sequence
  derived and/or modified sequence opt11 from HuMab-060_HeavyChain_VDJ-Region
gagguccagcucgugcaaucgggcgcggaagugaaaaagcccggggaaucgcucaagaucucgugcaagggcucgggcuaucgcuuuaccucauacuggaucggguggguacgccagaugccgggcaagggcuuggaauggauggggagcauauacccgggcgauagcuauaccaggaacucgcccucguuccagggccaggucacgaucucggccgauaaaucgaucgcgaccgcguaccugcaauggaacucgcucaaggccucggacacggccauguacuauugcgcgcgccaugccggggacuuuuacuauuucgauggcuuggacgugugggggcaaggaaccacggucacggucucgagc

SEQ ID NO: 53868 - RNA, 327 nt, Artificial Sequence
  derived and/or modified sequence opt11 from HuMab-060_LightChain_VJ-Region
gaaaucguccucacccaaucccccggcacccucucccucucccccggcgaacgcgccacccucuccugccgcgccucccaauccgucuccuccuccuaccucgccugguaccaacaaaaacccggccaagccccccgccuccucaucuacggcgccuccucccgcgccacaggcauccccgaccgcuucuccggcuccggcuccggcaccgacuucacccucaccaucucccgccucgaacccgaagacuucgccgucuacuacugccaacaauacggcuccuccccccccaucaccuucggccaaggcacccgccucgaaaucaaa

SEQ ID NO: 53869 - RNA, 366 nt, Artificial Sequence
  derived and/or modified sequence opt11 from HuMab-067_HeavyChain_VDJ-Region
gaagugcaauugguccagagcggggccgaggucaagaaaccgggcgagagcuugaaaauaagcuguaaagggagcggguacucguucacgagcuauuggauaggcugggucaggcaaaugcccgggaaagggcucgaguggaugggaauaaucuaucccggggacucggacacgcgcuauagcccgagcuuucaagggcaagugaccauaagcguggacaagagcauaagcacggccuaucuccaguggucgagcuugaaagcgagcgauaccgcgauguauuacugugccaggcaaaagggcgauuacuauuaccauuacgggcucgaugucuggggccagggcacgaccgugaccgugagcucg

SEQ ID NO: 53870 - RNA, 366 nt, Artificial Sequence
  derived and/or modified sequence opt11 from HuMab-072_HeavyChain_VDJ-Region
gaagugcaauugguccagagcggagccgaggucaagaaaccgggcgagagcuugaaaauaagcuguaaagggagcggguacucguucacgagcuauuggauaggcugggucaggcaaaugcccgggaaagggcucgaguggaugggaauaaucuaucccggggacucggacacgcgcuauagcccgagcuuucaaggacaagugaccauaagcgcggacaagagcauaagcacggccuaucuccaguggucgagcuugaaagcgagcgauaccgcgauguauuacugugccaggcaaaagggcgauuacuauuacuuuaacgggcucgaugucuggggccagggcacgaccgugaccgugagcucg

SEQ ID NO: 53871 - RNA, 327 nt, Artificial Sequence
  derived and/or modified sequence opt11 from HuMab-072_LightChain_VJ-Region
gaaaucguccucacccaaucccccggcacccucucccucucccccggcgaacgcgccacccucuccugccgcgccucccaauccgucuccuccuccuaccucgccugguaccaacaaaaacccggccaagccccacgccuccucaucuacggcgccuccucccgcgccaccggcauccccgaccgcuucuccggcuccggcuccggcaccgacuucacccucaccaucucccgccucgaacccgaagacuucgccgucuacuacugccaacaauacggcuccuccccccgccucaccuucggcggcggcaccaaagucgaaaucaaa

SEQ ID NO: 53872 - RNA, 363 nt, Artificial Sequence
  derived and/or modified sequence opt11 from HuMab-084_HeavyChain_VDJ-Region
cagguccagcucguacaaucgggcgcggaagugaaaaagcccgggagcucggucaaggucucgugcaaggccucgggcgggaccuuucgcacguacgcgaucaauugggugcgccaggccccgggccagggcuuggaauggauggggcgcauaaacacggucuugggcauagucaaucacgcgcaaaaguuccagggcaggguaacgaucacggccgauaaaucgaccaauaccgcguacauggaauugaacucgcucaggagcgaggacacggccguguacuauugcgcgcgcgagaaaggggucgauuacuauuacgggaucgaggucuggggccagggcacgaccgugaccgugagcucg

SEQ ID NO: 53873 - RNA, 321 nt, Artificial Sequence
  derived and/or modified sequence opt11 from HuMab-084_LightChain_VJ-Region
gacauccaaaugacccaaucccccuccuccgucuccgccuccgucggcgaccgcgucaccaucaccugccgcgccucccaaggcaucuccuccuggcucgccugguaccaacacaaacccggcaaagcccccaaacuccucaucuacgucgccuccacccuccaauccggcguccccucccgcuucuccggcuccggcucaggcaccgacuucacccucaccaucuccucccuccaacccgaagacuucgccaccuacuacugccaacaagccaacuccuucccccucaccuucggcggcggcaccaaagucgaaaucaaa

SEQ ID NO: 53874 - RNA, 360 nt, Artificial Sequence
  derived and/or modified sequence opt11 from HuMab-091_HeavyChain_VDJ-Region
caaguacaacuccaacaauggggcgcaggccuccucaaacccuccgaaacccucucccucaccugcgccgucucaggcggcuccuucuccggcuacuacuggaccuggauccgccaaccccccggcaaaggccuagaauggaucggcgaaaucuaccacuccggcgacaccaacuacaaccccucccucaaaucccgcgucaccaucuccgucgacaccuccaaaaaccaauucucccucaaacucuacuccgucaccgccgccgacaccgccgucuacuacugcgcccgccucuacuucggcuccggcaucuacuaccucgacuacuggggccaaggcacccucgucaccgucuccucc

SEQ ID NO: 53875 - RNA, 321 nt, Artificial Sequence
  derived and/or modified sequence opt11 from HuMab-091_LightChain_VJ-Region
gacauccaaaugacccaaucccccuccucccucuccgccuccgucggcgaccgcgucaccaucaccugccgcgccucccaaggcaucuccuccuggcucgucugguaccaacaaaaacccgaaaaagcccccaaaucccucaucuacgccgccuccucccuccaauccggcguccccucccgcuucuccggcuccggcuccggcaccgacuucacccucaccaucuccucccuccaacccgaagacuucgccaccuacuacugccaacaauacaacuccuucccccccaccuucggccaaggcaccaaagucgaaaucaaa

SEQ ID NO: 53876 - RNA, 366 nt, Artificial Sequence
  derived and/or modified sequence opt11 from HuMab-093_HeavyChain_VDJ-Region
gaagugcaauugguccagagcggggccgaggucaagaaaccgggcgagagcuugaaaauaagcuguaaagggagcggguacucguucacgagcuauuggauaggcugggucaggcaaaugcccgggaaagggcucgaguggaugggcaggaucuaucccggggacucggacacgcgcuauagcccgagcuuucaagggcaagugaccauaagcgcggacaagagcauaaccacggccuaucuccaguggucgagcuugcgcgcgagcgauaccgcgauguauuacugugccaggcaaaggggcgauuacuauuacuuuuucgggcucgauaucuggggccaaggcacgaccgugaccgugagcuug

SEQ ID NO: 53877 - RNA, 372 nt, Artificial Sequence
  derived and/or modified sequence opt11 from HuMab-098_HeavyChain_VDJ-Region
gaaguccaacuccucgaauccggcggcggccucguccaacccggcggcucccuccgccucucaugcgccgccuccggcuucaccuucuccaacuacggcauguccuggguccgccaagcccccggcaaaggccucgaaugggucuccgccaucuccggcuccgccuacuccaccuacuacgccgacuccguaaaaggacgcuucaccaucucccgcgacaacuccaaaaacacccucuggcuccaaaugaacucccuccgcgccgaagacaccgcagucuacuacugcgccaaagcccacuaccacggcuccggcuccuacuacacccucuucgacuacuggggccaaggcacccucgucaccgucuccucc

SEQ ID NO: 53878 - RNA, 321 nt, Artificial Sequence
  derived and/or modified sequence opt11 from HuMab-098_LightChain_VJ-Region
gacauccaaaugacccaaucccccuccucccucuccgccuccgucggcgaccgcgucaccaucaccugccgcgcaucccaaggcaucuccuccuggcucgccugguaccaacaaaaacccgaaaaagcccccaaaucccucaucuacgccgccuccucccuccaauccggcguccccucccgcuucuccggcuccggcuccggcaccgacuucacccucaccaucuccucccuccaacccgaagacuucgccaccuacuacugccaacaauacaacuccuaccccuacaccuucggccaaggcaccaaacucgaaaucaaa

SEQ ID NO: 53879 - RNA, 372 nt, Artificial Sequence
  derived and/or modified sequence opt11 from HuMab-100_HeavyChain_VDJ-Region
gaaguccaacuccucgaauccggcggcggccucguccaaccaggcggaucccuccgccucuccugcgccgccuccggcuucaccuucaacaacuacggcaugaacuggguccgccaagcccccggcaaaggccucgaaugggucuccgccaucuccggaacaggcuacuccaccuacuacgccgacuccgucaaaggccgcuucaccaucucccgcgacaacuccaaaaacacccuauaccuccaaaugaacucccuccgcgccgaagacaccgccgucuacuacugcgccaaagcccacuacuucggcuccggcuccuacuacacccucuucgacuacuggggccaaggcacccucgucaccgucuccucc

SEQ ID NO: 53880 - RNA, 372 nt, Artificial Sequence
  derived and/or modified sequence opt11 from HuMab-106_HeavyChain_VDJ-Region
gaagugcaauugguccagagcggggccgaggucaagaaaccgggcgagagcuugaaaauaagcuguaaagggagcggguacucguucacgcgauauuggauaggcugggucaggcaaaugcccgggaaagggcucgaguggaugggcauaaucuaucccggggacucggacacgcgauauagcccgagcuuucaagggcaagugacaauaagcgcggacaagagcauaagcacggccuaucuccaguggucgagcuugaaagcgagcgauacagcgauguauuacugugccaggcucacgggcgaucgcggguucgauuacuauagcgggauggaugucuggggccagggcacgaccgugaccgugagcucg

SEQ ID NO: 53881 - RNA, 321 nt, Artificial Sequence
  derived and/or modified sequence opt11 from HuMab-106_LightChain_VJ-Region
gaaaucguccucacccaaucccccggcacccucucccucucccccggcgaacgcgccacccucuccugccgcgccucccaauccgucucauccuccuaccucgccugguaccaacaaaaacccggccaagccccccgccuccucaucuacggcgccuccucccgcgccaccggcauccccgaccgcuucuccggcuccggcuccggcaccgacuucacccucaccaucucccgccucgaacccgaagacuucgccgucuacuacugccaacaauacggcuccuccuucaccuucggccccggcaccaaagucgacaucaaa

SEQ ID NO: 53882 - RNA, 351 nt, Artificial Sequence
  derived and/or modified sequence opt11 from HuMab_10F8_HeavyChain_V-Region
caagugcaauuggucgagagcgggggcggggucgugcaaccgggcaggagcuugcgcuugagcuguaccgcgagcggguucacguucucgcacuauggcauguacugggucaggcaagcgcccgggaaagggcucgaguggguggccgugaucugguacgauggcucguacgaguacaaugaagauagcgugaaagggcgcuuuaccauaagcagggacaauagcaagaacacgcucuaucuccagaugaauagcuugcgcgcggaagauaccgcggucuauuacugugccagggacagggucgggcucuuugacuauugggggcaagggaccuuggucacggucucgagc

SEQ ID NO: 53883 - RNA, 408 nt, Artificial Sequence
  derived and/or modified sequence opt11 from HuMab_10F8_HeavyChain_V-Region_Precursor
auggaguucgggcucucauggguguucuuggucgcgcuccugcgcgggguccagugccagguccagcucguggaaucgggcgggggcgugguccagcccgggcgaucgcucagacucucaugcacggccucgggcuuuaccuuuagccauuacgggauguauugggugcgccaggccccgggcaagggcuuggaaugggucgcggucauaugguaugacgggagcuaugaauauaacgcggacucggucaagggcagguucacgaucucgcgcgauaacucgaaaaauaccuuguacuugcaaaugaacucgcucagggccgaggacacggccguguacuauugcgcgcgcgaucgcgugggcuuguucgauuacuggggccagggcacgcuagugaccgugagcucg

SEQ ID NO: 53884 - RNA, 321 nt, Artificial Sequence
  derived and/or modified sequence opt11 from HuMab_10F8_LightChain_V-Region
gaaaucguccucacccaaucacccggcacccucucccucucccccggcgaacgcgccacccucuccugccgcgccucccaauccaucuccuccuccuaccucgccugguaccaacaaaaacccggccaagccccccgccuccucaucuacggccccuccucccgcgccaccggcauccccgaccgcuucuccggcuccggcuccggcaccgacuucacccucaccaucucccgccucgaacccgaagacuucgccgucuacuacugccaacaauacgccggcucccucaccuucggccccggcaccaaagucgacaucaaa

SEQ ID NO: 53885 - RNA, 381 nt, Artificial Sequence
  derived and/or modified sequence opt11 from HuMab_10F8_LightChain_V-Region_Precursor
auggaaacccccgcccaacuccucuuccuccuccuccucuggcuccccgacaccaccggcgaaaucguccucacccaaucccccggcacccucucccucucccccggcgaacgcgccacccuauccugccgcgccucccaauccaucuccuccuccuaccucgccugguaccaacaaaaacccggccaagcaccccgccuccucaucuacggccccuccucccgcgccaccggcauccccgaccgcuucuccggcuccggcuccggcaccgacuucacacucaccaucucacgccucgaacccgaagacuucgccgucuacuacugccaacaauacgccggcucacucaccuucggccccggcaccaaagucgacaucaaa

SEQ ID NO: 53886 - RNA, 357 nt, Artificial Sequence
  derived and/or modified sequence opt11 from HuMab-111_HeavyChain_VDJ-Region
caaguacaacucguccaauccggagccgaagucaaaaaacccggcagcucagucaaagucuccugcaaagccuccggcggcaccuucagcagcuacggcaucagcuggguccgccaagccccaggccccggccuagaauggaugggccgcauaaucccaauacucggcauagcaaacuacgcccaaaaauuccaaggccgagucacaaucacagccgacaaaagcaccaacaccgccuacauggaacucagcagccuccgcagcgaagacaccgcaguauacuacugcgcccgcgaccaagaauacuccagcaacugguacuacuggggccaaggcacacuaguaacagucagcucc

SEQ ID NO: 53887 - RNA, 321 nt, Artificial Sequence
  derived and/or modified sequence opt11 from HuMab-111_LightChain_VJ-Region
gaaaucguccucacccaaucacccggcacccucucccucucccccggcgaacgcgccacccucuccugccgcgccucccaauccguccgcucauccuaccucgccugguaccaacaaaaacccggccaagccccacgccuccucaucuacggagccuccucccgcgccaccggcauccccgaccgcuucuccggcuccggcuccggcaccgacuucacccucaccaucucccgccucgaacccgaagacuucgccgucuacuacugccaacucuacggcuccucccccaccuucggccccggcaccaaagucgacaucaaa

SEQ ID NO: 53888 - RNA, 363 nt, Artificial Sequence
  derived and/or modified sequence opt11 from HuMab-123_HeavyChain_VDJ-Region
caaguccaacucguccaauccggcgccgaagucaaaaaacccggcgccuccgucaaagucuccugcaaagccgccggcuacaccuucaccaacuacggcaucuccuggguccgccaagcccccggccaagcccucgaauggaugggcuggaucaccaccuacucauccaacaccaucuacgcccaaaaacuccaaggacgcgucaccaugaccaccgacaccuccaccuccaccgcauacauggaacuccgcucacuccgcuccgacgacaccgccgucuacuacugcgcccgcgaccgcgucgucguccgccccgacuacuucgacuacuggggccaaggcacccuagucaccgucuccucc

SEQ ID NO: 53889 - RNA, 321 nt, Artificial Sequence
  derived and/or modified sequence opt11 from HuMab-123_LightChain_VJ-Region
gaaaucguccucacccaaucccccgccacccucucccucucccccggcgaacgcgccacccucuccugccgcgccucccaauccgucuccuccuaccucgccugguaccaacaaaaacccggccaagccccccgccuccucaucuacgacaccuccaaccgcgccaccggcauccccgcccgcuucuccggcuccggcuccggcaccgacuucacccuaaccaucuccucccucgaacccgaagacuucgccgucuacuacugccaacaacgcucccacuggccccgaaccuucggccaaggcaccaaagucgaaaucaaa

SEQ ID NO: 53890 - RNA, 363 nt, Artificial Sequence
  derived and/or modified sequence opt11 from HuMab-124_HeavyChain_VDJ-Region
caaguccaacucguccaauccggcgccgaagucaaaaaacccggcgccuccgucaaagucuccugcaaagccgccggcuacaccuucaccaacuacggcaucuccuggguccgccaagcccccggccaaggccucgaauggaugggcuggaucaucaccuacaacggcaacaccaucuacgcccaacgcuuccaagaccgcgucacaaugaccaccgacaccuccaccuccaccgccuacauggaacuccgcucccuccgauccgacgacaccgccgucuacuacugcgcccgcgaccgcaucaucguccgccccgacuacuucgacuacuggggccaaggcacccucgucaccgucucauca

SEQ ID NO: 53891 - RNA, 372 nt, Artificial Sequence
  derived and/or modified sequence opt11 from HuMab-125_HeavyChain_VDJ-Region
gaaguacaacuccucgaauccggcggcggccucguccaacccggcggcucccuccgccucuccugcgccgccuccggcuucaccuucaccgacuacgccaugaacuggguccgccaagcccccggcaaaggccucgaaugggucuccaccaucuccggcuccggcuacgccaccuacuacgccgacuccgucaaaggccgcuucaccaucucccgcgacaacuccaaaaccacccucuaccuccaaaugaacucccuccgcgccgaagacaccgccgucuacuacugcgccaaaggccacacacucggcuccggcuccuacuacacccucuucgacuacuggggccaaggaacccucgucaccgucuccucc

SEQ ID NO: 53892 - RNA, 321 nt, Artificial Sequence
  derived and/or modified sequence opt11 from HuMab-125_LightChain_VJ-Region
gacauccaaaugacccaaucccccuccucccucuccgccuccgucggcgaccgcgucaccaucaccugccgcgccucccaaggcaucaacuccuggcucgccugguaccaacaaaaacccgaaaaagcccccaaaucccucaucuacgccgccuccucccuccaauccggcguccccucccgcuucuccggcuccggcuccggcaccgacuucacccucaccaucuccucccuccaacccgaagacuucgccaccuacuacugccaacaauacaacucauaccccuacaccuucggccaaggcaccaaacucgaaaucaaa

SEQ ID NO: 53893 - RNA, 369 nt, Artificial Sequence
  derived and/or modified sequence opt11 from HuMab-127_HeavyChain_VDJ-Region
gagguccagcucgugcaaucgggcgcggaagugaaaaagcccggggaaucgcucacgaucucaugcaagggcucaggcuauagcuuuagcauauacuggaucgggugggugcgccagaugccgggcaagggcuuggaauggauggggaucauauucccgggcgauagcgauaucagguacucacccucguuccagggccaggucacgaucucggccgauaaaucgaucucgaccgcguacuugcaauggagcucacucaaggccucggacacggccauguacuauugcgcgcgccagcccggggacuggagcccgcgccauugguauuucgaucucuggggcagaggcacgcucgugaccgugagcucg

SEQ ID NO: 53894 - RNA, 321 nt, Artificial Sequence
  derived and/or modified sequence opt11 from HuMab-127_LightChain_VJ-Region
gucaucuggaugacccaaucccccucccuccucuccgccuccaccggcgaccgcgucaccaucuccugccgcaugucccaaggcaucuccuccuaccucgccugguaccaacaaaaacccggcaaagcccccgaacuccucaucuacgccgccuccacccuacaauccggcguccccucccgcuucuccggcuccggcuccggcaccgacuucacccucaccaucuccuaccuccaauccgaagacuucgccaccuacuacugccaacaauacuacuccuucccccucaccuucggcggcggcaccaaagucgaaaucaaa

SEQ ID NO: 53895 - RNA, 357 nt, Artificial Sequence
  derived and/or modified sequence opt11 from HuMab-129_HeavyChain_VDJ-Region
cagguccagcucguggaaucgggcgggggcgugguccagcccgggcgcucgcucaggcucucgugcgcggccucgggcuuuaccuuuagcacguucgcgauccauugggugcgccaggccccgggcaagggcuuggaaugggucgcggucauaagcuaugacgggggccauaaauuuuacgcggacucggucaagggcagguucacgaucucgcgagauaacucgaaaaauaccuuguacuugcaaaugaacucgcucagggccgaggacacggcaauguacuauugcgcgcgcgggcucggggucuggggcgcguucgauuacuggggccagggcacgcucgugaccgugagcucg

SEQ ID NO: 53896 - RNA, 318 nt, Artificial Sequence
  derived and/or modified sequence opt11 from HuMab-129_LightChain_VJ-Region
gaaaucguccucacccaaucccccgccacccucucccucucccccggcgaacgcgccacccucuccugccgcgccucccaauccgucuccuccuaccucgccugguaccaacaaaaacccggccaagccccccgccuacucaucuacgacgccuccaaccgcgccaccggcauccccgcccgcuucuccggcuccggcuccggcaccgacuucacccucaccaucuccucccucgaacccgaagacuucgccgucuacuacugccaacaacgcuccaacugguggaccuucggccaaggcaccaaagucgaaaucaaa

SEQ ID NO: 53897 - RNA, 375 nt, Artificial Sequence
  derived and/or modified sequence opt11 from HuMab-132_HeavyChain_VDJ-Region
caaguccaacucguccaauccggcgccgaaguaaaaaaacccggcgccuccgucaaagucucaugcaaagccuccggcuacaccuucaccuccuacggcaucuccuggguccgccaagcccccggccaaggccucgaauggaugggcuggaucuccgcauacaacggcaacuccaacuacguccaaaaauuccaaggccgcgucaccaugacaaccgacaccaccaccuccaccgccuacauggaacuccgcucccucaccagcgacgacaccgccgucuacuacugcgcccgcgaauacuccuacgacuccggcaccuacuucuacuacggcauggacgucuggggccaaggcaccaccgucaccgucuccucc

SEQ ID NO: 53898 - RNA, 324 nt, Artificial Sequence
  derived and/or modified sequence opt11 from HuMab-132_LightChain_VJ-Region
gaaaucguccucacccaaucccccgccacccucucccucucccccggcgaacgcgccacccucuccugccgcgccucccaauccgucuccuccuaccucgccugguaccaacaaaaacccggccaagccccccgccuccucaucuacgacgccuccaaccgcgccaccggcauccccgcccgcuucuccggcuccggcuccggcaccgacuucacccuaaccaucuccucccucgaacccgaagacuucgccgucuacuacugccaacaacgcucaaacuggcccauguacaccuucggccaaggcaccaaacucgaaaucaaa

SEQ ID NO: 53899 - RNA, 360 nt, Artificial Sequence
  derived and/or modified sequence opt11 from HuMab-143_HeavyChain_VDJ-Region
caaguccaacuccaacaauggggcgccggccuccucaaacccuccgaaacccucucccucaccugcgccgucuacggcggcuccuucuccggcuacuacuggaacuggauccgacaaccccccggcaaaggccucgaauggaucggcgaaauccaccacucaggcuccgccaacuacaaccccucccucaugucccgcgucaccaucuccgucgacaccuccaaaaaccaauucucccuccaacucuccuccgucaccgccgccgacaccgccgucuacuacugcgcccgcggcuacuacggcuccggcuacuacuacuucgacuacuggggccaaggcacccucguaaccgucuccucc

SEQ ID NO: 53900 - RNA, 321 nt, Artificial Sequence
  derived and/or modified sequence opt11 from HuMab-143_LightChain_VJ-Region
gacauccaaaugacccaaucccccuccucccucuccgccuccgucggcgaccgcgucaccaucaccugccgcgccucccaaggcaucuccuccuggcucgccugguaccaacaaaaacccgaaaaagcccccaaaucccucaucuacgccgccucccgccuccaauccggcguccccucccgcuucuccggcuccggcuccggcaccgacuucacccucaccaucuccucccuccaacccgaagacuucgccaccuacuacugccaacaauacaacucauaccccaucaccuucggccaaggcacccgacucgaaaucaaa

SEQ ID NO: 53901 - RNA, 366 nt, Artificial Sequence
  derived and/or modified sequence opt11 from HuMab-150_HeavyChain_VDJ-Region
gagguccagcuagugcaaucgggcgcggaagugaaaaagcccggggaaucgcuaaagaucucgugcaagggcucgggcuauagcuuuaccucguacuggaucggguggguacgccagaugccgggcaagggccuggaauggauggggagcauauacccgggcgacagccauaccagguacaggcccucguuccagggccaggucacgaucucggccgauaaaucgaucucgaccgcguacuugcaauggagcucgcuaaaggccucggacacggccauguacuauugcgcgcgacaggccggggacuauuacuauuacaauggcauggacgugugggggcaagggaccacggucacggucucgagc

SEQ ID NO: 53902 - RNA, 321 nt, Artificial Sequence
  derived and/or modified sequence opt11 from HuMab-150_LightChain_VJ-Region
gaaaucguccucacccaaucccccggcacccucucccucucccccggcgaacgcgccacccucuccugccgcgccucccaauccgucuccuccuccuaccucaccugguaccaacaaaaacccggccaagccccccgccuccucaucuacggcgccuccucccgcgccaccggcauccccgaccgcuucuccggcuccggcuccggcaccgacuucacccucaccaucucccgccucgaacccgaagacuucgccgucuacuacugccaacaauacggcuccucccucaccuucggcggcggcaccaaagucgaaaucaaa

SEQ ID NO: 53903 - RNA, 363 nt, Artificial Sequence
  derived and/or modified sequence opt11 from HuMab-152_HeavyChain_VDJ-Region
cagguccaggucguggaaucgggcgggggcgugguccagcccgggcgcucgcucaggcucucgugcgcggccucgggcuuuaccuuuagcucguacgcgaugcauugggugcgccaggccccgggcaagggcuuggaaugggucgcggucauaagcuaugacgggagcuauaaauauuacgcggacucggucaagggcagguucacgaucucgcgcgauaacucgaaaaauaccuuguacuugcaaaugaacucgcucagagccgaggacacggccguguacuauugcgcgcgcgggagcauaaccgggagcacgggcguguucgauuacuggggccagggcacgcuagugaccgugagcucg

SEQ ID NO: 53904 - RNA, 321 nt, Artificial Sequence
  derived and/or modified sequence opt11 from HuMab-152_LightChain_VJ-Region
gacauccaaaugacccaaucccccuccucccucuccgccuccgucggcgaccgcgucaccaucacaugccgcgccucccaaggcaucaacuccuggcucgccugguaccaacaaaaacccgaaaaagcccccaaaucccucaucuacgacgccuccucccuccaauccggcguccccucccgcuucuccggcuccggcuccggcaccgacuucacccucaccaucuccucccuccaacccgaaaacuucgccaccuacuacugccaacaauacaacuccuaccccaucaccuucggccaaggcacccgccucgaaaucaaa

SEQ ID NO: 53905 - RNA, 363 nt, Artificial Sequence
  derived and/or modified sequence opt11 from HuMab-153_HeavyChain_VDJ-Region
cagguccagcucguggaaucgggcgggggcgugguccagcccgggcgcucgcucaggcucucgugcgcggccucaggcuuuaccuuuagcgauuacgugauccauugggugcgccaggccccgggcaagggccuggaaugggucacggucauaagcuaugacgggagcaauaaauauuacgcggacucggucaagggcagguucacgaucucacgcgauaacucgaaaaauaccuuguaccugcaaaugaacucgcucucggccgaggacacggccauguacuauugcgcgcgcgggggcauaaccgggaccacgggcguguucgauuacuggggccagggcacgcucgugaccgugagcucg

SEQ ID NO: 53906 - RNA, 321 nt, Artificial Sequence
  derived and/or modified sequence opt11 from HuMab-153_LightChain_VJ-Region
gacauccaaaugacccaaucccccuccucccucuccgccuccgucggcgaccgcgucaccaucaccugccgcgccucccaaggcaucuccuccuggcucgccugguaccaacaaaaacccgaaaaagcccccaaaucccucaucuacgacgccuccucccuccaauccggcguccccucccgcuucuccggcuccggcuacggcaccgacuucucccucaccaucuccucccuccaacccgaagacuucgccaucuacuacugccaacaauacaaauccuaccccaucaccuucggccaaggcacccgccucgaaaucaaa

SEQ ID NO: 53907 - RNA, 378 nt, Artificial Sequence
  derived and/or modified sequence opt11 from HuMab-159_HeavyChain_VDJ-Region
gaaguccaacuaguccaauccggcgccgaagucaaaaaacccggcgaaucccucaaaaucuccugcaaaggcuccggcuacaacuucaccuccuacuggaucggcuggguccgccaaaugcccggcaaaggccucgaauggaugggcaucaucuaccccggcgacuccgacacccgcuacucccccuccuuccaaggccaagucaccaucuccgccgacaaauccaucuccaccgccuaccuccaauggucaucccucaaagccuccgacaccgccauguacuacugcgcccgcuggggcaccuacuacgacauccucaccggcuacuucaacugguucgaccccuggggccaaggcacccucgucaccgucuccuca

SEQ ID NO: 53908 - RNA, 321 nt, Artificial Sequence
  derived and/or modified sequence opt11 from HuMab-159_LightChain_VJ-Region
gacauccaaaugacccaaucccccuccucccucuccgccuccgucggcgaccgcgucaccaucaccugccgcgccucccaaggcaucuccuccuggcucgccugguaccaacaaaaacccgaaaaagcccccaaaucccucaucuacgccgccuccucccuccaauccggcguccccucccgcuucuccggcuccggcuccggcaccgacuucacccucaccaucuccucccuccaacccgaagacuucgccaccuacuacugccaacaauacuacaucuaccccuggaccuucggccaaggcaccaaagucgaaaucaaa

SEQ ID NO: 53909 - RNA, 363 nt, Artificial Sequence
  derived and/or modified sequence opt11 from HuMab-160_HeavyChain_VDJ-Region
cagguccagcucguggaaucaggcgggggcgugguccagcccgggcgcucgcuaaggcucucaugcgcggccucgggcuuuaccuuuagcucgcacgcgaugcauugggugcgccaggccccgggcaagggcuuggaaugggucgcggccauaagcuaugacgggagcaauaaauauuacgcggacucggucaagggcagguucacgaucucgcgcgauaacucgaaaaauaccauguacuugcaaaugaacucgcucagggccgaggacacggccaugugcuauugcgcgcgcggaagcauaaccgggagcacgggcguguucgauuacuggggccagggcacgcucgugaccgugagcucg

SEQ ID NO: 53910 - RNA, 321 nt, Artificial Sequence
  derived and/or modified sequence opt11 from HuMab-160_LightChain_VJ-Region
gacauccaaaugacccaaucccccuccucccucuccgccuccgucggcgaccgcgucaccaucaccugccgcgccucccaagacaucuccuccuggcucgccugguaccaacaaaaacccgaaaaagcccccaaaucccucaucuacgccgccuccucccuccaauccggcguccccucccgcuucuccggcuccggcuccggcaccgacuucacccucaccaucuccucccuccaacccgaagacuucgccaccuacuacugccaacaauacaacuccuaccccaucaccuucggccaaggcacccgccucgaaaucaaa

SEQ ID NO: 53911 - RNA, 372 nt, Artificial Sequence
  derived and/or modified sequence opt11 from HuMab-162_HeavyChain_VDJ-Region
gaagugcaauugugggagagcgggggcgggagcgugcaaccgggcgggagcuugcgccugagcugugccgcgagcggguucacguucucgagcuauggcaugagcuggguaaggcaagcgcccgggaaagggcucgagugggugagcgggaucucgggcucgggcuauagcacguacuaugccgauagcgugaaagggcgcuuuaccauaagcagggacaauagcaagaacacgcucuaucuccagaugaauagcuugcgcgcggaagauaccgcggucuauuacugugccaagggcuauuaccauggcucgggcucguacuauaccucauucgauuacuggggccagggcacgcucgugaccgugagcucg

SEQ ID NO: 53912 - RNA, 321 nt, Artificial Sequence
  derived and/or modified sequence opt11 from HuMab-162_LightChain_VJ-Region
gacauccaaaugacccaaucccccuccucccucuccgccuccgucggcgaccgcgucaccaucaccugccgcgccucccaaggcaucuccuccuggcucgccugguaccaacaaaaacccgaaaaagcccccaaaucccucaucuacgccgccuccucccuccaauccggcguccccucccgcuucuccggcuccggcuccggcaccgacuucacccucaccaucuccucccuccaacccgaagacuucgccaccuacuacugccaacaauacaacuccuacccccucaccuucggcggcggcaccaaagucgaaaucaaa

SEQ ID NO: 53913 - RNA, 366 nt, Artificial Sequence
  derived and/or modified sequence opt11 from HuMab-163_HeavyChain_VDJ-Region
gagguccagcucgugcaaucgggcgcggaagugaaaaagcccggggaaucgcucaagaucucgugccagggcucgggcuaucgcuucaucucguacuggaucgggugggugcgccagaugccgggcaagggcuuggaauggauggggcgcauauacccgggcgauagcgauaccagguacucgcccucauuccagggccaggucacgaucucggucgauaaaucgaucucgaccgcguacuugcaauggagcucgcucaaggccucggacacggccauguacuauugcgcgcgccagcgcggggacuauuacuauuucaauggcuuggacgugugggggcaagggaccacggucacggucucgagc

SEQ ID NO: 53914 - RNA, 321 nt, Artificial Sequence
  derived and/or modified sequence opt11 from HuMab-163_LightChain_VJ-Region
gagaucgugcucacgcaaucgcccgggaccuugagcuugagcccgggcgagcgcgcgaccuugagcugucgcgcgagccagagcgugagcucgagcuaucuagcgugguaucaacagaaaccgggccaggccccgcgcuugcucauauacggagccucgagcagggccacgggcauacccgaucgcuuuagcgggagcgggagcgggaccgauuucacgcucacgaucucgcgcuuggaaccggaagauuucgcggucuauuacugucaacaguacggaagcucgcucacguucgggggcgggaccaaggucgagaucaag

SEQ ID NO: 53915 - RNA, 363 nt, Artificial Sequence
  derived and/or modified sequence opt11 from HuMab-166_HeavyChain_VDJ-Region
cagguccagcucguggaaucgggcgggggcgugguccagcccgggcgcucgcucaggcucucgugcgcggccucgggcuuuaccuuuagcucguacgcgaugcauugggugcgccaggccccgggcaagggccuggaaugggucgcggucauaagcuaugacgggagcaaugaauauuacgcggacucggucaagggcagguucacgaucucgcgcgauaacucgaaaaauaccuuguacuugcaaaugaacucgcucagggccgaggacacggccguguacuauugcgcgcgagggagcauaaucgggagcacgggcguauucgauuacuggggccagggcacgcuagugaccgugagcucg

SEQ ID NO: 53916 - RNA, 321 nt, Artificial Sequence
  derived and/or modified sequence opt11 from HuMab-166_LightChain_VJ-Region
gacauccaaaugacccaaucccccuccucccucuccgccuccgucggcgaccgcgucaccaucaccugccgcgccucccaaggcaucuccaacuggcucgccugguaccaacaaaaacccgaaaaagcccccaaaucccucaucuacgacgccuccucccuccaauccggcguccccucccgcuucuccggcuccggcuccggcaccgacuucacccucaccaucuccucccuccaacccgaagacuucgccaccuacuacugccaacaauacaacuccuaccccaucaccuucggccaaggaacccgccucgaaaucaaa

SEQ ID NO: 53917 - RNA, 363 nt, Artificial Sequence
  derived and/or modified sequence opt11 from HuMab-167_HeavyChain_VDJ-Region
caagugcaauuggucgagagcgggggcggggucgugcaaccgggcaggagcuugcgcuugagcugugccgcgagcggguucacguucucgagcuaugccauacacugggucaggcaagcgcccggaaaagggcucgaguggguggccgugaucucguacgauggcucgaacaaguacuaugccgauagcgugaaagggcgcuuuaccauaagcagggacaauagcaagaacacgcucuaucuacagaugaauagccugcgcgcggaagauaccgcggucuauuacugugccaggggcucgaucacgggcucgaccggggucuuugacuauugggggcaagggaccuugguaacggucucgagc

SEQ ID NO: 53918 - RNA, 363 nt, Artificial Sequence
  derived and/or modified sequence opt11 from HuMab-169_HeavyChain_VDJ-Region
caagugcaauugguccagagcggagccgaggucaagaaaccgggcgcgagcgugaaagugagcuguaaagcgagcggguacacguucacgaacuauggaauaagcugggucaggcaagcgcccgggcaagggcucgaguggaugggcuggcucucggccuauagcgggaacacgaucuaugcacagaaauugcaagggcgcgugaccaugacaacggacacgagcacgaccacggccuauauggagcucaggagcuugcgcucggacgauaccgcggucuauuacugugccagggacaggaucguggucaggcccgauuacuuugacuauugggggcaagggacccuggucacagucucaagc

SEQ ID NO: 53919 - RNA, 321 nt, Artificial Sequence
  derived and/or modified sequence opt11 from HuMab-169_LightChain_VJ-Region
gaaaucguccucacccaaucccccgccacccucucccuaucccccggcgaacgcgccacccucuccugccgcgccucccaauccgucuccuccuaccucgccugguaccaacaaaaacccggccaagccccccgccuccucaucuacgacgccuccaaccgcgccaccggcauccccgcccgcuucuccggcucaggcuccggcaccgacuucacccucaccaucuccucccucgaacccgaagacuucgccgucuacuacugccaacaacgcuccaacuggccccgcaccuucggccaaggcaccaaagucgaaaucaaa

SEQ ID NO: 53920 - RNA, 366 nt, Artificial Sequence
  derived and/or modified sequence opt11 from HuMab-7D8_HeavyChain_VH-Region
gagguccagcucguggaaucaggcgggggcuugguccagccagaucgcucgcuaaggcucucgugcgcggccucgggcuuuaccuuucacgauuacgcgaugcauugggugcgccaggccccgggcaagggcuuggaaugggucucgaccauaagcuggaacucgggcacgaucggguacgcggacucggucaagggaagguucacgaucucgcgagauaacgcgaaaaauagcuuguacuugcaaaugaacucgcucagggccgaggacacagccuuguacuauugcgcgaaagauauccaguacgggaacuauuacuauggcauggacgugugggggcaagggaccacggucacggucucgagc

SEQ ID NO: 53921 - RNA, 366 nt, Artificial Sequence
  derived and/or modified sequence opt11 from HuMab-7D8_HeavyChain_V-Region
gagguccagcucguggaaucgggcgggggcuugguccagcccgaucgcucgcucaggcucucgugcgcggccucgggcuuuaccuuucacgauuacgcgaugcauugggugcgccaggccccgggcaagggcuuggaaugggucucgaccauaagcuggaacucgggcacgaucggguacgcggacucagucaagggcagguucacgaucucgcgcgauaacgcgaaaaauagcuuguacuugcaaaugaacucgcucagggccgaggacacggcccuguacuauugcgcgaaagauauccaguacgggaacuauuacuauggcauggacgugugggggcaagggaccacggucacggucucaagc

SEQ ID NO: 53922 - RNA, 321 nt, Artificial Sequence
  derived and/or modified sequence opt11 from HuMab-7D8_LightChain_VL-Region
gaaaucguccucacccaaucccccgccacccucucccucucccccggcgaacgcgccacccucuccugccgcgccucccaauccgucuccuccuaccucgccugguaccaacaaaaacccggccaagccccccgccuccucaucuacgacgccuccaaccgcgccaccggcauccccgcccgcuucuccggcuccggcucaggcaccgacuucacccucaccaucuccucccucgaacccgaagacuucgccgucuacuacugccaacaacgcuccaacuggcccaucaccuucggccaaggcacccgccucgaaaucaaa

SEQ ID NO: 53923 - RNA, 321 nt, Artificial Sequence
  derived and/or modified sequence opt11 from HuMab-7D8_LightChain_V-Region
gaaaucguccucacccaaucccccgccacccucucccucucccccggcgaacgcgccacccucuccugccgcgccucccaauccgucuccuccuaccucgccugguaccaacaaaaacccggccaagccccccgccuccuaaucuacgacgccuccaaccgcgccaccggcauccccgcccgcuucuccggcuccggcuccggcaccgacuucacccuaaccaucuccucccucgaacccgaagacuucgccgucuacuacugccaacaacgcuccaacuggcccaucaccuucggccaaggcacccgccucgaaaucaaa

SEQ ID NO: 53924 - RNA, 324 nt, Artificial Sequence
  derived and/or modified sequence opt11 from huMAb-anti-MSP10.1_LightChain_VJ-Region
gaaaucguccucacccaaucccccgacauccucucccucuccccaggcgaacgcgccacccucuccugccgcgccucccaagcccucaccgccaaauaccucgccugguaccaacaaaaacccggccaagucccccgccuccucaucuacggcuccuccacccgcgccaccggcauccccgaccgcuuccgcggcuccggcuccggcaccgacuucacccucaccaucucccgccucgaacccgccgacuccgccgucuacuacugccaacaauacgaagacucccccuggaccuucggccaaggcaccaaacucgaaaucaaa

SEQ ID NO: 53925 - RNA, 324 nt, Artificial Sequence
  derived and/or modified sequence opt11 from huMAb-anti-MSP10.2_LightChain_VJ-Region
gaaaucguccucacccaaucccccgacacccucucccucucccccggcgaaaccgccacccucuccugccgcgccucccaaaccguccgccgcaacucccucgccugguaccaacaaaaacccggccaagccccccgccuccucaucuacggcgccuccgaccgcgccaccggcauccccgaccgauucuccggcuccggcuucggcaccgacuucacccucaccgucuccggccucgaacccgaagacuucgccgucuacuacugccaacaauacggcaccuccccccgcaccuucggccaaggcaccaaacucgaaaucaaa

SEQ ID NO: 53926 - RNA, 324 nt, Artificial Sequence
  derived and/or modified sequence opt11 from HUMAB-Clone_18_VJ-Region
gaaaucguccucacccaaucccccgccacccucucccucucccccggcgaacgcgccacacucuccugccgcgccucccaauccgucuccuccuaccucgccugguaccaacaaaaacccggccaagccccccgccuccucaucuacgacgccucaaaacgcgccaccggcauccccgcccgcuucuccggcuccggcuccggcaccgacuucacccucaccaucuccucccucgaacccgaagacuucgccgucuacuacugccaacaacgcuccaaauggccccccuggaccuucggccaaggcaccaaagucgaauccaaa

SEQ ID NO: 53927 - RNA, 324 nt, Artificial Sequence
  derived and/or modified sequence opt11 from HUMAB-Clone_22_VJ-Region
gaaaucguccuaacccaaucccccgccacccucucccucucccccggcgaacgcgccacccucuccugccgcgccucccaauccgucuccuccuaccucgccugguaccaacaaaaacccggccaagccccccgccuccucaucuacgacgccuccaaccgagccaccggcauccccgcccgcuucucaggcuccggcuccggcaccgacuucacccucaccaucuccucccucgaacccgaagacuucgccgucuacuacugccaacaacgcuccaaauggccccccuggaccuucggccaaggcaccaaagucgaaaucaaa

SEQ ID NO: 53928 - RNA, 432 nt, Artificial Sequence
  derived and/or modified sequence opt11 from HuMab-L612_Chain_VDJ-Region_Precursor
auggaguucgggcuaacguggcuguucuuggucgcgaacuugaaagggguacagugcgagguccagcucuuggacucgggcgggggcuugguccagcccgggggcugucucaggcuaucgugcgcggccucgggcuuuaccuuuagcucgugcgcgaugucgugggugcgccaggccccgggaaagggcuuggaaugggucucggccauaagcgggagcgggggcucgaccuauuacgcggacucggucaagggcagguucacgaucucgcgcgauaaaucgaaaaauaccuuguacuugcaaaugaacucgcucagggccgaggacacggcaguguacuauugcgcgaaagggggcaaugacauacucacgggcuauuacgcgugggggcaagggacccuggucacggucucgagcgggagcgcgagcgcg

SEQ ID NO: 53929 - RNA, 321 nt, Artificial Sequence
  derived and/or modified sequence opt11 from HuMab_LC5002-002_LightChain_V-Region
gacauccaaaugacccaaucccccuccucccucuccgccuccgucggcgaccgcgucaccaucaccugccgcgccucccaaggcaucucccgcugggucgccugguaccaacaaaaacccgaaaaagcccccaaaucccucaucuacgccgccuccucccuccaauccggcguccccucccgcuucuccggcuccggcuccggcaccgacuucacccucaccaucuccucccuccaacccgaagacuucgccaccuacuacugccaacaauacaacuccuaccccuggaccuucggccaaggcaccaaagucgaaaucaaa

SEQ ID NO: 53930 - RNA, 357 nt, Artificial Sequence
  derived and/or modified sequence opt11 from HuMab_LC5002-002_gamma1-Chain_V-Region
gaagugcaauugcucgagagcgggggcgggcucgugcaaccgggcgggagcuugcgcuugagcugugccgcgagcggguucacguucaauauauaugccaugaacugggucaggcaagcacccgggaaagggcucgagugggugagcgugaucucgggcaggggcauaaccacguacuaugccgauagcgugaaagggcgcuuuaccauaagcagggacaauagcaagaacacgcucuaucuccagaugaauagcuugcgcgcggacgauaccgcggucuauuacugugccaagggcucgagcucguggacggacuuugacuauugggggcaagggaccuuggucacggucucgagc

SEQ ID NO: 53931 - RNA, 321 nt, Artificial Sequence
  derived and/or modified sequence opt11 from HuMab_LC5002-003_LightChain_V-Region
gacauccaaaugacccaaucccccuccucccucuccgccuccgucggcgaccgcgucaccaucaccugccgcgccucccaaggcaucuccuccuggcucgccugguaccaacaaaaacccgaaaaagcccccaaaucccuaaucuacgccgccuccucccuccaauccggcguccccucccgcuucuccggcuccggcuccggcaccgacuucacccucaccaucuccucccuccaacccgaagacuucgccaccuacuacugccaacaauacaacuccuaccccuggaccuucggacaaggcaccaaagucgaaaucaaa

SEQ ID NO: 53932 - RNA, 357 nt, Artificial Sequence
  derived and/or modified sequence opt11 from HuMab_LC5002-003_gamma1-Chain_V-Region
gagguccagcucuuggaaucgggcggggacuugauccagcccgggggcucgcucaggcucucgugcgcggccucgggcuuuaccuuuaacauauacgcgaugaauugggugcgccaggccccgggcaagggcuuggaauggguaucggucauaagcgggcgcgggaucacgaccuauuacgcggacucggucaagggcagguucacgaucucgcgcgauaacucgaaaaauaccuuguacuugcaaauggacucgcucagggccgaggacacggccguguacuauugcgcgaaagggagcucguacuggaccgauuucgauuacuggggccagggaacgcucgugaccgugagcucg

SEQ ID NO: 53933 - RNA, 321 nt, Artificial Sequence
  derived and/or modified sequence opt11 from HuMab_LC5002-005_LightChain_V-Region
gacauccaaaugacccaaucccccuccucacucuccgcauccgucggcgaccgcgucaccaucaccugccgcgccucccaaggcaucuccuccuggcucgccugguaccaacaaaaacccgaaaaagcccccaaaucccucaucuacgccgccuccucacuccaauccggcguccccucccgcuucuccggcuccggcuccggcaccgacuucacccucaccaucuccucccuccaacccgaagacuucgccaccuacuacugccaacaauacaacucccacccccccaccuucggccaaggcaccaaacucgaaaucaaa

SEQ ID NO: 53934 - RNA, 354 nt, Artificial Sequence
  derived and/or modified sequence opt11 from HuMab_LC5002-005_gamma1-Chain_V-Region
gaagugcaagugcucgauagcgggggcgggcucgugcaaccgggcgggagcuugcgcuugagcuguaccgcgagcggguucacguucaggcucuauaccaugagcugggucaggcaaacgcccgggcgagggcucgagugggugagcgggaucucgggcucgggcuugagcacguacuuugccgauagcgugaaagggcgauuuaccauaagcagggacaauagcaagaacacggucuaucuccagaugaauagcuugcgcgcggaagauaccgcggucuauuacugugccaaggaaggggacuggaucuauuucgauagcuggggccagggcacgcucgugaucgugagcucg

SEQ ID NO: 53935 - RNA, 321 nt, Artificial Sequence
  derived and/or modified sequence opt11 from HuMab_LC5002-007_LightChain_V-Region
gaaaucguccucacacaaucccccggcacccucucccucucccccggcgaacgcgccacccucuccugccgcgccucccaauccgucuccuccuccuaccucgccugguaccaacaaaaacccggccaagcaccccgccuccucaucuacggcgccuccucccgcgccaucggcauccccgaccgcuucuccggcuccggcuccggcaccgacuucacccucaccaucucacgccucgaacccgaagacuucgccgucuacuacugccaacacuacggcuccucccucaccuucggcggcggcaccaaagucgaaaucaaa

SEQ ID NO: 53936 - RNA, 369 nt, Artificial Sequence
  derived and/or modified sequence opt11 from HuMab_LC5002-007__gamma1-Chain_V-Region
caagugcaauugguccagagcggggccgaggucaagaaaccgggcucgagcgugaaagugagcuguaaagugagcgggggcacguucucgagcuaugccuuuagcugggucaggcaagcgcccgggcaagggcuagaguggaugggcaggauaauaccaauacucgggcgaacgaacuaugcccagaaauuucaagggcgcgugaccauaaccgcggacaagagcacgagcacggccuauauggaggucucgagcuugagaucggaagauaccgcggucuauuacugugccagggaaggggaaacgcucgauuacuuuuacuauggcauggacgugugggggcaagggaccacggucacggucucgagc

SEQ ID NO: 53937 - RNA, 357 nt, Artificial Sequence
  derived and/or modified sequence opt11 from HuMab_LC5002-018_gamma1-Chain_V-Region
gagguccagcucuuggaaucgggcgggggcuugguccagcccgggggcucgcucaggcucucgugcgcggccucgggcuuuaccuuuaacauauacgcgaugaauugggugcgccaggccccgggcaagggcuuggaaugggucucgguaauaagcgggagcggggucacgaccuauuacgcggacucggucaagggcagguucacgaucucgcgcgauaacucgaaaaauaccuuguaccugcaaaugaacucgcuaagggccgaggacacggccguguacuauugcgcgaaagggagcucgugguaugucgauuucgauuacuggggccagggcacgcucgugaccgugagcucg

SEQ ID NO: 53938 - RNA, 1347 nt, Artificial Sequence
  derived and/or modified sequence opt11 from Ibalizumab_HeavyChain1
caaguccaacuccaacaaucuggacccgaagucguaaaaccaggcgcguccguaaaaaugagcugcaaagcaagcggcuacaccuucaccagcuacgucauccauuggguccgccaaaaacccggccaaggccuagacuggauuggcuacaucaauccauacaacgacggaaccgacuacgacgaaaaauucaaaggcaaagccacccugacauccgacacaucaaccucaaccgccuacauggaacucuccucccuccgauccgaagacacagcagucuacuacugcgcccgugaaaaagacaacuacgccaccggagccugguucgccuauuggggacagggaacccucgucaccguauccuccgccucuaccaaggguccgucaguauucccacucgcccccugcagcagauccaccuccgaauccaccgccgcccucgguugccucguaaaagacuacuuccccgagcccgucaccgucucauggaacagcggcgcacucaccucaggcguacacaccuuccccgccguccuucaaucaaguggccucuacucacucuccucagucgucaccgucccauccuccucccuaggcaccaaaaccuauaccugcaacgucgaccauaaaccaucaaacaccaaaguagacaagcgagucgaauccaaauacgggcccccaugccccuccugccccgcccccgaguuucucggcggcccaucagucuuccuauucccacccaaacccaaagacacccucaugaucucacgaacccccgaaguaaccugcgucgucguagacgucucccaagaagaccccgaaguccaauucaacugguacguagacgguguagaaguacacaacgcuaaaacaaaaccccgcgaagaacaauucaacucaaccuaccgaguuguauccgucuuaaccguacuccaccaagacuggcucaacggcaaagaauacaaaugcaaagucuccaacaaaggccuacccuccuccauagagaaaaccaucuccaaagccaaaggccaaccccgcgaaccccaagucuacacccucccacccucccaagaagaaaugaccaaaaaccaaguaucccugaccugccuagucaaagguuuuuaccccuccgacaucgccgucgaaugggaaagcaacggccaaccagaaaacaacuacaaaaccacaccucccguccucgacucagacggcuccuucuuccuauacucacgacucaccgucgacaagagccgauggcaagaaggcaacgucuucucuugcucuguaaugcaugaagcccuacacaaccacuacacacagaaaagccuaagccucagcuuaggaaaa

SEQ ID NO: 53939 - RNA, 657 nt, Artificial Sequence
  derived and/or modified sequence opt11 from Ibalizumab_LightChain1
gacaucgucaugacccaaucacccgacucccucgccgucucacucggcgaacgcgucaccaugaacugcaaaucaucccaaucccuccuauauuccaccaaucagaaaaacuaccuagcaugguaccaacaaaaaccaggccaaucccccaaacuccucaucuacugggccucaacccgagaauccggcguccccgaccgcuucuccggcuccggcuccggcaccgacuucacccucaccaucucguccguacaagccgaagacgucgccgucuacuacugccaacaauacuacuccuaccgcaccuucggcggcggcaccaaacucgaaaucaaacgcacagucgccgcaccaagcgucuucauauucccacccucugacgaacaacucaaauccggcaccgccuccgucgucugccuccucaacaacuucuacccccgcgaagccaaaguccaauggaaagucgacaacgcccuccaaucaggaaacucccaagaaagcgucaccgaacaagacucaaaagacucaaccuacucccuauccucaacccucacccucuccaaagccgacuacgaaaaacacaaagucuacgccugcgaagucacccaccaaggccucuccucccccgucaccaaauccuucaaccgaggcgaaugc

SEQ ID NO: 53940 - RNA, 1329 nt, Artificial Sequence
  derived and/or modified sequence opt11 from Ibritumomab_tiuxetan_HeavyChain
caagccuaccuacaacaauccggcgcagaacucgugcgacccggcgccuccgucaaaauguccugcaaagccucaggcuacaccuucaccuccuacaacaugcacugggucaaacaaacaccccgccaaggccucgaauggaucggcgccauauaccccggcaacggagacaccuccuacaaucaaaaauucaaaggcaaagccacccuaaccgucgacaaauccuccuccaccgccuacaugcaacuaucaucucuaaccuccgaagacagcgcagucuacuucugcgccagagucgucuacuacuccaauuccuacugguacuucgacgucuggggcaccggaaccaccgucaccgucuccgcccccuccgucuacccacuagccccugucugcggcgacaccacaggcucguccguaacccuaggcugccuagucaaaggcuacuucccagaaccugucacacuaaccuggaacucgggcucacucuccagcggcguccacaccuuccccgccguccuccaaucugaccuguacacccuuucgucuucagucacaguaacuuccucaaccuggcccucccaaagcauaaccuguaacguagcacacccagccuccuccaccaaaguagacaagaaaaucgaaccacgcggccccacuaucaaaccaugcccacccugcaaaugccccgcacccaaucuccucggaggucccucagucuucauauucccacccaaaaucaaagauguacucaugaucagccuaucccccaucguuaccugcgucgucguggacgucucagaagacgaccccgacguccaaaucuccugguucgucaacaacguagaaguccacaccgcccaaacucagacccaccgcgaagacuacaacucaacccuucgcguaguaucggcccugcccauacaacaccaagacuggaugucaggcaaagaauuuaaaugcaaagucaacaauaaagaccuccccgcacccaucgaacgaacuaucucuaaacccaaaggcucaguccgagcaccccaagucuacguccugcccccacccgaagaagaaaugaccaagaaacaaguaacucuaaccugcauggucaccgacuucaugccagaagacauuuacguagaauggacaaacaacggaaaaaccgaacucaacuacaaaaacaccgaaccuguccucgacagcgacggaucauacuucauguacagcaaacuccgagucgaaaagaaaaacugggucgaaagaaacuccuacagcugcucuguaguccacgaaggccuccacaaccaccacacaacuaaauccuucucacga

SEQ ID NO: 53941 - RNA, 627 nt, Artificial Sequence
  derived and/or modified sequence opt11 from Ibritumomab_tiuxetan_LightChain
caaaucguccuaucccaaucccccgccauccucuccgccucccccggcgaaaaagucaccaugaccugccgcgccuccuccuccgucucauacaugcacugguaccaacaaaaacccggcucaucccccaaacccuggaucuacgcccccuccaaccucgccuccggcguccccgcccgcuucuccggcuccggcuccggcacauccuacucccucaccaucucccgagucgaagccgaagacgccgccacauacuacugccaacaauggucauucaacccccccaccuucggcgccggcaccaaacucgaacucaaacgcgccgacgccgcacccaccgucuucaucuucccccccucagacgaacaacucaaauccggcaccgccucugucgucugccuccucaacaauuucuacccccgcgaagccaaaguacaauggaaagucgacaacgcccuccaauccggcaacucccaagaauccgucaccgaacaagacuccaaagacucaaccuacucacuauccuccacccucacccucuccaaagcagacuacgaaaaacacaaagucuacgccugcgaagucacacaccaaggccuauccucccccguaaccaaauccuucaac

SEQ ID NO: 53942 - RNA, 1368 nt, Artificial Sequence
  derived and/or modified sequence opt11 from Icrucumab_HeavyChain1
caagcccaagucgucgaauccggcggcggcgucguccaaucaggacgcagccuccgccuauccugcgccgcauccggcuucgcauucucaucauacggcaugcacuggguccgacaagcccccggaaaaggccuagaauggguagccguaaucugguacgacggaucuaacaaguacuaugcagacucuguacgcggccgcuuuacaaucucccgcgacaacucugaaaacacccucuaccuccaaaugaacucccuccgcgccgaagacaccgcaguuuacuacugcgcacgcgaccacuacggcucaggaguccaccacuacuucuacuacggacuugacgucuggggacaaggaacaaccgucaccguauccuccgcaagcaccaaaggccccucagucuucccccuggcucccucuuccaaaaguaccuccgggggcaccgccgcacucggcugccuaguaaaagauuacuuccccgaacccgucaccgucuccuggaacuccggugcccucaccuccgggguacacacauuccccgccguccuccaauccuccggccucuacucccuuuccucugucguaaccgucccauccuccucccucggcacccagacuuacaucugcaacgucaaccauaaacccucaaacaccaaagucgacaaacgcgucgaacccaaaucgugcgacaaaacacauaccugucccccaugcccagccccagaacuccuaggcggcccauccgucuuccucuucccacccaaacccaaagacacccucaugaucucccgcacaccagaaguaaccugcguugucgucgacgucucacacgaagacccagaagucaaauucaacugguacgucgacggcguagaaguacacaacgccaaaacaaaaccccgugaagaacaauacaacagcacauaccgagucguaucuguccuaaccguccuccaccaagacuggcucaacggcaaagaauacaaaugcaaagucuccaacaaagcccuucccgcacccaucgagaaaaccaucuccaaagccaagggacaacccagagaaccccaagucuacacccucccucccagccgcgaagaaaugaccaaaaaccaagucucccucacaugccuaguaaaaggcuucuaccccuccgacaucgcagucgaaugggaauccaacggccagcccgaaaacaacuacaaaaccacaccacccguccucgacuccgacggauccuucuuccuauacucaaaacucacagucgacaaaucccgauggcaacaaggcaacguauucagcugcuccguaaugcacgaagcacuacacaaccacuacacccaaaaaucccucucccuaucccccggaaaa

SEQ ID NO: 53943 - RNA, 645 nt, Artificial Sequence
  derived and/or modified sequence opt11 from Icrucumab_LightChain1
gaaaucguccucacccaaagccccggaacacuaucacucucacccggcgaacgcgccacacucuccugccgcgccucccaauccgucuccuccuccuaccuagccugguaccaacaaaaacccggccaagccccccgccuccucaucuacggcgccuccucccgcgccaccggcauccccgaccgcuucucaggcuccggcuccggcaccgacuucacccuaaccaucucacgccucgaacccgaagacuucgccgucuacuacugccaacaauacggcuccuccccccucaccuucggcggcggcaccaaaguagaaauaaaacgcacagucgccgcccccucagucuucaucuucccccccucagacgaacaacuaaaauccggcacagccuccguagucugccuacucaacaacuucuacccccgcgaagccaaaguccaauggaaggucgacaacgcccuccaaucaggcaacucacaagaaucagucaccgaacaagacuccaaagacucaaccuacucccucucauccacccuaacacucuccaaagccgacuacgaaaagcacaaagucuacgccugcgaagucacccaccaaggccucuccucccccgucacaaaauccuucaaccgaggagaaugc

SEQ ID NO: 53944 - RNA, 675 nt, Artificial Sequence
  derived and/or modified sequence opt11 from Idarucizumab_HeavyChain1
caaguccaacuucaagaauccggccccggccucgucaaaccauccgaaacccuaucccucaccugcacagucuccggcuucucccuaaccuccuacaucgucgacuggauccgacaaccacccggcaaaggccucgaauggaucggcgucaucugggccggcggcucaaccggcuacaacuccgcccuucgaucccgcguauccaucacuaaagacaccuccaaaaaccaauucucccucaaacucuccucagucaccgcagccgacaccgccgucuacuacugcgccagcgcagccuacuacuccuacuacaacuacgacggcuucgccuacuggggccaaggcacacucgucaccgucuccuccgccuccaccaaaggccccuccgucuucccccucgcccccuccucaaaauccacauccggcggcaccgccgcccucggcugccucgucaaagacuacuuccccgaacccgucaccgucuccuggaacuccggcgcccucaccuccggcguccacaccuucccagccguccuccaauccucuggccucuacucccucuccuccgucguuacaguccccucaucaucucucggcacccaaacauacauaugcaacgucaaccacaaacccuccaacaccaaagucgacaaaaaagucgaacccaaauccugc

SEQ ID NO: 53945 - RNA, 657 nt, Artificial Sequence
  derived and/or modified sequence opt11 from Idarucizumab_LightChain1
gacgucgucaugacccaaagcccccucucacuccccgucacacucggacaacccgccucaaucucaugcaaauccucccaaucccuccuauauaccgacggcaaaaccuaccucuacugguuccuacaacgccccggccaauccccacgccgccucaucuaccucgucuccaaacucgacuccggcguccccgaccgauucucaggcuccggcuccggcaccgacuucacccucaaaaucucacgagucgaagccgaagacgucggcgucuacuacugccuccaauccacccacuucccacacacauucggcggcggcaccaaagucgaaaucaaacgcacagucgccgccccauccguauucaucuucccacccucagacgaacaacucaaaucaggcaccgccuccgucgucugccuacucaacaacuucuacccccgcgaagccaaaguccaauggaaagucgacaacgcccuccaaagcggcaacucccaagagagcgucaccgaacaagacuccaaagacucaaccuacucccucuccuccacccucacccucuccaaagccgacuacgaaaaacacaaaguauacgcaugcgaagucacacaccaaggccucuccucccccgucaccaaauccuucaaccgaggcgaaugc

SEQ ID NO: 53946 - RNA, 1332 nt, Artificial Sequence
  derived and/or modified sequence opt11 from Igatuzuab_HeavyChain1
caaguacaacucguccaaucaggcgccgaagucaagaaacccggcagcuccgucaaaguauccugcaaagccucaggauucaccuucaccgacuacaaaauccacuggguccgacaagcccccggccaaggccucgaauggggcuacuucaaccccaauagcggcuacagcaccuacgcccagaaauuccaaggccgcgucacaaucaccgccgacaaauccaccucaaccgccuacgaacucagcucccuccgauccgaagacacagcaguauacuacugcgcacgcuuauccccaggcggcuauuacgucgaugccuggggacaaggcaccacagucaccgucuccuccgccucgacuaaaggccccuccgucuucccccuagcccccuccucaaaauccaccuccggaggcaccgcagcccuagggugccucguaaaagacuacuucccagaacccgucacagucuccuggaacuccggagcccucaccucagguguccacaccuucccagccguacuacaaagcucagggcucuacucucucucguccguagucacugugccuucauccucacucggcacgcaaacauacaucugcaaugucaaucacaaacccuccaacaccaaagucgacaagaaagucgaacccaaaaguugcgauaaaacacauaccugcccacccugccccgccccagaacuccuaggcggacccagcgucuuccucuucccaccgaaacccaaagacacacucaucucacgcaccccugaaguaaccugcgucgucgucgacguaucccacgaggacccagaagucaaauuuaacugguacguagacggcgucgaaguccacaacgcaaaaaccaaaccccgcgaagaacaauacaacuccaccuaccgaguagucuccguccucaccguccuccaccaagacuggcucaacggcaaagaauacaaaugcaaagucuccaacaaagcacuccccgcacccauugagaaaaccauaucaaaagcaaaaggacaaccccgcgaaccccaaguguacacccucccacccucacgcgacgaacucaccaaaaaccaagucucccuaaccugccucgucaaaggcuucuacccaagcgacaucgccgucgaaugggaauccaacggccaaccagaaaacaacuauaaaacaacaccacccguacucgacucugacggcucauucuuccucuacuccaaacugaccgucgacaagucccgguggcaacaaggcaacgucuucuccugcuccguacacgaagcacuucacaaccauuacacccaaaaaucccucucccuaucccccggc

SEQ ID NO: 53947 - RNA, 636 nt, Artificial Sequence
  derived and/or modified sequence opt11 from Igatuzuab_LightChain1
gacauccaaacccaaucacccuccucccucuccgccuccgucggagaccgcgucaccaucaccugccgcgccucccaaggcaucaacaacuaccucaacugguaccaacaaaaacccggcaaagcccccaaacgccucaucuacaacaccaacaaccuccaaaccggcguccccucccgauucuccggcuccggaucaggcaccgaauucacccucacaaucuccucccuccaacccgaagacuucgccaccuacuacugccuccaacacaacuccuuccccaccuucggucaaggaaccaaacucgaaaucaaacgcaccgucgcagcccccuccgucuucaucuucccccccuccgacgaacaacucaaaucaggcaccgccuccgucguaugccuacucaacaacuucuacccccgcgaagccaaaguccaauggaaagucgacaacgcccuccaauccggcaacucucaagaauccguaaccgaacaagacucuaaagacuccaccuacucccucuccuccacccuaacccucuccaaagccgacuacgaaaaacacaaagucuacgccugcgaagucacccaccaaggccucuccuccccaguaaccaaauccuucaaccgaggcgaaugc

SEQ ID NO: 53948 - RNA, 357 nt, Artificial Sequence
  derived and/or modified sequence opt11 from IGF-IR_HUMAB-1A_HeavyChain
gaagugcaauugguccagagcgggggagggcucgugcacccgggcgggagcuugcgcuugagcugugccgggagcggguucacguucaggaacuaugccauguacugggucaggcaagcgcccgggaaagggcucgagugggugagcgcgaucgggagcgggggcgggaccuauuacgcggacucggucaagggcagguucacgaucucgcgcgauaacgcgaaaaauagcuuguacuugcaaaugaacucgcucagggccgaggacauggccguguacuauugcgcgcgcgcgcccaauugggggagcgaugccuuugacauaugggggcaagggaccauggucacggucucgagc

SEQ ID NO: 53949 - RNA, 357 nt, Artificial Sequence
  derived and/or modified sequence opt11 from IGF-IR_HUMAB-23_HeavyChain
gaagugcaauugguccagagcgggggcgggcucgugcacccgggcgggagcuugcgcuugagcugugccgggagcggguucacguucucgaacuaugccauguacugggucaggcaagcgcccgggaaagggcucgagugggugagcgcgaucgggagcgggggcgggaccuauuacgcggacucggucaagggcagguucacgaucucgcgcgauaacgcgaaaaauagcuuguacuugcaaaugaacucgcuaagggccgaggacauggccguguaccauugcgcgcgagcgcccaauugggggagcgaggccuuugacauaugggggcaagggaccauggucacggucucgagc

SEQ ID NO: 53950 - RNA, 321 nt, Artificial Sequence
  derived and/or modified sequence opt11 from IGF-IR_HUMAB-23_LightChain
gacauccaaaugacccaaucccccucaucccucuccgccuccgucggcgaccgcgucaccauaaccugccgcgccucccaaggcaucucauccuggcucgccugguaccaacaaaaacccgaaaaagcccccaaaucccucaucuacgccgccuccucccuccaauccggcguccccucccgcuucuccggcuccggcuccggcaccgacuucacccucaccaucuccucccuccaacccgaagacuucgccaccuacuacugccaacaauacaacuccuaccccaucaccuucggccaaggcacccgccucgaaaucaaa

SEQ ID NO: 53951 - RNA, 357 nt, Artificial Sequence
  derived and/or modified sequence opt11 from IGF-IR_HUMAB-8_HeavyChain
gaagugcaauugguccagagcgggggcgggcucgugcacccgggcgggagcuugcgcuugagcugugccgggagcggguucacguucaggagcuaugccauguacugggucaggcaagcgcccgggaaagggcucgagugggugagcgcgaucgggagcgggggcgggaccuauuacgcggacucgguaaagggcagguucacgaucucgcgcgauaacgcgaaaaauagcuuguacuugcaaaugaacucgcucagggccgaggacauggccguguacuauugcgcgcgcgcgcccaauugggggagcgaugccuuugacauaugggggcaagggaccauggucacggucucgagc

SEQ ID NO: 53952 - RNA, 321 nt, Artificial Sequence
  derived and/or modified sequence opt11 from IGF-IR_HUMAB-8_LightChain
gacauccaaaugacccaaucccccuccucacucuccgccuccgucggcgaccgcgucaccaucaccugccgcgccucccaaggcaucuccuccuggcucgccugguaccaacaaaaacccgaaaaagcccccaaaucccucaucuacgccgccuccucccuccaauccggcguccccucccgcuucuccggcuccggcuccggcaccgacuucacccucaccaucuccucccuccaacccgaagacuucgccaccuacuacugccaacaauacaacuccuacccccccaccuucggccccggcaccaaagucgacaucaaa

SEQ ID NO: 53953 - RNA, 708 nt, Artificial Sequence
  derived and/or modified sequence opt11 from ImAb1_LightChain
auggacaugcgcgcccccgcccaauucuucggcauccuccuccuaugguuccccggcauacgcugcgacaucaaaaugacacaaucccccucaagcauguacgccagccucggcgaacgcguaaccauaaccugcaaagcaucccaagacaucaaauccuaccucuccugguaccaacaaaaacccuggaaaucccccaaaauccuaaucuacuacgcgaccucacucgcggacggagucccaagccgaaucuccggcuccggcucaggccaagacuacucccucaccauaagcucccucgaauccgacgacacagccacauacuacugccuacaacacggcgaaagccccuacaccuucggcggaggaaccaagcucgaaaucaaacgcgcagacgcagccccaaccgucagcaucuucccacccucauccgaacaacuaaccuccggcggggccucggucguaugcuuccucaacaacuucuaccccaaagacaucaacgucaaauggaaaauagacggcuccgaaagacaaaacggcguccucaacuccuggaccgaccaagacuccaaagacucgacuuacagcaugagcucaacccuaacccucaccaaggacgaauacgaacgccacaacuccuacacaugcgaagccacccacaaaaccuccaccucgcccaucgucaaauccuucaacagaaacgaaugc

SEQ ID NO: 53954 - RNA, 681 nt, Artificial Sequence
  derived and/or modified sequence opt11 from ImAb1_gamma1-Chain
augaacuucggcuucucacuaaucuuccucguccucguccucaaaggcguucaaugcgaagucaaacucgucgaauccggcggcggccucgucaaacccggcggcucccucaaacucuccugcgccgcauccggcuucaccuucuccaacuacgccaugagcuggguccgccaaacccccgaaaaacgccucgaaugggucgccuccaucucauccgacggcgacaccuauuuccccgacaacgucaaaggccgcuucaccaucucccgagaaaacgccggcaacauccuauuccuacaaauguccucccuccgauccgaagacaccgccauguacuacugcgcccgcggcuucaugaucaccuucuggggccaaggcacccucgucaccgucuccgccgccaaaaccacacccccuuccgucuacccccucgcacccggaugcggagacaccaccggaucuuccgucacccucggcugccucgucaaaggcuacuuccccgaauccgucaccguuaccuggaacuccggcucacucuccuccuccguucacaccuuccccgcccuccuccaauccggccucuacaccauguccuccuccgucaccguccccucauccaccuggccuucccaaaccguaaccugcuccgucgcccacccagcguccuccaccaccgucgac

SEQ ID NO: 53955 - RNA, 1344 nt, Artificial Sequence
  derived and/or modified sequence opt11 from Imalumab_HeavyChain1
gaaguccaguuacuagaauccggcggaggacucguccaacccggcggcucccuccggcuauccugugccgccagcggguucaccuucuccaucuacuccaugaacuggguccgccaagcccccggcaaaggccuagaauggguaucaucaaucggcuccagcggcggcaccaccuacuacgcagacagcgucaaaggccgauucaccaucagccgcgacaacuccaaaaacacccuauaccuccaaaugaacucccuccgcgccgaagacaccgcagucuacuacugcgccgggucccaauggcucuacggaauggacgucuggggccaaggcaccacagucaccgucagcuccgccuccaccaaaggcccauccguuuucccacuagcccccucgucaaaauccacguccggcggcacagccgcacuaggcugcuuaguaaaagacuacuuccccgaacccgucacugucuccuggaacucaggugcccucaccuccggcguccacaccuucccagcaguccuacagucauccggacuauacucacuauccuccguagucacaguaccuucuucaucacucggcacccaaacauacaucugcaacgucaaccauaaaccuuccaacaccaaagucgacaaacgcgucgaaccaaaaagcugcgacaaaacccacacaugcccacccuguccagcccccgaacuccuaggcggcccaucagucuuccuauuucccccaaaacccaaggacacacuaaugaucucccgcacccccgaaguaaccugcgucguaguugacgucagccacgaggaccccgaagucaaauucaacugguacguagacggcgucgaaguacacaacgcuaaaaccaaacccagagaagaacaguacaacuccacauaccgagucgucuccguccuuaccguacuucaucaagacuggcuaaacggcaaagaauacaaaugcaagguuuccaacaaagcccucccagcucccaucgagaaaaccauauccaaagccaaaggccaaccccgcgaaccacaagucuauacccucccacccucccgagaagaaaugaccaaaaaccaaguaucccuuaccugccucguaaaaggauucuaccccagcgacaucgccguagaaugggagagcaacggccaacccgaaaacaacuacaagaccaccccacccguacucgacucagacggcuccuucuuccucuacuccaaacuuacaguagacaaaucacgguggcaacagggcaacgucuucuccugcucaguaaugcacgaggcacuccacaaccacuacacacaaaaaucccucucucucucacccgggaaa

SEQ ID NO: 53956 - RNA, 642 nt, Artificial Sequence
  derived and/or modified sequence opt11 from Imalumab_LightChain1
gacauccaaaugacacaaucccccuccucacucuccgccuccguaggcgaccgcgucaccaucacaugccgauccucccaacgcaucaugaccuaccucaacugguaccaacaaaaacccggcaaagcccccaaacuccucaucuucgucgccucccacucccaauccggcguccccucccgauuccguggcuccggcucagaaaccgacuucacccucaccaucuccggacuccaacccgaagacucagccaccuacuacugccaacaauccuucuggacaccacucacauucggcggcggcaccaaagucgaaaucaaacgcaccguagcagcccccuccgucuucaucuucccacccuccgacgaacaacucaaauccggcaccgccucagucgucugccuccucaacaacuucuacccccgugaagccaaaguccaauggaaagucgacaacgcccuccaauccggcaacucccaagaauccgucaccgaacaagacuccaaagacuccaccuacucccucuccucaacacuaacccucuccaaagccgacuacgaaaaacacaaagucuacgcaugcgaagucacccaccaaggccucuccucccccgucaccaaauccuucaaccgaggcgaaugc

SEQ ID NO: 53957 - RNA, 1347 nt, Artificial Sequence
  derived and/or modified sequence opt11 from Imgatuzumab_HeavyChain1
caaguacaacucguccaaucaggcgccgaagucaagaaaccaggcucgucagucaaagucuccugcaaagccuccggcuucacauucaccgacuacaaaauccacuggguccgccaagcccccggacaaggccucgaauggaugggauacuucaaucccaacucaggauacuccaccuacgcacagaaauuucaaggccgcgucaccaucacagccgacaaguccacaaguacugccuacauggaacucuccucccuccgcagugaagauaccgccguauacuacugcgcccgccuuuccccaggcggcuacuacguaauggacgccuggggacaaggaacaacagucaccgucuccuccgcaagcaccaaaggaccauccgucuucccccucgccccaagcucaaaaagcacaagcggcggaaccgccgcacuaggcugccuuguaaaagacuacuuccccgaacccgucaccgucucauggaacuccggcgccuuaaccucaggcguccacaccuuccccgccguucuucaauccuccggccuauacucccucucaagcgucgucaccguccccuccuccucccucggcacccaaaccuacauaugcaacgucaaccacaaaccaucaaacaccaaagucgacaagaaaguagaacccaaaucaugcgacaaaacccacacguguccaccaugccccgcccccgaacuccucggcggccccuccguuuuccucuucccacccaaaccaaaagacacccuaaugaucucccgaacccccgaaguaaccugcgucgucgucgacgucucccacgaagaccccgaagucaaauucaacugguacgucgacggcguagaaguccacaacgcaaaaaccaaacccagagaagaacaauacaacucaaccuaccgcgucguauccguccucacaguccuccaccaagacuggcucaacggcaaagaauacaaaugcaaaguguccaauaaagcacuccccgcacccaucgagaaaacuauuucaaaagcaaaaggccaaccccgagaaccccaagucuauacccucccacccucccgagacgaacucaccaaaaaccaaguaucgcucacaugucucgucaaaggcuucuaccccuccgacaucgccguagaaugggaauccaacggacaacccgaaaacaacuauaagaccacaccacccguccucgacuccgacggcuccuucuuucucuacagcaaacuaaccgucgauaaaucccgcuggcaacaaggcaacgucuucucaugcuccguaaugcacgaagcccuacacaaccacuauacccaaaaaucccucucccucagccccggc

SEQ ID NO: 53958 - RNA, 639 nt, Artificial Sequence
  derived and/or modified sequence opt11 from Imgatuzumab_LightChain1
gacauccaaaugacccaaucccccuccucccucuccgccuccgucggcgaccgcgucaccaucaccugccgagccucccaaggcaucaacaacuaccucaacugguaccaacaaaaacccggcaaagcccccaaacgccuaaucuacaacaccaacaaccuccaaaccggcguccccucccgcuucuccggcuccggcuccggcaccgaauucacccucaccaucuccucccuccaacccgaagacuucgccaccuacuacugccuccaacacaacuccuuccccaccuucggccaaggcaccaaacucgaaaucaaacgcaccguagccgcacccuccguauucauauucccccccuccgacgaacaacucaaauccggcaccgccuccgucgucugccuccucaacaacuucuacccacgcgaagccaaaguccaauggaaagucgacaacgcccuccaauccggcaacucacaagaauccguaaccgaacaagacuccaaagacucaaccuacucccucucauccacccucacccuuuccaaagccgacuacgaaaaacacaaagucuacgccugcgaagucacccaccaaggccuauccucccccgucaccaaauccuucaaccgcggcgaaugc

SEQ ID NO: 53959 - RNA, 1353 nt, Artificial Sequence
  derived and/or modified sequence opt11 from Inclacumab_HeavyChain1
gaagugcagcuaguagaaagcggcggaggacucgugcgucccggcgguagucuccgacucagcugcgccgccuccggcuucacuuucucgaacuacgacaugcacuggguccggcaagccacagggaaaggccucgaaugggucuccgcaaucacagccgcaggcgacaucuacuaccccggcucgguaaaaggccgcuucaccaucucccgcgagaacgccaaaaacucccuuuaccuacaaaugaacucacuacgagccggagacacagcagucuacuacugcgcccgcggccgcuauuccggcagcggguccuacuacaacgacugguucgaccccuggggccaaggcacccuagucaccgucucauccgccucaaccaagggcccaagcgucuucccccucgcgcccugcagccgauccacaagcgaauccacugccgcacucggcugccucgucaaggacuacuuccccgaacccgucaccgucuccuggaacuccggcgcccuaaccucaggaguacacacauucccagccguacuccaaucaucaggccucuauucccucuccagcguagucacaguccccagcucaucccuaggcacaaaaaccuauaccugcaaugucgaccacaagcccucaaacacaaaagucgacaagcgaguggaauccaaauacgguccgcccugcccacccugccccgcccccgaguucgaaggcggcccauccgucuucuuauucccucccaagcccaaagacacgcuaaugaucagccgcacgcccgaagucacaugcgucgucguggacgucucccaagaagaucccgaaguccaauucaacugguacgucgacggcgucgaaguccacaacgccaaaaccaaaccccgcgaagaacaauucaacucaaccuaccgcguagucuccguccucaccguccuacaccaagacuggcucaacggaaaagaauacaaaugcaaagucucuaacaaaggccuacccucguccauugagaaaaccaucagcaaagcaaaaggccaaccacgcgaaccacaagucuacacccucccgcccucccaagaagaaaugaccaagaaccaaguaucacucacaugccucgucaaaggcuuuuaccccagcgacaucgcagucgaaugggaauccaacggccaacccgaaaacaacuacaaaacaacaccacccguccuagacucagaugggagcuucuuccucuacucacgccucaccguggacaaauccagguggcaagaaggaaacguauucuccugcuccguuaugcacgaagccuugcacaaccacuacacccaaaaaucccucucucucucccucggaaaa

SEQ ID NO: 53960 - RNA, 642 nt, Artificial Sequence
  derived and/or modified sequence opt11 from Inclacumab_LightChain1
gaaaucguccucacacaaucacccgccacccucagccuaucccccggugaacgcgccacccuauccugccgcgccucccaauccgucucauccuaccucgccugguaccaacaaaaacccggccaagccccccgccuccucaucuacgacgcauccaaccgcgccaccggcauccccgcccgcuucuccggcucaggcuccggcacagacuucacccucaccaucuccucccuagaacccgaagacuucgccgucuacuacugccaacaacgaucaaacuggccccuaacauucggaggcggcaccaaagucgaaaucaaacgcaccgucgccgcccccuccgucuucaucuucccccccuccgacgaacaacucaaauccggcaccgccuccgucguaugccuccucaacaacuucuacccccgcgaagccaaaguacaauggaaagucgacaacgcccuccaaucaggcaacucacaagaauccgucaccgaacaagacuccaaagacuccaccuacucccucuccuccacccuaacccuauccaaagccgacuacgaaaaacacaaagucuacgccugcgaagucacccaccaaggccucagcucacccgucaccaaaucauucaaccgaggcgaaugc

SEQ ID NO: 53961 - RNA, 1347 nt, Artificial Sequence
  derived and/or modified sequence opt11 from Indatuximab_ravtansine_HeavyChain1
caaguccaacuccaacaaucagguagcgaacuuaugaugcccggcgccuccgucaagauauccugcaaagccacuggcuacacauucucaaacuacuggaucgaaugggucaaacaaagaccaggccacggacuagaauggaucggcgaaauacugccaggcaccggccgcaccaucuacaacgaaaaauucaaaggaaaagcaacauucacagccgacaucuccuccaauaccguccaaaugcaacuguccucacucacauccgaagauagcgcaguauacuacugcgcccgccgcgauuacuacggaaacuucuacuacgccauggacuacuggggccaaggcaccagcgucaccguauccuccgccagcaccaaaggcccauccgucuucccacucgcccccugcucccgcucuaccagcgaaucgaccgccgcacucggcugccuagucaaagacuacuuccccgagccuguaaccgucagcuggaacuccggcgcgcucacguccggcguccacacauuccccgccguccuccaaucguccggacucuacucccucucaagcgucguaaccguccccucauccucauuaggaaccaaaacauacacaugcaacguugaccacaaacccagcaacaccaaagucgacaaacgcgucgaaagcaaauacggacccccaugccccuccugcccagcccccgaguuccuaggcggccccucagucuuccucuucccaccaaaacccaaagacacccucaugauuagccguacccccgaaguaaccugcgucgucgucgacguaucacaagaggacccugaaguccaauucaacugguacgucgacggcgucgaaguccacaacgccaaaacaaaaccccgcgaagaacaauucaacuccacauaccgcguaguuuccguacucaccgugcuucaccaagacuggcuaaacggcaaagaauacaaaugcaaagucucaaacaaaggccuacccucauccaucgagaaaaccaucucaaaagccaagggccaaccucgcgaaccccaaguauacacccucccaccaucucaagaagaaaugaccaaaaaccaaguaucccuaaccugccucgugaaaggcuucuaccccucugacaucgccguagaaugggaauccaacggccaacccgaaaacaacuacaagaccaccccacccguccucgacucagacggcuccuucuuccuuuacucccgccuaaccguagacaaauccagguggcaagaaggcaacgucuucuccugcuccgucaugcacgaagcgcuccacaaccacuacacacagaaaucccucagccucucccucggaaaa

SEQ ID NO: 53962 - RNA, 642 nt, Artificial Sequence
  derived and/or modified sequence opt11 from Indatuximab_ravtansine_LightChain1
gacauccaaaugacacaaucaaccuccucccucucagccucccucggcgaccgagucaccaucuccugcuccgccagccaaggcaucaacaacuaccucaacugguaccaacaaaaacccgacggcaccgucgaacuccucaucuacuacaccuccacccuccaaucagguguccccuccagauucucaggcuccggcuccggcaccgacuacucccucaccaucagcaaccucgaacccgaagacaucggcacauacuacugccaacaauacuccaaacucccccgcaccuucggcggcggaaccaaacucgaaaucaaacgcaccgucgccgcccccuccgucuucaucuucccacccuccgacgaacaacucaaauccggcaccgccucagucgucugccuccucaacaacuucuacccccgcgaagccaaaguccaauggaaagucgacaacgcccuacaaagcggcaacucccaagaauccgucaccgaacaagacuccaaagacuccaccuacagccucuccucuacccucacccucagcaaagccgacuacgaaaaacacaaagucuacgccugcgaaguaacccaccaaggccucagcucacccguaacaaagagcuucaaccgcggcgaaugc

SEQ ID NO: 53963 - RNA, 1347 nt, Artificial Sequence
  derived and/or modified sequence opt11 from Indusatumab_vedotin_HeavyChain1
caaguccaacuccaacaauggggcgccggccuacucaaaccaucugaaacacuaucacucaccugcgccgucuucggcgguuccuucucaggcuacuauuggagcuggauccgccaaccccccggaaaaggacucgaauggaucggcgaaaucaaccaccguggaaacacaaacgacaaccccucccucaaauccagaguuacaauauccgucgacaccuccaaaaaccaguucgcccuaaaacuguccuccgucacagcagcagacaccgcaguauacuacugcgcccgugaaagaggcuacaccuacggaaacuuugaccacuggggccaaggcacucucgucaccgucuccucagccuccaccaaaggccccuccgucuucccccuugccccuuccucgaaauccaccagcggcggcacagccgcccuaggaugccuagucaaagacuacuucccagaacccgucaccgucuccuggaacuccggcgcucucaccuccggcgugcacacauuccccgccgugcuccaauccagcggccuauacucccucuccucagucgucacagucccguccagcucacucggcacccaaaccuacaucuguaacgucaaccacaaacccuccaacaccaaagucgauaaaaaagucgaacccaaauccugcgacaaaacccauacaugcccacccugccccgcccccgaacuacucggcggccccucaguauuucucuucccccccaaacccaaagacacucucaugaucucaagaacccccgaaguaacuugcgucguagucgacgucucacacgaagaccccgaagucaaauucaacugguacguagacggcgucgaaguccacaacgccaaaaccaaaccucgagaagaacaauacaacuccaccuaccgcgucgucucuguacucaccguacuccaccaagacuggcucaacggcaaagaauauaaaugcaaaguauccaacaaagcacuccccgcccccauagaaaaaaccaucagcaaagccaaaggacaaccaagagaaccccaaguauacacccucccaccaucccgcgacgaacucaccaaaaaccaagucucacucaccugccucgucaaaggcuucuaucccucagacaucgcaguagaaugggaaucgaacggccaacccgaaaacaacuacaaaaccaccccacccguccuggacagcgacggcuccuucuuccucuacuccaaacucaccguagacaagucccgcuggcaacaaggcaacgucuucagcugcucagucaugcacgaagcccuccacaaccacuacacccaaaaaucccucucccucucccccggcaaa

SEQ ID NO: 53964 - RNA, 642 nt, Artificial Sequence
  derived and/or modified sequence opt11 from Indusatumab_vedotin_LightChain1
gaaauuguaaugacacaaucccccgcaacccucuccguauccccuggcgaacgcgccacccuauccugccgcgccucccaauccgucucccgcaaccucgccugguaccaacaaaaacccggccaagccccccgccuccucaucuacggcgccuccacacgcgccaccggcauacccgcccgauucuccggcucaggcuccggcacagaauucacccuaaccauaggcucccuccaauccgaagacuucgccgucuacuacugccaacaauacaaaaccuggccccgcacauucggccaaggaaccaacgucgaaaucaaacgcaccgucgccgcccccuccgucuucaucuucccccccuccgacgaacaacucaaauccggcaccgccuccgucguaugccuccucaacaacuucuacccacgcgaagccaaaguccaauggaaagucgacaacgcccuccaauccggaaacucacaagaauccguaaccgaacaagauucaaaagacucaaccuacucccucuccuccacccucacccucuccaaagccgacuacgaaaaacacaaagucuacgccugcgaagucacccaccaaggccucucaucccccgucaccaaauccuucaaccgcggcgaaugc

SEQ ID NO: 53965 - RNA, 1353 nt, Artificial Sequence
  derived and/or modified sequence opt11 from Inebilizumab_HeavyChain1
gaaguccaacucgucgaauccggcggcggccucguccaacccggaggcucccuccgccucuccugcgcagccuccggcuucacauucuccucaagcuggaugaacuggguacgccaagcccccggcaaaggacucgaauggguaggccgcauauacccaggcgauggcgacaccaacuacaacguaaaguucaaaggacgcuucaccaucucacgggacgacagcaaaaacucacucuaccuacaaaugaacucacucaaaaccgaagacacagcagucuacuacugcgcacgaucgggcuucaucaccaccguccgcgacuucgauuacuggggccaaggcacccucgucacagucagcagcgcauccaccaaaggcccguccgucuucccccucgcaccaucaucaaaguccaccuccggcggcaccgcugcccucggcugccucgucaaggacuacuucccagaacccguaaccgucucauggaacagcggugcccuaaccuccggaguccacacauuccccgcagugcuccaaagcuccggccucuacucccucucauccgucguuaccgucccauccucaagccucggcacucaaaccuacaucugcaacgucaaccacaaaccaagcaacacaaaagucgacaaacgcgucgaaccgaaaucaugcgacaaaacccacaccuguccacccugccccgcccccgaacuauuaggagggcccucagucuuucucuuucccccaaaacccaaagacacacuuaugaucucccgcacaccagaggucacuugcgucgucgucgacguaucccacgaagaucccgaaguaaaauucaacugguacgucgacggcgucgagguccacaacgcuaaaaccaaaccucgcgaagaacaauacaacuccacauaccgagucguaagcguccucacuguccuccaccaagacuggcuaaacggcaaagaauacaagugcaaaguaagcaacaaagcccucccagcccccaucgagaaaaccauauccaaagcaaagggacaaccacgagaaccccaagucuacacacuacccccaagcagagaggaaaugaccaaaaaccaaguaagccuuacaugccucgucaaaggauucuacccaucggacauagccguagaaugggaauccaacggacaacccgaaaacaacuacaaaaccacuccacccguccucgacuccgacggauccuucuuccucuacagcaagcucaccguagacaaaucccgcuggcaacaaggcaaugucuuuagcugcagugucaugcacgaagcccuccacaaccacuacacccagaaaagccucucccucucacccggaaaa

SEQ ID NO: 53966 - RNA, 654 nt, Artificial Sequence
  derived and/or modified sequence opt11 from Inebilizumab_LightChain1
gaaaucguacucacacaaucacccgacuuccaaagcgugaccccaaaagaaaaaguaaccauaaccugccgcgcaagcgagagcguagacacauucgggaucuccuucaugaacugguuccaacaaaaacccgaccaaucacccaaacuccucauccacgaagccagcaaccaaggaagcggagucccaagcagguucucaggcucaggcucgggcacagacuucacccugaccauaaacucacucgaagccgaagacgcagccacauacuacugccaacaaucgaaagaagucccguucacauucggaggcggaaccaaagucgaaaucaaacgcacagucgcggccccaagcguguucauauucccacccucggacgaacaacuaaaaucaggcacagccucagucguaugccugcucaacaacuucuacccacgagaagccaaaguccaauggaaagucgacaacgcacuccagagcggaaacucacaagaaagcguaaccgaacaagacagcaaagacucaaccuacagccuaagcucaacccuaacccuaagcaaagccgacuacgagaaacacaaaguauacgcaugcgaagucacacaccaaggccucagcucgcccguaaccaagagcuucaacaggggcgagugc

SEQ ID NO: 53967 - RNA, 90 nt, Artificial Sequence
  derived and/or modified sequence opt11 from Insulin_peglispro_Fragment1
uucgucaaccaacaccucugcggcucccaccucgucgaagcccucuaccucgucugcggcgaacgcggcuucuucuacaccaaacccacc

SEQ ID NO: 53968 - RNA, 63 nt, Artificial Sequence
  derived and/or modified sequence opt11 from Insulin_peglispro_Fragment2
ggcaucgucgaacaaugcugcaccuccaucugcucccucuaccaacucgaaaacuacugcaac

SEQ ID NO: 53969 - RNA, 495 nt, Artificial Sequence
  derived and/or modified sequence opt11 from Interferon_beta-1b_chain1
uccuacaaccuccucggauuccuccaacgcuccuccaacuuccaaucccaaaaacuacuauggcaacucaacggccgacucgaauacugccucaaagaccgcaugaacuucgacauccccgaagaaaucaaacaacuccaacaauuccaaaaagaagacgccgcccucaccaucuacgaaaugcuccaaaacaucuucgccaucuuccgccaagacuccuccuccaccggcuggaacgaaaccaucgucgaaaaccuccucgccaacgucuaccaccaaaucaaccaccucaaaaccguccucgaagaaaaacucgaaaaagaagacuucacccgcggcaaacucauguccucccuccaccucaaacgcuacuacggccgcauccuacacuaccuaaaagccaaagaauacucccacugcgccuggaccaucguccgcgucgaaauccuacgcaacuucuacuucaucaaccgccucaccggcuaccuccgcaac

SEQ ID NO: 53970 - RNA, 1347 nt, Artificial Sequence
  derived and/or modified sequence opt11 from Intetumumab_HeavyChain1
caaguccaacucgucgaauccggcggcggagucguacaacccggacgaucccgacgccucucaugcgcagccagcggauucacauucucccgcuacacaaugcacuggguccgacaagcccccggcaaaggcuuagaaugggucgcaguaaucuccuucgacggcucaaacaaguacuacguggauuccgucaaaggccgcuucaccaucuccagggacaacagcgaaaacacccucuaccuccaagucaacauccuccgcgccgaagacacagccguauacuacugcgcccgcgaagcacgcggaucauaugccuucgacaucuggggacaaggaaccauggucaccguuucauccgccucaacaaagggacccagcgucuuuccuuuagcacccagcuccaaaucaacauccggaggcacagccgcacucgguugccucgucaaagacuacuuccccgaacccgucaccgucagcuggaacucaggugcucucaccucaggaguccacacauucccagcaguccuccaauccagcggccucuacucccuauccucugucgucacaguccccuccucaucccucggcacccaaacauacaucugcaacgucaaccacaaacccuccaacaccaaaguagauaagaaagucgaaccaaaauccugcgacaaaacacacacaugcccacccugcccagcaccagaacuccucggcggccccuccgucuuccuauucccacccaaacccaaagacacccuuaugaucucccgcacccccgaaguaaccugcgucgucgucgacguaagccacgaagaccccgaagucaaauucaacugguacgucgacggcgucgaaguccacaacgccaaaaccaaaccccgagaagaacaauacaacuccaccuaccgagucguaucuguccuaaccguccuacaccaagacuggcucaacgguaaagaauacaaaugcaaaguaucuaacaaagcccuccccgcccccauagagaaaaccauauccaaagccaaaggccaaccccgcgaaccccaagucuacacccucccacccucccgcgacgaacucaccaaaaaccaggucucacugacaugccuagucaagggcuucuaccccucugacauagccgucgaaugggaaucaaacggccaacccgaaaacaacuacaaaaccaccccacccguacuagacucugacgguucauucuuccucuacucaaaacucaccgucgacaaaagccgauggcaacaaggcaacgucuuuuccugcucagucaugcacgaagcucuacacaaccacuacacccaaaaaucacucucccuaagccccggcaaa

SEQ ID NO: 53971 - RNA, 645 nt, Artificial Sequence
  derived and/or modified sequence opt11 from Intetumumab_LightChain1
gaaaucguccucacccaaucccccgccacccucucccuaucccccggagaacgcgccacccucuccugccgagccucacaaucagucuccuccuaccucgccugguaccaacaaaaacccggccaagcaccccgccuccucaucuacgacgccuccaaccgcgccacaggcauccccgcccgcuucucaggcuccggcucaggaacagacuucacccuuaccaucuccucccucgaacccgaagacuucgccgucuauuacugccaacaacgauccaacuggccacccuucacauucggccccggcaccaaagucgacaucaaacgcaccguagccgcccccuccgucuucaucuucccacccuccgacgaacaacucaaauccggcaccgccucagucgucugccuccucaacaacuucuacccccgcgaagccaaaguccaauggaaagucgacaacgcccuccaauccggaaacucccaagaauccgucaccgaacaagacuccaaagacucaaccuacucccucuccuccacacuuacccucuccaaagccgacuacgaaaaacacaaagucuacgccugcgaaguaacccaccaaggacucuccucccccgucaccaaauccuucaaccgcggcgaaugc

SEQ ID NO: 53972 - RNA, 1347 nt, Artificial Sequence
  derived and/or modified sequence opt11 from Iodine_(124I)_Girentuximab_HeavyChain1
gacguaaaacucguggaaagcggcggaggccucgucaaacucggcggcucccucaaacucagcugcgccgccucaggcuuuacauucuccaacuacuacauguccuggguccgccaaacccccgaaaaacgccucgagcuagucgccgccaucaacuccgacggaggcauaaccuacuaccucgacaccgucaaaggcagauucaccaucucucgagacaacgccaaaaacacccucuaccuccaaauguccucacuuaaauccgaggacaccgcccucuucuacugcgcacgccaccgcucaggcuacuucuccauggacuacuggggccagggcaccuccgucaccgucuccuccgccuccaccaaaggccccuccgucuucccucucgcaccaucauccaaaagcaccuccgguggaaccgcagcccugggcugccuagucaaagacuacuuccccgaaccagucacagucuccuggaacagcggcgcccuaacuucaggcguacacacauuccccgccguauuacagucguccggccucuacucauuauccuccguaguuaccguccccucauccucgcuaggcacccaaaccuacaucugcaacgucaaccacaaaccaucuaacaccaaagucgacaagaaagucgaacccaaauccugugauaaaacgcacacaugcccacccugcccagcacccgaacuccucggaggacccucugucuuccuauucccacccaaacccaaagacacacuaaugaucucccgaacccccgaaguaaccugcguagucgucgacguaucucacgaagaccccgaaguaaaauucaacugguacgucgacggagucgaaguccacaacgccaaaaccaaaccccgcgaagaacaauacaacuccaccuaccgcgucguauccgucuuaaccguccuccaccaagacuggcucaacggcaaagaauauaaauguaaagucagcaacaaagcccuucccgcccccaucgaaaagaccaucuccaaagccaaaggccaaccccgcgaaccccaagucuacacccuaccacccucacgcgacgaacucaccaaaaaccagguaucccuaaccugccucguuaaaggauucuaccccuccgauauagccgucgaaugggaaucuaacggccaaccagaaaacaacuacaaaacaaccccaccaguccuagacucugacgguuccuucuuccucuacuccaaacucaccgucgacaaaucacguuggcaacagggcaacgucuucagcugcucagucaugcacgaagcacuucacaaccacuacacacaaaaaucacucucccucucaccaggcaaa

SEQ ID NO: 53973 - RNA, 642 nt, Artificial Sequence
  derived and/or modified sequence opt11 from Iodine_(124I)_Girentuximab_LightChain1
gacaucguaaugacccaaucccaacgcuucauguccacaaccgucggcgaccgcguauccaucaccugcaaagccucccaaaacgucgucucagccgucgccugguaccaacaaaaacccggccaaucccccaaacuccucaucuacucagccuccaaccgcuacaccggcguccccgaccgauucacaggcuccggcuccggcaccgacuucacccuaaccauauccaacaugcaauccgaagaccucgccgacuucuucugccagcaauacuccaacuaccccuggaccuucggcggcggcaccaaacucgaaaucaaacgcaccgucgcagcccccuccgucuucaucuucccccccuccgacgaacaacucaaauccggcacugccucagucgucugccuucucaacaacuucuacccccgcgaagccaaaguacaauggaaagucgacaacgcccuccaauccgguaacucacaagaauccguaaccgaacaagacuccaaagacuccacauacucccucucauccacccuuacccucuccaaagccgacuacgaaaaacacaaagucuacgccugcgaagucacacaccaaggccucuccucccccgucaccaaguccuucaacagaggcgaaugc

SEQ ID NO: 53974 - RNA, 1335 nt, Artificial Sequence
  derived and/or modified sequence opt11 from Iodine_(131I)_derlotuxiab_biotin_HeavyChain1
caaguccaacucaaagaauccggcccgggccucguugcccccucccaaucccucagcauaaccugcaccguaagcggcuucucccucaccgacuacggcguacgcuggauccgucaaccacccggcaaaggccucgaauggcuuggagucaucuggggcggaggauccaccuacuacaacucagcccuaaaaucccgccuaagcaucagcaaagacaacuccaaaucccaagucuuccucaaaaacagccuccaaaccgacgauacugccuacuacugcgccaaagaaaaacgccgcggcuauuacuacgcagacuacuggggucaagggaccuccguaacagucucauccgccucaaccaaaggacccuccgucuucccgcucgcaccaucaagcaagagcaccucuggcggaaccgccgcccuaggcugccuagucaaagacuacuucccagaacccguaaccgucucauggaacuccggagcacuaaccuccggaguccacaccuuccccgcaguccuccaauccuccggucucuacucccuaucaagcgucgucaccguccccucaagcucccugggaacccaaaccuacaucugcaacguuaaucacaagcccuccaacacgaaagucgacaagaaagccgaacccaaauccugcgacaaaacacacacaugcccgcccugccccgccccagaacuccucggcggccccagcguauuccucuuuccacccaaacccaaagacacccuaaucuccagaacccccgaagucacuugcgucguuguagacgucucccacgaagaccccgaagucaaauucaacugguacguagacggagucgaaguccacaacgcaaaaaccaaaccccgcgaagaacaauacaacucaaccuaccgcgucgucuccguccucaccguacuccaccaggacuggcuaaacggcaaagaauacaaaugcaaagucuccaacaaagcacugccugcccccauagagaaaaccaucagcaaagccaaaggucaaccccgcgaaccucaaguauacacccucccacccucccgagacgaacucaccaaaaaccaagucucacuaaccugccucgucaaaggcuucuaccccagcgacaucgcagucgaaugggaaucgaacggccaacccgaaaacaacuacaaaaccacaccgccaguccucgacuccgacggcagcuucuuccucuacuccaaacucaccgucgacaaaucucgcuggcagcaaggcaacgucuucuccugcagcguccacgaagcucuccacaaccacuacacccaaaaaucccugucccuaucccccggcaaa

SEQ ID NO: 53975 - RNA, 639 nt, Artificial Sequence
  derived and/or modified sequence opt11 from Iodine_(131I)_derlotuxiab_biotin_LightChain1
gaaaacguccuuacccagucccccgccauauccgccucccccggcgaaaaagucacaaccugccgagccuccuccuccgucuccuccuccuaccuccacugguaccaacaaaaauccggagccucccccaaacucuggaucuacuccaccucuaaccuagccuccggagucccagccagauucuccggcuccggcuccggaacauccuacucccucaccaucuccuccgucgaagccgaagacgccgccaccuacuacugccaacaauacuccggauacccccuuaccuucggcggcggcaccaaacucgaaaucaaacgaacagucgccgcccccuccgucuucauauucccacccuccgacgaacaacuaaaauccggcaccgccuccgucgucugccuccucaacaacuucuacccccgagaagccaaaguacaauggaaagucgacaacgcccuacaauccggcaacucccaagaauccguaaccgaacaagacuccaaagacuccaccuacucccuauccucaacacucacccuauccaaagccgacuacgaaaaacacaaagucuacgccugcgaagucacccaccaaggccucuccucccccgucaccaaauccuucaacagaggcgaaugc

SEQ ID NO: 53976 - RNA, 1350 nt, Artificial Sequence
  derived and/or modified sequence opt11 from Iodine_(131I)_Derlotuximab_biotin_HeavyChain1
caaguccaacuuaaagaauccggccccggacucgucgcacccagccaaucccugucaaucacaugcaccguauccggcuucagccucaccgacuacggaguacgcuggauccgccaaccacccggaaaaggccucgaauggcucggcguaauauggggcgggggcucaaccuacuacaacuccgcccucaaaucacgccucuccauauccaaagacaacucaaaaucccagguauuccucaaaaugaacucccuccaaaccgaugacaccgccauguacuacugcgccaaagaaaaacgacguggauacuacuacgccauggacuacuggggccaaggcaccuccguaacagucuccuccgccuccaccaaaggcccaucagucuucccacucgcuccauccucaaaaagcaccucaggcggcaccgccgcccugggcugccuagucaaagacuacuucccagaacccgucaccguaucauggaacagcggcgcacucaccuccggaguccacaccuucccagccguccuucaauccuccggccuuuacagccucucguccgucgucaccguccccucauccucccucggcacacaaacuuacaucugcaacguaaaccacaagcccucaaacaccaaaguagacaagaaagcugaacccaaauccugcgacaaaacccacaccugucccccaugccccgcccccgaacuucucggaggucccucaguauuccucuuuccucccaaacccaaagacacccuaaugauaucccgaacccccgaaguaaccugcguagucgucgacgucucccacgaagaccccgaaguaaaauucaacugguacgucgacggcgucgaaguacacaacgccaaaaccaaaccucgcgaagaacaauacaacuccaccuacagagucgucagcguccuaacaguccuucaccaagacuggcuaaacggcaaagaauacaaaugcaaaguauccaacaaagcacuucccgcccccauagaaaagaccauauccaaagccaaaggacagccccgcgaaccccaagucuacacccuaccacccucaagggacgaacuaaccaaaaaccaagugucccuaaccugccucguaaaaggcuucuacccaagcgacauagcuguagaaugggaauccaacggacaaccagaaaacaacuacaaaacaaccccucccguacucgacuccgacggcucauucuuccucuauucgaaacucaccguagacaaaucacgcuggcagcaaggcaauguauucagcugcuccguaaugcacgaagcccuccacaaccacuacacccaaaaaucgcucucccuaagccccggcaaa

SEQ ID NO: 53977 - RNA, 645 nt, Artificial Sequence
  derived and/or modified sequence opt11 from Iodine_(131I)_Derlotuximab_biotin_LightChain1
gaaaacguccucacccaaucccccgccaucaugucagccagccccggcgaaaaagucaccaugacaugccgagccucaucauccgucuccucuucauaccuacacugguaccaacaaaaauccggcgccucccccaaacuuuggaucuacuccaccuccaaccucgccuccggaguacccgcccgcuucuccggcuccggcuccggcaccuccuacucccucaccaucuccucaguagaagccgaagacgccgccaccuacuacugccaacaauacuccggcuacccccucaccuucggcggcggcaccaaacucgaaaucaaacgcaccgucgccgccccuuccgucuucaucuucccucccuccgacgaacaacucaaauccggcaccgccuccgucgucugccuccuaaacaacuucuacccccgcgaagccaaaguccaauggaaagucgacaacgcccuccaaucaggcaacucccaagaauccgucaccgaacaagacuccaaagacucaaccuacucccuauccuccacccucacccucuccaaagccgacuacgaaaaacacaaagucuacgccugugaagucacccaccaaggccuaucuucccccgugaccaaauccuucaaccgaggcgaaugc

SEQ ID NO: 53978 - RNA, 1344 nt, Artificial Sequence
  derived and/or modified sequence opt11 from Ipilimumab_HeavyChain
caaguacaacucgucgaaagcggaggcggcgucguacaacccggccgcucccuacgacuuuccugcgccgcaagcggcuucacauucagcucauauacaaugcacuggguccgacaagcccccggcaaaggacuugaauggguaaccuucaucucauacgacggaaacaacaaauacuacgcugacuccgucaaaggacgcuucaccaucucccgagacaacuccaaaaacacccucuaccuacaaaugaauagccuccgggccgaagacacagccauauacuacugcgcccgaaccggauggcuaggucccuucgacuauuggggccaaggcacccuagucaccgucucaagcgcaucuacgaaaggccccuccguauucccccuagccccauccagcaaaagcaccuccggcggcacagcagcacuaggcugccucguaaaagacuacuuccccgaacccgucaccgucucauggaacucaggcgcacucacuuccgggguccacacauucccugccguccuacaaagcucaggccuauacucacucuccagcgucgucaccgucccaagcuccucccucgguacccaaaccuacaucugcaaugucaaccacaaacccuccaacaccaaaguagacaaacgagucgaaccgaaaucaugcgacaaaacccacacaugcccacccugccccgcccccgaacuccucggcggccccagcgucuuccuauucccacccaaacccaaagacacccucaugaucucucgcaccccagaaguuaccugcgucgucgucgacgucucccacgaagaccccgaaguuaaauuuaacugguacgucgacggcguagaaguccacaacgcaaaaaccaaaccccgcgaagaacaauacaacuccaccuaccgcgucguauccguccucaccguccuacaccaagacuggcuaaacgguaaagaauacaaaugcaagguauccaacaaagcccuucccgcccccaucgagaaaaccaucuccaaagccaaaggccaaccaagagaaccacaaguauacacucucccacccucccgagacgaacucaccaaaaaucaagucucccuaaccugccucguuaaaggcuucuaucccucagacaucgccguggaaugggaaucaaacggccaacccgaaaacaacuacaaaacaacaccacccguacucgacuccgacggauccuucuuccucuacucuaaacucaccgucgacaaauccagauggcaacaaggaaacgucuucagcugcuccguaaugcacgaagcccuucacaaccacuacacccaaaaaucccuaucccucucacccgguaaa

SEQ ID NO: 53979 - RNA, 645 nt, Artificial Sequence
  derived and/or modified sequence opt11 from Ipilimumab_LightChain
gaaaucguccucacccaaucccccggcacccuaucccucucccccggcgaacgcgcaacccucuccugccgcgccucccaauccgucggcuccuccuaccuagccugguaccaacaaaaacccggccaagccccccggcuccucaucuacggcgcuuucucccgcgccaccggcauccccgaccgcuucuccggcuccggcuccggcaccgacuucacacuaaccauaucccgccucgaacccgaagacuucgccguauacuacugccaacaauacggcucaucccccuggaccuucggccaaggcaccaaagucgaaaucaaacgcacaguugccgcacccucagucuucaucuucccccccuccgacgaacaacucaaauccggcacagccuccgucgucugccuccuaaacaacuucuacccccgcgaagccaaaguccaauggaaagucgacaacgcccuucaauccggaaacucacaagaaucagucaccgaacaagacuccaaagacuccaccuacucccucuccuccacccuaacccucuccaaagccgacuacgaaaaacacaaaguauacgccugugaagucacccaccaaggacucuccucacccgucacaaaauccuucaaccgaggugaaugc

SEQ ID NO: 53980 - RNA, 186 nt, Artificial Sequence
  derived and/or modified sequence opt11 from Iratumumab_HeavyChain1
caggugcaguugcagcaguggggggcgggguuguugaagccgagugagacguugaguuugacgugugcgguguauggggggaguuuuagugcguauuauuggaguuggauaaggcagccgccggggaagggguuggaguggauaggggauuauugggggcaggggaguuuggugacggugaguagu

SEQ ID NO: 53981 - RNA, 321 nt, Artificial Sequence
  derived and/or modified sequence opt11 from Iratumumab_LightChain1
gacauccaaaugacccaaucccccaccucacucuccgccuccgucggcgaccgcgucaccaucaccugccgcgccucccaaggcaucuccuccuggcucaccugguaccaacaaaaacccgaaaaagcccccaaaucccucaucuacgccgccuccucccuccaauccggcguccccucccgcuucucaggcuccggcuccggcaccgacuucacccucaccaucuccucccuccaacccgaagacuucgccaccuacuacugccaacaauacgacuccuaccccaucaccuucggccaaggcacccgccucgaaaucaaa

SEQ ID NO: 53982 - RNA, 1350 nt, Artificial Sequence
  derived and/or modified sequence opt11 from Isatuximab_HeavyChain1
caaguacagcugguccaauccggagccgaagucgcaaaaccaggaacaucagucaaacucucaugcaaagccuccggcuacaccuucaccgacuacuggaugcaaugggugaagcaacgacccggccaaggccucgaauggauaggaacaauauaucccggggacggagauaccggcuacgcacaaaaguuccaaggcaaagccacccucaccgcagacaaaucauccaaaaccgucuacaugcaccucuccucacuagccuccgaagacucagccguauacuacugcgcccgcggcgacuacuacggauccaacucccuagacuauuggggacaaggcaccucagucacaguuucuucagcauccaccaaaggaccgucggucuucccucuagcccccucuucuaaaucaaccucagguggaaccgcagcacucggcugccucgucaaagacuacuuccccgaacccguuacagucuccuggaacagcggagcccucaccagcggcguccacacauuucccgccguacuacaaagcaguggacucuacucccucuccuccgucgucaccgucccauccucaucccucggcacacaaacauacaucugcaacgucaaccacaaaccauccaacacaaaaguagacaagaaaguugaaccaaaauccugcgacaaaacccacacaugcccacccugccccgcccccgaacuacucggcggccccuccgucuuccuauucccacccaagcccaaagacacccucaugauaucccgcacacccgaaguaaccugcgucguggucgacgucagccacgaagaccccgaagucaaauucaacugguacguagacggcguagaaguucacaacgccaaaacaaaaccccgcgaagaacaauacaacuccacauaccgcgucgucagcguccucaccguccuucaccaagacuggcuaaacggcaaagaauacaaauguaaggucucaaacaaagcacuccccgcccccaucgagaaaaccaucucaaaagccaaaggccaaccccgcgaaccccaagucuacacucuacccccaucccgagacgaacucaccaaaaaccaagucucccuaaccugccucgucaaaggguuuuacccauccgacaucgcagucgaaugggaaucaaacggccaaccagaaaacaacuacaaaacaacacccccaguacuagacagcgacggcuccuucuuccuauacucuaaacuaaccgucgacaaaucccgauggcaacagggcaacguauucucaugcuccgucaugcacgaagcacuccacaaccacuacacccaaaaaucacucucccuaagcccaggaaag

SEQ ID NO: 53983 - RNA, 642 nt, Artificial Sequence
  derived and/or modified sequence opt11 from Isatuximab_LightChain1
gacaucgucaugacccaaucccaccucuccauguccaccucccucggcgaccccgucuccauaaccugcaaagccucccaagacgucuccaccguagucgccugguaccaacaaaaacccggacaaucaccccgacgccucaucuacuccgcauccuaccguuacaucggcguccccgaccgauucaccggcucaggcgccggaaccgacuucaccuucaccaucuccucaguccaagccgaagaccuagccgucuacuacugccaacaacacuacucacccccauacaccuucggcggcggcaccaaacucgaaaucaaacgcaccgucgccgcccccuccgucuucaucuucccacccuccgacgaacaacucaaauccggcacagccuccgucgucugccuccucaacaacuucuacccccgcgaagccaaaguccaauggaaagucgacaacgcccuacaauccggcaacucccaagaauccgucaccgaacaagacuccaaagacuccaccuacucccucuccuccacucucacccucuccaaagccgacuacgaaaaacacaaagucuacgcaugcgaagucacccaccaaggacucuccucccccgucaccaaauccuucaaccgcggcgaaugc

SEQ ID NO: 53984 - RNA, 1347 nt, Artificial Sequence
  derived and/or modified sequence opt11 from Itolizumab_HeavyChain1
gaaguccagcucguagaauccggaggaggccuggucaaaccaggcggcucacucaaacuaucaugcgccgcuucaggcuucaaauucucccgauacgccaugucauggguccgucaggcucccggcaaacgacuggaaugggucgcuaccaucagcucuggcggcagcuacaucuacuacccagacuccgucaaaggacgauucaccaucucccgagacaacgucaaaaacacccuauaccuacaaaugucaucccuacguuccgaggacaccgccauguacuacugcgcucgcagagacuacgaccucgacuacuucgacuccuggggacagggcaccuuaguaaccgucucuuccgcuuccaccaagggccccuccgucuucccccucgcacccuccuccaaauccacauccggugguaccgcagcccucggaugccucgucaaagacuacuucccagaaccugucacaguguccuggaacagcggcgcacuaacauccggaguccacaccuuccccgccguacuccaauccuccggccucuacucccucuccuccgucguaacuguacccuccuccucucucggcacccaaacuuacaucugcaacgucaaccacaaaccuuccaacaccaaagucgacaagaaagucgaacccaaaucgugcgacaaaacacacacaugcccacccugccccgccccagaacuccuuggcggccccucagucuuccucuucccacccaaacccaaagacacccucaugaucucccgaacccccgaaguaacaugcgucguugucgacgucucccacgaagacccagaagucaaauucaacugguaugucgacggcguagaaguccacaacgccaaaaccaaaccccgcgaagaacaauauaacuccaccuaccgcgucguauccguccucacaguccuacaccaagacuggcucaauggaaaagaauacaaaugcaaagucuccaacaaagcauuacccgcccccaucgagaaaaccauauccaaagcaaaaggccaaccccgagaaccccaagucuacacacuaccucccuccagagacgagcucaccaaaaaccaagucucccucacaugccucgucaaaggauucuaccccuccgacaucgcaguugaaugggaaucuaauggccaacccgaaaacaauuacaagaccaccccacccguacucgacuccgacggcuccuucuuccucuacuccaaacucacaguagacaagucccgcuggcaacaaggcaaugucuucuccugcuccgucaugcacgaagcucuccacaaccacuacacccaaaaaucccucagccuuucccccggcaaa

SEQ ID NO: 53985 - RNA, 642 nt, Artificial Sequence
  derived and/or modified sequence opt11 from Itolizumab_LightChain1
gacauccaaaugacccaaucccccuccucccucuccgccuccgucggcgaccgaguaaccauuaccugcaaagccucccgagacauccgcucauaccucaccugguaccaacaaaaacccggaaaagcccccaaaacccucaucuacuacgccaccucacucgccgacggaguccccucccgauucuccggcuccggcuccggccaagacuacucacuaaccaucuccucccucgaauccgacgacaccgccaccuacuacugccuccaacacggcgaaucccccuucacacucggcuccggcaccaaacucgaaaucaaacgcaccgucgccgcccccuccgucuucaucuucccacccuccgacgaacaacucaaauccggcaccgccuccgucgucugccuacucaacaacuucuacccccgcgaagccaaaguccaauggaaagucgacaacgcccuccaauccggcaacucacaagaauccgucaccgaacaagacagcaaagacuccaccuacucccucuccuccacccucacccucuccaaagccgacuacgaaaaacauaaagucuacgccugcgaagucacacaccaaggucucuccucccccgucaccaaauccuuuaaccgcggcgaaugc

SEQ ID NO: 53986 - RNA, 1335 nt, Artificial Sequence
  derived and/or modified sequence opt11 from Ixekizumab_HeavyChain1
caaguccagcucguccaauccggagcagaagucaaaaagcccggcuccucagucaaaguauccugcaaagccucaggcuacuccuucaccgacuaccacauucacuggguucgccaagcaccaggccaaggccuagaauggaugggugucaucaaccccauguacggaaccacagacuauaaccagcgauucaaaggcagagucaccaucacagccgacgaaagcaccuccaccgccuacauggaacucuccucgcuccgaucagaagacaccgcagucuacuacugugcccgauacgacuacuucacaggcaccggagucuacuggggccaaggcacccucgucaccgucagcuccgcauccaccaaaggacccucggucuucccccuagcccccugcucccgauccaccuccgaaagcaccgccgcccuuggaugucucgucaaagacuauuucccagaaccagucacaguauccuggaacagcggcgcccuuaccagcggcguccacacuuucccagccguauuacaauccucaggccuauacucccucuccucagucgucacaguccccucauccucacugggaaccaaaaccuacacaugcaacguagaccacaagcccuccaacacaaaaguagacaaacgcguggaauccaaauacggcccacccugcccaccaugccccgcccccgaauuucuuggcggacccuccgucuuccucuucccucccaaacccaaagauacccucaugaucagccgcacacccgaaguuaccugcgucguaguagacgucucccaagaagaccccgaaguccaauucaacugguauguagacggcguggaaguccacaacgccaagacaaaaccccgcgaagaacaguucaacuccaccuaccgagucgucuccguccuaaccguacuacaccaagacuggcuaaacggaaaagaauacaaaugcaaaguauccaacaaaggccucccaucauccaucgaaaagaccauaucgaaagccaaaggccaaccccgagaaccccaagucuauacccuaccaccaucccaagaagaaaugaccaaaaaccaagucucccucaccugucuugucaaaggauucuacccaucagacauagcagucgaaugggaauccaacggccaaccagaaaacaacuacaaaaccaccccacccguacuagacagcgacggcuccuuuuuccuauacucacgacuaaccgucgacaaaagccgcuggcaggaaggaaacgucuucuccugcuccguaaugcacgaagcacuccacaaucacuacacccaaaaaucacuaucgcucucacucgga

SEQ ID NO: 53987 - RNA, 657 nt, Artificial Sequence
  derived and/or modified sequence opt11 from Ixekizumab_LightChain1
gacauagucaugacacaaaccccccucucccucuccguaacccccggacaacccgccuccaucuccugccgcagcucccgcucacucguccacucccgcggcaacaccuaccuccacugguaccuccaaaaacccggacaauccccccaacuccuaaucuacaaagucuccaaccgauucaucggcguccccgaccgcuucucaggcuccggcucaggcaccgacuucacccucaaaaucuccagagucgaagccgaagacgucggcgucuacuacugcucacaaucaacccaccuccccuucaccuucggccaaggcacaaaacucgaaaucaaacgcaccgucgccgcccccagcgucuucauauucccccccuccgacgaacaacucaaauccggcacagccucagucgucugccuccucaacaacuucuacccccgagaagccaaaguccaauggaaagucgacaacgcccuccaauccggcaacucacaagaauccgucaccgaacaagacuccaaagacuccaccuacucccucuccuccacccucacccucuccaaagccgacuacgaaaaacacaaagucuacgccugcgaagucacccaccaaggccucuccucccccgucaccaaauccuucaacagaggagaaugc

SEQ ID NO: 53988 - RNA, 1347 nt, Artificial Sequence
  derived and/or modified sequence opt11 from Labetuzumab_govitecan_HeavyChain1
gaaguccaacucgucgaaucaggaggaggcgucguccaacccggcagaucgcuccgccucuccugcuccgccucaggauucgacuucaccaccuacuggauguccugggugcgacaagcccccggcaagggacuagaauggaucggagaaauacaccccgacuccuccaccauaaacuacgcccccucccuaaaagaccgauucaccaucucccgcgauaacgccaaaaacacauuauuccuccaaauggacucccuccgccccgaagacaccggcgucuacuuuugcgccucccucuauuucggcuuccccugguucgccuauuggggucaaggcaccccagugaccgucucuuccgccuccacuaaaggccccuccgucuucccccuagcccccucguccaaaucaaccuccggcggcacggccgcacuaggaugccuagucaaagacuacuucccagaaccaguuacagucuccuggaacucaggcgcccuuaccuccggaguacacaccuucccagccguacuucaaucguccggccucuacucccucucauccguaguaacaguccccucuuccucccucggcacccaaaccuacauaugcaacgucaaccacaaacccagcaacacaaagguagacaaacgcgucgaaccaaaaucuugcgacaaaacccacacaugcccgccgugcccagcgccagaacuccucggcggcccauccgucuuccucuucccacccaaacccaaagacacccucaugaucagccgcacccccgaaguuaccugcgucgucgucgacgucucccacgaagaccccgaagucaaauucaauugguacgucgacggggucgaaguccacaacgccaaaaccaaaccccgcgaagaacaauacaauucaaccuaucgcgucgucuccguccucaccguucuccaccaagauuggcuaaacggcaaagaguacaaaugcaaaguaagcaacaaagcccuccccgcuccuaucgagaaaacuaucuccaaagcaaaaggucaaccccgcgaaccccaagucuacacccucccacccucccgagaagaaaugaccaaaaaccaagucucccuaaccugccucguaaagggcuucuaccccucagacaucgccgucgaaugggaaucuaacggacaacccgaaaacaacuacaaaaccacaccacccguccucgacucagacggguccuucuucuuauacucaaaacucaccgucgacaaauccagauggcaacaaggaaacgucuucuccugcuccgucaugcacgaagcccugcacaaccacuacacacaaaaaucccucagccuuucacccggaaaa

SEQ ID NO: 53989 - RNA, 639 nt, Artificial Sequence
  derived and/or modified sequence opt11 from Labetuzumab_govitecan_LightChain1
gacauccaacucacccaauccccauccucccuauccgccuccgucggcgaccgcgucacaauaaccugcaaagccagccaagacgucggaaccucagucgccugguaccaacaaaaaccaggcaaagcccccaaacuccucaucuacuggaccuccacccgccacacaggcguacccucacgcuucuccggcuccggauccggcaccgacuucacauucaccaucuccucccuacaacccgaagacaucgccacauacuacugccaacaauacucccucuaccgcuccuucggccaaggaaccaaagucgaaaucaaacgaaccgucgccgcccccuccgucuucaucuucccacccuccgacgaacaacuaaaauccggcaccgccuccgucguaugccuccucaacaacuucuacccccgcgaagccaaaguccaauggaaagucgacaacgcccuccaauccggcaacucacaagaauccgucaccgaacaagacuccaaagacuccaccuacucccucuccuccacccuaacccucuccaaagcagacuacgaaaaacacaaaguauacgccugcgaagucacccaccaaggccucagcucccccguaaccaaauccuucaaccgcggcgagugc

SEQ ID NO: 53990 - RNA, 1341 nt, Artificial Sequence
  derived and/or modified sequence opt11 from Lambrolizumab_HeavyChain1
caaguccaacucguacaauccggcgucgaagucaagaaacccggcgccucagucaaaguuucaugcaaagccuccggcuauaccuucaccaacuacuacauguacuggguccgacaagcccccggccaaggccucgaauggaugggaggcaucaaccccuccaacggcggaaccaacuucaacgaaaaauucaaaaacagagucacacucaccacugacagcuccaccaccaccgccuauauggaacuaaaaucccuccaauucgacgacaccgccgucuacuacugcgcccgccgcgacuaccgcuucgacaugggcuucgacuacuggggccagggaaccaccguaaccgucuccuccgccuccacaaaaggcccauccguauucccccuagcucccugcucaagaucaacauccgaauccaccgcagcccuuggcugccucgucaaagacuacuucccagaaccugucacagucagcuggaacucaggcgcccucacauccggaguccacaccuuuccagccguacuccaaucuuccggccucuacucacucagcucugucgucacggucccaucauccucccucggcacaaaaacguauaccugcaacguagaccacaaacccagcaacacuaaagucgacaaacgcgucgaaucaaaauacggcccaccaugcccacccugccccgcaccugaguuccuaggaggccccagcgucuuccucuucccaccaaaaccuaaggacacccucaugaucucacggaccccagaaguaaccugcgucgucgucgaugucucccaagaagacccagaaguccaauuuaacugguacgucgacggcgucgaaguacacaacgccaaaaccaagccccgagaagaacaauucaacuccacauaccgcgucgucucaguacucaccguccuacaccaagacuggcuaaacggaaaagaauacaaaugcaaagucuccaacaaaggccucccuuccuccaucgagaaaacaauuagcaaagcaaagggccaaccccgagaaccccaagucuacacacuaccacccagucaagaagaaaugaccaaaaaccaaguuucccucacgugccuagucaaaggcuucuaccccagcgacaucgcgguugaaugggaauccaacggacaaccagaaaacaacuacaagacaacacccccaguccucgacucagacggcucuuucuuccuauacucgcgccucaccgucgacaaaucacgauggcaagaaggcaacguauucuccugcagcgucaugcacgaggcccuccacaaccacuacacccaaaaaucccucagccuaagccuaggaaaa

SEQ ID NO: 53991 - RNA, 654 nt, Artificial Sequence
  derived and/or modified sequence opt11 from Lambrolizumab_LightChain1
gaaaucguacucacccaaagccccgccacccucagccucagcccaggcgaacgcgccacccucagcugccgcgcauccaaaggcguguccacauccggauacuccuaccuacacugguaccaacaaaaacccgggcaagcaccccggcuccucaucuaccuagccagcuaccucgaauccggagucccagccagauucuccggcuccggcuccggcacagacuucacccuaaccauaagcucacucgaacccgaagacuucgccguauacuacugccaacacucccgcgaccucccccucaccuucggaggcggcaccaaagucgaaaucaaacgcacaguagccgcccccuccguauucauauucccacccucggacgaacaacucaaaucaggcacagcaucagucgucugccugcucaacaacuucuacccacgcgaagccaaaguccaauggaaagucgacaacgcacuccaaagcgggaacucacaagaaagcgugaccgaacaagacuccaaagacucaaccuacagccucagcucaacccuaacccuguccaaagccgacuacgaaaaacacaaaguauacgccugcgaagucacacaccaaggccucagcucacccguaacaaaaucauucaacagaggcgaaugc

SEQ ID NO: 53992 - RNA, 669 nt, Artificial Sequence
  derived and/or modified sequence opt11 from Lampalizumab_HeavyChain1
gaaguccaacucguacaauccggccccgaacucaaaaaacccggcgccuccgucaaagucuccugcaaagccuccggcuacaccuucaccaacuacggcaugaacuggguccgccaagccccaggccaaggccuagaauggaugggcuggaucaacaccuacaccggcgaaaccaccuacgccgacgacuucaaaggccgcuuugucuucucccucgacaccucagucucaaccgccuaccuccaaaucuccucccucaaagccgaagacaccgccgucuacuacugcgaaagagaaggcggcgucaacaacuggggacaaggaacccuagucaccgucucauccgccuccaccaaaggcccauccgucuucccccucgcacccuccuccaaauccacauccggcggaaccgccgcccucggcugccucgucaaagacuacuucccagaaccagucaccguauccuggaacucuggcgcccuaaccuccggaguacauaccuuccccgccguacuccaauccuccggcuuauacucccuauccuccguagucacaguccccuccuccucccucggcacccaaaccuacaucugcaacgucaaccacaaacccuccaacaccaaagucgacaaaaaaguagaacccaaauccugcgacaaaacccacacc

SEQ ID NO: 53993 - RNA, 642 nt, Artificial Sequence
  derived and/or modified sequence opt11 from Lampalizumab_LightChain1
gacauccaaguaacacaaucacccuccucccuauccgccuccgucggcgaccgcgucaccauaaccugcaucaccuccaccgacaucgacgacgacaugaacugguaccaacaaaaacccggcaaaguccccaaacuacuaaucucaggcggcaacacccuccgccccggcguccccucacgcuucucaggcuccggcuccggcaccgacuucacacucacaaucuccucccuacaaccagaagacgucgcaaccuacuacugccuccaauccgacucccuccccuacaccuucggccaaggcaccaaagucgaaaucaaacgcaccguagccgcccccuccgucuucaucuucccacccuccgacgaacaacucaaauccggcacagccuccgucgucugccuccuaaacaacuucuacccacgcgaagccaaaguccaauggaaagucgacaacgcacuccaauccggcaacucccaagaaucagucaccgaacaagacuccaaagacuccacauacucccuuuccucaacccucacccucagcaaagccgacuacgaaaaacacaaaguauacgccugcgaagucacccaccaaggccucuccucacccgucaccaaauccuucaaccgaggcgaaugc

SEQ ID NO: 53994 - RNA, 1353 nt, Artificial Sequence
  derived and/or modified sequence opt11 from Lanadelumab_HeavyChain1
gaaguccaacuacucgaaagcgguggcggacucguacaacccggcggaucccuccgccuaagcugcgccgcuagcggcuucaccuucucccacuacaucaugauguggguccgacaagcccccgguaaaggacucgaauggguaagcggcauauacuccucaggcgguaucaccgucuacgccgacuccgucaaaggacgcuuuaccaucucccgcgacaacagcaaaaacacccucuacuuacaaaugaacucacuccgcgccgaagacaccgcaguauacuauugcgcguaccgacgcaucgggguccccagacgagacgaguucgauaucuggggccaaggcaccaugguaaccgucagcuccgccucaacaaaaggccccucaguauucccccuagcccccuccucaaaaucaaccuccggcggcaccgcagcccucggcugccucgucaaagacuacuuccccgaacccgucaccgucagcuggaacuccggcgcccucacauccggcguccacaccuuccccgccguccuucaauccuccggccucuacucacucucaucaguugucaccguccccagcucaucccucggcacacaaaccuacaucuguaacgucaaccacaaacccuccaacacuaaggucgacaaacgaguagaacccaaaucuugcgacaaaacacacacaugcccacccugccccgcacccgaacuccucggcggccccuccgucuuucuuuucccacccaaacccaaagacacccucaugaucucccgaacccccgaagucacaugcgucguuguagacguuucccacgaagaccccgaaguaaaauucaacugguacguagacggcgucgaaguccacaacgccaaaaccaagccccgcgaagaacaauacaauagcaccuaccgcgucguuuccguccucaccguacuucaccaagacuggcucaacggaaaagaauacaaaugcaaagucucaaacaaagcccuccccgcacccaucgagaaaaccaucucaaaagccaaaggccagccccgcgaaccccaggucuacacacuuccacccucccgcgaagaaaugacuaaaaaucagguuagccuaaccugccucguaaaaggcuucuaccccucagacaucgccguagaaugggaaucaaacggccaacccgaaaacaacuacaaaacuaccccgcccguccucgacagcgaugguuccuucuuucucuacuccaaacucaccguagacaaaucccgcuggcaacaaggcaacguauucagcugcuccguuaugcacgaagcccuccacaaccacuacacccagaaaagccugucccucucccccggc

SEQ ID NO: 53995 - RNA, 639 nt, Artificial Sequence
  derived and/or modified sequence opt11 from Lanadelumab_LightChain1
gacauccaaaugacccaaucacccuccacccucuccgccagcgucggcgaccgcgucaccaucaccugccgcgccucccaauccaucuccuccuggcuagcaugguaccaacaaaaacccggcaaagcccccaaacuacucaucuacaaagccuccacccucgaaucaggcguccccucccgcuucuccggcucaggcuccggcaccgaauucacccucaccaucuccucccuccaacccgacgacuucgcaaccuacuacugccaacaauacaacaccuacuggaccuuuggccaaggcaccaaagucgaaaucaaacgcaccgucgccgcccccuccgucuucauauucccccccucugacgaacaacucaaaucaggcaccgccucagucgucugccuccucaacaacuucuacccccgcgaagccaaaguccaauggaaagucgacaacgcccuccaguccggcaacucacaagaauccgucaccgaacaagacuccaaagacuccacauacucccucuccuccacccucacccuauccaaagccgacuacgaaaaacacaaagucuacgccugcgaagucacccaccaaggccucuccucccccgucaccaaauccuucaaccgcggcgaaugc

SEQ ID NO: 53996 - RNA, 1317 nt, Artificial Sequence
  derived and/or modified sequence opt11 from Landogrozumab_HeavyChain1
gaaguccaacucgucgaaucaggcggaggccucguacaacccggcgguucacuacgccuaucuugcgcagccucaggacucaccuucucccgcuaccccauguccuggguacgccaagcccccggcaaaggccucgucugggucuccgccaucaccuccucaggcggaucaaccuauuacuccgacaccgucaaaggcagauuuacaauaagccgcgacaaugccaaaaacacccuauaccuccaaaugaacagccuucgagcagaagacacagccguauacuacugcgcccgacuccccgacuacuggggccaagguacccucgucacagucucauccgccucuacuaagggccccuccgucuucccccucgccccaugcucaaggagcacaucagaauccaccgccgcccuaggaugccucgucaaagacuacuuccccgaacccgucaccgucuccuggaacucaggagcacucaccucugguguacacacauuccccgccguacuucaaagcucaggccuauacucccuaagcucagucgucaccguccccuccucaucacuaggcaccaagacauauaccugcaacgucgaccacaaacccucaaacacaaaagucgacaaacgcguagaauccaaauacggcccacccugcccacccugccccgcccccgaguuccucggaggccccuccguauuccucuucccacccaaacccaaagacacacuaaugaucucccgcacccccgaagucacaugcguuguagucgacgucucccaagaagaccccgaaguucaauucaacugguacgucgacggcgucgaaguccacaacgccaaaaccaaaccccgggaagaacaauucaacucaacauaccgcgucguaucaguccucacaguccuccaccaagacuggcucaacggcaaagaauacaaaugcaaagucuccaacaaaggacuccccucuuccaucgagaaaaccaucucgaaagccaaaggccaaccccgcgaaccccaaguauacacacucccaccuucgcaagaagaaaugaccaaaaaccaaguaucccucacaugccucgucaaaggcuuuuacccauccgacaucgcagucgaaugggaaucaaacggucagcccgaaaacaacuauaaaaccaccccacccguccuggacuccgacggcucauucuuucucuacucacgacuaaccguagacaaaucccgcuggcaagaagggaacguuuucuccugcuccguaaugcacgaagcccuccauaaccacuacacacaaaaaucccucagccucucccucggc

SEQ ID NO: 53997 - RNA, 645 nt, Artificial Sequence
  derived and/or modified sequence opt11 from Landogrozumab_LightChain1
gaaaucguccucacccaaucccccggcacccucucccucucccccggcgaacgcgccacccucuccugccgagcauccuccuccgucuccuccucuuaccuacacugguaccaacaaaaacccggucaagccccccgccuccucaucuacuccaccuccaaccucguagccggcauccccgaccgcuucucaggcuccggcuccggcaccgacuucacccuaaccaucucccgccucgaacccgaagacuucgccgucuacuacugccaacaccacuccggcuaccacuuuaccuucggcggcggcaccaaagucgaaaucaaacgcaccgucgccgcccccucagucuucaucuucccccccuccgacgaacaacucaaaucuggcaccgcaucagucgucugccuccucaacaacuucuacccccgcgaagccaaaguccaauggaaagucgacaacgcccuccaauccggcaacucccaagaauccgucaccgaacaagacucaaaagacuccaccuacucccucucaucaacccucacccuauccaaagccgacuacgaaaaacacaaaguauacgccugcgaaguaacccaccaaggccucuccucccccgucaccaaauccuucaaccgcggcgaaugc

SEQ ID NO: 53998 - RNA, 1344 nt, Artificial Sequence
  derived and/or modified sequence opt11 from Laprituximab_emtansine_HeavyChain1
caaguccaacucguccaauccggcgcagaagucgccaaacccggcgccuccgucaaacuauccugcaaagcaaguggauacaccuucaccucuuacuggaugcaaugggucaaacaacgccccggccaaggccuagaaugcaucggcacaaucuaccccggcgacggcgacacaacauacacacaaaaauuccaaggaaaagccacacuaaccgccgacaaauccagcuccacggcauacaugcaacucagcagccuucgauccgaggacucagccgucuacuacugcgcccgcuacgacgcccccggcuacgcaauggacuacuggggccaaggaacccucgucaccgucucaucggccagcaccaagggccccuccguguucccccucgcaccauccucuaaaucaacaucaggcggaaccgccgcccuaggaugccucguaaaagacuacuucccagaaccagucaccguauccuggaacucaggagcccucaccucaggcguacacaccuucccagccgucuuacaauccuccggccuauacucccucuccuccgucgucaccguacccuccuccucccucggaacccaaaccuacauaugcaacgucaaucacaaaccguccaacaccaaaguagacaagaaagucgaacccaaaucaugcgacaagacccacaccugucccccaugccccgcacccgagcuccuaggaggaccuuccgucuuccucuucccaccaaagccaaaagacacccucaugauaucacgaaccccggaagucacaugcguaguugucgacguaucccacgaagaccccgaagucaaauucaacugguacgucgacggcguagaaguacacaacgccaaaaccaaaccccgcgaagaacaauacaacagcacauaccgcguagucuccguccucaccguccuccaccaagacuggcuuaacggcaaagaauacaaaugcaaaguguccaacaaagcacuaccagcaccuauagaaaagacaauaucaaaagccaaaggccaaccccgcgaaccccaaguguacacccucccuccaagccgcgacgagcucaccaaaaaccaagucucucuaacaugccuagucaaaggcuucuacccuuccgacaucgccguagaaugggaaucuaacggccaacccgaaaacaacuacaaaaccacuccucccguucucgacuccgacggcuccuucuuccuauacagcaaacuuacaguugacaaaucccgauggcaacaaggcaacguauucuccugcucaguaaugcacgaagcccuccacaaccacuacacacaaaaaucacucucccuaucccccggc

SEQ ID NO: 53999 - RNA, 642 nt, Artificial Sequence
  derived and/or modified sequence opt11 from Laprituximab_emtansine_LightChain1
gacauccagaugacucaaucacccucaucccuauccgccucaguuggcgaccgcgucaccaucacaugccgcgccucacaagacaucaacaacuaccuagccugguaccaacacaaacccggcaaaggccccaaacuccucauccacuacaccuccacacuccaccccggcauccccucccgauucuccggcuccggcucaggccgcgacuacuccuucuccaucuccucccucgaacccgaagacaucgccacauacuacugccugcaauacgacaaccuccuauacaccuucggccaaggaaccaaacucgaaaucaaacgcacagucgcagcccccuccgucuucaucuucccacccuccgacgaacaacuaaaaucaggcacagcauccgucgucugccuccucaacaacuucuacccccgcgaagccaaaguccaauggaaggucgacaacgcccuccaauccggcaacucccaagaaucugucaccgaacaagacuccaaagacuccaccuacucccucuccucaacacucacccucuccaaagccgacuacgaaaaacacaaaguuuacgcaugcgaagucacccaucaaggccuaagcucccccguaaccaaauccuucaacagaggcgaaugc

SEQ ID NO: 54000 - RNA, 1314 nt, Artificial Sequence
  derived and/or modified sequence opt11 from Lealesoab_HeavyChain1
caaguccagcuccaagaaucuggucccgaacucaagaaacccggugaaaccgucaaaaucuccugcaaagcauccggcuacacauuccgcaacuacggcaacugggucaaacaagcaccagggaaaggacucaaauggggcuggaucaacaccuacacaggcgaacccaccuacgccgacgacuucaaaggacgcuucgccuucucccucgaaacauccgccuccacggcauaccuacaaaucaacaacgucaaaaacgaagacaccgccaccuacuucugcgcccgaaagggcugggacuucaacggcuccucccuagacuauuggggacaaggcacuaccgucacuguauccucagccaaaacaacacccccguccgucuacccccuugccccaggaucagccgcccagaccaacuccgucacccucggcugccuagucaaaggcuacuuccccgaaccaguaaccguaacuuggaacucuggcucgcucuccucaggcguccacaccuucccagccguccuccaauccgaccucuacacgcucucuucaucagucaccguaccauccucuccccgccccucagaaaccguuaccugcaacgucgcacaccccgccuccuccaccaaagucgacaagaaaaucgucccucgagacugcggcugcaaacccugcauaugcaccgucccagaagucucauccgucuucaucuucccacccaaacccaaagacguccuaacaauaacacuaacgccuaaaguuaccugcgucgucgucgacaucucaaaagacgaucccgaaguacaguucuccugguucgucgacgacguugaaguucacaccgcccaaacccaaccccgcgaagaacaauucaacuccaccuuccgcucagucuccgaacuucccauccaccaagacuggcucaacggcaaagaguucaaaugccgcgucaacuccgcagccuucccugcucccauagagaaaaccaucucaaaaacaaaaggccgacccaaagcuccccaagucuacaccaucccaccucccaaagaacaggccaaagacaaaguaucacuaaccugcaucaccgacuucuuccccgaagacauaaccgucgaauggcaauggaacggacaacccgcagaaaacuacaaaaacacccaacccaucaacaccaacggcagcuacuucguauacuccaaacucaacguccaaaaauccaacugggaagccggaaacaccuuuaccugcucuguccuccacgaaggacugcacaaccaccacaccgaaaaaucccucagccacucccccggcaaa

SEQ ID NO: 54001 - RNA, 654 nt, Artificial Sequence
  derived and/or modified sequence opt11 from Lealesoab_LightChain1
gacauccaacucacccaaaccccccuaucccuccccgucucacucggcgaccaagcauccaucuccugccgauccucccaaucaaucguccacuccaacggcaacaccuaccucgaaugguaccuccaaaaacccggccaaucccccaaccuccucaucuacaaagucuccaaccgauucuccggcguccccgaccgauucuccggauccggcuccggcaccgacuucacccucaaaaucucccgcgucgaagccgaagaccucggagucuacuacugcuuccaaggcucucacgucccccccaccuucggcggcggcaccaaacucgaaaucaaacgcgcagacgccgcccccacggucuccaucuuccccccaucauccgaacaacucaccuccggcggcgccuccgucgucugcuuccucaacaacuucuaccccaaagacauaaacgucaaauggaaaaucgacggcuccgaacgccaaaacggcguacuaaauuccuggaccgaccaagauucaaaagacuccaccuacucaagcucaacacucacccucaccaaagacgaauacgaacgccacaacuccuacaccugcgaagccacccacaaaaccuccaccucccccauagucaaauccuucaaccgcaacgaaugc

SEQ ID NO: 54002 - RNA, 1335 nt, Artificial Sequence
  derived and/or modified sequence opt11 from Lebrikizumab_HeavyChain1
caagucacccuccgugaaagcggucccgcacucgucaaaccaacccaaacucuaacccucacaugcaccgucagcggauucucgcucucugccuacuccguaaacuggauccgacaaccacccggcaaagcucucgaauggcuggcaaugaucuggggcgacggcaaaaucgucuacaacagcgcccuaaagagcagacucaccaucuccaaagacaccuccaaaaaccaaguaguccuaaccaugaccaacauggaccccgucgacaccgccaccuacuacugcgcaggcgacggauacuaccccuacgcgauggacaacuggggccaaggcucucucgucacagugagcuccgccucaaccaaaggccccagcguauucccccucgcccccugcucccgauccaccagcgaaagcacagccgcccucggcugccuagucaaagacuacuuccccgaacccguaacagucuccuggaacuccggagcccucacauccggcguccacacuuuccccgcaguccuccaauccucaggccucuacucacuaucauccgucgucaccgucccauccuccucccucggcaccaaaacauauaccugcaacguugaccacaagccuuccaacaccaaaguagacaaacgaguagaaucaaaauacggcccgcccuguccgcccugucccgcccccgaguuccucggcggccccuccgucuuccuuuucccucccaaacccaaagacacucucaugaucucaagaacccccgaagucacaugcgucguggucgacgucucccaagaagaccccgaaguccaauucaacugguacgucgacggcgucgaaguacacaacgccaaaacuaaaccccgagaagaacaauucaacucgaccuaccgagucgucucuguccucaccguccuccaccaagacuggcugaacggcaaagaauacaaaugcaaagucuccaacaaaggccugcccucaagcaucgaaaagaccaucagcaaagccaaaggccagcccagagaaccccagguauacacacucccacccucccaagaagaaaugaccaaaaaccaagucucacuaaccugccucgucaaaggcuucuaccccagcgauaucgcaguagaaugggaauccaacggccaacccgaaaacaacuacaaaaccacaccacccguccuagauuccgacggcagcuucuuccuuuacucacgccucacaguugacaaaagcagauggcaggaaggcaacgucuucucaugcuccgucaugcacgaagcccuacacaaccacuacacccaaaaaucacuuucacucucccucggcaaa

SEQ ID NO: 54003 - RNA, 654 nt, Artificial Sequence
  derived and/or modified sequence opt11 from Lebrikizumab_LightChain1
gauaucgugaugacgcaaucgcccgacagccugagcgugagccugggcgaacgcgcgaccauaaacugucgcgcgagcaagagcguagacucguacgggaacucauucaugcacugguaccagcaaaagcccgggcaaccgcccaagcuauugaucuaucucgcgagcaaucucgagagcggggucccggaccgauucucgggcucaggcucgggcacggacuuuaccuugaccauaagcucgcuccaggccgaggacguggccguguacuauugccagcaaaauaacgaggacccgcgcacguucgggggagggaccaaggucgagaucaagcgcacggucgcggccccgagcguguucauauucccacccucggacgagcaauugaaaucgggcacagccucggucgugugcuugcucaacaacuuuuacccgcgcgaggccaagguccaguggaaggucgauaacgcacuccagagcgggaacucacaagagagcgugaccgagcaagauagcaaggacucaaccuauagcuugagcucgacccugaccuugagcaaggccgauuacgagaaacauaaaguauacgcaugcgaggucacgcaccagggcuuaagcucgcccgugaccaagagcuuuaacaggggcgagugc

SEQ ID NO: 54004 - RNA, 1227 nt, Artificial Sequence
  derived and/or modified sequence opt11 from Lenercept_chain1
cucgucccccaccucggcgaccgcgaaaaacgcgacagcguaugcccccaaggcaaauacauccacccacaaaacaacucaauaugcugcacaaaaugccacaaagggacauaccucuacaacgacugccccggacccggccaggacaccgacugccgagaaugcgaauccggcuccuucaccgccucagaaaaccaccuacgacacugccucagcugcuccaaaugccgcaaagaaaugggccaagucgaaaucuccuccugcaccguugaccgagacacagucugcgggugccgcaaaaaccaguaccgacacuacugguccgagaaccucuuccaaugcuucaacugcucccuaugccucaacggaaccguccaccucucaugccaagaaaaacaaaacaccgucuguaccugccacgcaggcuucuuccuccgcgaaaacgaaugcguauccugcuccaacugcaagaaaucacucgaaugcaccaaacucugccucccacaaaucgaaaacgucaaaggaaccgaagacuccggcaccaccgacaaaacccacaccugucccccuugccccgcccccgaacuccucggcggacccuccgucuuccuauuuccacccaaaccuaaagauacccucaugaucucccgcacccccgaggucacaugcgucgucgucgacguaucccacgaggaccccgaagucaaauucaacugguacgucgacggcguugaaguccacaacgccaaaaccaaaccacgcgaagaacaauacaacucaacuuaccgaguagucucuguccucaccguccuccaccaagacuggcucaacggcaaagaauacaaaugcaaagucuccaacaaagcccucccagccccaauagagaaaacaaucuccaaagccaaaggccaaccucgagagccgcaggucuacacccuacccccaucccgcgaagaaaugacuaaaaaccaagucucccuaaccugccucguaaaaggauucuacccaucagacaucgccguagaaugggaaucaaacggccaacccgaaaacaacuauaaaacaacaccacccguacucgacuccgacggcucuuucuuccucuacagcaaacucaccgucgacaaaucccgcuggcaacaaggcaacguguucagcugcuccgucaugcacgaggcacuccacaaccauuacacccaaaaaucccucucacuuucccccggcaaa

SEQ ID NO: 54005 - RNA, 1347 nt, Artificial Sequence
  derived and/or modified sequence opt11 from Lenzilumab_HeavyChain1
caaguacaacucguccaauccggcgcagaaguaaagaaacccggcgcauccguaaaaguaagcugcaaagccuccggcuacuccuucacaaacuacuacauccacuggguccgacaagcccccggccaacgccuugaauggaugggauggauuaacgccggcaacggaaacaccaaauacucacaaaaauuccaaggacgaguuaccauaacccgugacaccucagcauccacugccuacauggagcucuccucacuacguuccgaagacaccgcugucuacuacugcguacgucgccaacgcuucccauacuacuucgacuacuggggccaaggcacacucgucaccgucuccuccgccucaaccaaaggccccucagucuucccccuagcacccuccuccaaaucaaccucaggcgguacagcagcccuagguugccucguaaaagacuauuucccagaacccguaaccguauccuggaacucaggcgcacucaccucuggaguucacaccuuccccgcuguccuccaauccagcggccucuacucacugucauccgucgucaccguaccuuccuccucccucggaacccaaaccuacauaugcaacguaaaccacaaacccucaaacaccaaagucgacaaacgagucgaaccaaaauccugugacaaaacacauaccugcccucccugccccgccccagaacuccucgguggacccuccguauuccucuucccacccaagcccaaggacacauuaaugaucucccgaacacccgagguaaccugcgucgucgucgacgucucccaugaagacccugaaguaaaauucaacugguacgucgacggcgucgaaguacacaacgcuaaaaccaaaccccgcgaggaacaauacaacuccaccuaccgcguagucuccguccucaccguccuccaccaggacuggcuaaacggcaaagaauauaaaugcaaagucuccaacaaagcccuaccugcccccaucgagaaaaccaucuccaaagccaaaggacagccccgugaaccccaagucuacacccucccacccucccgcgaagaaaugaccaaaaaccaaguuucccucacaugccucguaaaaggcuucuaucccuccgacauagccguagaaugggaauccaacggccagcccgaaaacaacuacaaaaccacaccacccguccuugacucagacggcuccuucuuccuguacucaaagcugaccgucgacaaguccagauggcaacaaggaaacgucuucuccugcucugucaugcacgaagcacugcacaaccacuacacccaaaaaucccucucacucucgcccggaaaa

SEQ ID NO: 54006 - RNA, 642 nt, Artificial Sequence
  derived and/or modified sequence opt11 from Lenzilumab_LightChain1
gaaaucguacucacgcaaucacccgcgacccuaagcguaagcccaggagaacgcgcaacccuaagcugccgcgcaagccaguccguaggaacaaacguagcaugguaccaacaaaaacccggacaagcacccaggguccuaaucuacuccacaagcucacgcgcaaccggaaucacggacagguucucaggcucgggcucaggcacagacuucacccugaccauaagcagacucgaacccgaagacuucgccguguacuacugccaacaauucaacaaaagcccacucacauucggaggcggaaccaaggucgaaaucaaacgaacggucgcagccccaagcguguucauauucccacccucagacgaacaacucaaaucaggcacggccucagucgugugccuacucaacaacuuuuacccccgcgaagccaaaguccaguggaaagucgacaacgcacuccaaagcggaaacucacaagaaagcguaaccgaacaagacagcaaggacucgaccuacagccuaagcucaacccuaacccugagcaaagccgacuacgaaaaacacaaaguauacgcaugcgaagucacacaccaaggccuaagcucacccguaaccaagagcuucaaccgcggcgaaugc

SEQ ID NO: 54007 - RNA, 1326 nt, Artificial Sequence
  derived and/or modified sequence opt11 from Lerdelimumab_HeavyChain1
gagguacaacuuguggaauccggcggcggcgucguccaaccaggccgcucacucagacuaucaugcgcggcgagcggauucacauucagcagcuacggaaugcacuggguccgccaagcaccgggcaaaggacuagaauggguagccgucauaugguacgacggcucaaacaaauacuacgcagacuccguaaagggccgauucacuaucucacgagacaacuccaaaaacacacucuaccuccaaauggacucacuccgagcagaggacaccgccguuuacuacugcggccgcacacucgaaagcucacuauggggccaaggcacccugguaaccguauccucagccuccaccaaaggccccucagucuucccccuagcgcccugcucacgaucaaccucagaaucaaccgccgcucuagggugccucgucaaggauuacuucccagagcccguaacaguaucauggaacuccggcgcccucaccucaggcguucacacuuuccccgccguccuacaaucauccggacucuacagucuuucauccgucgucaccgucccaucaucaucccucggaaccaaaaccuauaccugcaacguagaccacaaacccuccaacacaaaagucgacaaacgagucgaauccaaauacggcccaccuugcccuuccugcccagccccggaguuccuaggcggcccauccgucuuccucuucccacccaagcccaaagacacacucaugaucucccguaccccagaaguaaccugcgucgucgucgacgucucucaagaagaccccgaaguccaauucaacugguacgucgacggcguagaagugcacaacgccaaaaccaaaccccgcgaagaacaauucaacagcaccuacagaguaguaucaguccuaaccguacuccaccaagacuggcucaacggcaaagaauacaaaugcaagguauccaacaaaggccuaccaucaucaaucgagaaaaccaucaguaaagccaaaggccaaccccgcgaaccccaagucuacacgcucccacccucccaagaagaaaugaccaaaaaccaagucucacuaaccugccuagucaagggcuucuaccccucagacauagccgucgaaugggaaagcaacggccaacccgaaaacaacuacaaaaccacacccccaguccuagacucagacggaucuuucuuccucuacucacgccucaccgucgacaaaucccgcuggcaagaaggaaacgucuucuccugcuccguaaugcacgaagcccuccacaaccacuacacccagaaaagccucucucucucccucggcaaa

SEQ ID NO: 54008 - RNA, 645 nt, Artificial Sequence
  derived and/or modified sequence opt11 from Lerdelimumab_LightChain1
uccuccgaacuuacccaagaccccgccgucuccgucgcacucggccaaaccguccgcaucaccugccaaggcgacucccuacgauccuacuacgcaucaugguaccaacaaaaacccggccaagcaccaguccucgucaucuacggcaaaaacaaccgccccuccggcauccccgaccgcuucuccggauccuccuccggcaacacagccucccuaaccaucacaggagcccaagccgaagacgaagcagacuacuacugcaacucccgcgacuccucauccacacaccgcggagucuucggcggcggcaccaaacucaccguacucggacaaccaaaagccgcccccucaguaacccucuucccccccuccuccgaagaacuccaagccaacaaagcaacccuugucugccucauauccgacuucuaccccggcgccgucaccguagccuggaaagccgacuccucccccgucaaagccggcgucgaaaccaccacacccuccaaacaauccaacaacaaauacgccgcauccuccuaccucucacucacucccgaacaauggaaaucccaccgcuccuacuccugccaaguaacccacgaaggcuccacagucgaaaaaaccgucgccccaaccgaaugcucc

SEQ ID NO: 54009 - RNA, 1353 nt, Artificial Sequence
  derived and/or modified sequence opt11 from Lexatumumab_HeavyChain1
gaaguucaacucguccaaucaggcggcggagucgaacgccccggggguucacuucgccuaagcugcgcagccuccggauucaccuucgacgacuacggaaugagcuggguccgccaagcaccaggaaaagggcucgaguggguguccggaaucaacuggaacggcggcaguacaggauacgccgacuccgucaaaggcagagucaccauaucccgagacaacgccaaaaacucacucuaccuccaaaugaacucacuccgagcagaagacaccgcagucuacuacugcgcuaaaauacuuggagccggccgaggcugguacuucgaccuguggggcaaaggaaccacagucacagucuccuccgccaguaccaaaggccccucagucuucccccucgcccccagcucgaaaucaaccucaggcggaacagcagcccuaggcugccuaguaaaagacuacuuucccgaacccguaaccguauccuggaacuccggcgcccugacaagcggaguccacaccuucccugccguucugcaauccuccggacucuacucccucagcuccgucgugaccguucccucuucaucacuuggcacacaaaccuacaucugcaacgucaaccacaaacccagcaacaccaaagucgacaagcgggucgaacccaaaucaugugauaaaacucacacuugcccacccugccccgccccggaacuccuugguggaccaucagucuuccuauucccucccaaacccaaagacacauuaaugaucucccgcacacccgagguaaccugcgucgucgucgacgucagccacgaagaccccgaggucaaauucaacugguacguggacggcgucgaaguccacaacgccaaaaccaaaccccgcgaagaacaauacaacuccaccuaccgcgucgucuccguccuaaccguccuacaccaagacuggcuaaacggcaaagaauacaaaugcaaagucuccaacaaagcucuaccagcaccaaucgagaaaaccauuuccaaagcaaaaggccaaccccgcgaaccacaaguauacacacucccacccucucgcgaagaaaugaccaaaaaccaaguaucccuuacaugccucgucaaaggcuucuaccccagcgacauagcagucgaaugggaaagcaacggacaacccgaaaacaacuacaaaaccacaccacccguccucgacuccgacggcuccuucuuccucuacuccaaacucaccgucgacaagucccguuggcaacaagguaacguguucuccugcucagucaugcacgaagcccuucacaaccacuacacccagaaaucacucucucucucccccgguaaa

SEQ ID NO: 54010 - RNA, 1353 nt, Artificial Sequence
  derived and/or modified sequence opt11 from Lexatumumab_HeavyChain
gaaguccaacucguccaauccggaggaggcgucgaacgccccggaggcucccuacgccucuccugcgcagccuccggauucaccuucgacgacuacggaauguccuggguccgccaagcccccggcaaaggacuagaauggguauccggaaucaacuggaacggaggcuccaccggcuacgccgacuccgucaaaggccgaguaaccauaucacgcgacaacgccaaaaacucgcucuaccuccaaaugaauagccuccgcgcagaagacacagccgucuacuacugcgcaaagauccugggcgccggucgaggcugguacuucgaccucuggggcaagggcaccaccgucacagucuccuccgccuccaccaaaggacccuccgucuucccccuagcacccuccucaaaauccaccucgggaggcaccgcagcccucggaugccuggucaaagacuacuuccccgaacccgucacaguauccuggaacuccggcgcccugaccagcggcguccacaccuuccccgcaguucuccaaucaucaggauuauauucacucagcuccguggucaccguccccucauccucacuaggaacccaaaccuacaucugcaacgucaaccacaagcccuccaacaccaaagucgacaaacgcgucgaacccaaaagcugcgacaaaacccauaccugcccaccgugccccgcccccgaacuacuaggcggcccaucagucuuccuauuucccccaaaacccaaagacacucucaugauaucacgcacucccgaaguaaccugcgucguaguagacgucucccacgaagaccccgaagucaaauucaacugguacgucgacggcgucgaaguccacaacgccaagaccaaaccccgcgaagaacaguacaauucaaccuaccgagucgucuccguauuaaccguacuucaccaagacuggcuaaacggcaaagaauacaaaugcaaagucucaaacaaggcacuccccgcaccaaucgagaaaaccauauccaaagccaaaggacaaccacgagaaccccaaguauauacccuaccucccucgcgagaagaaaugaccaagaaccaagucucccucacaugccucgucaaaggauucuacccauccgauaucgccguugaaugggaaucaaacggccaaccagaaaacaacuacaaaaccacaccgcccguccuagacuccgacggauccuucuuccuauacuccaaacucaccgucgacaaguccagauggcaacaaggcaacgucuucuccugcagcguaaugcacgaagcacuccacaaccacuacacucaaaaaucccuaucccuuucacccggcaaa

SEQ ID NO: 54011 - RNA, 642 nt, Artificial Sequence
  derived and/or modified sequence opt11 from Lexatumumab_LightChain1
ucauccgaacucacccaagaccccgccgucuccgucgcccucggccaaaccguccguaucaccugccaaggcgacucacuccgcuccuacuacgcuuccugguaccaacaaaaacccggccaagcccccguccucgucaucuacggcaaaaacaaccgccccucuggcauccccgaccgauucuccggcuccucauccggcaacaccgccucacuaacuaucaccggcgcccaagccgaagacgaagccgacuacuacugcaacucccgcgacuccuccggcaaccacgucgucuucggcggcggcaccaaacuaacaguacucggccaacccaaagccgcccccucagucacacucuucccccccuccuccgaagaacuccaagccaacaaagccacccucgucugccuaaucuccgacuucuaccccggcgccguaaccgucgccuggaaagccgacucaucacccgucaaagccggcgucgaaaccaccacccccuccaaacaauccaacaacaaauacgcagccuccuccuaccucucacucaccccagaacaauggaaaucccaccgcuccuacuccugccaagucacacacgaaggcuccaccgucgaaaaaaccgucgcccccaccgaaugcucc

SEQ ID NO: 54012 - RNA, 642 nt, Artificial Sequence
  derived and/or modified sequence opt11 from Lexatumumab_LightChain
ucaucagaacuaacccaagaccccgccgucuccgucgcccucggacaaaccguccgcaucaccugccaaggcgacucccuccgcuccuacuacgccuccugguaccaacaaaaacccggccaagcccccguccuugucaucuacggcaaaaacaaccgccccuccggcauccccgaccgcuucagcggcucauccuccggcaacaccgccucacucacaaucaccggcgcccaagccgaagacgaagcagacuacuacugcaacucccgagacuccuccggcaaccacgucguauucggcggcggcaccaaacucaccguccucggacaaccaaaagccgccccauccgucacccucuucccucccuccuccgaagaacuccaagccaacaaagccacccuaguaugccucaucucagacuucuaccccggcgccgucacagucgccuggaaagcagacuccucccccguaaaagcaggcguagaaaccaccacccccuccaaacaauccaacaacaaauacgccgccucaagcuaccucucccucacccccgaacaauggaaaucacaccgcucauacuccugccaagucacacacgaaggcuccacaguagaaaaaaccgucgcccccaccgaaugcuca

SEQ ID NO: 54013 - RNA, 1377 nt, Artificial Sequence
  derived and/or modified sequence opt11 from Libivirumab_HeavyChain1
caaguccaacucguagaauccggcggcggcguaguccgccccggccgaucccuccgccucucuugcgccgcaucaggcuucgccuucuccgacuacuccaucaacuggguccgucaagcacccggaaaaggucuagaauggguagccaucaucuccuacgacggccgcaucaccuacuaccgagauucugucaaaggccgauucaccauaagccgcgacgacuccaagaacacacuauaccuacaaaugaacagccugcgcacagaagacacugccguauauuacugcgcccgccaauacuacgacuucugguccggcuccuccgucggccgcaacuacgacggcauggacgucuggggccugggaaccaccgucaccguaucaagcgcauccaccaaaggccccuccgucuucccccucgcacccuccuccaaguccacaucaggcggaaccgcugcccucggcugccucguuaaagacuacuuccccgaaccaguaacagucagcuggaacagcggagcucucacauccggcguccacaccuuucccgccguccuccaaucauccggacucuacucacuauccuccguagucacaguccccuccagcucccucggcacacaaaccuauaucugcaacgucaaccauaaacccuccaacaccaaagucgacaaacgaguagaacccaaaagcugcgacaaaacacauaccugcccacccugccccgcccccgaacuucucggaggacccuccguuuuccuauucccuccaaaaccaaaagacacccucaugaucucaagaaccccagaaguaaccugcgucgucguugacguaagccacgaagaccccgaggucaaauucaacugguacgucgacggcguagaaguacacaacgccaaaaccaaacccagagaagaacaauacaacuccacauaccgaguaguuucaguccucaccguccuccaucaagacuggcucaacggaaaagaauacaaaugcaaggucuccaauaaagcacucccagcacccaucgagaaaaccaucagcaaagccaagggccaacccagagaaccccaaguauacacccucccgccaucacgugaagaaaugaccaaaaaccaagucucccuaaccugccucgucaaaggcuucuaccccucagacaucgccgucgaaugggaaucgaacggccaacccgaaaacaacuacaaaaccacaccacccguccucgacucagacggaucauucuuucucuacucaaaacucaccgucgacaaaucccgcuggcaacaaggaaacgucuucuccugcucaguaaugcacgaagcccuacacaaccacuacacccaaaaaucccucucucuuucacccggcaaa

SEQ ID NO: 54014 - RNA, 657 nt, Artificial Sequence
  derived and/or modified sequence opt11 from Libivirumab_LightChain1
gacaucguaaugacccaaucaccccucucccucuccgucacccccggcgaacccgccuccaucuccugccgcuccucacaaucacuacuacaccgaucaggcaacaacuaccucgacugguaccuccaaaaacccggacacucaccccaacuccucaucuacgucggcuccaaccgcgcauccggcguccccgaccgcuucuccggcuccggauccggcaccgaauacacccucaaaaucucccgcgucgaagccgaagacgucggcgucuacuacugcaugcaagcccuucaaacaccccgcaccuucggccaaggaaccaaacucgaaaucaaacgcaccgucgcggcccccagcguauucauauucccacccuccgacgaacaacucaaaucaggcaccgccuccgucgucugccuccucaacaacuucuacccccgagaagccaaaguccaauggaaagucgacaacgcccuccaauccggcaacucccaagaauccgucaccgaacaagacuccaaagacucaaccuacucucucuccuccacccucacccuaucaaaagccgacuaugaaaaacacaaagucuacgccugcgaagucacccaccaaggccuauccucccccgucaccaaauccuucaaccgcggcgaaugc

SEQ ID NO: 54015 - RNA, 1350 nt, Artificial Sequence
  derived and/or modified sequence opt11 from Lifastuzumab_HeavyChain
gaaguacaacucgucgaaucaggcggcggccuaguacaaccaggcggaucacuucgacuaucaugcgccgccuccggcuucuccuucagcgacuucgcgaugagcuggguccgacaagccccaggaaaaggccuagaaugggucgccaccaucggccgcgucgccuuccacaccuacuaccccgacucaaugaagggccgauucaccaucucacgcgacaacuccaaaaacacccucuaccuccaaaugaacucccucagagcagaagacaccgcaguauacuacugcgcccgccaccgcggauucgacgucggccacuucgacuucuggggacaaggcacccucguuaccgucucaucagccucaaccaaaggccccuccgucuucccccucgcacccagcagcaaaagcaccagcggcggaaccgccgcacucggcugccucguaaaagacuacuuccccgaaccaguaacaguauccuggaacucaggcgcccucacaagcggcguccacaccuucccagcuguccuacaauccucgggccuguacucacucagcagcgucgucacuguccccuccuccucccugggcacccaaacauacaucugcaacgugaaccacaaaccaucaaacacaaaaguagauaagaaaguagaacccaaauccugcgauaaaacacacaccuguccacccugccccgcccccgaacuacuaggcggccccuccgucuuccucuucccacccaaacccaaagacacauuaaugaucucgcgcacccccgaaguaaccugcgucgucgucgacgucucccaugaagaccccgaagucaaauucaacugguacgucgacggcguugagguacacaacgccaaaaccaaaccccgcgaagaacaauacaacuccacauaccgagucgucuccguccucacaguacuacaccaagacuggcucaacggcaaagaauacaaaugcaaaguauccaacaaagcacuacccgcacccauagagaaaacaaucucgaaggccaaaggccaaccccgagaaccacaagucuacacccuacccccuucacgugaagaaaugaccaaaaaccaagucucccuaaccugccucgucaaaggcuucuaccccucggacaucgccgucgaaugggaaucaaacggccaacccgaaaauaauuacaaaacaacacccccaguacucgacucugacggauccuucuuccucuauuccaagcuaaccguagacaaaucccguuggcaacaaggaaacgucuucuccugcagcgucaugcacgaagcccuacacaaccacuacacccaaaaaucacuaucccucagccccggaaag

SEQ ID NO: 54016 - RNA, 657 nt, Artificial Sequence
  derived and/or modified sequence opt11 from Lifastuzumab_LightChain
gacauccaaaugacccaaucacccuccucacucucagccuccguaggcgaccgcgucaccauuaccugccgcuccuccgaaacccucguccacuccuccggcaacaccuaccucgaaugguaccaacaaaaacccggcaaagcccccaaacuccucaucuaccgcgucucaaaccgcuucucaggaguccccucacgcuucuccggcuccggcuccggcacagacuucacccuaacaaucuccucacuccaacccgaagacuucgccaccuacuacugcuuccaaggcuccuucaacccccucacauucggccaaggcacuaaagucgaaaucaaacgcaccgucgccgccccauccgucuucaucuucccacccuccgacgaacaacucaaauccggcacagccuccgucgucugccuccucaacaacuucuacccacgcgaagccaaaguccaauggaaagucgacaacgcccuccaauccggcaacucccaagaauccgucaccgaacaagacuccaaagacucaaccuacucacucuccuccacccucacccucuccaaagccgacuacgaaaaacacaaagucuacgccugcgaagucacccaccaaggccucucaucccccgucaccaaauccuucaacagaggcgaaugc

SEQ ID NO: 54017 - RNA, 1347 nt, Artificial Sequence
  derived and/or modified sequence opt11 from Lifastuzumab_vedotin_HeavyChain1
guacaacucgucgaaucaggcggaggccuuguccaacccggcggcucucuccgccuuucaugcgccgccuccggauucuccuucuccgacuucgccauguccugggugcgacaagcccccgguaaaggacuagaaugggucgccaccauaggcagagucgccuuccacaccuacuaccccgacuccaugaaaggccgauucaccaucucccgcgacaacuccaaaaauacccuauaccuccaaaugaacucccuccgagccgaagacacagcagucuacuacugcgcacgccaccgcggcuucgacguaggccacuucgacuucuggggacaaggcacacucguaaccguaucaagcgcauccaccaaaggcccuuccguauucccccucgcccccuccucaaaaucaaccuccggcggaaccgcagcccucggaugccucgucaaagacuacuucccagaaccagucaccgucuccuggaacuccggcgcacucaccuccggcguccauacuuuccccgccguccuccaaucgucuggccucuacucacucuccuccguagucaccgucccauccuccucccucggcacccaaaccuacaucugcaacgucaaccacaagcccucaaacacaaaagucgacaagaaagucgaacccaaauccugcgacaaaacccauacaugcccacccugccccgccccagaacuccucggcggccccuccgucuuccucuucccacccaaacccaaagacacacucaugaucucacgcacucccgaaguaacuugcgucguagucgacgucucccacgaagaccccgaagugaaauucaacugguacgucgacggagucgaaguccacaacgccaaaaccaaaccacgcgaagaacaauacaacagcacguaucgugucgucuccguccucacaguccuccaccaagacuggcucaacggaaaagaauauaaaugcaaagucuccaacaaagcacuacccgcacccauagagaaaaccauaucuaaagcuaaaggucaaccaagagaaccacaagucuauacccuaccacccucacgcgaagaaaugacuaagaaccaagucagccuaaccugccucguaaaaggauuuuaccccagcgacaucgccguagaaugggaauccaacggccaacccgaaaacaacuacaaaacgacaccucccguccucgacuccgacggauccuucuuucucuacuccaaacucacagucgauaaauccagauggcagcaaggcaacguauucuccuguucagucaugcacgaagcccuccacaaccacuacacacagaaaucccuaucccuaucccccggcaaa

SEQ ID NO: 54018 - RNA, 657 nt, Artificial Sequence
  derived and/or modified sequence opt11 from Lifastuzumab_vedotin_LightChain1
gacauccaaaugacccaaucccccuccucacucuccgccuccgucggcgaccgcgucaccauaaccugccguucuucagaaacacuuguccacuccuccggcaacaccuaccucgaaugguaccaacaaaaacccggcaaagcccccaaacuccucaucuaccgcguaucaaaccgcuucagcggcguccccucccgcuucuccggcucaggcuccggcaccgacuucacccucaccaucuccucacuccaacccgaagacuucgccaccuacuacugcuuccaaggcuccuucaacccccucaccuucggacaaggcaccaaagucgaaaucaaacgcaccgucgccgcacccuccgucuucaucuucccacccuccgacgaacaacuuaaaucaggcaccgccuccgucguaugccuacucaacaacuucuacccccgcgaagccaagguccaauggaaagucgacaacgcccuccaauccggcaacucccaagaauccguaaccgaacaagacucuaaagacuccaccuacucccucuccuccacccucacccucuccaaagccgacuacgaaaaacacaaagucuacgccugcgaagucacccaccaaggccucuccucccccgucaccaaauccuucaaccgcggcgaaugc

SEQ ID NO: 54019 - RNA, 1359 nt, Artificial Sequence
  derived and/or modified sequence opt11 from Ligelizumab_HeavyChain1
caaguacaacucguccaauccggugcagaaguaaugaaacccggaucauccgucaaagucagcugcaaagcaucaggauacaccuuuagcugguacuggcuagaaugggucagacaagccccaggacacggccuagaauggaugggcgaaauagacccaggcacauucaccacaaacuacaacgaaaaauucaaggcccgcgucaccuuuaccgccgacacuucaaccuccaccgccuacauggaacucucaucccuacgcuccgaagacacugccgucuacuacugcgcccgcuucucacacuucucaggcucaaacuacgacuacuucgacuacuggggccaaggcacccucgucaccguauccagcgccucaaccaaaggccccucaguauucccccuagccccauccucaaaauccaccagcggcggcaccgccgcacucggcugccucguaaaagacuacuuccccgaacccgucaccguaucauggaacucaggagcccuaaccuccggcguccacaccuuccccgccguccuucaaucuagcggacucuacucccuuucaucuguggucacaguccccuccucaucccucggcacacaaaccuacaucugcaacgucaaccacaaaccauccaacacaaaaguggacaagaaagucgaaccaaaauccugcgacaaaacccacacaugcccacccugccccgcccccgaacuccuaggcggccccucggucuuccuuuucccacccaaacccaaagacacccucaugaucucccggaccccggaaguuaccugcgucguagucgacgucucccacgaagacccagaagucaaauucaacugguacgucgacggcgucgaaguucacaaugcgaaaaccaaaccacgagaagaacaauacaacucaaccuaccgagucgucucaguccuaaccguccugcaccaagauuggcucaacggcaaagaauacaaaugcaaagucuccaacaaagcacuccccgccccaauagagaaaaccaucucaaaagccaaaggccaaccccgagaaccccaaguauacacucucccucccucccgagacgaacucacuaaaaaccaaguaucccucacaugccucgucaaaggcuucuaccccuccgacauagccguagaaugggaauccaacggccaacccgaaaacaacuacaaaacgacaccacccguccucgacuccgacggcuccuucuuccucuacucaaaacuaacggucgacaaaucacgcuggcaacaagguaacgucuuuucaugcuccgucaugcacgaagcgcuccacaaccacuacacccaaaagagccuaagccuaucccccggcaaa

SEQ ID NO: 54020 - RNA, 642 nt, Artificial Sequence
  derived and/or modified sequence opt11 from Ligelizumab_LightChain1
gaaaucguaaugacacaaucgcccgcaacccuaagcguaagcccaggagaacgcgcaacccuguccugccgcgcaagccaauccauaggcacaaacauacacugguaccaacaaaaacccggacaagcacccagacuccuaaucuacuacgcaagcgagagcauaagcgggaucccagccagauucucaggcucgggcucaggcacagaguucacccuaaccauaagcucgcuccaaagcgaagacuucgcaguguacuacugccaacaaucauggucguggccaaccacauucgggggcggaaccaaagucgaaaucaagcgcacagucgcggccccauccguauucauauucccacccucggacgaacaacuaaaaucaggcacggccucagucguaugccuacucaacaacuucuacccacgcgaagccaaaguccaauggaaagucgacaacgcgcuccaaagcggaaacucacaagaaagcguaaccgaacaagauagcaaagacucgaccuacagccuaagcucgacccucacccugagcaaagccgacuacgaaaaacacaaaguauacgcaugcgaagucacacaccaaggccuaagcucacccguaaccaagagcuucaacagaggcgaaugc

SEQ ID NO: 54021 - RNA, 1329 nt, Artificial Sequence
  derived and/or modified sequence opt11 from Lilotomab_HeavyChain1
gaaauccaacuacaacaaagcggacccgaacucgucaaacccggcgcaucugucaaagucuccugcaaagccucaggauacagcuucacggacuacaacauguacugggucaaacaaucacacggcaaaucccucgaauggaucggcuacauagacccauacaacggcgacacaaccuacaaccaaaaauucaaaggcaaagccacacucacugucgacaaaagcucauccacagccuucauacaccucaacucccuaaccagcgaagacuccgccgucuacuacugcgcuagauccccauacggccacuacgccauggauuacuggggccaaggaacaucuguaacagucuccucugccaaaaccacacccccaucugucuacccccucgcccccggcuccgccgcccaaaccaacuccaugguaacacuagguugccuagucaaaggauauuuccccgaacccgucaccgucacauggaacuccggcucacucucguccggaguacauaccuuccccgccgucuuacaaucugaccuauacacccucagcucauccguaacaguccccuccucaaccuggcccuccgaaacuguaaccugcaacgucgcccaccccgccucauccacaaaagucgacaagaaaaucgucccacgugacugcggcugcaaacccugcaucugcacaguccccgaagucucaucagucuucaucuuuccacccaaacccaaagacguccucaccaucacccucacaccuaaagucacaugcgugguugucgacaucuccaaagacgacccagaaguacaauucucgugguucgucgacgacguagaaguccacacagcacaaacacagccucgagaagaacaauucaacucaaccuuccgauccgucuccgaacuucccaucaugcaccaagacuggcucaacggcaaagaguucaaaugccgagucaacuccgccgccuuccccgcccccauagagaaaacaaucucaaaaaccaaaggccgacccaaagccccacaagucuacacuaucccgccacccaaagaacaaauggcaaaagacaagguaucucuaaccugcaugaucaccgacuucuuucccgaagacaucacugucgaauggcaauggaacggccaacccgcagaaaacuacaaaaacacccaacccaucauggacacagacggcuccuacuucgucuacucaaaacucaacguacaaaaguccaacugggaagccggaaauaccuucacgugcuccguacuccacgaaggccuccacaaccaccacacagaaaaauccuugucacacuccccaggaaaa

SEQ ID NO: 54022 - RNA, 642 nt, Artificial Sequence
  derived and/or modified sequence opt11 from Lilotomab_LightChain1
gacaucgucaugacccaaucacacaaacuccucuccaccuccgucggcgaccgcgucuccaucaccugcaaagccucccaagacgucuccaccgccgucgacugguaccaacaaaaacccggccaaucccccaaacuccucauaaacugggccucaacccgacacaccggcguccccgaccgcuucaccggauccggcuccggcaccgacuacacccucaccaucucaucaaugcaagccgaagaccuagcccuauacuacugccgccaacacuacucaacccccuucaccuucggcuccggcaccaaacuagaaaucaaacgcgccgacgccgcacccaccgucucaaucuucccccccuccuccgaacaacucaccuccggcggagccuccgucgucugcuuccucaacaacuucuaccccaaagacaucaacgucaaauggaaaaucgacggcuccgaacgucaaaacggcguccucaacuccuggaccgaccaagacuccaaagacucaaccuacucuaugucauccacccucacccucaccaaagacgaauacgaacgacacaacuccuacaccugcgaagccacccacaaaaccucuaccucccccaucgucaaauccuucaaccgcaacgaaugc

SEQ ID NO: 54023 - RNA, 1338 nt, Artificial Sequence
  derived and/or modified sequence opt11 from Lintuzumab_HeavyChain1
caaguacaacucguccaaagcggcgcugaggucaagaaacccggcuccuccgucaaagucuccugcaaagcauccggauacaccuucaccgacuacaacaugcacuggguccgccaagcuccaggccaaggucucgaauggaucggcuacaucuaccccuacaacggaggcaccggcuacaaccaaaaauucaaaucuaaagccacgaucacagccgacgaaucuaccaacaccgccuacauggaacucucaagccugcggucugaagacaccgccgucuacuacugcgcccgcggucgaccagccauggacuacuggggacaaggcacccuaguuaccgucuccuccgccucaaccaaaggacccuccgucuuuccucuugcccccucaucgaaaucaaccucaggcggaacugccgcccucgguugccucgucaaagacuacuucccugaacccgucaccguaucauggaacuccggagcucucaccuccggaguccacacauuccccgccguccuccagagcuccggccucuacucccucuccuccgucguaacuguccccucaucaucacucggcacacaaacguacaucugcaacguaaaccauaaacccuccaacacuaaagucgacaagaaaguagaacccaaaucuugcgacaaaacacacacaugcccacccugccccgcacccgaacuacucggcggccccucagucuuccucuucccaccaaaacccaaagacacacuaaugaucagccgcacccccgaagugacaugcgucguagucgaugucucccacgaagaccccgaagucaaauucaacugguacgucgacggcgucgagguacacaacgccaaaaccaaaccucgcgaagaacaauacaacuccacuuaccgugucgucuccguccucacaguccuacaucaagacuggcuaaacgguaaagaauacaaaugcaaagucuccaacaaagcacuccccgccccaaucgagaaaaccaucuccaaagccaaaggacaaccccgagaaccacaagucuacacccuacccccgucccgagacgaacucaccaaaaaccaagucucccuuaccugccucguaaaaggauuuuaccccucugacauagccgucgagugggaauccaacggccaacccgaaaacaacuacaaaaccacaccucccguccucgacuccgacggcuccuucuuccucuacuccaaacuaacaguagacaaaucacgcuggcaacaaggaaacgucuuuuccugcuccgucaugcacgaagcacuacauaaccacuacacccaaaaaucccuaucccucucccccggcaaa

SEQ ID NO: 54024 - RNA, 654 nt, Artificial Sequence
  derived and/or modified sequence opt11 from Lintuzumab_LightChain1
gacauccaaaugacacaaucccccucaagccucagcgcaagcgucggcgaccgcguaaccauaaccugccgcgcaagcgaaagcguagacaacuacgggaucucguucaugaacugguuccaacaaaaacccggaaaagcccccaaacuccuaaucuacgccgcgagcaaccaaggauccggcgucccaagcagauucucaggcucaggcucaggcacagacuucacccuaaccauaagcucacuccaacccgacgacuucgccacauacuacugccaacaauccaaagaagucccauggaccuucggacaaggaaccaaagucgaaaucaaacgcacagucgccgccccaagcgucuucauauucccacccucagacgaacaacucaaaucaggcaccgccucagucguaugccuccuaaacaacuucuacccccgcgaagccaaaguccaguggaaagucgacaacgcacuccaaagcggaaacucacaagaaagcguaaccgaacaagacagcaaagacuccaccuacagccuaagcucaacccucacccucagcaaagccgauuacgaaaaacacaaaguauacgcaugcgaagucacccaccaaggccuaagcucccccgucaccaagagcuucaacagaggcgaaugc

SEQ ID NO: 54025 - RNA, 1350 nt, Artificial Sequence
  derived and/or modified sequence opt11 from Lirilumab_HeavyChain1
caaguccagcuaguccaauccggagccgaagucaagaaacccggcuccuccgucaaaguuucaugcaaagcaucuggcggcacauucuccuucuacgcaaucucauggguccgacaagccccaggccaaggacucgaauggauggguggcuucaucccaauauucggcgccgccaacuacgcccaaaaauuccaaggccgcgucacaauaaccgccgacgaauccacaucuaccgccuacauggaacucucaucucucagguccgacgacaccgccgucuacuacugcgcacgcaucccuucaggauccuacuacuacgacuacgacauggacgucuggggccaaggcacaacaguuacagucagcuccgccuccacaaaaggcccaagcgucuucccccucgcccccugcucacgauccaccuccgaauccacagccgcacuugguugucuugucaaagacuacuuccccgaacccgucacgguaucauggaacuccggagcccucaccuccgguguccacaccuuccccgcaguccuccaauccuccggccuauacucacuaucauccguagucaccguccccuccuccucacuaggcacaaaaacauacacaugcaaugucgaccacaaaccaucaaacaccaaagucgacaaacgcgucgaauccaaauacggaccacccugcccacccugccccgcccccgaauuucucggcggccccuccgucuuccucuucccucccaaacccaaagacacccucaugaucagccgaaccccagaagucacaugcguggucgucgacguaucucaggaagaucccgaaguccaauucaacugguacgucgacggcgucgaaguccauaaugcuaaaacaaaaccaagagaagaacaauucaacucgaccuaccgcgucguauccguccucaccguucuucaccaagacuggcucaacggcaaagaauacaaaugcaaagucuccaacaaaggccucccaagcucuaucgaaaagaccaucucuaaagccaaaggccaaccccgagaaccacaagucuacacccucccgcccagccaagaagaaaugaccaaaaaccaggucucccucacgugccuagucaaaggcuucuaccccuccgacaucgccguagaaugggaauccaacggccaaccugaaaacaacuacaaaaccacacccccaguccuagacagugacgggagcuucuuccucuacucgcgccucaccgucgacaaaucccgcuggcaagaaggcaacguuuucagcugcucagucaugcacgaagcccuccacaaccacuacacccaaaaaucccucucauuaucccucggaaaa

SEQ ID NO: 54026 - RNA, 642 nt, Artificial Sequence
  derived and/or modified sequence opt11 from Lirilumab_LightChain1
gaaaucguacucacacaaucccccguaacucucucccucucccccggagaacgagcaacccucuccugccgcgcaucccaauccgucuccuccuaccuggccugguaccaacaaaaacccggccaagcaccccgacuccucaucuacgacgccuccaaccgcgccaccggcauccccgcccgcuucuccggcuccggcuccggcacagacuucacccucaccaucuccucacucgaacccgaagacuucgccgucuacuacugccaacaacgcuccaacuggauguacaccuucggccaaggcaccaaacucgaaaucaaacgcacagucgcagccccauccgucuucaucuucccaccauccgacgaacaacuuaaauccggcaccgccuccgucgucugccuccucaacaacuucuacccccgcgaagccaaaguccaauggaaagucgacaacgcccuacaauccggcaacucccaagaauccgucaccgaacaagacuccaaagacucaaccuacucccuuucauccacccuaacccuauccaaagccgacuacgaaaaacacaaagucuacgccugcgaagucacccaccaaggccucuccucccccguaaccaaauccuucaaccgaggcgaaugc

SEQ ID NO: 54027 - RNA, 1344 nt, Artificial Sequence
  derived and/or modified sequence opt11 from Lodelcizumab_HeavyChain1
caaguccaacucguccaauccggagccgaagucaagaaacccggcgcauccgucaaagucuccugcaaagcaucaggauacacauucucgaccauguauauguccuggguacgccaagcccccggacaaggccucgaauggaugggacgaaucgaccccgcaaaugaacacaccaacuacgcccaaaaauuccaaggccgagucaccaugacucgcgacacauccaucagcaccgcauacauggaacuaagccgccuuaccucagacgauacugccgucuacuacugcgcccgcuccuacuauuacuacaacauggacuacuggggccaaggaacacucgucaccgucuccuccgccagcaccaaaggacccucuguauucccccucgcccccuccucgaaauccaccuccggaggcaccgccgcccuaggaugccucgucaaagacuacuuccccgaacccgucaccgucuccuggaacucaggcgcacucaccucaggcguccacacauucccagccguccuucaaucauccggccucuauucccucucaucaguagucacuguacccucauccucacucggcacccaaacguacaucugcaacgugaaccacaaacccucuaacaccaaaguagacaaacgagucgaaccaaaaucaugcgauaaaacccacacaugcccacccugccccgcccccgaagccgccggaggccccagcgucuuccucuucccacccaaacccaaagacacacucaugaucucccgcacccccgaaguuacaugcgucgucgucgaugucucacacgaagaccccgaaguaaaauucaacugguacguagacggagucgaaguccacaacgcaaaaaccaaaccccgcgaagaacaauacaacucaacauaccgcgucguaucuguacucacaguccuacaccaagacuggcucaacggcaaagaauacaaaugcaaagucuccaacaaagcccucccagcccccaucgaaaagaccaucuccaaagcaaaaggccaaccccgcgaaccccaagucuacacccuacccccuucccgcgaagaaaugaccaaaaaccaagucucccuaacaugccuagucaaaggcuucuaccccucagacauagcagucgaaugggaauccaacggccaaccggaaaacaacuacaaaaccaccccacccguccuagacucagacggcuccuucuuccucuacuccaaacucaccgucgauaaaucccgauggcaacaaggaaacguauucuccugcuccgucaugcacgaagcccuccacaaccacuacacccaaaaaucacucucccucucgcccggcaaa

SEQ ID NO: 54028 - RNA, 639 nt, Artificial Sequence
  derived and/or modified sequence opt11 from Lodelcizumab_LightChain1
caaauaguccuaacccaaucccccgcaacccucuccgucucccccggcgaacgcgccacccucuccugccgagccucccaauccgucuccuacaugcacugguaccaacaaaaacccggacaagcaccccgucuccucaucuacggcgucuuccgccgcgccaccggaauccccgaccgcuucuccggcuccggcuccggcaccgacuucacccuaaccaucggccgccucgaacccgaggacuucgccgucuacuacugccuccaaugguccuccgacccacccacuuucggccaaggcaccaaacucgaaaucaaacgaacaguagccgcccccuccgucuucaucuucccacccucugacgaacaacucaaauccggaaccgccuccguagucugccuccucaacaacuucuacccccgagaagccaaaguccaauggaaagucgacaacgcccuccaauccggcaacucccaagaauccgucaccgaacaagacuccaaagacuccaccuacucccucuccuccacccucacccucuccaaagccgacuacgaaaaacacaaagucuacgccugcgaaguaacccaccaaggccucuccucccccgucaccaaauccuucaaccgcggagaaugc

SEQ ID NO: 54029 - RNA, 1356 nt, Artificial Sequence
  derived and/or modified sequence opt11 from Lokivetmab_HeavyChain1
gaaguccagcuagucgaaagcggcggcgaccuaguaaaacccggaggaucccucagacuauccugcguagccuccggcuucaccuucucuaacuacgguaugucauggguacgccaagcccccggaaaaggacuccaauggguagccaccaucuccuacggcggcucuuacaccuacuaucccgacaacaucaaaggccgcuucaccaucuccagagacaaugccaaaaacacccucuaccuccaaaugaacucccugcgagcagaagacaccgcaauguacuacugcguccgaggcuacggauacgacaccauggacuacuggggacaaggcacccuagucaccgucucaucagccuccacuaccgcccccagcgucuucccacucgcacccucuugcggcuccaccuccggcucuacagucgcccucgccugccucgucucaggcuacuucccagaacccgucacagucucauggaacuccggcucacucacuuccggaguacacaccuuccccuccguccuccaaucauccggccucuacucacucucuagcauggucacagucccgagcucacguuggcccucagaaacauucacgugcaacgucgcccaccccgccuccaaaaccaaagucgacaaacccguaccaaaaagagagaacggccgaguacccagaccacccgacugccccaaaugccccgcccccgaaaugcucgggggccccuccgucuucaucuucccacccaaacccaaagacacccuccucauagccagaacccccgaaguaaccugcgucguagucgaccucgaccccgaagaccccgaaguccagauaucgugguucgucgacgguaagcaaaugcaaacagccaaaacccaacccagagaagaacaauucaacggaacauaucgcgucgucucaguucuacccaucggccaccaggacuggcugaaaggcaaacaauucacaugcaaagucaauaacaaagcccuacccucccccaucgaaagaaccaucuccaaagcacgcggccaagcccaccaaccauccguauacguucuuccucccucccgcgaagaacuaagcaagaacaccgucucacuaaccugccucaucaaagacuucuucccacccgauaucgacgucgaauggcaaagcaacggccaacaagaaccagaaucaaaauaccgaaccaccccaccccaacucgacgaagacggcagcuacuuccucuacucaaaacuuuccgucgacaaaucaagauggcagcgaggcgacaccuucauaugcgcugucaugcacgaagcacugcacaaccacuacacccaagaaucccucucccacucacccggc

SEQ ID NO: 54030 - RNA, 651 nt, Artificial Sequence
  derived and/or modified sequence opt11 from Lokivetmab_LightChain1
gaaaucguaaugacccaaucccccgccucccucucccucagccaagaagaaaaagucaccauaaccugcaaagccagccaaagcgucuccuucgcaggcaccggucuaaugcacugguaccaacaaaaacccggccaagcacccaagcuccucaucuaccgcgcaagcaaccuagaagccggaguacccagccgcuucuccggcucaggcucaggcaccgacuucuccuucaccaucuccucacuagaacccgaagacgucgccguauacuacugccaacaaucccgagaauaccccuggacauucggacaaggcaccaaacucgaaaucaaacgcaacgacgcccaacccgccgucuaccuauuccaacccucccccgaccaacuccacaccggcucagccuccgucguaugccuacuaaacagcuucuaccccaaagacaucaacgucaaauggaaagucgacggcgucauccaagacaccggcauccaagaauccgucaccgaacaagacaaagacucaaccuacucacuaucaagcacccucaccauguccuccacagaauaccucucccacgaacucuacuccugcgaaaucacccacaaaucacuccccuccacccucaucaaauccuuccaacgcucagaaugc

SEQ ID NO: 54031 - RNA, 1344 nt, Artificial Sequence
  derived and/or modified sequence opt11 from Lorvotuzumab_mertansine_HeavyChain1
caaguccaacucguggaauccggcggcggcguuguccaacccggccgcucacuacgccucuccugcgccgccuccggcuucaccuucucaucauucggaaugcauuggguccgccaagcgccuggcaaaggccucgaauggguagccuacauauccucgggcuccuucaccaucuacuacgcagacuccgucaaaggccgauucacaaucucccgcgacaacuccaaaaacacucuguaccuacaaaugaacucccuacgagccgaggacaccgccgucuacuacugugcucgaaugcgcaaaggcuacgccauggacuacuggggacaaggaacacucgucacagucuccuccgccuccaccaaaggcccauccguauucccacucgcucccucauccaaaucaacauccggcggaaccgccgcccuaggcugccuggucaaagacuacuucccagaacccguaaccgucagcuggaacuccggcgcccuuaccuccgggguacacaccuucccagccguccugcaaucuuccggccuuuacucacuuagcuccgucguuacaguaccaucauccucacucggcacucaaaccuacaucugcaacgucaaccacaaaccaucuaacacaaaaguugacaagaaaguagaaccgaaauccugcgacaaaacccauacaugcccacccugccccgcaccagaacuccucggcggccccuccgucuuccuuuucccacccaagcccaaagacacacucaugaucucccgaacccccgaaguuaccugcgucgucguagauguuucccacgaagaccccgaagucaaauucaacugguacgucgacggcguagaaguacacaacgcaaaaaccaaaccccgagaagaacaauacaacuccaccuaccgcgucgucucaguccucaccguccuccaccaagauuggcucaacggcaaagaauacaaaugcaaagucucaaacaaagcccuccccgcccccaucgaaaagaccauauccaaggcuaagggccaacccagagaaccacaagucuacacccuacccccaucacgagacgaacuaaccaagaaccaaguaucccuaaccugccuagucaaaggcuucuacccauccgacauagccgucgaaugggaguccaacggacaacccgaaaacaacuacaaaaccaccccacccguccuagacuccgacggcuccuucuuucuauacuccaaacucaccgucgacaagagccgcuggcaacaaggaaacguauuuuccugcucugucaugcacgaagcacuccacaaccacuauacccaaaaaucccucucgcucucccccggcaaa

SEQ ID NO: 54032 - RNA, 657 nt, Artificial Sequence
  derived and/or modified sequence opt11 from Lorvotuzumab_mertansine_LightChain1
gacgucgucaugacacaaagcccccuaucccuccccgucacccucggccaacccgccuccaucuccugccgcuccucacaaaucaucauccacuccgacggcaacaccuaccucgaaugguuccaacaacgccccggccaaucuccccgccgccugaucuacaaaguauccaaccgcuucuccggcguccccgaccgcuucuccggcuccggcuccggcaccgacuucacccuaaaaaucucccgcgucgaagccgaagacgucggcguauacuacugcuuccaaggaucccacgucccccacaccuucggccaaggaaccaaagucgaaaucaaacgcaccgucgccgccccaucugucuucaucuucccacccuccgacgaacaacucaaauccggcaccgccuccguagucugccuccucaacaacuucuacccccgcgaagcuaaaguccaauggaaaguagacaacgcccuccaauccggcaacucacaagaauccgucaccgaacaagacuccaaagacuccaccuacucccucucauccacacucacccucuccaaagccgacuacgaaaaacacaaagucuacgccugcgaagucacccaccaaggccucucaucccccguaaccaaauccuucaaccgcggagagugc

SEQ ID NO: 54033 - RNA, 336 nt, Artificial Sequence
  derived and/or modified sequence opt11 from Lpathomab_VL
gacgucgucaugacccaaaccccccucucccuccccgucucccucggcgaccaagccuccaucuccugcaccuccggccaaucccucguccacaucaacggcaacaccuaccuccacugguaccuccaaaaacccggccaaucccccaaacuccucaucuacaaagucuccaaccucuucuccggcguccccgaccgcuucuccggcuccggcuccggcaccgacuucacccucaaaaucucacgcgucgaagcagaagaccucggcgucuacuucugcucccaauccacccacuuccccuucaccuucggcaccggcaccaaacucgaaaucaaa

SEQ ID NO: 54034 - RNA, 366 nt, Artificial Sequence
  derived and/or modified sequence opt11 from Lpathomab_gamma1-Chain_VDJ-Region
caaguccaacuccaacaauccggcgccgaacucguccgccccggcaccuccgucaaaguauccugcaaagccuccggcuacggcuucaucaacuaccucaucgaauggaucaaacaacgccccggccaaggccucgaauggaucggccucaucaaccccggcuccgacuacaccaacuacaacgaaaacuucaaaggcaaagccacccucaccgccgacaaauccuccuccaccgccuacaugcaccucuccucccucaccuccgaagacuccgccgucuacuucugcgcccgccgcuucggcuacuacggcuccggcaacuacuucgacuacuggggccaaggcaccacccuaaccgucucaucc

SEQ ID NO: 54035 - RNA, 1350 nt, Artificial Sequence
  derived and/or modified sequence opt11 from Lucatumumab_HeavyChain1
caaguccaacucgucgaaucgggcggcggagucguacaaccgggccgaucccuucgccuuucaugcgccgccuccggcuucaccuucuccucguacgguaugcacuggguccgccaagcacccggcaaaggccuagaaugggucgccgucauaucauacgaagaaucuaaccgcuaccacgccgacucagucaaaggccgauucaccaucucccgggacaacuccaaaaucacccuauaccuacaaaugaacagccuucguaccgaagacaccgccgucuacuauugcgcaagagacgguggcaucgcagcccccggcccagacuacuggggccaaggcacgcuagucaccgucucauccgccuccaccaaaggccccuccgucuucccacuggcccccgccucuaaaucaaccucaggcggcaccgccgcucucgguugccucgucaaagacuacuuccccgaaccaguaaccgucucauggaacuccggcgcccucacaucuggcguccacaccuuuccagccguccuccaguccagcggccuauauucccuauccucuguugucaccguccccuccuccucgcucggaacacaaaccuauaucugcaacguaaaccacaaacccuccaacaccaaagucgacaaacgcgucgaacccaaaucgugcgacaaaacacacacaugcccacccugccccgcccccgaacuccugggaggccccuccgucuuccuuuucccucccaaacccaaagauacacucaugaucucacgcacccccgaaguaacaugcguugucgucgacguuucccacgaagaccccgaagucaaauuuaacugguacguagacggcgucgaaguccacaacgcuaaaacgaaaccccgcgaggaacaauacaacuccaccuaccgcgucgucucuguccuaaccguacuccaccaagacuggcucaacggcaaagaauacaagugcaaagucuccaacaaagcccuacccgcacccaucgagaaaaccaucucaaaagccaaaggccaaccccgcgaaccccaagucuacacccucccacccucacgcgaagaaaugaccaaaaaccaggucucauuaaccugccucgucaaaggcuucuaccccagcgacaucgccguagaaugggaauccaacggccaacccgaaaacaacuacaaaacuacucccccgguacuagacuccgacggcagcuucuuucucuacuccaaacuaaccgucgacaaaucaagauggcaacaaggaaacgucuucuccugcuccguaaugcacgaagcacuccacaaccacuauacccaaaaaucccucucccuaucccccggaaaa

SEQ ID NO: 54036 - RNA, 657 nt, Artificial Sequence
  derived and/or modified sequence opt11 from Lucatumumab_LightChain1
gacaucgucaugacccaaucuccccuaucccucaccgucaccccaggcgaacccgccuccaucuccugccgauccucccaaucacuccuuuacuccaacggcuacaacuaccucgacugguaccuacaaaaacccggacaaucaccccaaguccucaucucccucggcagcaaccgagccuccggaguccccgaccgcuucuccggcuccggcuccggcacagacuucacccucaaaaucucacgcgucgaagccgaagacgucggcgucuacuacugcaugcaagcccgccaaaccccauucaccuucggccccggcaccaaagucgacauccgccgcaccguagccgccccauccgucuucaucuucccacccucagacgaacaacucaaauccggcaccgcauccgucgucugccuacucaacaacuucuacccccgcgaagccaaaguccaauggaaggucgacaacgcacuccaauccggcaacucacaagaauccgucaccgaacaagacuccaaagacuccaccuacucacucuccuccacccuuacccucuccaaagccgacuacgaaaaacacaaagucuacgccugcgaagucacccaccaaggccucuccucccccgucaccaaauccuucaaccgaggcgaaugc

SEQ ID NO: 54037 - RNA, 324 nt, Artificial Sequence
  derived and/or modified sequence opt11 from Lulizumab_pegol_LightChain1
gacauccaaaugacccaaucccccuccucccucuccgccuccgucggcgaccgcgucaccaucaccugccgcgccucccgccccaucuggcccuuccucgaaugguaccaacaaaaacccggcaaagcccccaaacuccucaucuacuucaccucccgccuccgccacggcguccccucccgcuucuccggcuccggcuccggcaccugcuucacccucaccaucuccucccuccaacccgaagacuucgccaccuacuacugccuccaaaacgucgccaaccccgccaccuucucccaaggcaccaaagucgaaaucaaacgc

SEQ ID NO: 54038 - RNA, 324 nt, Artificial Sequence
  derived and/or modified sequence opt11 from Lulizumab_pegol_LightChain
gacauccaaaugacccaaucccccuccucccucuccgccuccgucggcgaccgcgucaccaucaccugccgagccucccgccccaucuggcccuuccucgaaugguaccaacaaaaacccggcaaagcccccaaacuccucaucuacuucaccucccgccuccgccacggcguccccucccgcuucuccggcuccggcuccggcaccugcuucacccucaccaucuccucccuccaacccgaagacuucgccaccuacuacugccuccaaaacgucgccaaccccgccaccuucucccaaggcaccaaagucgaaaucaaacgc

SEQ ID NO: 54039 - RNA, 1194 nt, Artificial Sequence
  derived and/or modified sequence opt11 from Lumiliximab_HeavyChain1
gaaguccaacuugucgaaagcggcggcggacucgccaaacccggcggcucacuccgccuuucaugcgccgccuccggcuucagauucaccuucaacaacuacuacauggacugggucagacaagcucccggccaaggacuagaaugggucuuaaccaccggcagcgauuccuggggccaagguguucuaguaaccgucuccuccgcauccaccaaaggccccuccguauuuccccuagcccccucuucaaaguccaccuccggcggaacagccgcccucggaugccucgucaaagacuacuuccccgaaccagucacaguaucuuggaacuccggagcccuaaccuccggcguccacaccuuccccgccgugcuccaauccucuggacucuacucccucucaucagucgucacagucccauccucaagccucggcacccaaaccuacaucugcaacgucaaucacaaacccuccaacaccaaaguagacaagaaaguagaaccaaaauccugcgacaaaacccacacaugcccacccugucccgccccagaacuccucggaggaccaucagucuuccuauucccacccaaaccuaaagacacccucaugauuucucgaacccccgaagucacaugcgucgucgucgacgucucacaugaagaccccgaagucaaauucaacugguaugucgacggagucgaaguacacaacgccaaaaccaaaccccgagaagaacaauacaacuccaccuaucgcgucgucuccguccucaccguccuccaccaagacuggcucaacggcaaagaauacaaaugcaaagucuccaacaaagcucuacccgccccaauugagaaaacaaucuccaaagccaaaggccaaccccgugaaccccaaguauacacccucccacccucucgagacgaacucaccaaaaaccaagucagccuaaccugccucguaaaaggauucuaccccucagacauagccgucgaaugggaaucaaacggacaacccgaaaacaacuacaaaaccacaccacccguccucgacuccgacggcuccuucuuccucuauuccaaacucaccguagacaaaucacgauggcaacaaggcaacgucuucuccugcuccguaaugcacgaagcccuccacaaccauuacacacaaaaaucacucucccucucccccggaaaa

SEQ ID NO: 54040 - RNA, 642 nt, Artificial Sequence
  derived and/or modified sequence opt11 from Lumiliximab_LightChain1
gacauccaaaugacacaaucacccuccucacuauccgccuccgucggagaccgcgucaccaucaccugccgcgccucacaagacauucgcuacuaccucaacugguaccaacaaaaacccggaaaagcccccaaacuccucaucuacgucgcauccucacuccaauccggaguccccucccgcuucuccggcagcggcuccggcaccgaauucacacuaaccgucuccucacuccaacccgaagacuucgccaccuacuacugccuccaagucuacuccaccccccgcaccuucggccaaggcaccaaagucgaaaucaaacgaacagucgccgccccauccgucuucaucuucccacccuccgacgaacaacucaaauccggcaccgccucagucgucugccuccucaacaacuucuacccacgcgaagccaaaguccaauggaaaguagacaacgcccuccaauccggcaacucacaagaauccgucaccgaacaagacuccaaagacuccaccuacagccucuccucaacccucacccuauccaaagccgacuacgaaaaacacaaagucuacgccugcgaagucacccaccaaggccucucaucucccgucaccaaauccuucaaccgcggcgaaugc

SEQ ID NO: 54041 - RNA, 1347 nt, Artificial Sequence
  derived and/or modified sequence opt11 from Lumretuzumab_HeavyChain1
caaguccaacucguccaauccggcgccgaagucaaaaaacccggcgcauccguaaaagucuccuguaaggcaagcggguacacauuccgcucauccuacaucuccuggguccgccaagccccaggccaaggccucgaauggauggguuggaucuacgccggcaccggcagcccgagcuacaaccaaaaacuacaaggucgcguaaccaugaccaccgacaccucaacauccaccgccuacauggaacuacgcagccuacgauccgacgacaccgccgucuacuacugugcacggcaccgagacuacuacucuaacucacucaccuacuggggccaaggcacacuagucacagucuccucugccucaaccaaaggccccucuguauucccccucgcccccuccucaaaauccacauccggcggaaccgcugcucucggcugccuagucaaagacuacuucccagagccaguaaccgucucauggaacuccggagcccucaccucaggcguccacacauuccccgccguacuccaaucaucuggccucuacucucucucguccguagucaccguccccuccucaagccucggcacccaaaccuacaucugcaacgucaaccacaaacccucaaacaccaaagucgacaaaaaagucgaaccuaaauccugcgacaaaacccauaccugcccccccugcccugcuccagaacuccuaggcggccccucagucuuccuauuccccccaaaacccaaagacacccucaugaucucacgcacccccgaaguaaccugcgucguaguagacgucucccacgaagaccccgaagucaaauucaacugguacguagacggagucgaaguacacaacgcaaaaaccaaaccacgcgaagaacaauacaacuccaccuaccgagucgucuccguccuaaccguccuacaccaagacuggcucaacggcaaagaauacaaaugcaaagucagcaacaaagcccuccccgccccaaucgagaaaacaaucagcaaagccaaaggucaacccagagagccacaagucuacacccucccccccucacgagacgaacucaccaaaaaccaaguaucacuaaccugccucgucaaaggauuuuaccccuccgacauagccgucgaaugggaaagcaacggccaacccgaaaacaacuacaaaaccaccccccccguccuagacagcgacggcuccuucuuccuauacuccaaacucaccgucgauaaaucucgcuggcaacagggaaaugucuucuccugcuccguaaugcacgaagcgcugcacaaucacuacacccaaaaaucccuaucccucuccccagga

SEQ ID NO: 54042 - RNA, 660 nt, Artificial Sequence
  derived and/or modified sequence opt11 from Lumretuzumab_LightChain1
gacaucguaaugacacaaucacccgacagccucgccguaagucuaggcgaacgcgcgaccauaaacugcaaaucaagccaaagcguacucaacagcggaaaccaaaaaaacuaccuaaccugguaccaacaaaaacccggccaaccacccaaacuccugaucuacugggcaagcacccgcgaaagcggaguccccgaccgauucucaggcucaggcucaggcaccgacuucacccuaaccauaagcucacuccaagccgaagacguagccguauacuacugccaaagcgauuacucauacccauauacauucggacaagggaccaaacucgaaaucaaacgcacagucgccgccccaagcguauucauauucccccccucagacgaacaacuaaaauccggcacagccuccgucgucugccuacuaaacaacuucuacccacgcgaagccaaaguccaauggaaagucgacaacgcccuccaaagcggaaacucacaagaaagcgucacagaacaagacagcaaagacucaaccuacagccucagcucaacccugacacuaagcaaagccgacuacgaaaaacacaaaguauacgcaugcgaagucacccaccaaggccuauccucacccgugaccaaaagcuucaacagaggcgaaugc

SEQ ID NO: 54043 - RNA, 1329 nt, Artificial Sequence
  derived and/or modified sequence opt11 from Lutetium_(177Lu)_lilotomab_satetraxetan_HeavyChain1
gaaauccaacuccaacaauccggccccgagcuagucaaacccggcgccucugucaaaguuuccugcaaagccuccggauacucauucacagacuacaauauguacuggguuaaacaaagccauggcaaaucccucgaauggaucggcuacaucgaccccuacaacggcgacaccaccuacaaccaaaaauucaaaggaaaagccacgcucacaguugacaaaucauccuccaccgcauucauccaccucaacucucuuaccucagaagacuccgcaguauacuacugcgcccgcucccccuacggccacuacgccauggacuacuggggccaaggcaccuccgucaccgucuccuccgccaaaacgaccccacccucugucuacccccuagcccccggcucugccgcccaaaccaacuccauggucacccucggcugucucguaaaaggcuacuuccccgaacccguaaccguaacauggaacuccggaucccuauccuccggcguccacaccuuccccgccguacuccaaucugaccucuacacccuauccuccuccguaacagucccaucuuccaccuggccauccgaaacagucaccuguaacguagcacacccagcauccucuaccaaagucgacaagaaaaucgucccccgcgacuguggcugcaaacccugcaucugcacugucccugaagucuccucagucuucauauucccgcccaaacccaaagacguccucacaaucacacucacacccaaagucaccugugucgucguugacaucuccaaagacgaccccgaaguccaauucuccugguucgucgacgacguagaaguccacaccgcccaaacccaaccccgcgaagaacaauucaacuccaccuuccgcuccgucuccgaacuacccaucaugcaccaagacuggcucaacggaaaagaguucaaaugccgcguuaacuccgcagccuuccccgcacccaucgagaaaaccauauccaaaacaaaaggacggccaaaagcgccccaaguauacaccaucccuccacccaaagaacaaauggccaaagacaaagucucacuaaccugcaugauaacggacuucuuccccgaagacaucaccguugaauggcaauggaacggccaacccgccgaaaacuacaaaaacacccaaccaaucauggacacagacggcucauacuucguauacuccaaacucaacguacaaaaaucgaacugggaagccggcaacaccuuuaccugcucaguccuccacgaaggacuccacaaccaccacaccgagaagucacuuucccacucacccgguaaa

SEQ ID NO: 54044 - RNA, 642 nt, Artificial Sequence
  derived and/or modified sequence opt11 from Lutetium_(177Lu)_lilotomab_satetraxetan_LightChain1
gacaucgucaugacccaaucccacaaacuacuauccacauccgucggagaccgcgucuccaucacaugcaaagccucccaagacgucuccaccgccgucgacugguaccaacaaaaaccaggccaauccccaaaacuccuaaucaacugggccuccacccgccacaccggcguccccgaccgcuucaccggcuccggcuccggcaccgacuacacccucaccaucuccuccaugcaagccgaagaccucgcccucuacuacugccgccaacacuacucaacccccuucaccuucggcucaggcaccaaacucgaaaucaaacgcgccgacgccgccccaaccgucucuaucuucccucccuccuccgaacaacucaccuccggcggcgcauccgucgucugcuuccucaacaacuucuacccaaaagacaucaacgucaaauggaaaaucgacggcucagaacgacaaaacggcguccucaacucauggaccgaccaagacuccaaagacuccaccuacucaauguccuccacccucacccucaccaaagacgaauacgaacgccacaacuccuacacaugcgaagccacccacaaaaccuccaccucccccauagucaaauccuucaaccgcaacgaaugc

SEQ ID NO: 54045 - RNA, 1350 nt, Artificial Sequence
  derived and/or modified sequence opt11 from Margetuximab_HeavyChain1
caaguacaacuccaacaauccggacccgagcuaguaaaacccggcgccucccucaaacucucaugcaccgccucagguuucaacaucaaagacacauacauacacuggguuaaacaaagacccgaacaaggccuugaauggaucggccgcauauaccccaccaacggcuacacccgauacgaccccaaauuccaggacaaagccaccaucacagcagacacguccucaaacaccgccuaucuccaagucucacgccucacauccgaagacaccgcaguauacuacuguucacgcuggggcggcgacggauucuacgccauggacuacuggggccaaggagcguccgucaccguuagcuccgccucuacaaaaggccccuccguauucccacucgcccccuccuccaaauccaccuccggcggaaccgccgcccucggaugccuagucaaagacuacuuccccgaacccguaaccguguccuggaacucaggcgcacucaccucaggugugcacaccuuccccgccgugcuacaauccuccggacucuacucacuauccagcgucgucaccguccccucaucaucccuaggcacccaaaccuacaucugcaacgucaaccacaaacccuccaacacaaaagucgacaaacgaguagaaccaaaauccugcgacaaaacacacacaugcccucccugccccgcccccgaacucgucggaggccccucaguauuccuccuacccccaaaacccaaagacacccuaaugaucucucgcaccccagaaguaacaugcguaguagucgacgucucccacgaggacccggaagucaaauuuaacugguacgucgacgguguagaaguccacaacgccaaaaccaaaccacccgaagaacaauacaacuccacacuacgcguagucuccguccucaccguccuacaccaagacuggcucaacggcaaagaauacaaaugcaaagucuccaacaaagcccuccccgcacccauagagaaaaccaucuccaaagccaaaggccaaccccgagaaccccaagucuacacccucccucccucccgcgacgaacucaccaaaaaccaagucagccuuacuugccucgucaaaggcuucuaccccucagacauagccgucgaaugggaaagcaacggacaacccgaaaacaacuacaaaaccacaccccucguucucgacuccgacggcucauucuuccucuauuccaaacuaaccgucgacaaaucacgauggcaacaaggcaacgucuucucaugcuccgucaugcacgaagcacuccacaaccacuacacccaaaaaucccuuucccuaucacccggcaaa

SEQ ID NO: 54046 - RNA, 642 nt, Artificial Sequence
  derived and/or modified sequence opt11 from Margetuximab_LightChain1
gacaucgucaugacccaaucccacaaauucauguccaccuccgucggcgaccgcgucuccauaaccugcaaagccucccaagacguaaacaccgccgucgccugguaccaacaaaaacccggccacucccccaaacuccucaucuacuccgccuccuuccgcuacaccggcguccccgaccgcuucaccggcucccgcuccggcaccgacuucaccuucacaaucuccucaguccaagccgaagaccucgccgucuacuacugccaacaacacuacaccaccccacccaccuucggcggcggcaccaaagucgaaaucaaacgcaccgucgccgccccauccgucuucaucuucccacccuccgacgaacaacucaaauccggcaccgccuccgucgucugccuacucaacaacuucuacccccgcgaagccaaaguccaauggaaagucgacaacgcccuccaauccggcaacucacaagaauccgucaccgaacaagacuccaaagacucaaccuacucacuauccuccacccucacccucuccaaagcagacuacgaaaaacacaaagucuacgccugcgaagucacccaccaaggccucagcucacccgucaccaaauccuucaaccguggcgaaugc

SEQ ID NO: 54047 - RNA, 762 nt, Artificial Sequence
  derived and/or modified sequence opt11 from Marzeptacog_alfa_HeavyChain1
aucgucggaggcaaagucugccccaaaggcgaaugccccuggcaaguccuccuccuagucaacggcgcacaacucugcggcggcacccucaucaacaccaucugggucgucagcgccgcccacugcuucgacaaaaucaaaaacuggcgcaaccucauagccguccucggagaacacgaccucuccgaacacgacggcgacgaacaaucacgacgcgucgcccaagucauaaucccgucuacauacguccccggcaccaccaaccacgacaucgcccuacuccgcuuacaccaaccaguaguacucaccgaccacgucgucccccuaugccuccccgaacgcaccuucuccgaacgcacccucgccuucguccgcuucucccuagucucaggcuggggccgccuacuagaccgcggcgccaccgcccucgaacuccaaguacucaacgucccccgccucaugacccaagacugccuccaacaaucccgaaaagucggcgacucccccaacaucaccgaauacauguucugcgccggcuacuccgauggcucaaaagacucaugcaaaggcgacuccggcggcccccacgcuacccacuaccgcggcaccugguaccucaccggcaucgucuccuggggccaaggcugcgccaccgucggccacuucggcgucuacacccgcgucucacaauacaucgaauggcuacaaaaacuuaugcgcuccgaaccacgcccaggcguccuccuccgcgcccccuucccc

SEQ ID NO: 54048 - RNA, 456 nt, Artificial Sequence
  derived and/or modified sequence opt11 from Marzeptacog_alfa_LightChain1
gccaacgccuuccucgaagaacuccgccccggcucccucgaacgcgaaugcaaagaagaacaaugcuccuucgaagaagcccgcgaaaucuucaaagacgccgaacgcaccaaacucuucuggaucuccuacuccgacggcgaccaaugcgccuccucacccugccaaaacggcggcuccugcaaagaccaacuccaauccuacaucugcuucugccuccccgccuucgaaggccgcaacugcgaaacacacaaagacgaccaacucaucugcgucaacgaaaacggcggaugcgaacaauacugcuccgaccacaccggcaccaaacgcuccugccgcugccacgaaggcuacucccuccucgccgacggcgucucaugcaacgccaccgucgaauaccccugcggcaaaauccccauccucgaaaaacgcaacgccuccaaaccccaaggccgc

SEQ ID NO: 54049 - RNA, 669 nt, Artificial Sequence
  derived and/or modified sequence opt11 from Matuzumab_HeavyChain1_variant_3c08_H
caaguccaacucguccaauccggugccgaagucaaaaaacccggcgccuccguaaaagucuccugcaaagccucaggcuacaccuucaccucccacuggaugcacuggguccgccaagcccccggccaaggccucgaauggaucggagaauucaaccccuccaacggccgaaccaacuacaacgaaaaauucaaauccaaagccaccaugaccgucgacaccuccaccaacacagccuacauggaacucuccucacuccgauccgaagacaccgccgucuacuacugcgccucccgcgacuacgacuacgacggccgauacuucgacuacuggggccaaggaacccucgucaccgucuccuccgccucaaccaaaggccccuccgucuucccccucgcccccuccucaaaaucaaccuccggcggcaccgcagcccucggcugccucgucaaagacuacuucccagaacccgucaccguauccuggaacuccggcgcacucaccuccggcguccacaccuuccccgccguccuccaauccuccggccucuacucccucucauccgucgucaccguccccucaagcucccucggcacccaaaccuacaucugcaacgucaaccacaaacccuccaacaccaaagucgacaaaaaagucgaacccaaaucc

SEQ ID NO: 54050 - RNA, 669 nt, Artificial Sequence
  derived and/or modified sequence opt11 from Matuzumab_HeavyChain1_variant_3c09_C
caaguacaacuaguccaauccggcgccgaagucaaaaaacccggcgccuccgucaaagucuccugcaaagccuccggcuacaccuucaccucccacuggaugcacuggguccgccaagcccccggccaaggccucgaauggaucggcgaauucaaccccuccaacggacgcaccaacuacaacgaaaaauucaaauccaaagccacaaugaccguagacaccuccaccaacaccgccuacauggaacucucuucccuccgcuccgaagacaccgccguauacuacugcgccucccgcgacuacgacuacgccggccgcuacuucgacuacuggggccaaggcacccucgucaccgucuccuccgccagcaccaaaggcccaucagucuucccccucgcacccuccucaaaaucaaccuccggcggcaccgcagcccucggcugccucgucaaagacuacuucccagaacccgucaccgucuccuggaacuccggcgcccucaccucaggaguccacaccuuccccgcaguccuccaauccuccggccuauacucacucuccucagucgucaccguccccuccuccucccuuggcacccaaaccuacaucugcaacgucaaccacaaaccauccaacaccaaagucgacaaaaaagucgaaccaaaaucc

SEQ ID NO: 54051 - RNA, 636 nt, Artificial Sequence
  derived and/or modified sequence opt11 from Matuzumab_LightChain1_variant_3c08_L
gacauccaaaugacccaaucccccuccucucucuccgccuccgucggagaccgagucacaauaaccugcucagcauccuccuccguaaccuacauguacugguaccaacaaaaacccggcaaagcaccaaaacuccucaucuacgacaccucaaaccucgcaucaggcguccccucacgcuucuccggcuccggcuccggcacugacuacaccuucaccaucucaucccuccaacccgaagacaucgccaccuacuacugccaacaaugguccucccacaucuucacauucggccaaggcaccaaagucgaaaucaaacgcaccguagccgcccccuccgucuucaucuucccacccuccgacgaacaacucaaauccggcacugccuccgucgucugccuccucaacaacuucuacccccgugaagccaaaguccaauggaaagucgacaacgcacuccaaucaggcaacucccaagaauccgucaccgaacaagacuccaaagacuccacauacucccuauccuccacccucacccucuccaaagcagacuacgaaaaacacaaagucuacgccugcgaagucacacaccaaggccucuccuccccagucaccaaauccuucaaccgcggcgaa

SEQ ID NO: 54052 - RNA, 636 nt, Artificial Sequence
  derived and/or modified sequence opt11 from Matuzumab_LightChain1_variant_3c09_B
gacauacaaaugacccaaucccccuccucacucucagccuccgucggcgaccgcgucaccauaaccugcuccgccuccuccuccgucaccuacauguacugguaccaacaaaaacccggcaaagcccccaaacuacucaucuacgacaccuccaaccucgcauccggcguccccucccgcuucuccggcuccggcuccggcaccgacuacaccuucaccaucuccucccuccaacccgaagacaucgccaccuacuacugccaacaaugguccucccacaucuucaccuucggccaaggcaccaaagucgaaaucaaacgcaccgucgcugcccccuccgucuucaucuucccacccuccgacgaacaacucaaauccggcacagccuccgucgucugccuccucaacaacuucuacccccgcgaagccaaaguccaauggaaagucgacaacgcccuccaauccggaaacucccaagaauccgucaccgaacaagacuccaaagacuccaccuacucccucuccucaacccucacccucuccaaagccgacuacgaaaaacacaaagucuacgccugcgaagucacccaccaaggccucuccucccccgucacaaaaucuuucaaccgcggcgaa

SEQ ID NO: 54053 - RNA, 1341 nt, Artificial Sequence
  derived and/or modified sequence opt11 from Mavrilimumab_HeavyChain1
caaguccaacucguccaauccggcgccgaagucaagaaacccggcgccuccguaaaagugagcugcaaaguaagcggcuacacccugaccgaacuaagcauacacuggguccgccaagcccccggcaaaggccucgaauggaugggaggcuucgaccccgaagaaaacgaaaucguauacgcccagcgauuccaaggacgcgucaccaugaccgaagacaccagcacggacaccgccuacauggaacucuccagccucagaagugaagacacugccgucuacuacugcgccaucguaggcagcuucagcccacucacacucggccucuggggccaaggcaccaugguaaccgugagcuccgccuccacuaaaggacccuccgucuucccccucgcccccugcucacgcuccaccuccgaauccacagccgcauuaggcugccucgucaaagacuacuuuccagaaccagucaccguaagcuggaacuccggagcacuuacauccggcguacacaccuuccccgccguacuacaaagcuccggccucuacucacucuccuccgucguaacaguccccuccucuucccucggcacaaaaaccuacacgugcaacgucgaccacaaacccuccaacacgaaagucgacaaacgcguagaauccaaauacggcccacccugucccucgugccccgcccccgaauuucucggcggccccuccgucuuccucuucccacccaaacccaaagacacacuuaugauuucaaggacacccgaaguaaccugcgucgucguagacguuucccaagaagaccccgaaguacaauucaacugguacguagacggcguagaaguacacaacgccaaaacaaaaccaagagaagaacaauucaacucaaccuaccgagucgucuccguccucacaguccuucaccaagacuggcuaaacggcaaagaauacaaaugcaaaguauccaacaaaggccuacccucaagcaucgaaaagaccauaagcaaagccaaaggccagccccgcgaaccucaagucuacacccucccacccagccaagaagaaaugaccaaaaaccaggucucccuaacaugccucgucaaaggauucuaccccuccgacauagccguagaaugggaaagcaacggacaacccgaaaacaacuacaaaacuacacccccaguccucgacucggacggauccuucuuccucuacucacgccucaccgucgacaaaucccgcuggcaagaaggcaacguauucagcugcucugucaugcacgaagcccuccacaaccacuacacccagaaaagucucagccuuagccuaggcaaa

SEQ ID NO: 54054 - RNA, 651 nt, Artificial Sequence
  derived and/or modified sequence opt11 from Mavrilimumab_LightChain1
caauccguccuuacccaaccacccuccgucuccggcgcacccggccaacgcgucaccaucuccugcaccggcuccggcucaaacaucggcgccccauacgacgucuccugguaccaacaacuccccggcacagcccccaaacuccucaucuaccacaacaacaaacgacccuccggcguccccgaccgcuucucaggcuccaaauccggcacauccgccucccucgccaucaccggccuccaagccgaagacgaagccgacuacuacugcgcaaccgucgaagcaggacucuccggcuccgucuucggcggaggcacaaaacucaccguccucggccaacccaaagccgcccccucaguaacccucuucccccccucauccgaagaacuccaagcaaacaaagccacccucgucugccucaucuccgacuucuaccccggcgccguaaccgucgccuggaaagccgacuccucccccgucaaagcaggcgucgaaaccaccacccccucuaaacaauccaacaacaaauacgccgccuccuccuaccuaucccuaacccccgaacaauggaaaucccaccgauccuacuccugccaagucacccacgaaggcuccaccgucgaaaaaacagucgccccaaccgaaugcucc

SEQ ID NO: 54055 - RNA, 1359 nt, Artificial Sequence
  derived and/or modified sequence opt11 from MDX-1303_HeavyChain1
caaguacaacucguagaauccggcggcggcgucguccaacccggacgaucccuccgccucuccugcgccgcaucaggcuucacauucucauacuacggaaugcacuggguccgccaagcacccgguaaaggccucgaauggguagccgucaucuggcacgacgaauccauagucuacuacgccgacagcguuaagggccgcuucacuaucucgcgagacaacuccaaaaacacccucuaccuccagaugaacucccuccgagccgaggacaccgccgucuacuacugcacacgugaccccggcgaccccuacuacuacuacuacggccucgacgucuggggccaaggcaccaccgucacugucuccuccgccaguacaaaaggccccuccgucuucccccuagcaccauccuccaaaucuaccucaggcggcacagccgcacucggcugccuagucaaagacuacuucccagaaccagucacuguauccuggaacuccggcgcacucaccucuggcguccacacauuccccgccgugcuccaaucaucaggccucuacucccucuccuccgucguaaccguaccaucaucaucgcuaggcacccaaacuuauaucuguaaugucaaucacaaaccauccaacaccaaaguagacaagcgaguagagccuaaguccugcgacaaaacacacaccuguccucccugccccgcccccgaacuccuuggcggccccuccgucuucuuauucccucccaaacccaaagacacccuaaugaucucacgcacccccgaaguaaccugcgucguaguagacguaucacacgaagaccccgaagucaaauucaacugguacgucgacggcguagaaguccacaacgccaaaacuaaaccccgcgaagaacaguauaacucaaccuaccgcgucguuuccguccucacaguccuccaccaagacuggcucaacggcaaagaauacaagugcaaaguaucaaacaaagcccuccccgcccccaucgagaaaacaaucagcaaagccaaaggccaaccacgcgaaccacagguauacacacucccacccucccgcgaagaaaugaccaaaaaccaagucucacuuaccugccucgucaaaggcuucuaccccuccgauaucgcagucgaaugggaaagcaacggccagccagaaaacaauuacaaaacaacaccaccaguccucgacagcgacggaucauucuuccucuacuccaaacucacagucgacaaaucacgcuggcaacaaggcaacguguucuccugcucagucaugcacgaagccuuacacaaccacuacacccaaaaaucccucucccugucacccggcaaa

SEQ ID NO: 54056 - RNA, 645 nt, Artificial Sequence
  derived and/or modified sequence opt11 from MDX-1303_LightChain1
gaaaucguccucacccaauccccaggcacccucucccucucaccaggagaacgcgccacccucuccugccgcgccucccaauccgucuccuccuccuaccucgccugguaccaacaaaagcccggccaagccccucgccuccucaucuacggagccucaucacgagccaccggcauccccgacagauucuccggauccggcuccggcacagacuucacccucaccaucucccgccucgaacccgaagacuucgccguauacuacugccaacaauacggcucauccauguacaccuucggccaaggaaccaaacucgaaaucaaacgcaccguagccgcccccuccgucuucaucuucccacccucagacgaacaacuuaaaucaggcaccgccucagucgucugccuccucaacaacuucuacccccgcgaagccaaaguccaauggaaagucgacaacgcccuccaauccggcaacucacaagaaucaguaaccgaacaagacagcaaagacuccaccuacucccuauccuccacccucacccucuccaaagccgacuacgaaaaacacaaagucuacgccugcgaagucacccaccagggccucuccucccccgucacaaaauccuucaaccgaggcgaaugc

SEQ ID NO: 54057 - RNA, 1347 nt, Artificial Sequence
  derived and/or modified sequence opt11 from Mepolizumab_HeavyChain1
caaguaacccuucgcgaaucgggccccgcucucgucaaaccaacccagacccucacacucacaugcacagucagcggcuucucccucaccuccuacucaguccacuggguacggcaaccuccaggcaaaggacucgaauggcucggcgucaucugggcuuccggcggcacagacuacaauucugcccuaaugucacgccucucuaucucaaaagauacauccagaaaccaagucguccuaaccaugaccaacauggaccccgucgacacagccaccuacuacugcgcccgcgacccacccucaucacuccuccgccuggacuacuggggacgcggcacccccgucaccguauccucagccuccacaaaaggccccuccguauucccccucgcccccagcuccaaaucgaccuccggaggcacagccgcccucggaugccucgucaaagacuacuuccccgaacccguaaccgucuccuggaacucaggagcccuaaccuccggcguccacaccuuccccgcaguccuccaauccagcggacuauauucacuauccuccguugucaccguccccuccucaucucuuggcacacaaaccuacaucugcaacgucaaccacaaaccauccaacacaaaggucgacaaacgcguagaaccaaaauccugcgacaaaacccauaccugcccacccugccccgcccccgaacuccuaggcggacccucaguauuccuauucccacccaaaccaaaggacacgcuuaugaucucccgcacacccgaaguaacaugcguagucguagacguaagccacgaagaccccgaagucaaauucaacugguacguagacggcgucgaaguccacaacgcgaagaccaaacccagagaagaacaauacaacucaaccuaccgcgucguauccguccucaccguccuccaccaagacuggcuaaacggcaaagaauacaaaugcaaagucagcaauaaagcacuacccgcacccaucgagaagacaaucuccaaagccaaaggacaaccucgcgaaccacaaguauacacacucccacccucacgcgaagaaaugaccaagaaccaaguaucacuaaccugccucgucaaaggcuuuuaccccuccgacaucgccguagagugggaaucaaauggccaacccgaaaacaauuacaaaaccacucccccaguccucgacagcgacggcuccuucuuccucuacuccaaacuaaccgucgacaaguccagauggcaacaaggcaacguguucucaugcuccgucaugcacgaagcacuccacaaccacuacacccaaaaaucucucucccucucacccggaaag

SEQ ID NO: 54058 - RNA, 660 nt, Artificial Sequence
  derived and/or modified sequence opt11 from Mepolizumab_LightChain1
gacaucgugaugacacaaucacccgacagccuggccgugucccugggcgaacgcgcaaccauaaacugcaaaucgagccaaucccuccucaacagcggaaaccagaaaaacuacuuagccugguaccaacaaaaacccggacaaccacccaaacuccuaaucuacggcgcaagcacacgagaaagcggagucccagaccgguucucaggcucaggcuccggcacagacuucacccuaaccauaagcucacuccaagccgaagacguagccguauacuacugccaaaacguacacucauucccauucacauucggaggcggaaccaaacucgaaaucaaacgcacagucgcagcaccaagcguguucauauucccacccucagacgaacaacuaaaaucaggcacggccucggucguaugccuacucaacaacuucuacccgcgcgaggccaaaguccaauggaaagucgacaacgcacuacagagcgggaacucacaagaaagcguaaccgaacaagacagcaaagacucaaccuacagccugagcucaacccuaacccuaagcaaagccgacuacgaaaaacacaaaguauacgcaugcgaagucacgcaccaaggccuaagcucgcccguaaccaagagcuucaacaggggcgaaugc

SEQ ID NO: 54059 - RNA, 1350 nt, Artificial Sequence
  derived and/or modified sequence opt11 from Metelimumab_HeavyChain1
gaaguccaacucgucgaaagcggaggcggcguaguccaacccggccgcucccuacgucucuccugcgcagccagcggcuucaccuucuccuccuacggaaugcacuggguccgucaagcccccggaaaagaacucgaaugggucgccguuaucuccuaugacggcagcaucaaauacuacgccgacagcguaaaaggccgauucaccaucucccgcgacaacuccaaaaacacacucuaccuccaaaugaacucacuccgcgccgaagacacggcagucuacuacugcgcacgcacaggcgaauacucaggcuacgacaccgacccccaauacagcuggggccagggcaccaccguaacugucucauccgccuccaccaaaggcccuuccguauucccacucgccccaugcucccgauccaccuccgaaucgaccgcagcccucggcugccuaguaaaagacuacuuccccgaacccguaaccgucucauggaacuccggcgcacugaccucaggcguccacaccuuccccgccguccuccaaagcucaggccuauacucccucucauccgucguaacagucccuucauccucucuaggaacaaaaaccuacacaugcaacgucgaccacaaaccauccaauaccaaagucgacaaacgugucgaaucaaaauacggacccccaugccccuccugcccagcccccgaguuccuuggcggccccuccguauuccuguucccacccaaacccaaacccacacuuaugaucucaagaacacccgaaguaaccugcgucgucgucgacgucucacaagaagaccccgaaguccaauucaauugguacguugacggcgucgaaguccacaacgccaaaaccaaaccacgugaagaacaauuuaacuccaccuaccgcgucgucagcguccucacaguccuccaccaagacuggcucaauggcaaagaauacaaaugcaaggucagcaauaaaggccuacccucuuccaucgaaaagacuaucucaaaagccaaaggccaaccccgagaaccccaagucuacacccuacccccuucacaagaagaaaugaccaaaaaccaaguaucccucacaugccuaguaaaaggcuucuaucccucagacaucgcagucgaaugggaauccaacggccaaccagaaaacaacuacaaaaccacaccaccaguacucgacucugacggaucauuuuuccucuacucccgccucacugucgacaaaucaagauggcaagaaggaaacguauucuccugcucgguuaugcacgaagcccuacacaaccacuacacgcaaaaaucccuuucacuaagccuuggcaaa

SEQ ID NO: 54060 - RNA, 639 nt, Artificial Sequence
  derived and/or modified sequence opt11 from Metelimumab_LightChain1
gaaaucguccucacucaaucccccuccucccucuccgccuccgucggcgaccgcgucaccaucaccugccgagccucccaaggcaucggcgacgaccucggaugguaccaacaaaaacccggcaaagcccccauccuccucaucuacggcaccuccacccuccaaucaggaguccccucccgcuucuccggcucaggaucaggcacagacuucacccucaccaucaacucacuccaacccgaagacuucgccaccuacuacugccuccaagacuccaacuacccccucacauucggcggcggcacccgccucgaaaucaaacgcaccgucgccgcccccucagucuucaucuucccccccuccgacgaacaacucaaauccggcaccgccuccgucguaugccuccuaaacaacuucuacccccgcgaagccaaaguacaauggaaagucgacaacgcccuacaauccggcaacucccaagaauccguaaccgaacaagacuccaaagacucuaccuacucccucuccuccacccuaacccucagcaaagcagacuacgaaaaacacaaagucuacgccugcgaagucacccaccaaggcuuaucacccgucaccaaaucauucaaccgcggagaaugc

SEQ ID NO: 54061 - RNA, 1350 nt, Artificial Sequence
  derived and/or modified sequence opt11 from Milatuzumab_HeavyChain1
caaguccaacuccaacaauccggcagcgaacucaagaaacccggagccucagucaaagucuccugcaaagcaucaggcuacaccuucaccaacuacggagucaauuggaucaaacaagcccccggccaaggccuccaguggaugggcuggaucaaccccaacaccggcgaacccaccuucgacgacgacuuuaaaggucgcuucgccuucucccucgacaccuccguuuccaccgccuaccuccaaauauccagucucaaagccgacgacaccgcagucuacuuuugcucccgcucccgcggcaaaaacgaagccugguucgccuacuggggccaagguacccuuguaacaguaucaucugccuccaccaaaggcccgucaguuuucccccucgcccccuccuccaaauccaccuccggaggcaccgccgcccuaggcugccucgucaaagacuacuuuccugaacccguaaccguauccuggaacuccggcgcgcuaacaucaggcguacacaccuucccugcaguccuccaaagcucaggccucuauucccuauccucaguaguaacaguacccagcuccucacucggcacccaaaccuacauaugcaacguaaaccauaaacccuccaacacaaaagucgacaaacgcguagaacccaaauccugcgacaaaacccacacaugcccucccugccccgcccccgaacuacucgggggccccuccgucuuccuauuuccuccaaaacccaaagacacccuaaugauaucccgcacccccgaaguaaccugcguagucgucgacgucucccacgaagaccccgaagucaaauucaauugguacgucgacggcguagaaguccacaacgcaaaaaccaaaccccgcgaagaacaguacaacucaacauaccgcgucgucucaguucuaacuguacuccaccaagacuggcucaacggaaaagaauacaaaugcaaagucucuaacaaagcccuccccgcccccauagaaaagaccaucuccaaagccaaaggccaaccccgcgaaccccaagucuacacccucccacccuccagagaagaaaugaccaaaaaccaaguaucgcuaaccugucucguuaaaggauucuaccccuccgacaucgcaguagaaugggagucaaacggacaacccgaaaacaacuauaaaaccaccccacccguccucgacucugauggcucauucuuccucuacuccaagcucaccgucgacaaaucccgcuggcaacaaggcaacgucuucucaugcucuguaaugcacgaagcccuacacaaccacuacacccagaaaagccuuucccucucccccggcaaa

SEQ ID NO: 54062 - RNA, 657 nt, Artificial Sequence
  derived and/or modified sequence opt11 from Milatuzumab_LightChain1
gacauccaacucacccaaucaccccucucccucccaguaacccucggccaacccgccuccaucucaugccgcuccucccaaucccucguccaccgaaacggcaacaccuaccuccacugguuccaacaacgccccggccaaucuccccgccuacucauauacaccgucuccaaccgcuucuccggcguccccgaccguuucuccggcuccggcuccggaaccgacuucacucucaaaaucucccgcgucgaagccgaagacgucggcgucuacuucugcucccaaucaucacacgucccccccaccuucggcgccggcacccgucucgaaaucaaacgcaccgucgccgcccccuccguauucaucuucccccccuccgacgaacaacucaaauccggcaccgccuccgucguaugccuucuaaacaacuucuacccccgcgaagccaaaguccaauggaaagucgacaacgcccuccaaucaggcaauucccaagaauccgucaccgaacaagacuccaaagacuccaccuacucccuauccuccacccucacccuauccaaagccgauuacgaaaaacacaaaguauacgccugcgaagucacccaccaaggccucucaucacccgucaccaaauccuucaaccgcggcgaaugc

SEQ ID NO: 54063 - RNA, 1341 nt, Artificial Sequence
  derived and/or modified sequence opt11 from Mirvetuximab_HeavyChain1
cagguccaacucguccaauccggcgccgaaguaguuaaacccggcgcauccgucaaaaucucaugcaaagcaucaggauacaccuucaccggcuacuucaugaacugggucaaacaaucccccggacaaucacucgaauggaucggacgaauccaccccuacgacggagacacauucuacaaccagaaguuucaaggaaaagccacccucaccgucgacaaaucaagcaacaccgcccacauggaacuauuaucacuaaccuccgaagacuucgcugucuacuacugcaccagauacgacggcucccgagcaauggacuacuggggccaaggcaccaccguuaccguaucauccgcauccaccaaaggccccuccguguucccccuagcccccuccuccaaauccacaagcggcggcacagccgcccucggaugccuagucaaggacuacuuccccgaacccgucaccgucuccuggaacuccggcgcccucaccuccgggguacacaccuuccccgccguacuacaauccucaggacucuauucccuaucaagcguagucaccguccccucuucuucucuagguacccaaaccuacaucugcaacgucaaccacaaacccucuaacacaaaagucgacaagaaagucgaacccaaaucaugcgacaaaacacacaccugucccccaugccccgcccccgaacuccuaggcggcccuuccgucuuccuauucccacccaaacccaaagacacccucaugauaucccggacccccgaagucacaugcgucgucguagacgucagccacgaagaccccgaggucaaauucaacugguacgucgacggcgucgaaguccacaacgccaaaacaaaaccccgcgaagaacaauacaacuccacuuaccgcgucguaucaguacuaaccguccuucaccaagacuggcuaaacggaaaagaauacaaaugcaaagucuccaacaaagcccuccccgcccccauagagaaaacaaucuccaaagccaaaggccaacccagagaaccccagguauacacccuacccccaucccgcgacgaacucaccaaaaaccaagucucccuaaccugccucgucaaaggcuucuaccccuccgacauagccgucgaaugggaauccaacggccaaccagaaaacaacuacaaaaccacaccacccguccucgacucagacggcuccuucuuccucuacucaaaacucacagucgacaaaucccgauggcaacaaggcaacgucuucagcugcucagucaugcacgaagcccuccacaaccacuacacccaaaaaucccucucucucucccccggc

SEQ ID NO: 54064 - RNA, 654 nt, Artificial Sequence
  derived and/or modified sequence opt11 from Mirvetuximab_LightChain1
gacaucguccucacccaaucaccccucucccucgccguaucccuaggccaacccgccaucaucuccugcaaagcaucccaauccgucuccuucgccggaaccucccucaugcacugguaccaccaaaaacccggccaacaaccccgccuccucaucuaccgcgccuccaaccucgaagccggcguccccgaccguuucuccggcuccggcuccaaaacagacuucaccuuaacaaucucaccagucgaagccgaagacgcagccaccuacuacugccaacaaucccgagaauaccccuacaccuucggaggcggcaccaagcucgaaaucaaacgcaccgucgcagcccccuccguauucaucuucccgccauccgacgaacaacuaaaaucaggcacagcaucggucgucugccuccucaacaacuucuacccccgcgaagccaaaguccaauggaaagucgacaacgcccuccaauccggcaacucccaagaaucugucaccgaacaagacuccaaagacuccaccuacucccucucaucaacccuaacccucuccaaagccgacuacgaaaaacacaaagucuacgcaugcgaagucacccaccaaggccucucaucccccgucaccaaauccuucaacagaggcgaaugc

SEQ ID NO: 54065 - RNA, 1344 nt, Artificial Sequence
  derived and/or modified sequence opt11 from Modotuximab_HeavyChain1
caaguccaacuccaacaacccggcgcagaacucgucgaacccgggggcuccgucaaacuaagcugcaaagcaucuggcuacaccuucaccucacacuggaugcauugggucaaacaacgccccggccaaggacuagaauggaucggcgaaaucaacccauccuccggacgaaacaacuacaacgaaaaauucaagucaaaagccacccuaaccgucgacaaauccucuucaaccgccuacaugcaguucucaucacuaaccucagaagacucagcugucuacuacugcguccgcuacuacggcuacgacgaagccauggacuacuggggacaaggcaccucggucaccguauccuccgcaucuaccaaaggcccauccguguucccccucgcccccuccucgaaauccaccucagguggaaccgccgcccucggcugucucgucaaagacuacuuccccgaaccugucacggucucauggaacucaggcgcacucaccuccggcguacacaccuuccccgccguccugcaaucauccggacucuacucccucucaagcguugucaccguccccucauccucacuaggaacccagacguacaucugcaacgucaaccacaaacccuccaacaccaaggucgacaaaagaguagaacccaaauccugcgacaaaacacauaccugcccacccugccccgcacccgaacuccuuggaggccccuccgucuuccucuucccucccaaacccaaagacacccucaugaucucacgcacacccgaaguaaccugcgucgucgucgacgucucccacgaagaccccgaagucaaauucaauugguacgucgacggagucgaaguacacaacgccaaaaccaaaccccgagaagaacaauacaacucgaccuaccgcgucgucuccguccucaccguccuccaccaagacuggcucaacggaaaagaauacaaaugcaaaguauccaacaaagcccucccagcucccauagagaaaaccauuuccaaagccaaaggccaaccacgcgaaccacaagucuacacccuucccccaucacgagaagaaaugaccaagaaccaagucucccucacaugccuugucaaaggcuucuacccaucagacaucgcagucgaaugggaauccaacggccaacccgaaaacaacuacaaaaccacacccccuguacuugacucagacggcuccuucuuccucuacuccaaacuaaccguagacaaaagccgcuggcaacaaggcaacgucuucucaugcucagucaugcacgaagcccuacacaaccauuacacccaaaaaucacucucacuaucccccgga

SEQ ID NO: 54066 - RNA, 657 nt, Artificial Sequence
  derived and/or modified sequence opt11 from Modotuximab_LightChain1
gacaucgucaugacccaagccgcauucuccaaccccgucacacucggcacauccgccuccaucucaugccgauccuccaaaucacuccuacacuccaacggcaucacauaccucuacugguaccuccaaaaacccggccaauccccccaacuacucaucuaccaaauguccaaccucgccuccggcguucccgaccgcuucuccuccucuggcuccggcaccgacuucacccuccgcaucucccgcgucgaagccgaagacgucggcgucuacuacugcgcccaaaaccucgaacuccccuacaccuucggcggcggcaccaaacucgaaaucaaacgaaccgucgccgcccccuccgucuucaucuucccccccuccgacgaacaacucaaauccggcaccgcaucagucgucugccuccucaacaacuucuacccccgcgaagccaaaguccaguggaaagucgacaacgcccuccaaucaggaaacucccaagaauccgucacagaacaagacuccaaagacuccaccuacucccucuccuccacccuaacccucuccaaagccgacuacgaaaaacacaaagucuacgccugcgaagucacccaccaaggccucuccucccccgucaccaaauccuucaaccgcggcgagugc

SEQ ID NO: 54067 - RNA, 1347 nt, Artificial Sequence
  derived and/or modified sequence opt11 from Mogamulizumab_HeavyChain1
gaaguacaacucgucgaaucuggcggcgaccucguccaaccaggccgaucccuacgucucuccugcgcagcaucaggcuucauuuucuccaacuacggcauguccuggguccgacaagcucccggaaaaggccucgaaugggucgccaccaucucaucagccuccacuuacuccuacuaccccgacuccgucaaaggucgauuuaccaucucccgcgauaacgccaaaaacucacucuaccuccaaaugaacucccuccgcguagaagacaccgcccucuauuacugcggccgacacuccgacggcaacuuugccuucggcuacuggggucaaggcacccucgugacaguauccucagcaagcacaaagggccccuccgucuucccacuagcccccucauccaaauccacauccggaggcacagccgcccuuggcugccucguuaaagacuacuuccccgaacccgucacagucagcuggaacuccggcgcucucaccuccggcguccacacauuuccagcaguacuccaauccuccggccuguacucccucagcuccgucgucaccguacccuccuccucacucggcacccaaacauauaucugcaacgucaaccacaaacccuccaauacaaaagucgacaagaaagucgaacccaaauccugcgacaaaacgcacacaugcccacccugccccgcccccgaacuacucggcggucccuccgucuuccucuucccacccaaacccaaagacacccuaaugaucucccguacccccgaagucacaugcguagucgucgacgucagccacgaagaccccgaagucaaauucaauugguacgucgacgguguagaaguccacaacgccaaaaccaaacccagagaagaacaauauaacucuaccuaccgcguugucucaguccucaccguccuacaccaagacugguuaaauggcaaagaauacaaaugcaaagucuccaauaaagcucuccccgcccccaucgagaaaaccaucuccaaagccaaaggccaaccccgcgaaccccaagucuacacucucccacccucacgcgacgaacucaccaaaaaccaagucucccuaacuugccucgucaaaggauucuaccccucagacaucgccgucgaaugggaauccaacggccaacccgaaaacaacuacaagaccacaccacccguacucgacuccgacggcuccuucuuccuauacucaaaacucaccgucgacaaaucaagauggcaacaaggcaacgucuucuccugcucagucaugcacgaagcccuccacaaccacuacacccaaaaaucccucucccucucccccggcaaa

SEQ ID NO: 54068 - RNA, 657 nt, Artificial Sequence
  derived and/or modified sequence opt11 from Mogamulizumab_LightChain1
gacguccucaugacccaaucaccccucucccuccccgucacccccggcgaacccgccuccaucuccugccgcuccucccgcaacaucguacacaucaacggagacaccuaccucgaaugguaccuccaaaagcccggccaaucaccccaacuccucaucuacaaagucucaaaccgauucuccggcguaccagaccgcuucucaggcuccggcucaggcaccgacuucacccucaaaaucuccagaguagaagcagaagacgucggcgucuacuacugcuuccaaggcucccuccuccccuggaccuucggccaaggcaccaaagucgaaaucaaacgcaccgucgccgcccccuccgucuucaucuucccacccuccgacgaacaacucaaaucaggcacagccucagucgucugccuccucaacaacuucuacccccgagaagccaaaguccaauggaaagucgacaacgcacuccaauccggcaacucccaagaaucaguaaccgaacaagacuccaaagacucaaccuacucccucuccuccacccucacccucucaaaagccgacuacgaaaaacacaaagucuacgccugcgaagucacacaccaaggccucucaucacccgucaccaaaucauucaaccgaggcgaaugc

SEQ ID NO: 54069 - RNA, 1356 nt, Artificial Sequence
  derived and/or modified sequence opt11 from Monalizumab_HeavyChain1
caaguucaacucguacaguccggcgcagaaguaaagaaacccggcgccuccgucaaaguaucuugcaaagccuccgguuacaccuucaccagcuacuggaugaacuggguccgccaagcacccgggcaaggccucgaauggaugggucgaauagaccccuacgacucagaaacccacuacgcccaaaaacuacaaggccgcguaaccaugaccacugacaccucgaccuccaccgcauacauggaacuacgcucccuccgcagugaugacaccgccgucuacuacugcgcacgcggggguuacgacuucgacguaggcacucucuacugguucuucgacgucuggggccagggcaccaccguuaccgucucauccgccuccaccaaaggacccuccguauucccgcuagcacccuguucccgcagcaccucugaaucaaccgccgcacucggcugccucguaaaagacuacuuccccgaacccgucaccgucuccuggaacagcggagcccucaccuccggcguacacaccuuccccgccguccuccaauccuccggccuuuacucccucuccuccguugucacagucccuuccucaucacuaggcaccaaaaccuacaccuguaacgucgaccacaaacccucaaacaccaaagucgacaaacgcgucgaauccaaauacgguccacccugcccuccaugccccgcacccgaauuucucggagguccauccgucuuccucuuucccccaaaaccaaaggacacccucaugaucucccgaaccccagaaguaaccugcgucgucgucgacguaucccaagaagaucccgaaguccaguucaacugguacgucgacggaguagaaguacauaacgcuaaaaccaaaccccgagaagaacaauucaacucaaccuaccgcgucgucuccguccucacaguccuccaccaagacuggcucaacggcaaagaauacaaaugcaaagucuccaacaaagggcuccccucauccaucgaaaagacaaucuccaaagccaaaggccaacccagagaaccacaaguauacacccucccgcccucccaagaagaaaugaccaaaaaccaagucucacuuaccugccucguaaaaggauucuaccccucagacaucgccgucgaaugggaaucaaacggccaacccgaaaacaacuacaaaaccaccccacccguacucgauucagacggcagcuucuuccucuacucccgacucacugucgacaaaucccgcuggcaagaaggcaacgucuucucaugcucugucaugcacgaagcacuccauaaccacuacacacaaaaaucccucucccucucacucggaaaa

SEQ ID NO: 54070 - RNA, 642 nt, Artificial Sequence
  derived and/or modified sequence opt11 from Monalizumab_LightChain1
gacauccaaaugacccaaucccccuccucccuaucagccucagucggcgaccgcgucaccaucaccugccgcgccuccgaaaacaucuacuccuaccucgccugguaccaacaaaaaccaggcaaagcccccaaacuccucaucuacaacgccaaaacccucgccgaaggcguucccagccgcuucuccggcuccggcucaggaaccgacuucacccucaccaucuccucccuccaacccgaagacuucgccaccuacuacugccaacaccacuacggcaccccccgcaccuucggcggcggcaccaaagucgaaaucaaacgcaccgucgccgcccccagcguauucauauucccccccucagacgaacaacucaaaucaggcaccgccuccgucgucugccuccucaacaacuucuacccccgcgaagccaaaguccaauggaaaguagacaacgcccuccaaucaggcaacucacaagaauccgucaccgaacaagacucuaaagacuccaccuacucccucagcuccacccucacccucuccaaagcagacuacgaaaaacacaaagucuacgccugcgaagucacccaccaaggccuauccucccccgucaccaaauccuucaaccgaggcgaaugc

SEQ ID NO: 54071 - RNA, 1350 nt, Artificial Sequence
  derived and/or modified sequence opt11 from Motavizumab_HeavyChain
caaguaacacuacgagaauccggacccgcccucgucaaacccacacaaacccucacauuaaccugcaccuucucaggauucucccucuccaccgccggaaugucagucggcuggauccgacaaccucccggcaaggcucucgaauggcucgccgauaucuggugggacgacaagaaacacuacaaccccucacucaaagaccgccucaccauauccaaagacaccuccaaaaaccaaguaguacucaaagucacaaacauggaccccgcagacaccgccacauacuacugcgcccgcgacaugaucuucaacuucuacuucgacgucuggggccaaggcaccacaguaacaguaucauccgcauccaccaaaggacccuccgucuucccccucgccccauccucuaaaucgaccuccggaggcaccgccgcccuaggaugccucguaaaagacuauuuccccgaacccgucacagucucauggaacucaggcgcccuaacaucuggcguacacaccuucccagccguauuacaauccucaggccucuacucacucucaagcgucguuaccgucccuagcuccagccucggcacacaaaccuacauaugcaacgucaaccacaaacccucaaacaccaaagucgacaaacgcgucgaacccaaaucaugcgacaaaacacacacaugcccucccuguccagccccagaacuucuaggaggacccuccguauuccucuucccucccaagcccaaagacacccucaugaucucgcgaacccccgaagugaccugcguuguagucgacgugagccacgaagaccccgaagucaaauucaacugguacguggauggcgucgaaguucacaaugccaagaccaaaccccgagaagaacaauauaacucaaccuaccgcgucgucagcguacucaccguccuccaccaagacuggcuaaacgguaaggaguacaaaugcaaagucuccaacaaagcacuacccgcccccaucgagaaaaccaucuccaaagcaaaaggccaaccccgugaaccccaaguuuacacccuaccucccucccgcgaagaaaugaccaaaaaccaagucucacuaaccugucucgucaaaggcuucuaccccuccgacaucgccgucgaaugggaaucaaacggccaaccugaaaauaacuacaaaaccacaccacccguccucgacucagacggaucauuuuuccucuacuccaaacucaccgucgacaaaucccgcuggcaacagggcaacguauucuccugcuccguuaugcacgaagcccuccacaaccacuacacccaaaagucacuaucccuaucacccggcaag

SEQ ID NO: 54072 - RNA, 1350 nt, Artificial Sequence
  derived and/or modified sequence opt11 from Motavizumab_HeavyChain_variant
caaguaacucuccgagaauccggucccgcccucgucaaacccacccaaacacucacccugaccugcacauucuccggcuuuucccugucaacagcuggcaugucaguaggauggauccgccagccccccggcaaagcccucgaauggcucgcagacaucuggugggacgauaaaaaacacuacaaccccucccucaaagaccgccucacaaucucaaaagacacaucaaaaaaccaagucguccuaaaagucaccaacauggaccccgccgacaccgccaccuacuacugcgcccgagacaugaucuucaacuucuacuucgacgucugggggcaaggcaccacagucacaguaucauccgccuccaccaaaggccccuccgucuucccccucgccccauccuccaaauccaccuccggcggcacagccgcccucggaugccucgucaaagacuacuuccccgagcccgucacagucucauggaacuccggcgcccuaaccucaggcguccacacauuccccgccguccuacaaucuuccggacucuacucccuaucauccguagucaccgucccauccuccucccucggcacccagaccuacauaugcaacgucaaccacaaaccguccaacaccaaagucgauaaacgcgucgaaccuaaauccugcgacaaaacccacacaugcccccccugccccgcacccgaacucuuaggcggccccucgguuuuccuauuccccccgaaacccaaagacacccucaugauaucacgcacacccgaagucaccugcgucgucguagacgucucccacgaagacccagaagucaaauucaacugguacgucgacggcgucgaaguccacaacgcuaaaaccaaaccgcgugaagaacaauacaacucaaccuacagagucguauccguccucacaguccuccaccaagacuggcucaacggaaaagaguacaaaugcaaagucucgaacaaagcccucccagcaccaaucgaaaaaacuaucuccaaagccaaaggccaaccucgugaaccccaagucuacacauuaccccccucccgcgaagaaaugaccaaaaaccaaguaucacuaacaugccucgucaaaggcuucuaccccagcgacaucgccgucgagugggaauccaacggccaacccgaaaacaacuacaaaacuacuccuccgguacucgacucugacggcucauucuuccuauacucaaaacuaacaguugacaaaucccgcuggcagcaaggcaacguauucucaugcuccguaaugcacgaagcccuccauaaccauuacacccaaaaaucccucucccucagcccuggcaaa

SEQ ID NO: 54073 - RNA, 639 nt, Artificial Sequence
  derived and/or modified sequence opt11 from Motavizumab_LightChain
gacauccaaaugacccaaucccccucaacccucucagccuccgucggcgaccgcgucaccaucaccugcucagccucuucccgagucggcuacaugcacugguaccaacaaaaacccggcaaagcccccaaacugcucaucuacgacaccuccaaacucgccuccggcguccccuccagauucuccggcuccggcuccggcaccgaauucacccuaaccaucagcucccuccaacccgacgacuucgccacauacuacugcuuccaaggcuccggcuaccccuucaccuucggcggcggcaccaaagucgaaaucaaacgcaccgucgccgcccccuccgucuucauauucccccccuccgaugaacaacucaaauccggcaccgccucagucgucugccuccucaacaacuucuacccccgcgaagccaaaguacaauggaaagucgacaacgcccuccaauccggcaacucacaagaauccgucaccgaacaagacuccaaagacuccaccuacucccuauccuccacccucacccucuccaaagccgacuacgaaaaacacaaagucuacgccugcgaagucacccaccaaggccucuccucccccguaaccaaaucuuucaaccgcggcgaaugc

SEQ ID NO: 54074 - RNA, 639 nt, Artificial Sequence
  derived and/or modified sequence opt11 from Motavizumab_LightChain_variant
gacauccaaaugacccaaucccccuccacccucuccgccuccgucggagaccgcgucacaaucaccugcuccgcauccucccgcgucggcuacaugcacugguaucaacaaaaacccggcaaagcccccaaacuacucaucuacgacaccuccaaacucgccucuggcguucccucacgcuucuccggcuccggcucaggcaccgaauucacccuaacuaucuccucacuccaacccgacgacuucgccaccuacuacugcuuccaaggcucaggauacccauucaccuucggcggcggcacaaaagucgaaaucaaacgcaccgucgccgccccauccgucuucaucuuccccccuucagacgaacaacuaaaaucuggcacagccuccgucgucugccuccucaacaacuucuacccccgcgaagccaaaguccaauggaaagucgacaacgcccuucaauccggaaacucccaagaauccgucaccgaacaagacuccaaagacucaaccuacucccucuccuccacccucacacucuccaaagccgacuacgaaaaacacaaagucuacgcaugcgaagucacccaccaaggccuauccucccccgucaccaaaucauucaaccgaggcgaaugc

SEQ ID NO: 54075 - RNA, 1428 nt, Artificial Sequence
  derived and/or modified sequence opt11 from Moxetumomab_pasudotox_HeavyChain1
auggaagugcaacucgucgaauccggcggaggucuggucaagcccggaggcucacucaaacucuccugcgcagccagcggauucgccuucagcauauacgacaugucguggguacgacaaaccccagaaaagugccuagaauggguagccuacaucagcagcggcggaggcacgacauacuaccccgacacagucaagggaagauucacaauaucccgcgacaacgccaaaaacacccuauaccugcaaaugagcucacucaaguccgaagacacagcaauguacuacugcgcgcgccacagcggauacggcacccacuggggaguccuauucgcauacuggggacaaggcacgcucgugaccguaagcgcaaaagcuagcggcggcccagaaggaggaucacucgcagcacucaccgcacaccaagccugccaccucccccuagaaacauucacaagacaccgacaaccuagaggcugggaacaacuagaacaaugcggcuaccccguacaacgauuaguggcccuauaccuagccgcaagacuauccuggaaccaagucgaccaagucauaagaaacgcccuagccuccccgggcucaggaggagaccucggcgaagccauacgcgaacaaccagaacaagccagacuugcccucacacucgcagccgcagaauccgaaagauucguccgacaaggcacaggaaacgacgaagcaggagccgccaacggccccgcagacagcggagacgcccuacucgaacgcaacuacccaacgggagccgaguuccucggagacggcggggacguauccuucuccacacgugggacccaaaacuggaccguagaacgacuacugcaagcgcaccgacaauuagaagaacgcggauacgucuucgucggauaccauggaacguuccucgaagccgcacaaucgaucguauucggaggcguacgcgcaagaucacaagaccuagacgccauauggcgaggcuucuacauagcaggcgacccagcacuagcauacggauaugcccaagaccaggaaccagacgcacgaggacgcauaagaaacggcgcacuccuaagaguguacgugcccagaagcucccuaccaggauucuaccgaaccucacucacccucgccgccccagaagcggccggagaaguagaaagacuaaucggccacccacuaccccugcgacuagacgcaaucacaggacccgaagaagaagggggcagacuagaaaccauacucggcuggccgcuagcagaaagaacuguagucaucccaagcgcaaucccaacggacccacggaauguagggggagaccucgacccaucaagcaucccagacaaagaacaagcgauauccgcccuacccgacuacgcaagucagcccggcaaaccacccagagaagaccuaaaa

SEQ ID NO: 54076 - RNA, 324 nt, Artificial Sequence
  derived and/or modified sequence opt11 from Moxetumomab_pasudotox_LightChain1
auggacauccaaaugacccaaaccaccuccucccucuccgccucccucggcgaccgcgucaccaucucaugccgcgccucccaagacaucuccaacuaccucaacugguaccaacaaaaacccgacggcaccgucaaacuccucaucuacuacaccuccauccuccacuccggcguccccucccgcuucuccggcuccggcuccggcaccgacuacucccucaccaucuccaaccucgaacaagaagacuucgccaccuacuucugccaacaaggcaacacccuccccuggaccuucggcugcggcaccaaacuagaaaucaaa

SEQ ID NO: 54077 - RNA, 1350 nt, Artificial Sequence
  derived and/or modified sequence opt11 from Muromonab-CD3_HeavyChain
caaguccaacuucaacaauccggagccgaacuagcacgacccggagcaucagucaaaauguccugcaaagccuccggcuauaccuuuacaagauacacaaugcacugggucaaacaacgccccggacaaggccuagaauggauaggcuacaucaaccccucccgaggcuacaccaacuacaaccagaaauucaaagacaaagcaacacuaaccaccgacaaguccuccuccaccgcauacaugcaacuauccagccucacauccgaagacucugcagucuacuacugcgcccgauacuacgacgaccacuauugccucgacuacuggggccaaggcaccacacucaccgucuccuccgccaagaccaccgccccaucaguauacccacuugcuccuguaugcggcggcacaaccggauccucagucacccugggcugccuagucaaaggcuauuuccccgaacccguuacccucaccuggaacuccggcagccucucauccggaguccacaccuuccccgccguccuccaaucagaccuauacacccuauccucaucuguaaccgucaccucuuccaccuggcccucccaguccauaaccugcaauguagcccaccccgccuccucaaccaaagucgacaagaaaaucgaacccagacccaaauccugcgacaaaacucacaccugucccccaugccccgcccccgaacuccucggcggccccucagucuuccuauucccacccaaacccaaagacacacucaugaucucccguacacccgaaguaaccugcgucguugucgacgucucucacgaagaccccgaagucaaauucaacugguacguagacggugucgaaguccacaacgccaaaaccaaacccagagaagaacaauacaacuccaccuaccgugucgucucaguccucaccguacuccaccaagacuggcucaacgguaaagaauacaaaugcaagguuuccaacaaggcgcuccccgcacccaucgagaaaacaauauccaaagccaaaggucaaccacgggaaccccaaguuuacacgcucccacccucacgcgacgaacucaccaaaaaccaaguaagccuaaccugccucguaaaaggcuucuaccccucagacauagccgucgaaugggaaagcaacggacaacccgaaaacaacuacaaaaccacacccccaguccuugacucagacggcuccuucuuccucuacuccaagcucacuguagauaaguccagauggcaacaaggcaacgucuucuccugcuccgucaugcacgaagcacuacauaaccacuacacucaaaaaucucuuucacuaucccccggcaaa

SEQ ID NO: 54078 - RNA, 639 nt, Artificial Sequence
  derived and/or modified sequence opt11 from Muromonab-CD3_LightChain
caaauaguccuuacccaaucucccgccaucaugucagccucccccggagaaaaagucaccaugaccugcuccgcaucauccucagucuccuacaugaacugguaccaacaaaaauccggcacaucccccaaacgcuggauauacgacaccucaaaacucgccuccggaguccccgcccacuuccgcggcuccggcuccggcaccucauacucccucaccaucuccggcauggaagccgaagacgccgcaacauacuacugccaacaauggucuuccaaccccuucaccuucggauccggcaccaaacucgaaaucaaccgcgcagacaccgcacccaccgucuccaucuucccccccuccucagaacaacucaccuccggcggagccuccgucgucugcuuccucaacaauuucuaccccaaagacaucaacgucaaauggaaaaucgacggcuccgaacgccaaaacggcguacucaacuccuggaccgaccaagacuccaaagacuccaccuacucaauguccuccacacucacccucaccaaagacgaauacgaacgccacaacucauacaccugcgaagccacacacaaaacauccaccucccccauagucaaauccuucaaccgcaacgaaugc

SEQ ID NO: 54079 - RNA, 1347 nt, Artificial Sequence
  derived and/or modified sequence opt11 from Namilumab_HeavyChain1
caaguacagcuaguccaauccggcgcugaaguaaagaaacccggcgccuccgugaaaguauccugcaaagccuucggcuacccguucaccgacuaccuccugcacuggguccgacaagcccccggccaaggccuugaauggguaggcuggcucaaccccuacucuggcgacaccaacuacgcacaaaaauuccaaggucgagucaccaugacccgugacaccuccaucuccaccgccuacauggaacucucucgacuccgcucagacgacacugccgucuacuacugcacucgcaccacccuaaucucagucuacuuugacuacuggggacaaggaaccaugguaaccguaucuucagccuccaccaaaggacccuccgucuucccacucgccccauccuccaaaucaacuucaggcggcacagccgcccucggcugccuagucaaagacuacuuccccgaacccgucacaguauccuggaacucaggagcccuaaccuccggcguccacaccuucccagcaguccuacaaagcucaggacucuacucccucuccuccgucguaaccguccccuccagcucucucggcacccaaacuuacaucugcaacgucaaccacaaacccucaaacaccaaagucgacaagaaagucgagcccaaauccugcgacaaaacccacacaugcccacccugccccgcccccgaacuucucggaggccccuccgucuuccuauuucccccaaaacccaaagacacccucaugaucucccgaacccccgaaguaaccugcgucgucgucgacguaucccacgaagacccagaagucaaauucaacugguacgucgacggaguggaaguccacaacgccaaaaccaaaccccgcgaagaacaguacaacucaaccuaccgagucguuuccguccucaccguccuccaccaagacuggcucaacggcaaagaauacaaaugcaaaguauccaacaaggcccuccccgcccccauugagaaaaccauuuccaaagccaaaggccaaccccgcgagccacaagucuacacccucccucccucccgcgacgaacucaccaaaaaccaagucucccuuacaugccucgucaaaggcuucuaccccuccgacaucgccgucgaaugggaaucuaauggccaaccugaaaacaacuacaaaaccacacccccaguccucgacucagacggauccuucuuucucuacuccaaacucaccguugacaaaucccgcuggcagcaaggcaacgucuucucaugcuccguaaugcacgaagccuuacacaaccacuacacccaaaagucacucucgcucuccccaggcaaa

SEQ ID NO: 54080 - RNA, 642 nt, Artificial Sequence
  derived and/or modified sequence opt11 from Namilumab_LightChain1
gacauccaaaugacccaaucccccuccuccguuuccgcauccgucggcgaccgcgucaccaucgccugccgcgccucccaaaacauccgaaacauccucaacugguaccaacaacgccccggcaaagcaccccaacuccucaucuacgccgccuccaaccuccaauccggaguccccucccgcuucuccggcuccggcuccggcacagacuucacccucaccauaaacucccuccaacccgaagacuucgccaccuacuacugccaacaaucauacuccaugccccguaccuucggcggcggcaccaaacucgaaaucaaacgcaccgucgccgcccccuccgucuucaucuucccacccucagacgaacaacucaaauccggcaccgccuccgucguaugccuacucaacaauuucuacccccgcgaagccaaaguccaauggaaagucgacaacgcccuccaaucaggcaacucccaagaauccguaaccgaacaagacuccaaagacuccacauacucccuauccuccacccuaacccucuccaaagccgacuacgaaaaacacaaagucuacgccugcgaagucacacaccaaggccucuccucccccgucaccaaauccuucaaccgcggcgaaugc

SEQ ID NO: 54081 - RNA, 1374 nt, Artificial Sequence
  derived and/or modified sequence opt11 from Naptumomab_estafenatox_HeavyChain
gaaguacaacuacaacaaagcgggccagaccuagucaaacccggcgcaagugucaaaauauccugcaaagccuccggauacucauucaccggcuacuacaugcacugggucaaacaaucacccgggaaaggccucgaauggauuggcagaaucaacccaaacaacggcgucacacuauacaaccaaaaauucaaggacaaagcaacccucaccgucgacaaauccucaaccacggccuauauggagcuccgcucucucacaucagaagacuccgccgucuacuacugcgcaagauccaccaugaucacaaacuacgugauggacuauuggggccagggaacuuccgucaccguauccucagccaaaacaacucccccaucaguauacccccucgcacccggcuccgcagcccagaccaacuccauggucacccuuggcugccuggucaaaggcuacuucccagaaccagucaccguaacauggaacuccggaucccucucauccggcguacacacauuccccgccguccuccaaagcgaccucuacacccucucaucaagcgucaccguccccucgucaacauggccgucagaaaccguaaccugcaacguagcacaccccgccuccuccaccaaagucgacaagaaaauagucccacgcgacuccggaggacccucagaaaaaucugaggaaaucaacgagaaagaccuccgaaagaaauccgaacuccaaggaacugcccuuggcaacuuaaaacaaauauacuacuacaacagcaaagcaauaacaucguccgaaaaaucagccgaccaauuccuaaccaacacacuccuauuuaaaggcuucuucaccggccaccccugguacaacgaccuccucgucgaccugggcagcaccgccgccaccuccgaauacgaaggcucguccgucgaccuguacggcgccuacuacggcuaccagugcgcgggcggcacacccaacaaaaccgcaugcauguacggaggaguaacccuacacgacaacaaccgccuaacagaagaaaagaaaguacccaucaaccuauggaucgacggaaaacaaacaacaguaccaaucgacaaaguaaaaacaucuaagaaagaggucacgguccaagaacucgaccuccaagcccgacacuaccuacacggcaaauucggccucuacaauuccgacucauucggcggaaaaguacaacgaggccuaaucguauuccacuccucagaaggauccaccgucagcuacgaccucuucgacgcccaaggacaauaccccgacacccuacucagaaucuaccgcgacaacacuaccaucucauccaccucccucucaaucucacuauaccuauacacaacc

SEQ ID NO: 54082 - RNA, 642 nt, Artificial Sequence
  derived and/or modified sequence opt11 from Naptumomab_estafenatox_LightChain
uccaucgucaugacccaaacccccaccucccuccucguauccgccggcgaccgcgucaccauaaccugcaaagccucccaauccgucuccaacgacgucgccugguaccaacaaaaacccggccaaucccccaaacuccucaucuccuacaccuccucccgcuacgccggcgucccagaccgauucucagguuccggcuacggcaccgacuucacccuaaccaucuccucaguccaagccgaagacgcagccgucuacuucugccaacaagacuacaacucaccacccaccuucggaggcggcaccaaacucgaaaucaaacgcgcagacgccgcccccaccgucuccauauucccacccuccuccgaacaacucaccuccggcggagccuccgucguaugcuuccucaacaacuucuaccccaaagacaucaacgucaaauggaaaaucgacggcucagaacgccaaaacggcguccucaacucauggaccgaccaagacuccaaagacuccaccuacuccauguccucaacccucacccucaccaaagacgaauacgaacgccacaacuccuacacaugcgaagccacccacaaaaccuccaccucccccaucgucaaauccuucaaccgcaacgaaucc

SEQ ID NO: 54083 - RNA, 1356 nt, Artificial Sequence
  derived and/or modified sequence opt11 from Narnatumab_HeavyChain1
gagguccaacucgucgaauccggaggcggccucguacagcccggaggcucccuccgacucagcugcgccgccucgggcuucaccuucagcagcuaccuaaugaccugggucagacaagcccccggcaaaggccucgaaugggucgccaacaucaaacaggacggaagcgagaaauacuacguagacuccgucaagggccgguucaccaucucacgcgacaaugccaaaaacagccucaaccuccaaaugaacucauuaagagcagaagacaccgcagucuacuacugcacccgagacggauacuccagcggccggcauuacggcauggacguauggggccaaggcaccacagucauagucuccuccgcaucaacaaaaggccccuccgucuuuccccuagcaccguccucaaaaagcacauccggcggcacagcagcccucggcugccucgucaaagacuacuucccagaacccgucaccgucuccuggaacucaggcgcacuaaccuccggaguacacaccuuccccgcaguccuacaauccuccggacuauacucccucagcucagucguaaccguuccuuccuccucccuaggcacccaaacauacaucugcaacguaaaccacaaaccguccaacaccaaaguagacaaacgcgucgaaccaaaauccugcgacaaaacccauaccugcccucccugccccgcccccgaacugcucggaggccccagcgucuuccuguucccacccaaacccaaagacacacucaugauaucacgaacucccgaaguaaccugcgucgucguagacgucucccacgaagaccccgaagucaaauucaacugguacguagauggagucgaaguacacaacgccaaaaccaaaccccgagaagaacaauacaacucaaccuaccgcgucguaucaguucucaccguccuccaccaagacuggcuaaacggaaaagaauacaaaugcaaggucucaaacaaagcccuaccagcccccauagagaaaacaaucuccaaagccaaaggacagcccagagaaccacaaguauacacccuacccccuucucgcgaagaaaugaccaaaaaccaggucucgcuaaccugccucgucaaaggcuucuacccuuccgacaucgcagucgaaugggaauccaacggccaacccgaaaacaacuacaaaacaacaccacccguacucgacucagacggaucuuucuuccucuacuccaaacucaccguagacaagucccgauggcaacaaggaaacgucuucuccugcucagucaugcaugaagcccuccacaaccacuacacccaaaaaucccucucacucagccccggcaaa

SEQ ID NO: 54084 - RNA, 642 nt, Artificial Sequence
  derived and/or modified sequence opt11 from Narnatumab_LightChain1
gaaaucguccucacacaaucccccgcaacccuaucccucucccccggcgaacgcgccacccucuccugccgcgcaucccaauccgucagccgcuaccucgcaugguaccaacaaaaacccggccaagcaccccgacuacucaucuacgacgccuccaaccgcgccaccggcauccccgcccgcuucuccggcuccggcuccggcaccgacuucacccucaccaucuccucccucgaacccgaagacuucgccgucuacuacugccaacaaagauccaacuggccccgcaccuucggacaaggaaccaaagucgaaaucaaacgcaccgucgccgcccccuccgucuucaucuucccaccauccgacgaacaacuaaaauccggcaccgccucagucgucugccuccucaacaacuucuacccacgcgaagccaaaguccaauggaaagucgacaacgcccuccaauccggaaacucccaagaaucagucaccgaacaagacucuaaagacuccaccuacucccucuccuccacccucacccucuccaaagccgacuacgaaaaacauaaaguauacgccugcgaagucacccaccaaggccucuccucacccgucacaaaauccuucaaccgaggcgaaugc

SEQ ID NO: 54085 - RNA, 1350 nt, Artificial Sequence
  derived and/or modified sequence opt11 from Natalizumab_HeavyChain1
caaguccaacucguacaauccggcgcagaaguaaagaaacccggcgcauccgucaaagucuccugcaaagcauccggauucaacauaaaagacaccuacauccacuggguacgacaggccccaggccagcgccucgaauggaugggacgcauugacccagccaacggcuacaccaaauacgauccuaaauuccaaggaagagucaccaucaccgccgacaccucagccucaaccgccuacauggaacucucauccuuacguagcgaagacacagccgucuacuacugcgcccgcgaaggauacuacggaaacuacggcguauacgcgauggacuacuggggccaagggacacucgucaccguauccuccgcauccacuaagggccccuccguauucccccuugcccccugcucccgauccacaagcgaaagcacggccgcacucggaugccucguuaaagacuacuucccugaaccagucaccgucuccuggaacuccggcgcccugacauccggcguccacacuuucccagccguccuacaaagcagcggccuauacucccuauccagcguagucaccguccccucaucgagucucggaacaaaaacauacacaugcaacgucgaccacaaacccagcaacaccaaagucgacaaacgaguugaauccaaauacggcccacccugccccucaugucccgcccccgaguuccuaggcggccccuccgucuuccuuuucccacccaagcccaaagacacccucaugaucucccgaacgcccgaaguaacuugugucguaguagacguaucccaagaagaccccgaaguccaguuuaacugguauguagacggcgucgaaguccacaacgccaaaacaaaaccccgcgaagaacaauucaacuccaccuaccguguugucucaguccuaaccguccuacaccaagacuggcucaacggcaaagaauacaaaugcaaagucuccaacaaaggccuacccuccucaaucgaaaagaccauauccaaagccaaagggcaaccccgagaaccccaaguauacacccuaccacccucacaagaagaaaugacaaagaaccaagucucccucacgugccucgucaagggcuucuaccccuccgacaucgccgucgaaugggaaucaaacggccaacccgaaaacaacuacaaaaccacacccccaguacucgacuccgacggcuccuucuuccuauacucucgccucaccgucgacaaaagccgguggcaagaaggaaacgucuucucaugcucagucaugcacgaagcccuacacaaccacuacacccagaaaucccuaucccucucacuaggcaag

SEQ ID NO: 54086 - RNA, 639 nt, Artificial Sequence
  derived and/or modified sequence opt11 from Natalizumab_LightChain1
gacauccaaaugacccaaucccccuccucccucuccgccuccgucggagaccgagucaccauaaccugcaaaaccucacaagacaucaacaaauacauggccugguaccaacaaacccccggcaaagcaccccgccuccucauccacuacaccucagcccuccaacccggcaucccaucccgcuucuccggcuccggcuccggccgagacuacaccuucaccaucuccucccuccaacccgaagacaucgccaccuacuacugccuccaauacgacaaccucuggaccuucggccaaggcaccaaagucgaaaucaaacgcaccgucgccgcccccucagucuucaucuucccacccuccgacgaacaacuaaaaucaggcaccgccuccguagucugccuccucaacaacuucuacccccgcgaagccaaaguccaauggaaagucgacaacgcccuacaauccggaaacucccaagaauccgucaccgaacaagacuccaaagacuccaccuacucccuaagcucaacccuuacccucuccaaagccgacuacgaaaaacacaaagucuacgccugcgaaguaacccaccaaggccucucaucccccgucaccaaauccuucaaccgcggcgaaugc

SEQ ID NO: 54087 - RNA, 1335 nt, Artificial Sequence
  derived and/or modified sequence opt11 from Navicixizumab_HeavyChain1
caaguacaacucguccaaagcggagccgaagucaagaaacccggcgccuccgucaaaaucuccugcaaagccuccggcuacagcuucaccgccuacuacauccacugggucaaacaagccccaggccaaggccuagaguggaucggcuacauauccaauuacaaccgcgccacgaacuauaaccaaaaauucaaaggacgcgucaccuucaccacagacaccuccaccuccacagcauacauggaacuacgcucacugcgaucagacgauacugccgucuacuacugcgcacgcgacuacgacuacgacguaggaauggacuacuggggccaaggaacccucgucacagugagcucagcuuccaccaaaggacccuccguauucccccucgcucccugcucacgaagcacauccgaaagcacagccgcccucggcugccucguaaaggacuacuuccccgaacccguaacaguauccuggaacuccggagcacucaccucaggcguccacaccuuccccgccguccuccaguccucaggacucuacucccucuccuccgucguaaccgucccauccuccaauuucggaacccaaaccuacacaugcaacgucgaccacaaaccaagcaacaccaaagucgacaaaacaguggaacgcaaaugcugcguagaaugcccacccugccccgccccacccguagccggacccagcguauuccucuucccacccaaacccaaagacacccucaugaucucccgcacacccgaaguaaccugcgucguagucgacguaucacacgaagaccccgaaguccaauucaacugguacgucgacggaguggaaguccacaacgccaaaaccaagccucgagaagaacaauucaacuccaccuuccgaguugucuccguccucaccgucguacaccaagacuggcuaaacgguaaagaauacaaaugcaaagucuccaacaaaggccucccagccccuauagagaaaaccauauccaaaacuaaaggacaaccccgcgaaccccaagucuacacucuaccacccucucgagaagaaaugaccaaaaaccaaguaucccuaaccugccucgucgaaggauuuuaccccagcgacaucgcugucgagugggaguccaacggccaaccugaaaacaacuacaaaaccaccccacccaugcucgacucagacggcuccuucuuccucuacucagaauuaaccgucgacaaaagcagauggcagcaaggcaacguauucucauguucaguaaugcacgaagcccuccacaaccacuacacccagaaaucccucucccucucccccggaaaa

SEQ ID NO: 54088 - RNA, 1341 nt, Artificial Sequence
  derived and/or modified sequence opt11 from Navicixizumab_HeavyChain2
caaguacaacucguccaaagcggcgccgaaguaaaaaaaccaggcgcauccgucaaagucuccugcaaagccagcggauacaccuucacaaacuacuggaugcacuggguccgacaagcacccggccaaggccucgaauggaugggcgacaucaacccgagcaacggacgcaccuccuacaaagaaaaauucaaacgccgcgucacccucuccgucgacaaauccuccucaaccgcauacauggaacucuccucacuccgaucagaagauaccgccgucuacuucugcaccauccacuaugacgauaaauacuacccacucauggacuauuggggccaagguacucucgucacaguauccuccgccuccaccaaaggccccucgguauucccccucgccccaugcucccgcucaaccuccgaauccacagccgcacuaggcugucuagucaaagacuacuucccagaacccgucaccgucuccuggaauucaggcgcccucaccucaggcguacacaccuucccagcaguacuccaauccuccggacucuacucccuuagcuccguagugaccguccccuccagcaacuucggaacccaaaccuacaccugcaacgucgaccauaagcccucaaacaccaaagucgacaaaaccgucgaacgaaaaugcugcgucgaaugcccacccugccccgccccccccgucgccggcccauccgucuuccuauucccacccaaaccaaaagacacucucaugaucucucgaacuccugaagucaccugcguagucgucgacgucagucacgaagacccagaaguccaauucaacugguaugucgacggcgucgaaguccacaacgcaaaaaccaaaccacgcgaagaacaauucaacucuacauuccgcgucgucuccguacugaccgucguacaccaagacuggcucaacggaaaagaauacaaaugcaaagucuccaacaaaggacugcccgcgcccauagaaaaaacaaucucaaaaacaaaaggccaaccccgcgaaccccaaguguacacccuacccccgagccgagaaaaaaugaccaaaaaccaaguaucccuaacgugccucgucaaaggcuucuaccccuccgacaucgccgucgaaugggaaagcaacggccaacccgaaaauaacuacaaaacaacaccccccaugcucaaauccgacggauccuucuuccuuuacuccaaacucaccguugacaaaucacgcuggcaacaaggaaacgucuucuccugcuccguuaugcacgaagcccuacacaaccacuacacccaaaagucccucucacucucccccggcaaa

SEQ ID NO: 54089 - RNA, 654 nt, Artificial Sequence
  derived and/or modified sequence opt11 from Navicixizumab_LightChain1
gauaucgugaugacgcaaucacccgacagcuuagccgugagccugggcgaacgcgcgaccauaagcugccgagcaagcgagagcguagacaacuacgggaucucauucaugaaaugguuccagcaaaagcccggacaaccgcccaagcucuugaucuaugccgcgagcaaucaagggagcggggucccggacagguucucaggcucaggcucgggcacggacuuuacccugaccauaagcucgcuccaggccgaggacguagccguguacuacugccagcaaucgaaagaggucccguggacguucggaggagggaccaaggucgagauaaagcgaacggucgcggccccaagcguguucauauucccgcccucggacgagcaacugaaaucaggcacggccucggucgugugccuacucaauaacuuuuacccgcgcgaggccaagguccaguggaaagucgacaacgcgcuacagagcgggaacucgcaagaaagcguaaccgagcaagacagcaaggacucgaccuacagcuuaagcucgacccugaccuugagcaaggccgacuacgaaaaacacaaaguguacgcgugcgaagucacgcaccagggacugagcucacccgugaccaagagcuucaacaggggagagugc

SEQ ID NO: 54090 - RNA, 1368 nt, Artificial Sequence
  derived and/or modified sequence opt11 from Navivumab_HeavyChain1
caaguucagcuaguccaaucaggcgcagaaguaaagaaacccggcgccuccgucaaaguauccugcaaaaccuccggcuacucuuucuccacauacggcgucuccuggguccgccaagccccaggccaaggucccgaaugggucggcuggauauccgccuacaccggcaucaccgacuacgcccaaaaauuccaaggccgcgucacccucacaaccgacgccaccacagccaccgccuuccucgaccuccguucacuccgcccagacgacacagccaccuacuucugcgcacgugacaaaguccaaggccgcgucgaagucggcagcggcggacgccacgacuacuggggucaaggcacacucguaaucguauccucagccuccaccaaaggccccucaguauucccacucgcacccucaagcaaaucgaccagcggcggcaccgccgcccuaggaugccuuguaaaggacuauuuccccgaacccgucaccgucuccuggaacagcggagcccucacauccggcguccacacauucccggccguccuccaaagcuccggucucuacucacucuccucagucgucaccgucccaucauccucacuaggcacccaaaccuauaucugcaacguaaaccacaaacccucaaacaccaaagucgacaagaaagucgaacccaaauccugcgacaaaacgcacacuugcccacccugccccgcccccgaacuccucggcggccccuccguguuccuauuuccacccaaacccaaagacacccuaaugaucucacgcaccccugaaguaaccugcgucgucgucgacgucucacacgaagaccccgaagucaaauuuaacugguacgucgacggcguagaaguccacaacgcaaaaaccaaacccagagaagaacaauacaacuccacuuacagggucguaucuguacucaccguccuccaccaagacuggcuuaacggcaaagaauacaaaugcaaagucagcaacaaagcccuccccgcccccaucgaaaagacaauauccaaagccaaaggacaaccccgggaaccacaggucuauacacuaccucccucacgcgacgaacucacuaaaaaccaagucucccuaacaugccucgucaaaggcuucuauccaucugacaucgcugucgaaugggaaucuaacggccaaccugaaaacaacuacaaaaccacucccccaguacuagacagcgauggcucauucuuccucuacuccaaacucaccgucgacaaaucacgcuggcaacaaggaaacgucuucuccugcucagucaugcacgaaggccuccacaaccacuauacacaaaaaucccuuucccucagccccggaaaa

SEQ ID NO: 54091 - RNA, 645 nt, Artificial Sequence
  derived and/or modified sequence opt11 from Navivumab_LightChain1
gaagucguccuaacccaaagccccggcacccuagcacucccacccggagaacgcgccacccucagcugccgagccucccaccgagucggaucaacauacauagccugguaccaacaaaaauccggccaagcaccccgccgccuaaucuacggcgccuccaaccgcgccaccgacauccccgaccgcuucucaggcucaggcucaggcaccgacuucacccucacaauccgccgacuagaacccgaagacuccgccgucuacuacugccaacaauucagcgucagccccuggacauucggccaaggaacccgcgucgaaaucaaacgcacagucgccgccccauccgucuucaucuucccacccucagacgaacaacucaaauccggcaccgccuccgucgucugccuacucaacaacuucuacccccgcgaagccaaaguccaauggaaagucgacaacgcacuccaauccggcaacucacaagaauccguaaccgaacaagacuccaaagacucaaccuacucccucagcucaacccucacccuauccaaagccgacuacgaaaaacacaaaguauacgccugcgaagucacccaccaaggccuguccucacccgucaccaaaucauucaaccggggcgaaugc

SEQ ID NO: 54092 - RNA, 2172 nt, Artificial Sequence
  derived and/or modified sequence opt11 from Ndimab-varB_HeavyChain
cagguacaacucguagaguccggaggcggcgucguccaacccggccguucccuacgucucucuugcgcagcaagcggauucaucuucuccagcuacgccaugcacuggguacgccaagccccaggaaacggccuagaaugggucgccuucauguccuacgacggauccaacaagaaauacgccgacagcguaaaaggacgauucacaauuucccgagacaacuccaaaaacacacucuaccuacaaaugaacucacuccgcgcugaagacaccgcugucuacuacugcgcccgcgacagaggcaucucagcaggcggaaacuacuacuacuacggaauggacguuuggggacaagguaccaccguuaccguaucaucagcgagcaccaaaggccccucuguuuucccccucgcccccucuuccaaaaguacaucaggaggcacagccgcucuagggugccucgucaaagacuacuucccugaaccaguaacugugucauggaacuccggcgcccucaccagcgguguccacacauuccccgcaguccugcaauccagcggccucuacucccuaagcucugucgucaccgugccaagcuccucccuaggcacucaaaccuacauauguaacgucaaccacaaacccagcaacacgaaaguggacaaacgaguagaaccaaaauccugcgacaaaacccacaccugucccccaugcccagcacccgaacuccuaggcgguccaagcgucuuccuauucccuccaaaacccaaggacacacuuaugaucagccgcacucccgaggucacuugcguggucguggacgucagccacgaagaccccgaaguaaaauucaacugguacguagacggcguagaaguccacaacgcuaaaacuaaaccccgcgaagaacaguacaauucaacguaccgcgucguaucuguccucacuguccuacaccaagacuggcucaacggcaaagaauacaaaugcaaagucagcaacaaagcgcuacccgcaccaauugagaaaacaaucucaaaagcgaaaggucaaccacgcgaaccacaagucuauacacuacccccaucccgagaagaaaugacuaaaaaccaaguaucacuaacaugccucgucaaaggcuucuaccccuccgacaucgccgucgaaugggaaucuaacggacaacccgaaaacaacuacaaaaccaccccacccguccuugacucagacggaucauucuuccuauacuccaaacucacggucgacaaaucacgauggcaacaagguaacgucuucucaugcuccguuaugcacgaagcccuacacaaccacuacacccaaaaaucccucucccucucccccggaaagggcggaggcggcagcggaggcggcgguagccagguccagcuaguccaauccggggccgaagucaagaaaccaggguccucagucaaagucucaugcaaagcaucuggaggaaccuucuccacguacggcauaagcugggugcgacaagcccccggccaaugucucgaguggaugggcgggauuauccccaucuucgacacgggcaacuccgcucaauccuuccaaggacgcgucaccauaaccgccgacgaauccaccucaaccgccuauauggagcuaucgucccuccgauccgaagacacagcugucuacuacugcgcccgcucaucacgaaucuacgaccuaaaccccucccucaccgccuacuacgacauggacgucuggggccaaggcaccauggucaccguuuccucaggaggcggaggauccgggggaggcggcuccgguggcggcggaagcggcggaggcggcagccaauccguacuaacacagccgcccucagucuccgccgcucccggccaaaaagucacaaucuccugcuccggcagcagcuccaacaucggcaacaacuacgugucaugguaucaacaacuccccggcacagcccccaaacuacucaucuaugacaacaacaaaagacccucagggauccccgaccgauucuccggcuccaaauccggcaccucagccaccuuaggcaucacaggacuacaaaccggcgacgaagcagacuacuacugcggcaccugggacucuucccucucagccuggguauucggcugcggcacgaaacuaaccguccua

SEQ ID NO: 54093 - RNA, 645 nt, Artificial Sequence
  derived and/or modified sequence opt11 from Ndimab-varB_LightChain
gaaaucguccucacccaaucccccgccacccuuucccucucccccggcgaacgcgccacccucuccugccgcgcaucccaauccgucuacuccuaccucgccugguaccaacaaaaacccggccaagccccccgccuacuaaucuacgacgccuccaaccgcgccaucggcauccccgcccgcuucuccggcucaggauccggcaccgacuucacccucaccaucuccucccucgaacccgaagacuucgccgucuacuacugccaacaacgcuccaacuggccccccuucacauucggccccggcaccaaagucgacaucaaacgcaccgucgccgcccccuccgucuucaucuucccccccuccgacgaacaacuaaaauccggcaccgcauccgucgucugccuccucaacaacuuuuacccccgcgaagccaaaguccaauggaaagucgacaacgcccuucaauccggcaacucacaagaaucagucaccgaacaagacuccaaagacuccacuuacucccucuccuccacccucacccuauccaaagccgacuacgaaaaacacaaggucuacgccugcgaaguaacccaccaaggccucuccucccccguaaccaaaucauucaacagaggcgaaugc

SEQ ID NO: 54094 - RNA, 1353 nt, Artificial Sequence
  derived and/or modified sequence opt11 from Necitumumab_HeavyChain1
caaguccaguuacaagaauccggccccggccucguaaaacccucccaaacacucucauuaaccugcaccgucuccggcggcucgaucuccucaggagacuacuacuggucauggauccgccaaccacccggcaaaggccucgaauggaucggcuacaucuacuacuccggcuccaccgacuacaaccccucccucaaaucacgcguaacgauguccgucgacaccucgaaaaaccaauuuucauuaaaagucaacuccgucacagcagcagacaccgccgucuacuacugcgcccgcguauccauauucggagucggcaccuucgacuacugggggcaaggcacacucgucaccgucuccuccgccuccaccaaaggcccauccguccucccccucgcccccucguccaaauccaccucaggcggcaccgccgcccucggaugccucgucaaagacuacuuccccgaacccgucaccgucuccuggaacuccggcgcccucaccuccggcguccacaccuuccccgccguacuccaauccuccggacucuacucccucuccucagucguaacugucccaucaucaucccucggcacccagaccuacauaugcaacgucaaccacaaacccuccaacaccaaaguagacaagagagucgaacccaaaagcugcgacaaaacacacaccuguccacccugccccgcccccgaacuacucggcggcccauccguauuccuauucccuccaaaaccaaaagacacccucaugaucucccgaacccccgaagucacaugcgucgucgucgacguaagccacgaagauccagaaguaaaauucaacugguacguagacggagucgaaguucacaacgccaaaaccaaaccccgagaagaacaauacaacagcaccuaccgcgucgucuccguccucacaguacuccaccaagacuggcuaaacggcaaagaauacaaaugcaaagucuccaacaaagcacucccagcucccauugaaaagacaauauccaaagccaaaggccaaccaagagaaccucaaguauacacccuacccccaucacgcgaagaaaugaccaaaaaccaggucucccucacaugccucgucaaaggauucuaucccuccgacaucgccgucgagugggaauccaauggccaaccagaaaacaauuacaaaacaaccccacccguacucgacucagacggauccuucuuccucuacuccaaacucaccgucgacaaaucccgcuggcaacaaggcaacguuuucucgugcuccguaaugcacgaagcccuacauaaccacuacacccaaaaaucucuaucccucucccccggcaaa

SEQ ID NO: 54095 - RNA, 642 nt, Artificial Sequence
  derived and/or modified sequence opt11 from Necitumumab_LightChain1
gaaaucgucaugacacaaucccccgccacccuaucccucuccccaggcgaacgcgccacccuauccugccgcgcaucccaaucaguaagcuccuaccucgccugguaccaacaaaaacccggccaagcccccagacuccucaucuacgacgccuccaaccgcgccacaggcauccccgcacgcuucuccggcuccggcuccggcaccgacuucacccucaccaucuccucccucgaacccgaagacuucgccguauacuacugccaccaauacggcuccaccccacucaccuucggcggcggcaccaaggccgaaaucaaacgcaccgucgccgcccccuccgucuucaucuucccacccuccgacgaacaacuaaaauccggcaccgccuccgucgucugccuucuaaacaacuucuacccccgcgaagcuaaaguccaauggaaagucgacaacgcccuccaauccggcaacucccaagaauccgucacugaacaagacuccaaagacuccaccuacucccucuccuccacccucacccuauccaaagccgacuacgaaaaacacaaagucuacgccugcgaagucacccaccaaggccuauccucccccguaaccaaauccuucaaccgcggcgaaugc

SEQ ID NO: 54096 - RNA, 396 nt, Artificial Sequence
  derived and/or modified sequence opt11 from Neliximab_HeavyChain_VH-Region
gaaguacaacuacaacagagcgggcccgaacucguaaaaccgggcgcaagcguaaaaaugagcugcaaagcaagcggauacacauucacgaccuacgucaugcacugggucaaacaaaagcccggacaaggacucgaauggauaggcuacaucaaccccuacaacgacggcacaaacuacaacgaaaaauucaaagggaaagcgacccugaccucagacaaaagcucaagcacggccuacauggaacucucaacccuaaccucagaagacagcgcggucuacuacugcgccgaauucauaaccaagaccguaggcggaagcaacugguaccucgacgucuggggcgcaggcacgaccgugaccguaagcucagccaagaccacacccccaaaacug

SEQ ID NO: 54097 - RNA, 372 nt, Artificial Sequence
  derived and/or modified sequence opt11 from Neliximab_HeavyChain_VH-Region_variant1
caagugcaauugaaacagagcgggcccgagcucgugaaaccgggcgcgagcgugaaaaugagcuguaaagcgagcggguacacguucacgaccuaugucaugcacugggucaagcaaaagcccgggcaagggcucgaguggauaggcuauaucaaucccuauaacgauggcacgaacuauaacgagaaauuuaaagggaaagcgaccuugaccucggacaagagcucgagcacggccuauauggagcucucgacccugaccucggaagauagcgcggucuauuacugugccgaguucauaaccaagaccgugggcgggagcaauugguaucucgaugucuggggcgcgggcacgaccgugaccgugagcucg

SEQ ID NO: 54098 - RNA, 318 nt, Artificial Sequence
  derived and/or modified sequence opt11 from Neliximab_LightChain_VL-Region
gacaucguccucacccaaucccccgccaucauguccgccucccccggcgaaaaagucaccaugaccugcuccgccuccuccuccaucuccuacauccacugguuccaacaaaaacccggcaccucccccaaacgcuggaucuacgacaccucaaaacuccccuccggcguccccgcacgcuucuccggcuccggcuccggcaccuccuacucccucaccaucuccuccauggaagccgaagacgccgccaccuacuacugccaccaacgcuccuccuacaccuggaccuucggcggcggcaccaaacucgaaaucaaa

SEQ ID NO: 54099 - RNA, 354 nt, Artificial Sequence
  derived and/or modified sequence opt11 from Neliximab_LightChain_VL-Region_variant1
caaaucguccucacccaaucccccgccaucauguccgccucccccggcgaaaaagucaccaugaccugcuccgccuccuccuccaucuccuacauccacugguuccaacaaaaacccggcaccucccccaaacgcuggaucuacgacaccuccaaacuccccucaggcguacccgcccgcuucucaggcuccggcuccggcaccuccuacucccucaccaucuccuccauggaagccgaagacgccgccacauacuacugccaccaacgcuccucauacaccuggaccuucggcggaggcaccaaacuagaaaucaaacgcgccgacgccgcccccaccgucuccgccgccgcc

SEQ ID NO: 54100 - RNA, 1335 nt, Artificial Sequence
  derived and/or modified sequence opt11 from Nemolizumab_HeavyChain1
caaguccaacucguccaaucaggcgccgaagucaagaaaccgggcgcaagcguaaaaguaagcuguaaagcuagcggauacacuuuuacggguuacaucaugaacuggguccgccaggcuccuggccaaggucuagaauggaugggcuuaaucaaccccuacaacggcggcaccgacuacaauccacaauuccaggaccgaguaaccaucaccgcagacaaaucaaccuccaccgcauacauggaacucuccucacuaagaagcgaagacaccgccgucuacuauugcgcccgggacggcuacgacgauggccccuacacccuagaaacauggggccaaggaacccucguaaccgucuccuccgccuccaccaaagggccauccguauucccccuugcaccaucaagcaaaagcaccuccggaggcaccgccgcccucggcugccucgucaaagacuacuuucccgaacccgucaccgucuccuggaacucaggcgcacuaaccuccggaguccacaccuuccccgccguccuacaguccuccggccucuacucccucuccuccgucgucacaguccccucaucaaacuucggcacccaaacauauaccugcaacgucgaccacaaacccuccaacacaaaaguagacaaaaccgucgaacgcaaauccugcgucgaaugcccaccaugccccgccccaccagucgccggccccuccguauuccucuucccacccaaacccaaagacacccucaugaucucacgcacccccgaagucacaugcguggucgucgacguaucacaggaagaccccgaaguccaauucaacugguacgucgacggcgucgaaguacauaacgccaaaacuaaaccccgagaagaacaauucaacuccaccuuccgaguaguauccguccucaccgucguacaccaagacuggcuaaacgguaaagaauacaaaugcaaagucuccaacaagggccuccccgcucccaucgagaaaaccaucuccaaaacaaagggccaaccccgggaaccccaaguauacacccucccacccucccaagaagaaaugaccaaaaaucaaguaucccuaaccugccucguaaaaggcuucuaccccuccgacaucgccgucgaaugggaaagcaacggccaacccgaaaacaacuacaaaaccacacccccaaugcucgacucagacggcuccuucuuccuuuacucaaaacuaaccgucgacaaaucccgcuggcaagaaggaaacguauucucaugcuccgucaugcacgaagcccuacacaaucacuauacccaaaaaucccuaucccuguccccc

SEQ ID NO: 54101 - RNA, 642 nt, Artificial Sequence
  derived and/or modified sequence opt11 from Nemolizumab_LightChain1
gacauccaaaugacccaaucacccucaucccucuccgccuccgucggcgaccgcgucaccauaaccugccaagccuccgaagacaucuacucauucgucgccugguaccaacaaaaaccaggcaaagcacccaaacuccucaucuacaacgcccaaaccgaagcccaaggaguccccucccgcuucucaggcuccggcucaggcaccgacuucacccuaaccaucuccucacuucaacccgaagacuucgccacauacuacugccaacaccacuacgacucaccccucacuuucggcggcggaaccaaagucgaaaucaaacgcaccgucgccgcccccuccgucuucaucuucccacccuccgacgaacaacucaaauccggcaccgccuccgucguuugccuccucaacaacuucuacccccgcgaagccaaaguccaauggaaagucgacaacgcccuccaauccggcaacucccaagaauccgucaccgaacaagacagcaaagacuccaccuacagccucucaucaacccucacccuauccaaagccgacuacgaaaaacacaaagucuacgccugcgagguaacccaccaaggccucuccucucccguaaccaaguccuucaaccgcggcgaaugc

SEQ ID NO: 54102 - RNA, 1356 nt, Artificial Sequence
  derived and/or modified sequence opt11 from Nesvacumab_HeavyChain1
gaaguacagcucgucgaaagcggcggcggccucguacaacccggaggaagccuccgacucagcugcgcagccagcggcuucaccuucuccuccuacgacauacacuggguccgccaagccacuggaaaaggacuugaaugggucuccgcaauaggccccgccggcgacaccuacuaccccggcucagucaaaggccgcuucacuaucucccgagaaaacgccaaaaacucccuauaccuacaaaugaacucgcuacgcgccggagacaccgccgucuacuacugcgcccgaggccucaucaccuucggcggccucaucgcccccuucgacuacuggggccaaggaacccuagucaccguauccucagccucgaccaaaggcccauccguauucccacucgcacccucauccaaauccacuagcgguggaaccgccgcacucggcugcuuagucaaagacuacuuccccgaaccagucacagucucguggaacucaggcgcccucaccagcggcguccacaccuuccccgcaguucuccaauccagcggccucuacucacucucuucaguagucacaguccccagcuccucccucggcacacaaacauacaucugcaacgucaaccacaaacccuccaacacaaaagucgacaagaaagucgaacccaaaucaugcgacaaaacacauacaugcccacccugccccgcccccgaacuccucggcggacccuccgucuuccucuucccaccuaaaccaaaagacacccuaaugauaagucgcacccccgaaguuacuugcgucguagucgaugucucacacgaagaccccgaaguuaaauucaacugguacgucgacggcgucgaaguccacaacgccaaaaccaaaccgcgcgaagaacaguacaauuccacauaccgcguaguauccguacucaccguccuccaccaagacuggcugaacggaaaagaauacaaaugcaaagucuccaacaaagcccuucccgccccaauagagaaaaccaucuccaaagccaaaggccaaccccgcgaaccacaaguauauacccuaccacccuccagagacgaacucaccaaaaaccaagucucccuuaccugccuaguaaaaggauucuaccccuccgacaucgccguagaaugggaauccaacggccaaccagaaaauaacuacaaaaccaccccucccguacucgacuccgacggcaguuucuuccucuauuccaaacuaaccgucgacaaaucucgcuggcagcaaggaaacguauucucuugcuccgucaugcacgaagcccuccacaaccacuacacccaaaagagccucucccuaucccccggcaaa

SEQ ID NO: 54103 - RNA, 642 nt, Artificial Sequence
  derived and/or modified sequence opt11 from Nesvacumab_LightChain1
gaaaucguccucacccaaucccccggaacacucucccucagcccaggcgaacgcgccacccucuccugccgcgccucccaaucagucuccuccaccuaccucgccugguaccaacaaaaacccggccaagcaccucgacuccuaaucuacggagccuccucccgcgccaccggcaucccagaccgcuucuccggcuccggauccggaaccgacuucacccucaccaucucccgccucgaaccagaagacuucgccgucuacuacugccaacacuacgacaacucccaaacauuuggacaaggcaccaaagucgaaaucaaacgcaccgucgcagcccccuccgucuucaucuucccacccuccgacgaacaacucaaauccggcaccgccuccgucgucugccuccuaaacaacuucuacccccgcgaagccaaaguccaauggaaaguagacaacgcccuccaauccggcaacucacaagaauccgucaccgaacaagacuccaaagacuccaccuacucccucuccuccacccucacccuuucuaaagccgacuacgaaaaacacaaagucuacgccugcgaagucacccaccaaggccucuccucccccgucaccaaaucuuucaaccgcggcgaaugc

SEQ ID NO: 54104 - RNA, 1362 nt, Artificial Sequence
  derived and/or modified sequence opt11 from Neuradiab_HeavyChain1
gaaguccaacuccaacaguccggacccgaacucguuaagcccggcgccucagucaaaaugucaugcaaagccuccggcuacaccuucaccucauacgucguccacugggucaaacagaacccuggccaaggacucgaauggaucggcuacaucaaccccuucaacgacggaaccaaauauaacgaaaacuucaaaugcaaagcaacccucacuucggaccgcuccuccucaacagccuacauggaacuaucaucccucaccagcgaagaguccgcagucuacuucugcgccagagacaugggccgugagggcuucgcauacuggggccaagguacccucguuaccguauccgccgcaaaaacaaccccaccauccgucuacccccuagcccccggcugcggcgacaccaccgguuccuccguaacccucggaugccucguaaaaggauacuucccagaaucugucacagucaccuggaacagcggaagccuauccucuucaguccacaccuuccccgcacuccuccaauccggccuauacaccauguccuccuccgugacaguccccucguccacauggcccucucaaaucgucaucugcuccgucgcacaccccgcaucaucaaccaccgucgacaaaaagcucgaacccucagguccaaucuccaccaucaaccccugcccaccuugcaaagaaugccacaaaugucccgccccaaaccucgaaggaggacccucaguuuucaucuuucccccaaacaucaaagacguccucaugaucucccucaccccgaaaguaaccugcgucguuguagacgucucggaagacgaccccgacguccaaaucuccugguucgucaacaacgucgaaguccacacugcacaaacccaaacccaccgagaagacuacaacuccaccauccgugucgugucaacccuccccauacaacaccaagacuggauguccggcaaagaauuuaaaugcaaagucaacaacaaggaccuacccuccccaaucgaacgcacaaucucaaaaaucaaaggccuaguccgcgcaccccaagucuacauucucccaccacccgcugaacaacucucccguaaagacguaucccuaacuugccuagucguaggcuucaaccccggcgacauauccguagaauggacaucaaacggacacacagaagaaaacuacaaagacaccgcccccguacucgacuccgacggcuccuacuucaucuacagcaagcuaaauaugaaaaccuccaaaugggagaaaaccgacuccuucuccugcaacguccgccacgaaggccucaaaaacuacuaccuaaagaaaaccaucucacgcucacccgguaaa

SEQ ID NO: 54105 - RNA, 657 nt, Artificial Sequence
  derived and/or modified sequence opt11 from Neuradiab_LightChain1
gacaucgucaugacccaagccgccuucagcaaccccgucacccucggcaccuccgccuccaucuccugccgcuccuccaaaucucuccuccacucuaacggcaucaccuaccucuacugguaccuccaaaaacccggccaaucaccccaacuccucaucuaccaaauguccaaccucgcauccggcgucccagaccgcuucuccuccuccggcucaggcaccgacuucacccuacgcaucucacgcgucgaagccgaagacgucggcgucuacuacugcgcccaaaaccucgaacuuccccgcaccuucggcggcggcaccaaacucgaaaucaaacgcgccgacgcagcccccaccgucuccaucuucccacccuccuccgaacaacucaccuccggcggcgccuccguagucugcuuccucaacaacuucuaccccaaagacaucaacgucaaauggaaaaucgacggcuccgaacgacaaaacggcguccucaacuccuggacagaccaagacuccaaagacuccaccuacuccaugucauccacacucacccucaccaaagacgaauacgaacgacacaacuccuacacaugcgaagccacccacaaaaccuccaccucccccaucgucaaauccuucaaccgaaacgagugc

SEQ ID NO: 54106 - RNA, 369 nt, Artificial Sequence
  derived and/or modified sequence opt11 from Nimotuzumab_HeavyChain1
caagugcaacugcaacagagcggggccgaggucaagaaaccgggcucgagcgugaaagugagcuguaaagcgagcggguacacguucacgaacuauuacauauacugggucaggcaagcgcccgggcaagggcucgaguggauaggcgggaucaaucccacgagcgggggcucgaacuuuaacgagaaauuuaaaacgcgcgugaccauaaccguggacgagagcacgaacacggccuauauggagcucucgagcuugcgcucggaagauaccgcguucuauuucugugccaggcaagggcucugguucgauagcgauggcaggggcuuugacuuuugggggcaagggagcacggucacggucucgagc

SEQ ID NO: 54107 - RNA, 342 nt, Artificial Sequence
  derived and/or modified sequence opt11 from Nimotuzumab_LightChain1
gacauccaaaugacccaaucccccuccucccucuccgccuccgucggcgaccgcgucaccaucaccugccgcucaucccaaaacaucguccacuccaacggcaacaccuaccucgacugguaccaacaaacccccggcaaagcccccaaacuccucaucuacaaagucuccaaccgcuucuccggcguacccucccgcuucuccggcuccggcuccggcaccgacuucaccuucaccaucuccucccuccaacccgaagacaucgccaccuacuacugcuuccaauacucccacguacccuggaccuucggccaaggcaccaaacuccaaaucacccgagaa

SEQ ID NO: 54108 - RNA, 1320 nt, Artificial Sequence
  derived and/or modified sequence opt11 from Nivolumab_HeavyChain1
caaguccaacucgucgaaucaggcgguggagucguccaaccaggccgcucccuccgccucgacugcaaagccucaggcauaaccuucuccaacagcggcaugcacuggguccgccaagcccccggcaagggccuagaaugggucgcagucaucugguacgauggcucaaaacgauacuacgcggacucagucaaaggacgcuucaccaucucccgcgacaacuccaaaaacacccucuuccuccaaaugaacucacuacgcgccgaagacaccgcaguauacuacugcgcaacaaaugacgacuacuggggccaaggaacgcucgucaccgucuccucagccuccacaaaaggccccucaguauucccucuggcgccaugcucacgcuccaccagcgaauccaccgccgcccucggcugccucgucaaagacuacuuccccgagcccgucaccgucagcuggaacagcggcgcccucaccucuggaguacacacauuucccgccguccuccaauccucaggccuguacucacucucaucagucgucacagucccauccagcagccucggaaccaaaaccuacacgugcaacgucgaucacaaacccucaaacaccaaagucgacaaacgcgucgaauccaaauacggaccacccugucccccaugccccgcccccgaguuccucggcggcccauccgucuuucucuucccaccaaaacccaaagacacacucaugaucucccguacccccgaaguaaccugcgucgucguugacguaucacaagaagacccagaaguccaauuuaacugguacguugacggcgucgaaguccacaaugccaaaaccaaaccacgcgaagaacaauucaacucaaccuauagaguaguauccguacuaaccguccuucaccaagacuggcucaacggcaaagaauacaaaugcaaaguuuccaacaaaggccuacccuccucaaucgaaaagaccauaucaaaagccaaaggacaaccccgcgaaccccaagucuauacacuacccccaucccaagaggaaaugaccaaaaaccaagucucccuaaccugccucgucaaaggcuucuaccccucggacauagccgucgaaugggaaagcaacggccaaccagaaaauaacuacaaaaccacacccccaguacucgacagcgacggcuccuucuuccucuacucacgacucaccgucgacaaaucacgauggcaagaaggcaacguauucucaugcuccgugaugcacgaagcccuacacaaccacuauacccaaaaaucccucucccucagccuaggcaaa

SEQ ID NO: 54109 - RNA, 642 nt, Artificial Sequence
  derived and/or modified sequence opt11 from Nivolumab_LightChain1
gaaaucguccucacccaaucacccgccacccuaucccuauccccaggcgaacgcgccacccucuccugccgcgccucccaaagcguauccuccuaccuagccugguaccaacaaaaacccggccaagccccccgccuccucaucuacgacgccagcaaccgcgccaccgguauccccgcccgauucucuggcuccggcuccggcaccgacuucacccuaaccaucagcucccucgaacccgaagacuucgccgucuacuacugccaacaaucauccaacuggccccgcaccuucggacaaggcaccaaagucgaaaucaaacgcacagucgccgcccccuccgucuucaucuucccccccuccgacgaacaacuuaaaucaggcaccgccucagucgucugccuccucaauaacuucuacccccgcgaagccaaaguccaauggaaaguagacaacgcccuccaauccggaaacucccaagaauccgucaccgaacaagacucaaaagacucaaccuacucccuaagcucuacccucacccuauccaaagccgacuacgaaaaacacaaagucuacgccugcgaagucacccaccaaggccuuuccucccccguaaccaaauccuucaaccgcggcgaaugc

SEQ ID NO: 54110 - RNA, 1347 nt, Artificial Sequence
  derived and/or modified sequence opt11 from Obiltoxaximab_HeavyChain1
caaguucaacuccaacaaucaggacccgaacucaagaaacccggcgccuccguaaaagucuccugcaaagacuccggcuacgccuucucuucaucguggaugaacuggguccgacaagcccccggccaaggccucgaauggaucggacgaaucuaccccggagacggcgacaccaacuacaacggaaaauuccaaggcagagucaccaucacagcagauaaauccuccuccacugccuacauggaacucuccucacuccgauccgaagacaccgcaguauacuucugcgcucgcuccggccugcuccguuacgcaauggacuacuggggacaaggcacacucguaaccgucuccuccgcaucaaccaaaggccccuccgucuucccccuggcccccuccucaaaaagcacuuccggcggcaccgccgcacuaggcugccucguaaaagacuacuucccggaacccguaacagucucuuggaacucgggagcacucaccuccggcgugcacaccuuccccgccguacuacaauccuccggacucuacucccuauccucagucgucaccgucccaagcuccucccuuggcacacaaaccuacaucugcaacgucaaccacaaaccaucgaacacaaaagucgacaagaaaguagaacccaaauccugcgacaaaacacauaccugcccacccugccccgcacccgaacuccuaggcggcccuuccgucuuccuauuuccacccaaaccaaaagacacccucaugauaucccgcacccccgaaguaaccugcgucgucgucgacgucagccacgaagaucccgaagucaaauuuaauugguacgucgacggcguagaaguccacaacgccaaaacaaaaccacgagaagaacaauacaacuccacauacagagucguauccguacucacuguccuccaccaagacuggcucaacggcaaagaauacaaaugcaaagucagcaacaaagcccucccagccccaauagagaaaaccaucucaaaagccaaaggccaaccccgagaaccacaagucuacacccucccacccucucgagaugaacuaacuaagaaccaagucucccuaaccugccucgucaaaggauucuaccccuccgacaucgccgucgaaugggaaucaaacggccaacccgagaacaacuacaagaccacaccacccguccuugacagugacggcuccuucuuccucuacucaaaacucaccgucgacaaaucccgcuggcaacagggcaacgucuucucaugcuccguaaugcacgaagcccuacauaaccacuacacgcaaaaaucacuaucacuuucacccggaaaa

SEQ ID NO: 54111 - RNA, 642 nt, Artificial Sequence
  derived and/or modified sequence opt11 from Obiltoxaximab_LightChain1
gacauccaaaugacccaaucacccuccucccucagcgccucagucggcgaccgcgucaccaucacaugccgcgccucccaagacauccgcaacuaccucaacugguaccaacaaaaacccggaaaagccgucaaacuccuaaucuacuacaccucacgccuccuccccggaguccccucccgcuucuccggcucaggcuccggcaccgacuacucccucaccaucuccucccaagaacaagaagacaucggcacauacuucugccaacaaggcaacacacuccccuggaccuucggacaaggcaccaaagucgaaauccgacgcaccgucgccgcccccuccguauucauauucccacccucagacgaacaacucaaauccggcaccgccucagucgucugccuacucaacaacuucuacccccgcgaagccaaaguccaauggaaagucgacaacgcacuccaaucaggaaacucgcaagaauccgucaccgaacaagacucuaaagacuccaccuacucccucagcucaacccucacccucuccaaagccgacuacgaaaaacacaaagucuacgccugcgaagucacccaccaaggccuaucaucccccgucaccaaauccuucaaccgcggcgaaugc

SEQ ID NO: 54112 - RNA, 1347 nt, Artificial Sequence
  derived and/or modified sequence opt11 from Obinutuzumab_HeavyChain1
caaguccaauuaguacaauccggcgccgaaguuaagaaacccggauccucaguaaaaguuuccugcaaagccuccggcuacgccuucuccuacuccuggaucaacuggguacgccaagcccccggccaaggccucgaauggaugggacguaucuucccaggcgacggagacaccgacuacaaugguaaauucaaaggccgagucaccaucaccgccgacaaaucaaccucaaccgccuacauggaacuguccucccuuagauccgaagacaccgcagucuauuacugcgcccgcaacgucuucgacggcuacuggcucgucuacuggggccaaggaacccucgucaccgugucauccgcaagcaccaaaggcccauccguuuucccacucgcccccuccuccaaauccacuuccggcggcaccgccgcccucggcugccucgucaaagacuacuucccagaaccaguaaccguauccuggaacagcggcgcccucacauccggaguccacaccuuccccgccguccugcaauccagcggccucuacucccucagcuccguugucaccguccccucauccucacucggcacucaaacauacaucugcaacgucaaccacaagcccuccaacaccaagguagacaagaaagucgaacccaaaucuugcgacaaaacccauacaugcccucccugucccgcccccgaacuccucggagggcccucggucuuccucuucccacccaaaccaaaagacacccucaugaucucgagaacucccgaaguuaccugcgucgucgucgacgucucacacgaagacccugaagucaaauucaacugguaugucgacggcguagaaguccacaacgcuaaaacaaaaccccgcgaagaacaauacaacuccaccuaccgcgucgucagcguacuuaccguacuccaccaggacuggcuaaacggcaaagaauacaaaugcaaaguauccaacaaagcccuccccgcccccauagaaaagaccauaagcaaagcgaaaggucaaccccgagaaccccaagucuauacccucccuccuucccgcgacgaacucaccaaaaaccaagucucccuaaccugccucgucaaaggcuuuuaccccucagauaucgccgucgaaugggaauccaacggccaaccagaaaacaacuacaaaaccacacccccaguccucgacuccgacggcuccuucuuccucuacucaaaacucaccguagacaaaucccgcuggcaacaaggcaacgucuuuuccugcucagucaugcacgaagcccuucacaaccacuacacccagaaaagccucucccucuccccuggcaaa

SEQ ID NO: 54113 - RNA, 657 nt, Artificial Sequence
  derived and/or modified sequence opt11 from Obinutuzumab_LightChain1
gacaucgucaugacccaaacaccccucucccuacccgucacccccggcgaacccgccuccaucucaugccgcuccuccaaaucacuccuccacuccaacggcaucaccuaccucuacugguaccuccaaaaacccggucaaucaccccaacuccucaucuaccaaauguccaaccucgucagcggcguccccgaccgauucuccggcuccggcuccggcaccgacuucaccuuaaaaauaagccgcguagaagccgaagacgucggcguauacuacugcgcccaaaaccucgagcucccguacaccuucggaggaggaaccaaagucgaaaucaaacgcaccgucgcagcccccagcguguucauauucccacccuccgacgaacaacuaaaaucaggcaccgccucagucguaugccuccucaacaacuucuacccccgcgaagccaagguccaguggaaagucgacaacgcccuccaauccggaaacucccaagaaagcguaaccgaacaagacagcaaagacuccacauacagccuaagcucgacccucacccuauccaaagccgacuacgaaaaacacaaaguauacgccugcgaagucacacaccaaggccuauccucccccguaaccaagagcuucaacagaggcgaaugc

SEQ ID NO: 54114 - RNA, 1350 nt, Artificial Sequence
  derived and/or modified sequence opt11 from Ocaratuzumab_HeavyChain1
gaaguacaacucguucaaucuggcgccgaaguaaagaaacccggcgaaagccuaaaaaucuccugcaaaggcagcggcagaaccuucacgucauacaacaugcacuggguacgccaaaugcccggcaaaggccucgaauggaugggcgccaucuacccacucaccggcgacacauccuacaaccaaaaaucgaaacuacagguaaccaucucagccgacaaaucaaucagcaccgcauaccuacaauggucaucacucaaagccuccgacaccgccauguacuacugcgcacgcuccaccuacgucggaggagacuggcaauucgacgucuggggcaaaggaacuaccguuaccgucuccuccgcuuccacaaaaggacccagcguauucccccuugcccccucuucaaaaagcacuuccggcggaacagccgcccucggcugccucguuaaagacuacuuucccgaacccgucacggucuccuggaacuccggagcccucaccucaggcguccacaccuucccugccguccuccaauccucaggacuuuacucacuauccuccgucgucacaguccccucaucaucccucggcacacaaaccuacauaugcaacguuaaccacaaacccuccaacaccaaagucgacaagaaaguugaacccaaaagcugcgacaaaacccauaccugcccacccugccccgcccccgaacuccuuggaggccccucaguauuccucuucccacccaaaaucaaagacacccugaugaucucccgcacacccgaaguaaccugcguaguugucgacgucagccacgaagaccccgaagucaaauucaauugguacguagacggcguagaaguccacaacgccaaaaccaaaccccgcgaggaacaauacaacuccaccuaccgcguagucucaguacucaccguucuccaccaagacuggcuuaacggcaaagaauacaaaugcaaagucagcaacaaagcccuucccgcccccaucgagaagaccaucucuaaacaaaaaggacaaccacgcgagccccaagucuacacccuacccccaucccgcgacgagcucaccaaaaaccaagucucucucacaugccucgucaaagguuucuacccaagcgacaucgcagucgaaugggaauccaacggccaacccgaaaacaacuacaagaccaccccucccguccucgauuccgacggcucguucuuccuauacagcaaacucacagucgacaagagccgauggcaacaaggcaacgucuucuccugcuccgucaugcacgaagcccuacacaaccacuacacccaaaaaucccuaucacuaucccccggc

SEQ ID NO: 54115 - RNA, 639 nt, Artificial Sequence
  derived and/or modified sequence opt11 from Ocaratuzumab_LightChain1
gaaaucguccuuacccaaucccccggaacccucucccucucacccggcgaacgcgccacccucuccugccgcgccuccuccuccguacccuacauccacugguaccaacaaaaacccggccaagcaccccgccuccucaucuacgccaccuccgcccucgcaucaggcauccccgaccgcuucuccggcuccggcuccggcaccgacuucacccucaccaucucacgacucgaacccgaagacuucgccgucuacuacugccaacaauggcucuccaacccacccaccuucggccaaggaaccaaacucgaaauaaaacgcacaguagccgcccccucugucuucaucuucccacccuccgacgaacaacucaaauccggcaccgccucagucgucugccuccucaacaacuucuacccccgcgaagccaaaguccaauggaaagucgacaacgcccuccaauccggcaacucccaagaauccguuaccgaacaagacuccaaagacuccaccuacucccucuccuccacccucacccucuccaaagccgacuacgaaaaacacaaagucuacgccugcgaagucacccaccaaggccucuccucccccgucaccaaauccuucaaccgcggcgaaugc

SEQ ID NO: 54116 - RNA, 1356 nt, Artificial Sequence
  derived and/or modified sequence opt11 from Ocrelizumab_HeavyChain1
gaaguccaacucgucgaaucaggcggcggccucguccaacccggaggcucucuccgccucuccugcgcagcauccggcuacacuuucaccuccuacaacaugcacuggguacgacaagcccccggcaaaggacucgaaugggucggagccauauaucccggcaacggagauaccucauacaaccaaaaguucaagggccgauucaccaucuccguagacaaauccaaaaacacauuauaccuccaaaugaacucccucagggcagaagacaccgccgucuacuacugcgcccgagucgucuacuauuccaauuccuacugguacuuugacgucuggggccaaggcacccucgucaccgucuccuccgccuccacuaaaggccccuccgucuucccccuagcccccuccucuaaaucgaccuccggcggaaccgcagcccucggcugucucgucaaagacuacuuccccgaacccguaaccguuucauggaacucgggagcccucaccuccggaguccacaccuucccagccguccuccaauccuccggacuauacucgcucagcucagucgucacaguccccuccuccucacucggcacccaaacauacaucugcaacgucaaccacaaaccuucuaacaccaaagucgacaagaaagucgaacccaaauccugcgacaaaacccauaccugcccucccugccccgcuccggaacuccucgguggacccuccguauuccuauucccacccaaacccaaagacacacucaugaucucuaggacccccgaaguaaccugcguagucgucgacgugucacacgaagaccccgaaguaaaauucaacugguacgucgacggcguugaaguccacaacgcaaaaaccaaacccagggaggaacaauacaacuccaccuaccgcgucgucuccguccuaaccguucuacaccaagacuggcucaacggaaaagaguacaaaugcaaaguauccaauaaagcacuacccgcacccaucgagaaaaccaucuccaaagccaaaggccaacccagagaaccccaagucuacacccucccucccucccgcgaagaaaugaccaagaaccaagucucacuaaccugcuuagucaaaggcuucuacccauccgacaucgcagucgaaugggaaagcaacggccaacccgaaaacaacuacaaaacaaccccacccguccucgacuccgacggcuccuucuuccucuacuccaaacucaccgucgacaaaucacgcuggcaacaaggcaacgucuucagcugcuccgucaugcacgaagcacuccacaaccacuacacccaaaaaucacuaucgcucagccccggcaaa

SEQ ID NO: 54117 - RNA, 639 nt, Artificial Sequence
  derived and/or modified sequence opt11 from Ocrelizumab_LightChain1
gacauccaaaugacccaaucccccuccucccucuccgccuccgucggcgaccgagucacaaucaccugccgcgccuccucauccgucuccuacaugcacugguaccaacaaaaacccggcaaagcccccaaaccccuaaucuacgcccccuccaaccuagccuccggcguccccucccgauucuccggcuccggcuccggcaccgacuucacccuuaccaucuccucccuccaacccgaagacuucgccaccuacuacugccaacaaugguccuucaacccccccaccuucggccaaggaaccaaaguagaaaucaaacgcaccgucgcagcccccuccgucuucaucuucccccccuccgacgaacaacucaaauccggcacagccuccgucgucugccuucucaacaacuucuacccccgcgaagccaaaguccaauggaaaguagacaacgcccuccaauccggcaacucccaagaaucagucacagaacaagacuccaaagacuccaccuacucccuaucauccacccucacccuauccaaagcagacuacgaaaaacacaaagucuacgcaugcgaaguaacccaccaaggacucuccucccccgucaccaaaucauucaaccgcggcgaaugc

SEQ ID NO: 54118 - RNA, 1356 nt, Artificial Sequence
  derived and/or modified sequence opt11 from Ofatumumab_HeavyChain1
gaaguccaacucgucgaaucugguggcggccucguccaacccggccguucccuccgccucucaugcgccgccucgggcuucacauucaacgacuacgccaugcauuggguccgccaagcccccggaaaaggccuugaaugggucucaaccaucagcuggaacucgggauccaucggcuacgccgacucggucaaaggccgcuucaccauaucccgcgacaacgcaaagaaaagccucuaccuacaaaugaacucccuucgggcagaggacaccgcccucuacuacugcgcaaaagacauacaauacggcaacuacuacuacggcauggacgucuggggccaaggcacgaccgucacaguauccucagccuccaccaaaggccccucagucuucccccuugccccguccucaaaauccaccuccggaggcaccgccgcccuaggcugccucgucaaagacuacuuccccgaacccgucaccgucucauggaacuccggcgcccucaccucaggcguccacaccuucccugcuguccuacaaucaucaggccucuacucccuauccuccgucguaaccguccccucgucaucccucggcacacaaaccuacaucugcaacgucaaccacaaacccucaaacaccaaaguagacaaacgagucgaaccgaaauccugcgacaaaacccacacaugcccacccugccccgcucccgaacuccuaggaggcccaucaguuuuccuauucccacccaaacccaaagacacccucaugaucucucgcacucccgagguuacaugcgucgucgucgacgucagccacgaagaccccgaggucaaguucaacugguacguagacggcguagaaguacacaacgccaagaccaaaccccgcgaagaacaauacaacucaacauaccggguuguauccguccucaccguccuacaccaagacuggcucaacggcaaagaauacaaaugcaaagucaguaacaaggcccuacccgcccccaucgagaaaaccauuagcaaagccaaaggccaaccucgcgaaccacaaguauacacccucccacccucccgcgaagaaaugaccaaaaaccaaguaucucuaacaugccucgucaaaggcuuuuaccccuccgacaucgccgucgaaugggaauccaacggccagcccgagaacaacuacaaaaccacgcccccaguccucgacucagauggcucauucuuccuauacuccaaacuaaccgucgacaaaucccgauggcaacaaggcaacgucuucuccugcagcguaaugcacgaagcccuacacaaccacuacacccaaaaaucacucucacuaucaccagggaaa

SEQ ID NO: 54119 - RNA, 642 nt, Artificial Sequence
  derived and/or modified sequence opt11 from Ofatumumab_LightChain1
gaaaucguccuaacacaauccccagccacccucucccucucacccggcgaacgcgccacccuauccugccgcgccucccaauccgucuccuccuaucucgccugguaccaacaaaaacccggccaagcaccccgccuccuaaucuacgacgccagcaaccgagccaccggcauccccgcccgcuucuccggcuccggcucuggaaccgacuucacccucaccaucuccucgcucgaacccgaagacuucgccgucuacuacugccaacaacgcucaaacuggcccaucaccuucggacaaggcacccgccucgaaaucaaacgcacagucgccgcccccucaguauucaucuucccacccuccgacgaacaacucaaaucaggcaccgccuccgucgucugccuacucaacaacuucuacccccgagaagccaaaguccaauggaaagucgacaacgcacuccaaucaggcaacucccaagaauccgucaccgaacaagacuccaaagacuccaccuacucccuauccuccacccuuacccuuuccaaagccgacuacgaaaaacacaaagucuacgcaugcgaagucacccaccaaggccucuccucacccguaaccaaauccuucaaccgcggcgaaugc

SEQ ID NO: 54120 - RNA, 1371 nt, Artificial Sequence
  derived and/or modified sequence opt11 from Olaratumab_HeavyChain1
caacuccaacuacaggaauccggccccggccuagucaaacccuccgagacccucucucucacuugcacaguuuccggcggcucaaucaacaguuccagcuacuacuggggauggcuccgacaaucuccaggcaaaggacucgaauggaucggauccuucuucuacaccggcucaaccuacuacaaccccucacuccgcagccgacuuacaaucuccgucgacaccagcaaaaaccaauucucacuuaugcuaucauccgucaccgccgccgacacagccgucuacuacugcgcccgccaaucaaccuacuacuacggcucaggcaacuacuacggaugguucgaccgcugggaccaaggcacccucgucaccguaucaagcgccuccacaaaagguccauccguauucccacucgccccauccucgaaaucaaccucgggcggaacagccgcccuaggcugccucgucaaagacuacuuccccgaaccugucacagucagcuggaacucuggagcgcucacauccgguguccacaccuucccagcgguccuccaaagcuccggccuuuacucgcucucauccgucguaacaguacccagcucaucccucggaacacaaaccuacaucugcaacgucaaccacaaacccucaaacaccaaagucgauaagcgcgucgagcccaaauccugcgacaaaacccauaccugcccucccugccccgcacccgaacuccucggaggacccuccgucuuccuguucccacccaaacccaaagacacacugaugauaucccgcacacccgaagucacaugcguugucguugacgugucccacgaagaucccgaagucaaauucaauugguaugucgacggcgucgaaguccacaacgcaaagaccaaaccccgugaagaacaauacaacuccacauacagagucguauccguccucaccguccuccaccaagacuggcucaacggcaaagaauacaaaugcaaagucuccaacaaagcccuccccgcacccaucgagaaaacaaucuccaaagcgaaaggacaaccacgcgaaccacaaguuuacacccuuccacccucucgcgaagaaaugaccaaaaaccaaguuucccuaaccugccucguaaaaggauucuaccccuccgauaucgccgucgaaugggaaagcaacggccaacccgaaaacaacuacaaaacuacaccacccguccucgacucggacggcuccuucuuccucuacuccaaacucacugucgacaaauccagauggcaacaaggcaacgucuucuccuguuccgucaugcacgaagcccuccacaaucacuauacccaaaaaucacucucccucucacccggcaaa

SEQ ID NO: 54121 - RNA, 642 nt, Artificial Sequence
  derived and/or modified sequence opt11 from Olaratumab_LightChain1
gagaucguacucacccaaucccccgccacccucucccucucccccggcgaacgagcaacacucuccugccgagcaucccaaagcguauccuccuaccuugccugguaccaacaaaaacccggacaagcccccagacuacucaucuacgacgccucaaaccgcgcaaccggcauccccgcacgauucucaggcuccggcuccggcaccgacuucacccucaccaucuccucccucgaacccgaagacuucgccguuuacuacugccaacaacgcuccaacuggccacccgccuucggacaaggcaccaaagucgaaaucaaacgcaccgucgccgcccccuccgucuucaucuucccgcccuccgacgaacaacucaaauccggcaccgccuccgucgucugccuccucaacaacuucuacccccgcgaagccaaaguccaauggaaagucgacaacgcccuccaauccggcaacucccaagaaagcgucaccgaacaagacuccaaagacucaaccuacucccuauccucaacccucacccucuccaaagccgacuacgaaaaacacaaagucuacgccugcgaagucacacaccaaggccucuccucccccgucaccaaauccuucaaccgcggcgaaugc

SEQ ID NO: 54122 - RNA, 1341 nt, Artificial Sequence
  derived and/or modified sequence opt11 from Olizuab_HeavyChain1
gaaguccaacuggucgaaagcgguggcggccucguccaaccuggcggaucccuccgucucuccugcgccguaucaggcuauucaauaaccuccggcuacuccuggaacuggauccgacaagccccaggcaaaggucuggaaugggucgcguccaucacauacgacggcuccacgaacuacaacccguccguaaaaggacgaaucaccaucagccgggacgacuccaaaaacacuuucuaucuacaaaacucccuacgcgccgaagacaccgccguuuacuacugcgcacgaggaucccauuacuucggccacuggcacuucgccgucuggggacaaggaacccucgucacagucagcucagcaucaaccaaaggccccuccgucuucccccuagcccccuccagcaaauccaccuccgggggcaccgccgcacucggcugccucguaaaagauuacuuccccgaaccagucacagucucauggaacuccggcgcccucaccuccggcguccacaccuucccggccguacuccagagcucuggccuuuacucccucucaucaguagucaccguacccuccuccucccucggcacacaaacuuacaucugcaacgucaaccacaaaccauccaacaccaaagucgacaagaaaguagaacccaaaucaugcgacaaaacccacaccugucccccaugccccgcccccgaacuccuaggcggacccucagucuuccucuucccuccuaaacccaaagacacccuaauaucacgcacccccgaagucacaugcguagucgucgacgucagccacgaagacccagaagucaaauucaacugguacgucgauggugucgaagugcacaaugccaagaccaaaccccgcgaagaacaauacaacuccaccuaccgcgucgucucaguucuuaccguccuacaccaagacuggcuuaacggcaaagaauacaaaugcaaagucuccaacaaagcacuccccgcacccaucgaaaagacaaucagcaaagccaaaggccaaccccgugaaccccaaguuuacacccuuccgcccucccgcgaagaaacuaaaaaccaaguaucacugaccugccucgucaaaggcuucuaccccucagacaucgccgucgaaugggaauccaacggccaacccgaaaacaacuacaaaaccacacccccaguccucgacuccgauggauccuucuuccucuacucaaaacucaccgucgacaaaucacgcuggcaacaaggaaaugucuucuccugcucuguccacgaagcccuccauaaccacuacacccaaaaaucacucucucucuccccaggaaaa

SEQ ID NO: 54123 - RNA, 651 nt, Artificial Sequence
  derived and/or modified sequence opt11 from Olizuab_LightChain1
gacauccaacucacccaaucccccuccagccucuccgccuccgucggcgaccgcgucaccauaaccugccgcgccucucaauccguagacuacgacggcgacuccuacaacugguaccaacaaaaacccggcaaagcccccaaacuccucaucuacgccgccuccuaccucgaauccggcguccccucccgcuucuccggcuccggcuccggaacagacuucacccucacaaucuccucccuccaacccgaagacuucgccaccuacuacugccaacaaucacacgaagaccccuacaccuucggccaaggcaccaaagucgaaaucaaacgcaccgucgccgccccaucagucuucaucuucccucccucagacgaacaacucaaauccggcacagccuccgucgucugccuccuaaacaacuucuacccucgcgaagccaaaguccaauggaaagucgacaacgcacuccaauccggcaacucacaagaaucagucaccgaacaagacuccaaagacuccaccuacucucucucauccacccucacccucucaaaagccgacuacgaaaaacacaaaguauacgcaugcgaagucacacaccaaggccuauccucacccguaaccaaauccuucaaccgcggagaaugc

SEQ ID NO: 54124 - RNA, 1341 nt, Artificial Sequence
  derived and/or modified sequence opt11 from Olokizumab_HeavyChain1
gaaguacaacucgucgaaagcggcggcggccuaguccaaccaggcgguucccuacgacuaucuugcgcagccuccggcuucaacuucaacgacuacuucaugaacuggguacgacaagcacccggaaaaggccuugaaugggucgcccaaaugcgcaacaaaaacuaccaauacggcaccuacuacgccgaaucccucgaaggacgcuucaccauaucccgugacgacuccaaaaacucccucuaccuccagaugaacucccucaagaccgaagacaccgccgucuacuacugcgcccgagaaucguacuacggcuucacaucauacuggggccaaggcacccuagucaccguauccuccgccuccacaaaaggaccauccgucuucccgcucgcccccugcucccgaucaaccuccgaauccaccgcagcccuuggcugccucgucaaagacuacuucccagaaccaguaaccgucuccuggaacuccggcgcacucaccuccggcguacacacauuuccagccguccuccaauccuccggacuuuacucccucagcagcgucguaaccgucccauccucaucccucggcaccaaaaccuauaccugcaacguagaccacaaacccuccaacaccaaaguagacaaaagagucgaaagcaaauacgguccaccaugcccacccugccccgcaccugaauuucucggcggccccuccgucuuccucuuucccccuaaaccaaaagacacccuaaugauaucacgcacacccgaaguaacaugcguagucguagaugucucacaagaagaccccgaaguccaguucaacugguacgucgacggugucgaaguccacaacgccaaaaccaaaccccgagaagaacaauucaacucaacauaccgcgucguaucgguccucacaguccuacaccaagacuggcucaacggaaaagaauacaaaugcaaagucagcaacaaaggccucccaucaucuaucgagaaaaccaucucaaaagcaaaaggccagcccagagaaccccaagucuacacccuacccccaucccaggaagagaugaccaaaaaccaaguaucccuaaccugccuagucaagggcuucuaccccuccgacaucgccgucgaaugggaaucaaacggccaaccugaaaacaacuacaaaaccacacccccaguauuagacucagacggauccuucuuccucuacucccggcuaaccguggacaaaucccgcuggcaagagggcaacgucuucagcugcuccgucaugcacgaagcccuacacaaccacuacacacaaaaaucccucucccucucacucggcaaa

SEQ ID NO: 54125 - RNA, 642 nt, Artificial Sequence
  derived and/or modified sequence opt11 from Olokizumab_LightChain1
gacauccaaaugacccaaagccccucaagccuaagcgcaagcguaggcgaccgaguaaccauaaccugccaagccagccaagacaucggcauaagccuaagcugguaccaacaaaaaccaggaaaagcgcccaaacuccuaaucuacaacgccaacaaccucgccgacggggucccaagccgauucucaggcucaggcuccggcacagacuucacccuaaccaucagcucacuccaacccgaagacuucgccaccuacuacugccuacaacacaacucagccccauacacauucggccaaggaaccaaacucgaaaucaaacgcacagucgcagcccccagcguauucauauucccacccucagacgaacaacuaaaaucaggcacagccucagucgucugccugcucaacaacuucuacccacgcgaagccaaaguccaauggaaagucgacaacgcacuccaaagcggaaacucacaagagagcgugaccgaacaagacagcaaagacucaaccuacagccuaagcucaacccuaacccuaagcaaagccgacuacgaaaaacacaaaguauacgccugcgaagucacccaccaaggccucagcucacccguaaccaaaucauucaaccgaggcgaaugc

SEQ ID NO: 54126 - RNA, 1341 nt, Artificial Sequence
  derived and/or modified sequence opt11 from Omalizumab_HeavyChain
gaaguucagcuaguagaauccggaggcggacucguccagcccggcggaucccuccgccucucaugcgccgucuccggcuacuccaucaccuccggauacucauggaacuggauucgccaagcccccggaaaaggccucgaauggguagccuccauaaccuacgacggcucaaccaauuacgccgacuccguaaaaggccgauucaccauaucgcgcgacgacuccaaaaacacauucuaccuccaaaugaauagccuccgcgcagaagauacagccgucuacuacugcgcacgcggcucccauuacuucgggcacuggcacuucgccgucuggggccagggcacccuagucaccgucucaagcggccccuccguauucccacucgcccccuccuccaaauccaccucaggaggcaccgccgcacucggcugccucguaaaagauuauuucccagaacccgucaccgucuccuggaacuccggcgcccucacauccggcguccacacuuuccccgccguccuacaauccuccggacucuauucccucuccuccgucguaacaguccccucaagcucacucggaacccaaacuuacauaugcaacguaaaccacaaacccucaaacacaaaagucgacaagaaagccgaacccaaauccugcgacaaaacacacacaugcccacccugccccgcgcccgaacucuuaggcggucccuccgucuuccucuucccacccaaacccaaagacacccucaugaucucccgcacacccgaaguaaccugcguaguagucgacgucucccaugaagaccccgaaguaaaauucaacugguacgucgacggagucgaaguccacaacgccaaaaccaaaccccgcgaagaacaauacaacucaaccuaccgcguaguauccguccucacuguccugcaucaagacuggcucaacggcaaagaauacaaaugcaaagucagcaacaaagcccuacccgcccccaucgagaaaacaaucucaaaggccaagggacaaccccgcgaaccccaagucuacaccuuaccacccucaagagacgaacuaaccaaaaaccaagucucacucacaugccuugucaaaggauucuacccgagcgacauagccgucgaaugggaauccaacggacaacccgaaaacaauuacaaaacaaccccucccguccucgacucagacggcucuuucuuccucuauucgaaacucaccgucgacaaaucccguuggcaacaaggcaacgucuucuccuguuccgucaugcacgaagcacuucacaaccacuauacccaaaaaucacuaucccuaucccccggaaaa

SEQ ID NO: 54127 - RNA, 645 nt, Artificial Sequence
  derived and/or modified sequence opt11 from Omalizumab_LightChain
gacauccaacucacacaaucccccuccucccucuccgcauccguaggcgaccgcgucaccaucacaugccgcgccagccaauccgucgacuacgacggcgacuccuacaugaacugguaccaacaaaaacccggcaaagcacccaaacuccuaaucuacgcagccuccuaccucgaauccggcguccccagccgauucuccggaucaggcuccggcaccgacuucacccuuaccaucuccucacuccaacccgaagacuucgccaccuacuacugccaacaaucccacgaagaccccuacaccuucggccaaggcaccaaagucgaaaucaaacguaccgucgccgcccccuccgucuucaucuucccacccuccgacgaacaacucaaauccggcaccgccuccgucgucugccuacucaacaacuucuacccccgcgaagccaaaguccaauggaaagucgacaacgcccuccaauccggaaacucccaagaaagcgucaccgaacaagacagcaaagacuccaccuacucccuauccucaacccuaacccuauccaaagccgacuacgaaaaacacaaagucuacgccugcgaagucacccaccagggccucuccucccccgucaccaaauccuucaacaga

SEQ ID NO: 54128 - RNA, 1347 nt, Artificial Sequence
  derived and/or modified sequence opt11 from Onartuzumab_HeavyChain1
gaaguacagcucgucgaauccggcggcggccucguacagccaggcggcucccuucgacucuccugcgccgccucaggauacacauucacauccuacuggcugcacuggguccgccaagccccaggcaaaggacuagaaugggucggcaugaucgacccauccaacuccgacacucgauucaaccccaacuucaaagaccgauucaccauaagcgcagacaccaguaaaaacaccgcuuaccuccaaaugaacucucuacgagcagaagacaccgcagucuauuacugcgcaaccuaccgcuccuacgucacuccacucgacuacuggggccaagguacccucguuacagucuccuccgccucaaccaaaggacccuccgucuucccacucgcccccuccucaaagucaaccuccggcggcaccgccgcccuagggugccuagucaaagauuacuucccagaaccagucacagucagcuggaacagcggagcccucaccuccggcguccauacauuccccgccguacuccaauccuccggucuauacucccuauccucugucguaacuguccccuccuccucucuaggcacccaaaccuacaucugcaacgucaaccacaaaccaucaaacaccaaggucgacaagaaagucgaacccaaaagcugugacaaaacccacaccuguccucccugccccgcccccgaacuucucgguggccccuccgucuuccucuucccacccaaacccaaggacacacucaugaucucccgcacccccgaaguaaccugugucgucgucgacgucucccacgaagaccccgaaguaaaauucaacugguacguagacggcguagaaguccacaacgccaaaaccaaaccccgcgaagaacaauacaacuccaccuaccgagucgucucaguucucaccguccuucaccaagacuggcucaacgguaaagaauacaaaugcaaagucuccaacaaagcccuccccgcccccauugagaaaaccauaucuaaagccaagggccaaccacgcgaaccgcaagucuacacccuacccccuucacgcgaagaaaugaccaaaaaccaaguuucccuauccugcgccguuaaaggcuucuacccauccgacaucgccgucgaaugggaauccaauggccaaccagaaaacaacuacaaaaccacacccccaguccucgauucagacggcuccuucuuccuagucuccaaacugaccguagacaaaucucgauggcagcaaggcaacgucuucuccugcuccgucaugcacgaagcccugcacaaccacuauacacaaaaaucacuaucccuaucccccggcaaa

SEQ ID NO: 54129 - RNA, 681 nt, Artificial Sequence
  derived and/or modified sequence opt11 from Onartuzumab_HeavyChain2
gacaaaacccacaccugcccccccugccccgcccccgaacuacucggcggccccucagucuuccucuucccccccaaaccaaaagacacccucaugaucucccgaacccccgaagucaccugugucgucgucgacgucucccacgaagaccccgaaguaaaauucaacugguacgucgacggcguagaaguccacaacgccaaaaccaaaccccgcgaagaacaauacaacuccaccuaccgcguagucucaguccuuaccguccuccaccaagacuggcucaacggcaaagaauacaaaugcaaagucucaaacaaagcccuccccgcccccaucgaaaaaaccaucuccaaagccaaaggacaaccccgagaaccacaagucuacacccucccccccucccgcgaagaaaugacuaaaaaccaagucucucucuggugccucgucaaaggcuucuaccccuccgacaucgccgucgaaugggaauccaacggccaaccagagaacaacuacaaaaccaccccccccguccuagacuccgacggcuccuucuuccucuacuccaaacucaccguagacaaaucccgcuggcaacaaggcaacgucuucuccugcucugucaugcacgaagcccuccacaaccacuacacccaaaaaucccuaucccucucccccggcaaa

SEQ ID NO: 54130 - RNA, 660 nt, Artificial Sequence
  derived and/or modified sequence opt11 from Onartuzumab_LightChain1
gacauccaaaugacacaaucccccucaucccucuccgccuccgucggcgaccgcgucaccaucaccugcaaauccucccaaucccuccucuacaccuccucccaaaaaaacuaccucgccugguaccaacaaaaacccggcaaagccccaaaacuccucaucuacugggcaucaacccgcgaauccggcguccccucccgauucuccggcucuggcuccggcacugacuucacccucaccaucuccucacuccaacccgaagacuucgccaccuacuacugccaacaauacuacgccuaccccuggaccuucggccaaggcaccaaagucgaaaucaaacgcaccgucgccgcacccuccgucuucaucuucccccccuccgacgaacaacucaaauccggcaccgccucugucgucugccuccucaacaacuucuacccccgcgaagccaaaguccaauggaaagucgacaacgcccuccaauccggcaacucccaagaauccguaaccgaacaagacuccaaagacuccaccuacucccucuccuccacccucacccucuccaaagccgacuacgaaaaacacaaagucuacgccugcgaagucacccaccaaggccucuccucucccgucaccaaauccuucaaccgcggcgaaugc

SEQ ID NO: 54131 - RNA, 1362 nt, Artificial Sequence
  derived and/or modified sequence opt11 from Ontuxizumab_HeavyChain1
caaguccaacuccaggaauccggccccggacucguccgccccucccaaacccuaucccucacuugcaccgccuccggguacaccuuuacagacuacgucauccacugggucaaacaaccacccggacgcggacucgaauggauaggcuacaucaaccccuacgacgacgacacuacuuacaaccaaaaauucaaaggacgcgucacaaugcucgucgacaccucauccaacaccgcauaccuccgccucucaucagucaccgcugaagacacagcaguauacuacugcgcacgccgcggcaacuccuaugacggcuacuucgacuacucaauggacuacuggggcagcggcacccccgucaccgucuccuccgccuccaccaaaggccccucaguauucccccuagcccccuccuccaaauccaccuccggcggaaccgcagcccucgguugccuagucaaagacuacuuccccgaaccaguaaccgucuccuggaacuccggcgcccucaccucaggcguucacacauuccccgccguucuccagagcuccggccucuacucccucuccuccgucgucacgguccccucauccucccucggcacccaaacauacauauguaacguaaaccacaaaccauccaacaccaaagucgauaagaaagucgaaccaaaauccugcgacaaaacccauaccugcccacccugucccgccccagaacuccuaggaggccccuccgucuuccucuucccaccuaaacccaaagacacccuuaugaucucccguaccccagaaguaaccugcgucgucgucgacguaucccacgaagacccagaagucaaauucaacugguacguagacggcgucgaaguccacaacgcgaaaaccaaaccccgugaggaacaauacaacagcaccuaccgcgucgucuccguccucaccguacuccaccaagacuggcucaacgggaaagaauacaaaugcaaaguuucuaacaaagcccucccagcccccauagagaaaaccaucuccaaagccaaaggccaaccacgugaaccucaaguguacacccucccacccucccgagacgaacuuaccaaaaaccaagucagccuaaccugccuaguaaaaggcuucuaccccuccgauaucgccgucgaaugggaaucaaauggccaaccggaaaacaacuacaaaaccaccccucccguucuugacuccgacggcuucuucuuccucuacucaaaacucaccgucgacaaaucccgauggcaacaaggcaacgucuucucaugcuccguaaugcacgaagcccuccacaaccacuacacccaaaaaucccucuccuuaucacccggcaaa

SEQ ID NO: 54132 - RNA, 645 nt, Artificial Sequence
  derived and/or modified sequence opt11 from Ontuxizumab_LightChain1
gacauacaaaugacccaaucccccuccucccucucagccuccgucggcgaccgagucaccaucaccugccgugcaucccaaaacgucggcaccgccgucgccuggcuccaacaaacccccggcaaagcccccaaacuccucauuuacuccgccuccaaccgcuacacaggcguccccucccgcuucucaggcucaggcuccggcaccgacuacaccuucaccaucuccucccuucaacccgaagacaucgccaccuacuacugccaacaauacaccaacuaccccauguacaccuucggccaaggcaccaaaguccaaaucaaacgcacagucgccgcccccuccgucuucauauucccccccuccgacgaacaacuaaaauccggcacagccuccgucguaugccuccucaacaacuucuacccccgagaagccaaaguccaauggaaagucgacaacgcccuccaauccggcaacucccaagaauccgucaccgaacaagacagcaaagacuccaccuacucacuauccuccacccucacccuauccaaagccgacuacgaaaaacacaaagucuacgcaugcgaagucacccaccaaggccucuccucccccgucaccaaauccuucaaccgcggcgaaugc

SEQ ID NO: 54133 - RNA, 1341 nt, Artificial Sequence
  derived and/or modified sequence opt11 from Opicinumab_HeavyChain1
gaaguccaacuccucgaaucaggcggaggccucguccaacccggcggcagccuaagacucagcugcgcagccuccggcuucacauucucagcauacgaaaugaaauggguccggcaagcaccaggaaaaggccuagaaugggucuccgucaucggccccuccggcggcuucaccuucuacgccgauucugucaaaggccgauucaccauaucacgugacaauuccaaaaacacccucuaccugcaaaugaacucccuacgcgccgaagauaccgcuguauacuacugcgccaccgaaggcgacaacgacgcauucgacaucuggggccaaggaaccaccguaacagucucuuccgcaucaacaaaaggccccucaguauucccccucgcgccaagcucaaaauccaccuccgggggcacagcugccuuaggcugccucgucaaagacuacuuccccgaaccagucaccguaagcuggaacucaggagcacucaccuccggaguacacaccuuccccgccguccuacaauccuccggacucuacucccucagcuccgucgucacuguacccagcuccagccucggcacccaaaccuacaucugcaaugucaaccacaaacccuccaacaccaaagucgacaagaaaguugaacccaaaucgugcgacaaaacacauacaugcccacccugccccgcccccgagcuacucggcggccccucagucuuccucuucccacccaaacccaaagacacccucaugauaucacgcacacccgaagucacgugcgucgucgucgacgucucacaugaagauccagaaguaaaauucaacugguacgucgacggaguagaaguccacaaugccaaaaccaaaccccgcgaagaacaauacaacagcgcuuaccgagucgucuccguucuuaccguccuccaccaagacuggcuaaacggcaaagaauacaaaugcaaaguuuccaacaaagcccuccccgcaccuaucgagaaaaccaucagcaaagccaaaggccaaccccgagaaccccaagucuacacucucccgccaucacgagacgaacucaccaaaaaccaaguaucccuaaccugccucgucaaaggcuucuauccauccgacauagccgucgaaugggaaucuaauggccaacccgaaaacaacuacaaaacaaccccacccguccuugacuccgacggcucauucuuccucuacucaaaacucaccgucgacaaaucacgcuggcaacaaggaaacgucuucucuuguucagucaugcacgaagcccuacacaaccacuacacccaaaaaucacuaucccucucacccggc

SEQ ID NO: 54134 - RNA, 645 nt, Artificial Sequence
  derived and/or modified sequence opt11 from Opicinumab_LightChain1
gacauccaaaugacccaaucccccgccacccucucccucucccccggcgaacgagccacccuauccugccgagccucccaaucagucuccuccuaccucgcaugguaccaacaaaaacccggccaagccccccgccuccuuaucuacgacgccuccaaccgcgccaccggcauccccgcccgcuucucaggcucaggcucaggcaccgacuucacccucaccaucuccucacucgaacccgaagacuucgccgucuacuacugccaacaacgauccaacuggcccauguacaccuucggacaaggcaccaaacuagaaaucaaacgcacagucgccgcccccuccgucuucaucuucccccccucagacgaacaacucaaauccggcaccgccuccgucgucugccuccucaacaacuucuacccccgcgaagccaaaguccaauggaaagucgacaacgcacuucaaucaggcaacucccaagaauccgucaccgaacaagacuccaaagacuccaccuacucacucuccuccacacucacccucucaaaagccgacuacgaaaaacacaaaguauacgccugcgaagucacccaccaaggccucuccucccccgucaccaaauccuucaacagaggagaaugc

SEQ ID NO: 54135 - RNA, 1941 nt, Artificial Sequence
  derived and/or modified sequence opt11 from Oportuzumab_monatox_HeavyChain1
caccaucaccaccaccacgauauacaaaugacccagagccccagcucccuaucagccucagucggcgaucgcguaacaauaaccugccgcagcaccaaaagccuccuacacuccaauggcaucacauaccucuacugguaccaacagaaacccggcaaagcccccaaauugcucauauaccaaaugagcaaccuggcaucaggaguccccagcagauucuccuccuccggaagcggcacggacuuuacccucacaaucuccagccugcaaccagaagacuucgcuacauacuauugcgcccaaaaccucgaaaucccccguacauucggacaaggcacaaaggucgaacuaaaacgagcaacccccucacacaacucccaucaaguucccagugcaggcggccccaccgcaaacucaggcacaucgggaucugaaguccaacucguacaaucaggacccggccucguucaacccggcggauccguccgcaucuccugcgccgcaucaggcuacaccuucaccaacuacggcaugaacuggguuaaacaagcccccggaaaaggccuagaauggaugggcuggauuaacaccuacacaggagaaagcacauacgcagacuccuucaaaggccguuucacauucagccucgacaccuccgcaagcgcugcauaccuccagaucaacucgcuaagagcagaagauaccgcgguuuacuauugcgccagguucgcaauaaagggcgacuacuggggacaaggcacacuucucacaguaagcucagaguucggaggcgcaccagaguuccccaaacccucaaccccacccggcagcuccggccuagaagguggcucucucgcagcccuaacggcccaccaagccugccaucucccccuagaaaccuucacccgccacagacagcccagaggcugggaacaacucgaacaaugcggcuaccccguacaacgccuagucgcccucuaucuggccgcgcggcucuccuggaaucaagucgaccaagucauacguaacgcccucgccucacccggcagcgguggcgaccucggcgaagccauacgcgaacaacccgaacaagcacgacuagcgcuuacccuagccgccgccgaauccgaacgauucgucagacaaggcacaggcaacgacgaggccggagccgcaucagcagacguagucucccugacaugucccgucgccgccggagaaugcgccggccccgcggacucaggcgacgcacuacucgaacgcaacuacccgacaggagccgaguuccucggcgacggaggcgacgugucauuuuccacccgaggcacccaaaacuggacagucgaacgccuccuccaagcacacagacaacucgaagaacgaggauacgucuucgucgguuaccacggcaccuuccuagaagcagcucaaagcaucguauucgguggcguaagagcccgaagccaagaccuagacgccauuuggagaggcuucuacaucgcaggagauccagcccuggccuacgguuacgcucaagaccaagaaccagacgcacgcggucgcauaagaaacggcgcccuccuccgcguuuacgucccccgcucaucccuaccaggcuucuauagaaccggacuuacccuagccgcaccagaagccgcaggcgaagucgaacgccuuauaggucacccacucccacuccgacuagacgccaucaccggaccagaagaagaaggaggccgacucgaaacaauccuaggauggccccuagcagaacguaccgucgucaucccgucagccauaccaacagacccgagaaacgucgguggcgaccuagacccuagcuccauccccgacaaagaacaagcuaucuccgcccuccccgacuacgcaagccagccaggaaaaccaccccaccaccaccaccaccacaaagacgaacua

SEQ ID NO: 54136 - RNA, 1941 nt, Artificial Sequence
  derived and/or modified sequence opt11 from Oportuzumab_monatox_SingleChain_variable_fragment
caccaccaccaccaccacgacauccaaaugacacaaucacccucgucacucuccgcgucagucggagaccgaguaaccauaaccugcagaucaaccaaaucccuccuacacucaaacggcaucaccuaccucuacugguaccaacaaaaacccggcaaagcccccaaacuccuaaucuaccaaaugucuaaucuugccucaggcgucccuucccgauucagcuccucaggaucagguacggacuucacccuaacaauaucaucacuacaaccugaagacuucgcuaccuacuacugcgcacaaaaccucgaaauccccagaaccuucggccaagguaccaagguagaacuaaagcgcgccacacccagucacaacucacaccaaguuccaucugccggcggacccaccgccaacucaggaacuagcgguuccgaaguacaacuuguccaaagcggcccaggccuaguacagccgggaggauccguccgcauauccugcgcugcaagcggauacaccuucacaaacuacggcaugaacuggguaaagcaagcacccggcaaaggccuugaauggaugggcuggaucaacaccuacacaggagaauccacauacgccgacuccuucaaaggccgauucacauuuagccucgacacauccgccuccgcugcauaucuccaaaucaacucacuccgugccgaagacacagccgucuacuacugcgcucgcuucgcaauaaaaggggacuacuggggacaaggcacacuucucacagucagcucugaguucggaggggccccugaguucccuaaacccuccacgcccccaggaagcucaggacucgaaggaggaucacuugccgcccucaccgcccaccaagccugccaccuuccccucgaaacauucacacgacaccgccagcccagaggcugggaacaacuagaacaaugcggcuacccaguccaacgacucguagcccucuaccuggcugcacgacucuccuggaaccaaguagaccaaguaauacgcaacgcccuugcauccccugguucaggaggggaccucggcgaagccauuagagaacaaccagaacaagcccgccucgcacucacucucgcagccgccgaauccgaaagauucgucagacaaggcaccggcaacgacgaagccggugcagcaucagccgacgucguaucacuaaccugcccagucgccgccggcgaaugcgccgguccagccgauuccggcgacgcguuacuagaaagaaacuaccccaccggugccgaguuccucggugacggcggagacgucagcuucagcacacgaggcacacaaaacuggacagucgaacggcuccuccaagcacauagacaacuagaagaacgcggcuacgucuucgucgguuaccacggcaccuuccucgaagcagcccagucgauaguguucggcgguguccgagcaagaucccaggaccuagacgccaucuggcgcggcuucuauauagccggcgaccccgcacucgccuacggauacgcacaagaccaagaaccagacgcccguggccgaauccgaaacggcgcgcuccucagagucuacguaccacgauccuccuuacccggcuucuaccgaacaggccuaacacuagcugccccagaagccgcaggcgaaguagaaagacucauaggucacccacuuccccuccgucuagacgcuaucaccggucccgaagaagaaggaggccguuuagaaacaauacuaggcuggccccuagccgaacgaaccgucguaaucccaagcgcaauacccacugacccccgcaacgucggcggagaccuagacccauccagcauccccgacaaagaacaagccauaucagcccucccugacuacgccagccaacccggaaaaccgccccaucaccaccaccaccacaaagacgaacuc

SEQ ID NO: 54137 - RNA, 762 nt, Artificial Sequence
  derived and/or modified sequence opt11 from Oreptacog_alfa_HeavyChain1
aucgucgguggaaaagucugccccaaaggagaaugccccuggcaaguccuucuccuagucaacggcgcccaacucugcggcggcacccuaaucaacaccaucugggucguauccgccgcccacugcuucgacaaaaucaaaaacuggcgcaaccucaucgcaguccuaggagaacacgaccucuccgaacacgacggcgacgaacaaucccgccgaguagcccaagucaucauccccuccaccuacguccccggcacaaccaaccacgacauagcacuccuccgccuccaccaacccgucaaccucacagaccacgucgucccacuaugccuacccgaacgcaccuucuccgaacgcacacuagccuucguccgauucucacucgucuccggcuggggccaacuccucgaccgcggcgccaccgcccucgaacucaugguacuaaacgucccccgccucaugacccaagacugccuacaacaaucccgcaaagucggcgacucacccaacaucacugaauacauguucugcgccggcuacuccgacggcucaaaagacuccugcaaaggagacuccggaggcccccacgccacccacuaccgcggaaccugguaccuaaccggcaucgucuccuggggccaaggcugcgccaccguaggccacuucggagucuacaccagagucucccaauacaucgaauggcuccaaaaauuaaugcgcucagaaccccgccccggcguccuccuccgagccccuuucccc

SEQ ID NO: 54138 - RNA, 456 nt, Artificial Sequence
  derived and/or modified sequence opt11 from Oreptacog_alfa_LightChain1
gccaacgccuuccucgaagaacuccgccaaggcucacuagaacgcgaaugcaaagaagaacaaugcagcuucgaagaagcccgcgaaaucuucgaagacgaagaagaaaccaaacucuucuggaucuccuacagcgacggcgaccaaugcgccuccagccccugccaaaacggcggcuccugcaaagaccaacuccaaagcuacaucugcuucugccuccccgccuucgaaggccgcaacugcgaaacccacaaagacgaccaacucaucugcgucaacgaaaacggcggcugcgaacaauacugcuccgaccacaacggcaccaaacgaagcugccgcugccacgaaggcuacagccuacucgccgacggcgucucaugcacccccaccgucgaauaccccugcggcaaaauccccauacucgaaaaacgaaacgccagcaaaccccaaggccgc

SEQ ID NO: 54139 - RNA, 1353 nt, Artificial Sequence
  derived and/or modified sequence opt11 from Orticumab_HeavyChain1
gaaguucaacuccucgaauccggcggcggccucguccaacccggaggcucacuccgccucagcugcgcagccuccggcuucaccuucucaaacgccuggaugucuugggucagacaagcccccggaaaaggccuugaaugggucucguccaucucagucgguggccaccgcaccuacuacgccgacucagucaaaggccgcucaacgaucucccgagacaacagcaaaaacacucuuuaccuccaaaugaacucccuacgagccgaagacacagccgucuacuacugcgcccguauccgcgugggccccucaggaggcgccuucgacuacuggggccaaggcacacucgucacagucagcuccgccuccaccaaaggcccauccgucuucccccucgcacccuccuccaaauccacauccggaggaacagccgcccucggcugccuagucaaagacuacuuccccgaaccagucacagucucuuggaacucaggcgcacuaaccuccgguguccacaccuuccccgccguuuuacaauccuccggccucuacucacucuccuccgucgucaccguccccuccuccucccucggcacccaaacauacauaugcaacgucaaccacaaacccucuaacaccaaagucgacaagaaaguagagcccaaauccugcgacaaaacccacacuugcccuccaugccccgcccccgaacuccuaggcgguccuuccgucuuccuguuuccucccaaacccaaagacacccuaaugauaucccgcacccccgaaguuaccugcgucgucguagacgucucucacgaagaccccgaaguaaaauucaacugguacgucgacggcguugaaguccacaacgcaaaaaccaaaccccgcgaagaacaguacaacuccaccuaccgcguugucagcguacuaacaguccuccaccaagacuggcucaacggcaaagaauacaaaugcaaagucuccaacaaagcacuccccgccccuauagagaaaacaaucucaaaagccaaaggacaaccucgagaaccccaggucuacacucucccaccaucgcgcgacgaacuuaccaaaaaccaagucucccucacuugccucgucaaaggcuucuaccccuccgacaucgccgucgaaugggaauccaacggccaacccgagaacaacuacaaaaccaccccucccguccucgacucagacggcagcuucuuccucuacucaaagcucacaguagacaaaucgcgcuggcaacaaggcaacguauucuccugcuccguaaugcacgaagcucuccacaaccacuacacccaaaaaucccucucccucagccccggcaag

SEQ ID NO: 54140 - RNA, 648 nt, Artificial Sequence
  derived and/or modified sequence opt11 from Orticumab_LightChain1
caauccguccuaacccaaccaccauccgccucaggaacacccggacaacgcguaaccaucuccugcuccggcucaaauaccaacaucggcaaaaacuacgucucaugguaccaacaacuccccggcaccgcccccaaacuccucaucuacgccaacuccaaccgacccuccggaguccccgaccgcuucuccggcucaaaauccggcaccuccgccuccuuagccaucuccggccuccgauccgaagacgaagccgacuacuacugcgccucaugggacgccucccucaacggcugggucuucggcggcggcacaaaacucaccguccucggacaacccaaagccgcacccuccgucacccucuucccccccuccuccgaagaacuccaagccaacaaagccacccuagucugccucaucuccgacuucuaccccggagccgucaccgucgccuggaaagccgacuccucccccgucaaagccggcgucgaaaccaccacccccuccaaacaauccaacaacaaauacgccgccuccuccuaccucucccuuacccccgaacaauggaaaagccaccgcuccuacagcugccaagucacccacgaaggcuccacagucgaaaaaaccgucgcccccaccgaaugcucc

SEQ ID NO: 54141 - RNA, 1347 nt, Artificial Sequence
  derived and/or modified sequence opt11 from Otelixizumab_HeavyChain1
gaaguccaacuacucgaauccgguggaggccucguccaacccggcggcucccuccgccucucaugcgccgccagcggauucaccuucuccuccuuccccauggcauggguacgccaagcacccggaaaaggccuggaaugggucagcacaaucucaacauccggaggacgcaccuacuaccgcgacuccgucaaaggccgcuucaccauaucccgcgacaacuccaagaacacucuguaccuccaaaugaacucgcuccgcgccgaagacacagccgucuauuauugcgcaaaauuccgccaauacuccggaggcuucgacuacuggggacaaggaacacucgucaccgucucauccgcauccaccaaaggcccauccguauucccacuagcccccuccucaaaaucuaccuccggaggcaccgccgcccuaggcugccucgucaaagacuacuuccccgaacccgucaccgucuccuggaacucaggcgcccucaccuccggcguccacaccuucccagcaguacuccaaucaucaggacucuacucccucuccucugucgucaccguccccucaucaucccugggcacgcaaacauacaucugcaacguaaaccacaaacccuccaacaccaaggucgacaagaaagucgaacccaaaagcugcgacaaaacacacacaugcccacccugccccgcacccgagcuacucggcggaccuucaguauuccucuucccucccaaacccaaagacacccuuaugaucucccgaacccccgaaguaaccugcgucgucguugacgucucccacgaagacccagagguaaaauucaacugguacgucgacggcgucgaaguccacaacgccaaaaccaaaccgcgagaagaacaauacgcaagcaccuaccgcgucgucucaguccucaccguccuucaccaagacuggcucaacggaaaagaauacaaaugcaaagucucaaacaaagcccuaccugcccccauagagaaaacaaucuccaaagcaaaagggcaaccacgcgaaccgcaggucuacacccucccacccucaagagacgaacucaccaaaaaccaagucucccuaaccugccucgucaagggcuucuaccccuccgacauagccgucgaaugggaauccaauggccaacccgagaauaacuacaaaacuaccccacccguacuggacucagacggcuccuucuuccuuuacucgaaauuaacagucgauaaaucccgcuggcaacagggcaacguuuucucaugcucaguaaugcacgaagcacuucacaaccacuacacacaaaaaucccuaucucucucccccggcaaa

SEQ ID NO: 54142 - RNA, 648 nt, Artificial Sequence
  derived and/or modified sequence opt11 from Otelixizumab_LightChain1
gacauccaacucacccaacccaacuccgucuccaccucccucggcuccaccgucaaacuauccugcacacucucauccggcaauaucgaaaacaacuacguccacugguaccaacucuacgaaggacgcuccccaaccaccaugaucuacgacgacgacaaacgccccgacggcguccccgaccgauucucaggcuccaucgaccgcuccucuaauuccgccuuccucaccauacacaacgucgccaucgaagacgaagccaucuacuucugccacuccuacgucuccuccuucaacgucuucggcggcggcaccaaacucaccguccuccgccaacccaaagcagcccccuccgucacacucuucccccccuccuccgaagaacuccaagccaacaaagccacacucgucugccucaucucugacuucuaccccggcgccgucaccgucgccuggaaagcugacucuuccccagucaaagccggcgucgaaacuaccacccccuccaaacaauccaacaacaaauacgccgccuccucauaccuaucccucacccccgaacaauggaaaucccaccgcuccuacuccugccaagucacccacgaaggaagcaccgucgaaaaaaccgucgcccccaccgaaugcucc

SEQ ID NO: 54143 - RNA, 1449 nt, Artificial Sequence
  derived and/or modified sequence opt11 from Otlertuzumab_HeavyChain1
gaaguucaacugguacaaagcggagccgagguaaagaagccaggagaaagccuaaaaaucagcugcaaaggaagcggauacucauucacaggauauaacaugaacugggucagacaaaugcccggaaaagggcuagaauggaugggcaauaucgaccccuacuacggcggcaccacauacaacagaaaauucaaagggcaagucacaauaagcgcagacaaaagcauaagcacagccuaccuccaaugguccagccuaaaagccucagacaccgccauguacuacugcgcccgaagcgucggacccuucgacagcuggggccaaggcacacuugugacaguuagcucaggcggcggcggcagcggaggugggggcucgggaggaggcggaagcggagggggaggauccggcggcggcggguccgaaaucguccuaacccaaucacccgcuacccugagccucagcccgggagagcgcgccacacuguccugccgagcaagcgaaaacguauacucauaccuagccugguaccaacaaaaaccaggccaagcacccagacuccuaaucuauuucgccaaaacacucgcagaaggcauccccgcaagauucuccggcucgggcucaggcacggacuucacccucaccauaagcucccuagagcccgaagacuucgccguguacuacugccaacaccacagcgacaacccguggaccuucggccaaggcaccaaagucgaaaucaaaggagaccaagaacccaaaagcucugacaaaacccacaccuccccacccugccccgccccagaacuacucggaggccccuccguauuccucuucccacccaaacccaaagacacauuaaugaucuccagaacccccgaagucacaugcguagucguagacguaucacaugaagaccccgaggucaaauucaacugguacgucgacggcguagaaguacacaacgcaaaaaccaaacccagggaggaacaauacaacucaaccuaccgugucgucucaguacuaacugugcuccaucaagacuggcuaaacggcaaggaauacaaaugcaaagucucaaauaaagcccuccccgcccccaucgaaaagaccauaagcaaggccaaaggccaacccagggaaccucaagucuacacacucccaccaucccgcgacgagcuaaccaagaaccaagucucacucacaugccuugucaaaggauucuaccccagcgacauagcagucgagugggaauccaacggccaaccugaaaacaauuacaaaacaacacccccaguccucgacuccgacggcagcuucuuccuguacucaaaacuaacaguagacaaaagccgauggcaacaaggaaacguauucucgugcucggucaugcacgaagcacuacacaaccacuacacacagaaaagccucucacuaucccccggaaaa

SEQ ID NO: 54144 - RNA, 1347 nt, Artificial Sequence
  derived and/or modified sequence opt11 from Oxelumab_HeavyChain1
gaaguccagcuacucgaauccggcggcggccucguacaacccggcggcucccuccgcuuauccugugccgccuccggcuucaccuucaacucauacgcuaugucuuggguccgccaagccccaggcaaaggacuagaaugggucuccaucaucuccggaucaggagguuucaccuacuacgcagacuccguaaaaggacgcuucacaauaucacgagacaacucccgaacaacccuuuaccuacaaaugaacucccuacgcgccgaagauaccgccguauacuacugcgccaaagaccgccuggucgcccccgguacauucgacuacuggggacaaggagcacucgucacggucaguuccgcauccaccaaaggccccuccgucuucccccucgcaccauccuccaaauccaccagcgguggaaccgcagcacucggaugccucguaaaagacuacuuccccgaacccguaacagucuccuggaacuccggcgcccuuacaucaggcguccacaccuuccccgccguccuccaauccucaggacuguacucccucagcagcgucgucaccguccccucuuccucccuuggcacccaaaccuacauuugcaaugucaaccacaagcccucaaacaccaaagucgacaagaaagucgaacccaaauccugcgacaaaacacacacaugcccacccugccccgcccccgaacuacuuggcggccccagcgucuuccuauucccucccaaacccaaagacacccucaugaucucacgaacccccgaagucacuugcguagucgucgacgucucucacgaagaccccgaaguaaaauucaacugguaugucgacggcgucgaaguacacaacgccaaaaccaaaccccgagaagaacaauauaacagcaccuaccgcgucgucagcguccuuaccguccuacaccaagacuggcucaacggcaaagaauacaaaugcaaagucuccaacaaagcacuccccgccccaaucgagaaaaccauauccaaagcuaaaggccaaccacgcgaaccccaaguauacacccuaccgcccucccgcgacgaacuuaccaaaaaccaaguaucacucacaugccuagucaaaggcuucuaccccucagacaucgcugucgaaugggaauccaacggccaacccgaaaacaacuacaaaacuacacccccaguccucgacuccgacggauccuucuuccucuacucaaaacucaccguagacaaaucacgcuggcaacaaggaaacgucuucuccugcagcgucaugcacgaagcacuccacaaccacuacacgcaaaaaucccucucccucucaccaggc

SEQ ID NO: 54145 - RNA, 642 nt, Artificial Sequence
  derived and/or modified sequence opt11 from Oxelumab_LightChain1
gacauccaaaugacccaaucccccuccucccucuccgccuccgucggcgaccgcguuaccauaaccugccgcgcaucccaaggcaucuccuccuggcuagccugguaccaacaaaaacccgaaaaagcccccaaaucccucaucuacgccgccuccucccuccaauccggcgucccaucccgauucucuggcuccggauccggcacagacuucacccucaccaucuccucccuccaacccgaagacuucgccaccuacuacugccaacaauacaacuccuaccccuacacauucggccaaggcaccaaacucgaaaucaaacgaacagucgccgccccauccgucuucaucuucccacccuccgacgaacaacucaaauccggcaccgccuccgucguaugccuccucaacaacuucuacccccgcgaagccaaaguccaauggaaagucgacaacgcccuucaaucuggcaacucccaagaaagcgucaccgaacaagacuccaaagacucaaccuacucccucucuucaacccucacccuauccaaagccgacuacgaaaaacacaaaguauacgccugcgaagucacccaccaaggccucagcucacccguaaccaaauccuucaaccgcggcgaaugc

SEQ ID NO: 54146 - RNA, 1329 nt, Artificial Sequence
  derived and/or modified sequence opt11 from Ozanezumab_HeavyChain1
caaguacaacucguccaaucaggcgccgaaguaaagaaacccggcgccuccgucaaagucuccugcaaagccucuggcuacacauuuaccuccuauuggaugcacuggguccgacaagcccccggccaaggacuagaauggaucggcaacaucaaccccuccaacggaggcacuaacuacaacgaaaaauucaaauccaaagcgacaaugacacgagacacaucaaccagcaccgccuacauggaacucuccucacuccgguccgaagacaccgccgucuacuacugcgaacucaugcagggguacuggggccaaggcaccuuagucacugucucauccgccuccacgaaaggccccagcguuuucccgcucgcaccaucguccaaaucaaccucaggagggacagccgcccucggcugccucgucaaagacuacuuccccgaacccguaaccgucuccuggaacagcggugcacucaccucaggcguucacaccuuccccgcaguccuccaaagcucgggccucuacagccucuccuccgucguuacaguccccucauccucccuaggcacccaaaccuacaucugcaacguaaaccacaaaccaucaaacaccaaagucgacaagaaagucgaaccaaaaagcugcgacaaaacucacacaugcccacccugccccgcgcccgaacucgccggugcacccuccgucuuccuauucccacccaaacccaaagacacccuaaugauaucccgcacccccgaaguaacaugcgucgucgucgacguaagccacgaagaccccgaagucaaauucaacugguacguagacggcgucgaaguccacaaugccaaaaccaaaccccgcgaagaacaauacaacucuaccuaccgcgucgucuccguacucaccguccuccaccaagacuggcucaacggcaaagaauacaaaugcaaaguauccaacaaagcccuucccgcaccaaucgagaaaaccaucagcaaagcuaaaggccaaccacgcgaaccccaagucuacacccuuccacccucucgcgacgaacucaccaaaaaccaagucagccugaccugccucgucaaaggcuucuaccccucagacaucgccguugaaugggaauccaacggccagcccgaaaacaacuacaaaacaaccccgccaguccuggacuccgacggcucauucuuccucuacuccaaacuaaccgucgacaaaucccgcuggcaacaaggcaacgucuucucaugcuccgucaugcacgaagcccuucacaaccacuacacccaaaaaucccucagccucuccccaggaaaa

SEQ ID NO: 54147 - RNA, 657 nt, Artificial Sequence
  derived and/or modified sequence opt11 from Ozanezumab_LightChain1
gacaucgucaugacccaaagcccccuauccaacccagucacccucggccaaccagucucaaucuccugccgauccuccaaaucccuacucuacaaagacggcaaaaccuaccucaacugguuccuccaacgccccggacaaucaccccaacucuuaaucuaccucauguccacccgcgcauccggcgucccagaccgcuucuccggcggcggcucaggcacggacuucacacuaaaaaucucccgcgucgaagccgaagacgucggcgucuacuacugccaacaacucgucgaauacccccucaccuucggccaaggcaccaaacucgaaaucaaacgcacagucgccgcccccagcgucuucauauucccacccuccgacgaacaacucaaaucaggcaccgccuccgucgucugccuacucaacaacuucuacccccgagaagccaaaguccaauggaaagucgacaacgcacuacaauccggcaacucacaagaaucagucaccgaacaagacuccaaagacuccaccuacucccucuccuccacccuaacacucuccaaagccgacuacgaaaaacacaaaguauacgccugcgaaguaacccaccaaggccucucaucacccguaaccaaauccuucaaccguggcgaaugc

SEQ ID NO: 54148 - RNA, 1089 nt, Artificial Sequence
  derived and/or modified sequence opt11 from Ozoralizumab_HeavyChain1
gagguccagcucguggagucgggagggggauuaguccagcccgggggaucauuaaggcuaucaugcgcggcaucaggauuuacauuuagugacuacuggauguauugggugcgacaggccccgggaaagggauuagaaugggucucagaaauaaacacgaacgggcuaauaaccaaguacccggacucgguaaagggaagguucacaaucucacgagauaaugcgaaaaacacccuguacuuacagaugaacucacucaggcccgaggacacggcaguguacuacugcgcgcgcucacccucgggauucaacagaggccagggcacacuugugacugugagcucgggcgggggcgggagcgggggagggagcgagguccagcucguggaaagcggcggaggcuugguccagcccgggaacucgcuacggcuaucaugcgcggccucaggcuuuaccuuuagcucguucgggaugucgugggugcgacaagcgccgggcaagggccuagaaugggucucgagcauaagcggaagcgggagcgacaccuuguacgcggacaguguaaagggcagguucacgaucagucgcgauaacgcgaaaacgacccuguacuugcaaaugaacucgcucagacccgaagacacggcaguguacuacugcacgauugggggaucacuaucgagaagcagccaaggaacgcuugugacagugagcucggguggaggcgggagcggaggaggaagcgagguccagcuaguggaaucgggcggaggccugguccaaccagggggcucgcucaggcucucgugugcggccucgggcuuuacauuuagcgauuacuggauguacugggugcgccaggccccggguaagggauuggaguggguaucggaaauuaacacaaacggacuaauaaccaaguacccagacucgguaaagggcagguucacgaucucccgagauaaugcgaaaaauacccuguacuugcaaaugaacucacucaggcccgaggacacggccguauacuauugcgcgcgaucgcccuccggcuuuaacaggggccaaggcacgcucgugacagugagcucg

SEQ ID NO: 54149 - RNA, 1350 nt, Artificial Sequence
  derived and/or modified sequence opt11 from Palivizumab_HeavyChain
caagucacacuccgcgaaucaggcccagcccucguuaaaccaacccaaacccucacccuaaccugcacauucagcggauucucacuauccacaucuggaauguccguaggcuggauccgccaaccacccggcaaagcccuagaauggcucgccgacaucuggugggacgacaagaaagacuacaaccccucccucaaguccagacucacuaucucaaaagacaccuccaaaaaccaagucguccuaaaaguaaccaacauggaccccgccgauaccgccacauacuacugcgccagaagcaugauaaccaacugguacuucgacgucuggggcgcaggcaccacaguaaccguaucauccgccuccaccaaaggccccuccgucuucccccuggcuccaucaagcaaauccacaagcgggggaacggccgcauuaggcugccucguaaaagacuauuucccagaaccugucaccgucagcuggaacucaggcgcccuaacauccgguguccacacauuccccgccguccuucaauccucuggucuauacucacucucaagcgugguuacaguccccucaagcucccuaggaacccaaaccuacaucugcaacguuaaccacaagcccucaaacacaaaagucgacaaacgaguggaacccaaaagcugcgacaaaacccacacaugucccccaugccccgcacccgaacuccucggcggcccaucaguauuccuuuucccacccaaaccaaaagacacacucaugaucagccgaaccccagaagucacaugcgucgucgucgaugucucccacgaagaccccgaagucaaauucaacugguacguagacggcgucgaaguucauaacgcaaaaacuaaaccccgcgaagaacaauacaacagcacauaccgcgucgucuccguccuaacagucuugcaucaagacuggcucaacggaaaagaauacaaaugcaaaguauccaacaaagcucuccccgccccaaucgagaaaaccaucuccaaagccaaaggacaaccccgagaaccccaagucuacacccugcccccaucccgagaagaaaugaccaaaaaccaagucucccuaaccugccucgucaaaggcuucuaccccucagacaucgccgucgaaugggaaucaaacgggcaacccgaaaacaacuacaaaacaaccccacccguacuagacagcgacggauccuucuuccuauacucaaaacugaccguagacaagucacgcuggcaacaaggcaacguauucuccugcucaguaaugcacgaagcccuacacaaccacuacacgcaaaaaucccucucccucucccccggaaaa

SEQ ID NO: 54150 - RNA, 639 nt, Artificial Sequence
  derived and/or modified sequence opt11 from Palivizumab_LightChain
gacauccaaaugacccaaucccccuccacccuauccgccuccgucggcgaccgcgucacaauaaccugcaaaugccaacucucaguaggcuacaugcacugguaccaacaaaaacccggcaaagcccccaaacuucuaaucuacgacaccuccaaacucgccuccggcguccccucacguuucuccggcuccggcuccggcaccgaauucacccucaccaucuccucccuccaacccgacgacuucgccacauacuauugcuuccaaggcuccggcuaccccuucaccuucggcggcggcaccaaacucgaaaucaaacgcaccgucgcagccccauccguauucaucuucccccccuccgacgaacaacucaaauccggcaccgccuccgucgucugccuccucaacaacuucuacccccgcgaagccaaaguccaauggaaagucgacaacgcccuccaauccggcaacucacaagaaucuguaaccgaacaagacucaaaagacuccaccuacucacucuccuccacucucacccucuccaaagccgacuacgaaaaacacaaagucuacgcaugcgaagucacccaccaaggccucuccucccccgucaccaaauccuucaaccgaggcgaaugc

SEQ ID NO: 54151 - RNA, 360 nt, Artificial Sequence
  derived and/or modified sequence opt11 from Palivizumab_VH-Region
caagucacccuccgcgaauccggccccgcccucgucaaacccacccaaacccucacccucaccugcaccuucuccggcuucucccucuccaccuccggcauguccgucggcuggauccgccaaccccccggcaaagcccucgaauggcucgccgacaucuggugggacgacaaaaaagacuacaaccccucccucaaaucccgccucaccaucuccaaagacaccuccaaaaaccaagucguccucaaagucaccaacauggaccccgccgacaccgcaacauacuacugcgcccgcuccaugaucaccaacugguacuucgacgucuggggcgccggcaccaccgucaccgucuccucc

SEQ ID NO: 54152 - RNA, 1347 nt, Artificial Sequence
  derived and/or modified sequence opt11 from Pamrevlumab_HeavyChain1
gaaggacaacucguccaaucaggaggcggccucguccacccaggcggcucucuccgccucuccugcgcaggauccggcuucaccuucuccuccuacggaaugcacugggucagacaagccccgggaaaaggacuagagugggucagcggcaucggcacaggcggcggcacauacucaacagacuccgucaaaggccgcuucaccaucucacgcgacaacgccaaaaacucacuauaccugcaaaugaacucacuccgcgcagaagacauggccgucuacuacugcgcccgcggcgauuacuacggaucagguuccuucuucgauuguuggggccaaggcacccucgucacagucucaucugccuccacaaaaggccccucagucuucccacucgcccccuccuccaaauccaccuccggaggcaccgcagcccuaggcugcuuagucaaagacuacuucccagaacccgucacaguaucauggaacuccggcgcacucacgagcggcguacacaccuuccccgccguccuccaauccucaggacuauacucacucucaucggucgucaccgucccauccucaucucucgguacccaaaccuacaucugcaacguaaaccacaaacccucaaacacuaaagucgacaaacgagucgaacccaaauccugcgacaaaacacacacaugucccccaugccccgcccccgaacuccuaggaggucccagcgucuuccucuucccgcccaaacccaaagacacacuaaugauaucccgcacccccgaagucacaugcguagucgucgacgucucccacgaagacccagaagucaaauucaacugguacgucgacggcgucgaaguccacaacgccaaaaccaagccacgcgaagaacaauacaacagcaccuaccgcgucgugagcguccucaccguccuccaccaagacuggcuaaaugguaaagaauacaaaugcaaaguauccaacaaagcccugcccgccccaauugagaaaaccaucuccaaagccaaaggccagccccgcgaaccccaagucuacacccuacccccaucccgagaagagaugaccaaaaaccaagucucccuaaccugccuagucaaaggauucuaccccucagacaucgccgucgaaugggaaucaaacggacaaccugaaaacaacuacaaaaccacacccccuguccuagacuccgacggauccuucuuccucuacuccaaacucacaguagacaaaucccgauggcaacaaggcaacgucuucuccugcucagucaugcacgaggcacuccacaaccacuacacccaaaaaucucuuucccuaucccccggc

SEQ ID NO: 54153 - RNA, 642 nt, Artificial Sequence
  derived and/or modified sequence opt11 from Pamrevlumab_LightChain1
gacauccaaaugacacaaucccccucuucccucuccgccuccgucggcgaccgagucacaauaaccugccgcgccucccaaggcaucucaucauggcucgccugguaccaacaaaaaccugaaaaagcccccaaaucccuaaucuacgccgccuccucccuccaauccggaguccccucccgcuucuccggauccggcuccggaaccgacuucacacucaccaucuccucccuccaacccgaagacuucgccaccuacuacugccaacaauacaacucauacccacccacauucggccaaggcaccaaacucgaaaucaaacgcaccgucgccgcccccucagucuucaucuucccacccucagacgaacaacucaaauccggcacagccucugucgucugccuccucaacaacuucuacccccgcgaagccaaaguccaauggaaagucgacaacgcccuacaauccggcaacucucaagaauccguaaccgaacaagacuccaaagacuccaccuacucccucuccuccacccucaccuuauccaaagccgacuacgaaaaacacaaagucuacgccugcgaagucacccaccaaggacucuccucacccgucaccaaauccuucaaccgcggcgaaugc

SEQ ID NO: 54154 - RNA, 1305 nt, Artificial Sequence
  derived and/or modified sequence opt11 from Panitumumab_HeavyChain1
cagguccaacuacaagaauccggccccggccuaguaaaacccucagaaacccuaucccuaaccugcaccguuucuggcggcuccgucagcagcggcgacuacuacuggaccuggauccgccaaucccccggcaagggccucgaauggaucggacacaucuacuacucaggaaacaccaacuacaaccccucccucaaauccagacucacaauauccaucgacaccuccaaaacucaguucucacucaagcucucuuccgucacugccgcagacaccgccauauacuacugcguccgcgaccgcgucaccggagccuucgacaucuggggccaaggcaccauggucaccguaucaagugcauccacaaaaggccccucagucuucccccucgcacccugcucucgauccacaucugaaucaacagcagcccuaggcugccucgucaaagacuacuuccccgaacccgucaccgucucuuggaacuccggagcacucaccagcggcguccacacauucccagcaguccuccaauccuccggccucuacucacucuccucagucgucaccguccccuccucuaacuucggcacccagacauacacaugcaacgucgaucauaaaccuuccaacacaaaggucgacgaacgaaaaugcugcgucgaaugcccagcaggcccauccgucuuccucuucccacccaaacccaaagacacacucaugaucucccguacccccgaaguaacaugcgucgucgucgacgucagccacgaagaccccgaaguccaauucaacugguacgucgacggaguagaaguccacaacgccaaaaccaaaccccgcgaagaacaauuuaacuccacauuccgcguugucucgguucucacagucguccaccaagacuggcucaacggcaaagaauacaaauguaaagucuccaacaaaggucuccccgcacccaucgagaaaaccaucuccaagaccaagggacaaccccgugaaccccaaguauacacccuaccacccucccgagaagaaaugaccaaaaaccaagucucacugaccugccucguaaaaggcuuuuaccccuccgacauagcuguagagugggaauccaacggccaacccgaaaauaacuacaaaaccaccccacccaugcucgacucagacggauccuucuuccucuacagcaaacugacugucgacaaaucucgcuggcaacaaggaaacguuuucucaugcuccgucaugcacgaagcccuucacaaccacuacacacaaaaaucccucucacucucccccgguaaa

SEQ ID NO: 54155 - RNA, 642 nt, Artificial Sequence
  derived and/or modified sequence opt11 from Panitumumab_LightChain1
gacauccaaaugacccaaucccccuccucccucagcgcauccgucggcgaccgcgucaccauaacaugccaagccucccaagacaucuccaacuaccucaacugguaccaacaaaaacccggcaaagcccccaaacuucucaucuaugacgcauccaaccucgaaaccggcguccccucccgauucuccggcuccggcucaggcaccgacuucacuuucaccaucuccucacuccaacccgaagacaucgccaccuacuucugccaacacuucgaccaccucccccucgcauucggcggcggcaccaaagucgaaaucaaacgcaccgucgccgcccccuccgucuucaucuucccccccucugacgaacaacuaaaaucaggcaccgccuccgucgucugccuccucaacaacuucuacccccgcgaagccaaaguccaauggaaagucgacaacgcccuccaauccggcaacucccaagaauccguaaccgaacaagacucaaaagacuccaccuauucccuauccuccacccucacacucuccaaagccgacuacgaaaaacacaaagucuacgccugcgaagucacccaccaaggccucuccucccccgucaccaaaucauucaaccgcggcgaaugc

SEQ ID NO: 54156 - RNA, 1326 nt, Artificial Sequence
  derived and/or modified sequence opt11 from Pankoab_HeavyChain1
gagguacaacucguagaaucaggcggcggccucguccaacccggcggcagccgccucuccugcguagcauccggcuuccccuuuagcaacuacuggaacugggucagacaagcccccggcaaaggccucgaauggguaggggaaauccgccucaaaagcaacaacuacaccacucacuacgccgaaucggucaaaggccguuucaccaucucccgagacgacuccaaaaacucccucuaccuccaaaacucccucaaaacagaagacacagcaguauacuacugcacccgccacuacuacuucgacuacuggggacaaggcacccucgugacaguauccucagccuccaccaaaggccccucaguauucccauuagccccaucuuccaaauccaccuccggaggcacagccgcccuaggcugccucguaaaagacuacuuccccgaacccguuaccgucuccuggaacuccggcgcccuuaccuccgguguccacaccuuccccgcaguccuccaauccagcggucuuuacucgcucuccucggucgucacuguccccucauccucacuaggcacccaaaccuacaucugcaaugucaaccacaaacccuccaacaccaaggucgacaagaaagucgaaccaaaauccugcgacaaaacccauaccugcccucccugccccgccccagaacuccuugguggccccuccgucuuccucuuucccccaaaacccaaagacacccucaucucccgaacaccagaagucacaugcgucguuguugacgucucccacgaagaccccgaaguaaaauucaacugguacguagacggcgucgaaguccacaacgccaaaaccaaaccccgcgaagaacaauacaacuccaccuaccguguagucucaguacucaccguccuccaccaagacuggcucaacggcaaagaauacaaaugcaaagucuccaacaaagcccucccagcacccaucgagaaaacuauaucaaaagccaaaggacaaccccgugaaccacaaguauacacacuuccacccucccgcgacgaacucaccaaaaaccaagucucauuaaccugccuagucaaaggcuucuaccccagcgacaucgcagucgaaugggaauccaacggccaacccgaaaacaacuacaaaaccaccccacccguccucgacuccgacggauccuucuuccucuacuccaaacucaccgucgacaaaucccgcuggcaacaaggcaacgucuucuccugcucaguacacgaaggucuacacaaucacuacacacaaaagagccugucccucagccccggcaaa

SEQ ID NO: 54157 - RNA, 651 nt, Artificial Sequence
  derived and/or modified sequence opt11 from Pankoab_LightChain1
gacaucgucacacaaucaccccucuccaaccccgucacacccggagaacccgcauccaucuccugccgcuccuccaaaucccuccuccacuccaacggcaucaccuacuucuucugguaccuccaaaaacccggccaaucaccccaacuucucaucuaccaaagcaaccuagcauccggcguccccgaccgauucucaggcuccggcucaggaaccgacuucacacuccgcaucucccgagucgaagccgaagacgucggagucuacuacugcgcccaaaaccucgaacucccacccaccuucggccaaggcaccaaagucgaaaucaaacgcaccgucgcagcccccuccguauucaucuucccacccuccgacgaacaacucaaauccggcaccgccucagucgucugccuacucaacaacuucuacccccgcgaagccaaaguccaauggaaagucgacaacgcacuccaauccggcaacucccaagaauccguaaccgaacaagacuccaaagacuccaccuacucccucuccuccacccugacccucuccaaagcagacuacgagaaacacaaagucuacgcaugcgaagucacacaccaaggccuauccucccccgucaccaaauccuucaaccgcggcgaaugc

SEQ ID NO: 54158 - RNA, 651 nt, Artificial Sequence
  derived and/or modified sequence opt11 from Pankoab_LightChain2
gacaucgucacccaaagcccccucagcaaccccgugacccccggagaacccgccuccaucuccugccgcucauccaaaucccuccuccacuccaacggcaucaccuacuucuucugguaccuccaaaaaccaggccaaagcccccaacuccucauauaccaauccaaucucgccuccggcguccccgaccgauucuccggcuccggcucaggcaccgacuucacccuccgcaucucccgaguagaagccgaagacgucggcgucuacuacugcgcuggcaaccucgaacuacccccuaccuucggccaaggcacaaaagucgaaaucaaacgcaccgucgcugccccauccgucuucaucuucccucccucagacgaacaacucaaauccggcaccgccucagucgucugccuacucaacaacuucuacccccgcgaagccaaaguccaauggaaagucgacaacgcccuccaguccggcaacucccaagaauccgucaccgaacaagacuccaaagacuccaccuacucccucuccuccacccucacccuauccaaagccgacuacgaaaaacacaaaguauacgccugcgaaguaacccaccaaggccuauccucacccgucaccaaauccuucaaccgaggagaaugc

SEQ ID NO: 54159 - RNA, 351 nt, Artificial Sequence
  derived and/or modified sequence opt11 from PankoMab_HeavyChain_VDJ-Region
gaagugaaacuggucgagagcgggggcgggcucgugcaaccgggcgggagcaugaaauugagcugugucgcgagcggguucacguucucgaacuacuggaugaacugggucaggcaaucgcccgagaaagggcucgaguggguggccgagaucaggcucaagagcaauaacuauaccacgcacuaugccgagagcgugaaagggcgcuuuaccauaagcagggacgauagcaagagcucggucucgcuccagaugaauaaccugcgcguggaagauaccgggaucuauuacuguaccaggcacuauuacuuugacuauugggggcaagggaccacgcucacggucucgagc

SEQ ID NO: 54160 - RNA, 339 nt, Artificial Sequence
  derived and/or modified sequence opt11 from PankoMab_LightChain_VJ-Region
gacaucgucaugacccaagccgccuucuccaaccccgucacccucggcaccuccgccuccaucuccugccgcuccuccaaaucccuacuccacuccaacggcaucaccuacuucuucugguaccuccaaaaacccggccucuccccccaacuccucaucuaccaaaugucaaaccucgccuccggcguccccgaccgcuucuccuccuccggcuccggcaccgacuucacccuccgcaucucccgcgucgaagccgaagacgucggcgucuacuacugcgcccaaaaccucgaacucccccccaccuucggcggcggcaccaaacucgaaaucaaacgc

SEQ ID NO: 54161 - RNA, 1707 nt, Artificial Sequence
  derived and/or modified sequence opt11 from Panobacumab_HeavyChain1
gaggaacaagucgucgaauccggcggcggauucguccaaccaggaggcucacuuagauuauccugcgcagcaucaggcuucaccuucuccccauacuggaugcacuggguacgccaagcacccggcaaaggccucgucuggguaucgagaaucaacagcgacggguccacauauuacgccgacuccguaaaaggccgauucacaaucucacgcgacaacgcccgcaacacacucuaccuccaaaugaacucucuccgcgccgaagauaccgccguauacuacugcgcccgcgaccgcuacuacggacccgaaauguggggccaaggcaccaugguaaccguaucauccggaucagccuccgcacccacccuauucccccuagucucaugcgagaacagcccauccgauaccuccuccguagccgucggcugccucgcacaagacuuccuccccgacucaaucaccuucucauggaaauacaaaaacaacuccgacaucucauccacccguggauuccccucaguccuacgcggcggcaaauacgccgccaccucacaaguacuacugcccucaaaagaugucaugcaaggcacagaugaacauguaguuugcaaaguccaacaccccaacggcaacaaagagaaaaacguuccccuucccgucauagcagaacucccaccaaaggucagcgucuucguaccaccgcgggacggcuucuucggaaacccuagaaaauccaaacucauaugccaagccaccggcuucucaccccgccaaauccaaguauccuggcuacgcgaaggaaaacaggucggauccggcgucaccacagaccaaguccaagcagaagcaaaagaauccggccccacaaccuacaaggucaccuccacacucacgaucaaagaauccgacugguuaucccaauccauguucacuugccgcgucgaccaccgcggacucacauuccagcagaacgccucguccaugugcgucccagaucaagacaccgcaauccgcguuuucgcaauaccacccucauucgccucaaucuuccucacaaaaucgacaaaauuaaccugccucgucacugaccucaccacauacgacagcguaaccauaucauggacacgacaaaacggcgaagcagucaagacccacaccaacaucucggaaucccaccccaacgcaacauucucagccgugggcgaggcuuccaucugcgaagacgacuggaacagcggagaacgcuucacaugcaccguaacccacaccgaccuccccucaccccucaaacaaaccauuucccgcccuaaaggcgucgcccuccaucgccccgacguauaccugcucccacccgccagagaacaacuuaaucuacgcgaauccgccacgauaaccugccucguaaccggcuucucaccagcagaugucuucguacaguggaugcaaagaggacaaccacuaucccccgaaaaauacguaacauccgcaccaaugcccgaaccccaggcccccggccgcuacuucgcccacucaauccucaccgucucagaagaagaauggaacacuggcgaaaccuauacaugcgucgucgcucacgaagcccuacccaaccgcgucaccgaacgcaccguagacaaauccacaggaaaacccacccuguacaacguaucccuggucaugucagacaccgccggaaccugcuac

SEQ ID NO: 54162 - RNA, 657 nt, Artificial Sequence
  derived and/or modified sequence opt11 from Panobacumab_LightChain1
gacgucgucaugacccaaucaccccucucacuccccgucacccucggccaaccggccuccaucuccugccgaucaucacaaucccucgucuacuccgacggaaacacauaccucaacugguuccaacaacgccccggccaauccccucgccgccucaucuacaaagucuccaaccgcgacuccggcguccccgaccgcuucuccggcuccggcucaggcaccgacuucacccucaaaaucucccgaguagaagccgaagacgucggcgucuacuacugcaugcaaggcacccacuggccccucacauucggcggcggcaccaaagucgaaaucaaacgcacagucgccgcccccuccgucuucaucuucccacccuccgacgaacaacucaaaucaggcaccgcuuccgucgucugccuccucaacaacuucuacccccgcgaagccaaaguccaauggaaagucgacaacgcccuccaauccggcaacucccaagaauccguaaccgaacaagacuccaaagacuccaccuacagccuauccuccacccucacacucuccaaagccgacuacgaaaaacacaaagucuacgccugcgaagucacccaccaaggacucucaucccccgucaccaagucuuucaaccgcggcgaaugc

SEQ ID NO: 54163 - RNA, 414 nt, Artificial Sequence
  derived and/or modified sequence opt11 from Panobacumab_LightChain2
ggcgacgacgaagccaccauccucgccgacaacaaaugcaugugcacccgaguaaccucccgcaucauccccuccacagaagaccccaacgaagacaucgucgaacgcaacauccgcaucgucgucccccuaaacaaccgcgaaaacaucuccgaccccaccagcccccuccgccgcaacuucgucuaccaccucuccgacguaugcaaaaaaugcgaccccgucgaagucgaacucgaagaccaagucgucaccgccacccaauccaacaucugcaacgaagacgacggcguccccgaaaccugcuacauguacgaccgcaacaaaugcuacaccaccauggucccacuccgauaccacggcgaaaccaaaaugguccaagccgcccuaacccccgacuccugcuaccccgac

SEQ ID NO: 54164 - RNA, 1359 nt, Artificial Sequence
  derived and/or modified sequence opt11 from Parsatuzumab_HeavyChain1
gaaguccaacucguagaauccggaggcggccucguccaacccggaggcucccuccgccucuccugcgcagcaucaggcuacacauuuauagacuacuacaugaacuggguccgacaggcccccggcaaaggccuagaaugggucggcgauaucaaccucgacaacucaggaacacauuacaaucaaaaauucaaagggcgcuucaccauaucccgcgacaaaagcaaaaacaccgccuaccuccaaaugaacucccuccgggcggaagacaccgcaguauacuacugcgcccgcgaaggagucuaccaugacuacgacgacuaugccauggacuacuggggccagggcacucuugugaccguauccucugcauccacaaaaggccccucagucuucccccuagcccccucauccaaauccaccuccggcggcaccgcugcccucggcugccuagucaaagacuacuuccccgaacccgucaccgucagcuggaacucaggcgcccuaaccuccggcguacacacuuuucccgcaguccuccaauccuccggccuauacucacuguccuccgucgucaccguacccuccucaucccucggcacacaaacauacaucuguaaugucaaucacaaaccaucaaacaccaaaguagacaagaaagucgaaccaaaauccugcgacaaaacccacacaugcccaccaugcccagccccagaacuccucggaggcccguccguauuccucuuucccccaaaaccuaaagacacccuuaugaucucccguacccccgaaguaaccugcgucgucgucgacgucucacacgaagaccccgaagucaaauucaacugguacguagacggcgucgaaguccauaacgccaaaaccaaaccccgcgaagaacaauacaacuccaccuaccgcgucgucuccguccucaccguccugcaccaagacuggcuaaacggcaaggaauacaaaugcaaggucuccaacaaagcccuccccgcccccaucgagaaaaccaucucaaaagccaaaggccaaccacgagaaccacaggucuacacccugccacccucacgcgaagaaaugaccaaaaaccaaguauccuuaaccugccucgucaaaggauucuaccccuccgacaucgccguagaaugggaaucaaacggccaacccgaaaacaacuacaaaaccaccccucccguccucgacagcgacggcuccuucuuccucuacucaaaacucacgguagacaaaucccgguggcaacaaggcaacguauucuccugcagcgucaugcacgaagcacuccacaaccacuacacccaaaaaucacuaucucuaucccccggaaag

SEQ ID NO: 54165 - RNA, 657 nt, Artificial Sequence
  derived and/or modified sequence opt11 from Parsatuzumab_LightChain1
gacauccaaaugacccaaucccccuccucacuaucagccuccgucggcgaccgcgucaccauaaccugccgcaccucccaaucucuaguccacaucaacgccaucaccuaccuccacugguaccaacaaaaacccggcaaagcacccaaacuccuaaucuaccgcgucuccaaccgcuucuccggcguccccucuagauucuccggcucaggcuccggcacagacuucacacucaccaucuccucccuccaaccagaagacuucgccaccuacuacugcggccaauccacccacgucccacucaccuucggccaaggaaccaaagucgaaaucaaacgcacagucgccgcuccauccgucuucaucuucccacccuccgacgaacaacucaaauccggcaccgccuccgucgucugccuacucaacaacuucuacccccgcgaagcaaaaguccaauggaaagucgacaacgcccuccaauccggcaacucacaagaauccgucaccgaacaagacagcaaagacuccaccuacucccuauccuccacccucacccuaucaaaagccgacuacgaaaaacacaaagucuacgccugcgaagucacccaccaaggccucucaucacccgucaccaaauccuucaaccgcggcgaaugc

SEQ ID NO: 54166 - RNA, 1353 nt, Artificial Sequence
  derived and/or modified sequence opt11 from Pascolizumab_HeavyChain1
caaguaacacuccgagaauccggacccgcccucguaaaaccaacccaaacccuaacccugaccugcacauucuccggcuucucccucagcaccuccggaaugggcgucucauggauccgacaaccacccggcaagggccucgaauggcucgcacacaucuacugggacgaugacaaacgcuacaaccccucccuuaaaucccgccuaaccaucucuaaagacaccucgagaaaccaagucguccucacaaugaccaacauggaccccguagacacagccacuuacuauugcgcacgaagggagaccgucuucuacugguacuucgacguauggggccgcggaacccccgucaccgucuccagcgcauccacuaaaggaccauccgucuucccacuagcacccuccuccaaauccaccucaggcggcaccgcagcccucggcugccuugucaaagacuacuuccccgaaccaguaacaguauccuggaacucaggcgcacucaccuccggaguccacacauuccccgccguccuacaauccuccgggcucuacucacuaagcucaguaguaacaguacccuccuccucacucggcacccaaaccuacaucugcaacgucaaccacaaacccuccaacaccaaagucgacaaaagaguagaacccaaaucgugcgacaaaacucacacaugcccucccugccccgcccccgaacuccucggcggccccuccguguuccucuucccacccaagcccaaagacacccuaaugaucucccguacccccgaagucacgugugucgucgucgacguaucccacgaagaccccgaagucaaauucaacugguacgucgacggcgucgaaguacacaacgccaaaaccaaaccccgagaagaacaauacaacucaaccuaccgcgucgucucuguccucaccguacuccaccaagacuggcucaacggcaaagaguacaaauguaaaguuucaaacaaagcccuccccgcccccauagagaaaaccaucuccaaggccaaaggccaacccagagaaccccaagucuacacccucccacccucccgcgaagaaaugaccaaaaaucaagucagccuaacaugccuagucaaaggauucuaccccuccgacaucgccgucgaaugggaaucaaacggccaacccgaaaacaacuacaaaaccacacccccagucuuagacucggacggcucuuucuuccucuacucaaaacucaccgucgacaaaagccgcuggcaacaaggcaacgucuucuccugcuccgucaugcacgaagcacuccacaaucauuacacccagaaaagccucucccucucgcccggaaaa

SEQ ID NO: 54167 - RNA, 654 nt, Artificial Sequence
  derived and/or modified sequence opt11 from Pascolizumab_LightChain1
gacaucgugcucacccaaucacccucaagccuguccgccuccgucggcgaccgcgugaccaucacauguaaagccucccaauccguagacuacgacggcgacuccuacaugaacugguaccaacaaaaacccggaaaagcacccaaacuccugaucuacgccgcauccaaccucgaauccggaauccccucccgauucuccggcuccggcucaggaaccgacuucaccuuuaccaucagcucacuccaacccgaagacaucgccacauacuacugccaacaaucaaacgaagacccucccaccuucggccaaggcaccaaagucgaaaucaaacgcacagucgcagcccccuccguauucaucuucccacccuccgacgaacaacucaaauccggcacagccucggucgucugccuccucaacaacuucuacccccgcgaagccaaaguccaauggaaagucgacaacgcacuccaauccggcaacucccaagaaagcgucaccgaacaagacagcaaagacucaaccuacagccucagcuccacccucacccuaagcaaagccgacuacgagaaacacaaagucuacgccugcgaagucacacaccaaggccucagcucccccgucaccaaauccuucaaccgaggcgaaugc

SEQ ID NO: 54168 - RNA, 1512 nt, Artificial Sequence
  derived and/or modified sequence opt11 from Pasotuxizumab_HeavyChain1
caagugcaacuggucgagagcgggggaggacucguaaaaccaggcgagagcuuacgucuguccugugccgcaagcggauucacauucucugacuacuacauguacuggguaagacaagcgccaggaaaaggacucgaguggguggccaucaucagcgacggcggcuacuacacguacuacagcgacauaauaaaagggcgauucacaauaagcagggacaacgcaaagaacucacucuaccuacaaaugaacagucuaaaagcagaagacacagcgguuuacuacugcgcccggggcuucccccuacucaggcacggcgcgauggacuacuggggacaagggacauuagucacagucucgaguggaggcggaggcucuggcggaggcggaagugggggcgggggcuccgacauacaaaugacccaaaguccaagcucacuaucggccucggucggcgacagagucacgauuacgugcaaggccucacaaaacgucgacacaaacgucgcaugguaucaacaaaaaccgggacaggcaccgaaaagccuaauauacucagcaucguacagauacuccgacgucccaagccgcuucagcggaagcgcaagcggaacugacuucacgcuaacaaucuccagcgugcaauccgaagacuucgcgaccuauuacugccaacaguacgacagcuaccccuacaccuucggcggaggaacaaaacuagaaauaaaaagcggcgggggcgggagcgaaguacagcucguggaaucaggcggaggccuaguacagcccgggggaagccucaaguuaucgugcgcagccucaggcuucacauucaacaaguacgcgaugaacuggguaagacaggccccaggaaagggccuagaaugggucgcaagaauacgcucgaaauacaacaacuacgcaacauacuacgcggacuccgucaaggacagauucacgauaucacgcgacgacucuaaaaauaccgcguaccuacaaaugaacaaccucaaaaccgaggacacggccguauacuacugcguacgccacggcaacuucgggaacuccuacauaagcuacugggcauacuggggacagggaacgcucgugaccgucagcucaggaggcggcggaagcggaggcggaggaucgggcgggggaggaagccaaacagugguaacgcaagaacccucgcucacagucucccccggaggcacagucacccucacaugcgggagcucgacaggcgcagucacauccggcaacuacccaaacuggguccagcaaaaacccggccaagcacccaggggacugaucggcggcacaaaauuucucgcgccaggcaccccggccagguucagcggaucacuacugggaggcaaagcggcccuaacccuaagcggaguacagccugaagacgaggccgaauacuauugcgugcucugguacagcaaccggugggucuucgggggcgggaccaagcucacaguccuacaccaucaccaucaccac

SEQ ID NO: 54169 - RNA, 1512 nt, Artificial Sequence
  derived and/or modified sequence opt11 from Pasotuxizumab_SingleChain
caagugcagcuaguacaaagcggcgggggacucgugaagcccggggaaucacucagacuauccugcgcagcaucaggauuuaccuucagcgacuacuauauguacugggugagacaagcaccagggaagggacuggaguggguagcaaucauaagcgauggaggguacuacaccuacuacagugacauaauaaagggacgguuuacaauaucgagggacaacgccaaaaacagccuauaccugcaaaugaacucacucaaggcagaggacacagcaguguacuacugcgcacgcggauucccacuacuacgacacggcgcaauggacuacuggggccagggaacgcucguaaccgucagcaguggcggaggcggaagcggaggaggaggaagcggaggaggagggagcgacauccaaaugacgcaaucgcccaguagccuaagcgcaagugugggcgacagagugaccauaaccugcaaagcaagccaaaacguggacacgaauguagcaugguaccaacaaaaaccagggcaagcgcccaaaagccugaucuacagugccagcuacagguacuccgacgucccaagccgauucuccggcagcgccagcggcacggacuucacacuaacaauuagcagcguccagagcgaagacuucgccacauacuacugccagcaauacgacucguacccauacacguucgggggaggcacaaaacuagaaaucaaauccggaggaggaggaucagaaguacagcuaguagaauccgggggaggccuaguacaaccaggaggcagccugaagcuaagcugcgccgcaagcggcuucacauucaacaaauacgccaugaacuggguccgacaagcaccagggaaaggccucgaaugggucgcccgaauaaggagcaaguacaauaacuacgcaacauacuacgcggacagcguaaaagaccgauucacgauaagcagagacgacagcaaaaacacagcauaccuccaaaugaacaacuuaaaaaccgaagacacagcugucuacuacugcgugaggcacggaaacuucggcaacagcuacaucucauacugggcauacuggggacaaggaacccuagucacagucucaagcggaggaggaggaucaggcggaggaggcagcggaggagggggaagccaaaccguaguaacccaggaaccaucccucacagugucaccaggcggaaccguaacccuaaccugcggaucgaguacaggagcaguuacgagcggaaacuacccgaacuggguccaacagaaaccaggccaagcaccccgcggucuaauaggcggaacaaaauuccuagccccaggcacgccugcacgauucagcggaagucuacuaggaggcaaggcagcccuaacacuaagcggaguacaaccagaagacgaagcggaauacuacugcguucugugguacagcaaccgaugggucuucggcgggggcacaaaauuaaccgugcuccaccaccaccaccaccac

SEQ ID NO: 54170 - RNA, 1341 nt, Artificial Sequence
  derived and/or modified sequence opt11 from Pateclizumab_HeavyChain1
gaaguccagcucgucgaaagcggcggcggccucguccaacccggaggcucccuucgacucucuugcgcagcaucagguuacaccuucaccucauacgucauccacuggguccgccaagcacccggcaaaggauuagaaugggucggcuacaacaaccccuacaacgcuggcaccaacuacaacgaaaaguucaaaggccgcuucaccaucucaucagacaaaagcaaaaacaccgccuacuuacaaaugaacucccuccgcgccgaagacaccgccguuuacuacugcucacgccccaccaugcuccccugguucgccuacuggggccaaggaacccuagucacugucuccuccgcuuccaccaaaggccccucagucuuccccuuagccccauccucaaaauccaccuccggcgguaccgcagcccuaggaugccucguuaaagacuacuuccccgaacccgucaccgucuccuggaacucaggagcccucaccuccggaguccacaccuuucccgccguccuccaauccagcggccucuacucacucuccucaguagucaccgucccaucaagcucgcuaggcacccaaaccuacaucugcaacguaaaccacaaacccucaaacaccaaagucgacaagaaagucgaaccaaaaagcugcgacaaaacacacacuugcccacccugccccgcccccgaacuacucggaggccccuccguauuucuguucccacccaaacccaaagacacgcuaaugauaucccgcaccccagaaguaaccugcgucgucgucgacgucucccacgaagacccugaagucaaauucaacugguacgucgacggcguugaaguacacaacgccaaaacuaagccccgagaagaacaauacaacucaaccuaccgcguagucucgguccucaccguccuccaccaagacuggcucaacggcaaggaauauaaaugcaaggucuccaacaaagcccuacccgcacccaucgagaaaacuauauccaaagccaaaggccaaccccgagaaccacaagucuacacacucccgcccucccgcgaagaaaugaccaaaaaccaaguaucgcuaaccugccucgucaagggcuucuaccccucagacaucgcagucgaaugggaaucaaacggacaacccgaaaacaacuacaaaacaacaccaccaguacucgacuccgacggaucauucuuccucuacucaaaacuaacaguagacaaaagccgcuggcagcaaggaaacgucuucuccugcucugucaugcacgaagcucuccacaaccacuacacccaaaaaucccuaucgcuuucccccggc

SEQ ID NO: 54171 - RNA, 642 nt, Artificial Sequence
  derived and/or modified sequence opt11 from Pateclizumab_LightChain1
gacauccaaaugacacaaucccccuccucacucuccgccuccgucggcgaccgcgucaccauaaccugccgcgccucccaagccgucuccuccgccgucgccugguaccaacaaaaacccggcaaagcccccaaacuccuaaucuacuccgccucccaccgcuacaccggcguccccucccgcuucucaggcuccggcuccggaaccgacuucacccuuaccaucuccucccuccaacccgaagacuucgcaaccuacuacugccaagaauccuacucuacccccuggaccuucggccaaggcaccaaagucgaaaucaaacgcaccgucgcagcccccuccgucuucaucuucccacccuccgacgaacaacucaaaucaggcaccgcauccgucgucugccuacucaacaacuuuuacccccgcgaagccaaaguccaauggaaagucgacaacgcccuccaauccggcaacucccaagaguccgucaccgaacaagacuccaaagacuccaccuacucccucuccuccacccucacccucuccaaagccgacuacgaaaaacacaaaguauacgccugcgaagucacccaccaaggccuaucaucccccgucaccaaauccuucaaccgaggagaaugc

SEQ ID NO: 54172 - RNA, 1341 nt, Artificial Sequence
  derived and/or modified sequence opt11 from Patritumab_HeavyChain1
caaguccaacuccaacaauggggcgccggccuccuaaaacccuccgaaacccucucacuaaccugcgccguuuacggcggaucauucuccggcuacuacuggagcuggauccgccaaccacccggcaaaggucucgaauggaucggcgaaaucaaccacagcggcucaacaaacuacaaccccagccugaaaucccgcguaaccaucagcguagaaaccuccaaaaaccaauucucccucaaacucucaucagucaccgccgcagacaccgccgucuacuacugcgcccgcgacaaauggaccugguacuucgaccuuuggggccgcgguacccucguaaccgucuccucagccuccaccaaaggccccuccguuuucccccuagcccccucaagcaaaagcaccagcggcggcacagccgcacucgguugccucguaaaagacuacuuccccgaacccgucaccguauccuggaacucaggagcccuaaccuccggcguucacacauucccagcaguccuacaauccucaggccucuacucacucuccucuguaguuaccguccccagcucgucccuaggaacccaaacauacauaugcaacgucaaccacaaacccuccaacaccaaaguugacaaacgaguagaacccaaauccugcgacaaaacccauaccugcccacccugccccgcccccgaacuccucggcggccccuccgucuuccucuucccacccaaacccaaagacacucuaaugauaucucgcacccccgaaguaaccugcgucgucguagacgucucacacgaagaccccgaaguaaaauucaacugguacgucgacggaguugaagugcacaaugccaaaacaaaaccccgugaagaacaauacaacagcaccuacagaguagucucaguccucacaguucuacaccaagacuggcuaaacggcaaagaauacaaaugcaaaguauccaacaaagcccuccccgccccaauagaaaagaccauauccaaagcaaaaggucaaccccgcgaaccccaagucuacacccuaccacccucccgagaagaaaugaccaaaaaccaagugucacucacaugccuagucaaagguuucuaccccucagacauagccgucgaaugggaauccaacggccaacccgaaaacaacuacaaaacaaccccacccguacucgacucagacggcagcuucuuccucuauucaaaacucaccgucgacaaaagccgcuggcaacaaggaaacgucuuuucaugcuccguaaugcacgaagcccuccacaaccacuacacccagaaaucccuaagccuaucccccggcaaa

SEQ ID NO: 54173 - RNA, 681 nt, Artificial Sequence
  derived and/or modified sequence opt11 from Patritumab_hinge-CH2-CH3
gacaaaacccacacaugcccacccugccccgcccccgaacuccucggcggccccuccguauuccucuucccacccaaacccaaagacacccucaugaucucccgcacccccgaaguaaccugcgucgucgucgacgucucccacgaagaccccgaagucaaauucaacugguacgucgacggcgucgaaguccacaacgccaaaaccaaaccccgcgaagaacaauacaacuccaccuaccgcgucgucuccguccucaccguccuacaccaagacuggcucaacggaaaagaauacaaaugcaaagucucaaacaaagcccuccccgcccccaucgagaaaaccaucucaaaagcaaaaggccaaccccgagaaccccaagucuacacccucccacccucccgcgaagaaaugaccaaaaaccaagucucccucuggugccucgucaaaggcuucuaccccucagacaucgccgucgaaugggaauccaacggccaacccgaaaacaacuauaaaaccacaccacccguccucgacuccgacggcuccuucuuccucuacuccaaacucacagucgacaaaucccgauggcagcaaggcaacgucuucuccugcuccgucaugcacgaagcccuccacaaccacuacacccaaaaaucacucucccucucccccggcaaa

SEQ ID NO: 54174 - RNA, 660 nt, Artificial Sequence
  derived and/or modified sequence opt11 from Patritumab_LightChain1
gacaucgaaaugacccaaucccccgacagccuagccgucucccucggcgaacgagccaccaucaacugccgcuccucccaauccguccucuacuccucauccaaccgcaacuaccucgccugguaccaacaaaaccccggacaaccacccaaacuccucaucuacugggccuccacccgcgaaucaggcguccccgaccgauucucaggcuccggcuccggcaccgacuucacacucaccaucuccucacuccaagccgaagacguagccgucuacuacugccaacaauacuacuccacaccccgcaccuucggccaaggaaccaaagucgaaaucaaacgcaccgucgccgcccccuccgucuucauauucccacccuccgacgaacaacuaaaauccggcaccgccuccguagucugccuccucaacaacuucuacccccgcgaagccaaaguccaauggaaagucgacaacgcccuccaauccggaaacucccaagaaagcguaaccgaacaagacuccaaagacuccaccuacucccuuuccuccacccucacccuauccaaagccgacuacgaaaaacacaaagucuacgccugcgaaguuacccaccaaggccucuccucacccgucacaaaauccuucaaccgcggcgaaugc

SEQ ID NO: 54175 - RNA, 1341 nt, Artificial Sequence
  derived and/or modified sequence opt11 from Pembrolizumab_HeavyChain1
caaguccaacucguccaaagcggcgucgaagucaagaaacccggcgccuccgucaaagucuccugcaaggcuucaggcuacaccuucacaaacuacuacauguacuggguccgccaagcccccggccaaggauuagaauggaugggcggcaucaacccaucaaacggcggcaccaacuucaacgaaaaauucaaaaaccgcgucacccugaccaccgacuccuccacaaccaccgccuacauggagcucaaaucccuacaauucgacgauaccgccgucuacuacugcgcaaggcgcgacuaccgcuucgacaugggcuucgacuacuggggacaaggaacaaccgucaccgucagcucagcaucaaccaaaggccccuccguauucccacucgcacccugcucccgcuccaccuccgaaucuaccgccgcccucggaugccucguaaaagacuacuucccagaaccugucacggucucauggaacuccggagcccucacauccggcguccacaccuuccccgccguccugcaauccuccggccucuacucacucucaagcgucguaaccguccccagcuccucccuaggcaccaaaaccuacacgugcaacgucgaccacaaacccucuaacacaaaagucgacaaacgagucgaaucaaaauacggucccccaugcccuccgugcccagcacccgaauuucuaggcggccccuccgucuuccucuuucccccaaaacccaaagacacacucaugauaucccgcacaccagaggugaccugcgucgucgucgacgucagccaggaagacccagaaguccaauucaacugguacgucgacggcgucgaaguccacaacgccaagaccaaaccacgcgaagaacaauucaacuccaccuaccgcgucgucuccguccugaccguacuccaccaagacuggcucaacggcaaggaauacaagugcaaagucucaaacaaaggccuccccuccuccauagagaaaacaauauccaaggccaaaggccaaccccgagaaccgcaagucuacacacuuccacccucccaagaagaaaugacaaagaaccaagucucccuaaccugccucgucaaaggauucuaccccuccgacaucgccgucgaaugggaauccaacggacaaccugaaaacaacuacaaaaccaccccucccguccucgauucagacggcuccuucuuccucuacucacgccucacugucgacaaaucccgcuggcaagaaggcaacguauucucaugcucaguaaugcacgaggccuuacacaaccacuauacccaaaaaucccucucccuuucccuaggaaaa

SEQ ID NO: 54176 - RNA, 654 nt, Artificial Sequence
  derived and/or modified sequence opt11 from Pembrolizumab_LightChain1
gaaaucguacucacacaaucacccgcaacccucagccuaagccccggcgaacgcgcuacccuaagcugccgcgcaagcaaaggcgucuccacaagcggauacucauaccuacacugguaccaacaaaaacccggacaagcacccagacuccucaucuaccucgcaagcuaccucgaaagcggggucccagccagauucucaggcuccggcucaggcacagacuucacccucaccauaagcucgcucgaacccgaggacuucgccguauacuacugccaacacucacgcgaccucccacuaacauucggaggcggaaccaaagucgaaaucaaacgcacagucgccgccccauccguauucauauucccgcccuccgacgaacaacuaaaaucaggcaccgccuccgucguaugccuccucaacaacuucuacccacgcgaagccaaaguccaauggaaagucgacaacgcccuccagagcggaaacucgcaagaaagcgucaccgaacaagacagcaaagacucaaccuacucccucagcucaacccucacccucuccaaagccgacuacgaaaaacacaaaguauacgccugcgaagucacacaccaaggccuaagcucccccgucaccaaauccuucaacaggggcgaaugc

SEQ ID NO: 54177 - RNA, 1356 nt, Artificial Sequence
  derived and/or modified sequence opt11 from Perakizumab_HeavyChain1
gaaguacaacucguagaauccggcggcggccuaguccaacccggaggaucacuccgacucucuugcgcagcauccggcuucacauucucagacuacaccaugcucuggguccgacaagccccaggcaaaggccuagaauggguagccaucaucaaauccggcggaucauacuccuacuaccccgacuccgucaaaggccgcuucacaaucucccgagacaacgccaaaaacagccuuuaccuccagaugaacucucuccgagcagaagacaccgcaguauacuacugcgccagagacggcgacuacggcucaucauacggcgccauggacuacuggggccaaggcacccuggucaccguauccuccgcaucaacaaaaggccccucaguauucccccucgcaccaucaagcaaauccacauccggcgguacggccgcccuaggcugccucguaaaagacuacuuccccgaacccguaacaguauccuggaacuccggcgcccuaaccuccgguguucacaccuuccccgccguccuucaaucauccggucuuuacucccuauccuccgucguaacaguacccagcuccucccuaggcacccaaaccuacauuugcaaugucaaccacaaacccagcaacacaaaagucgacaagaaagucgaacccaaaagcugcgacaaaacacacaccuguccacccugccccgcccccgaagcugccgguggccccuccgucuuucuuuucccacccaaacccaaagauacccuaaugauaucccgaacccccgaaguaaccugcgucgucgucgacgucucacacgaagaccccgaagucaaauucaauugguauguagacggcgucgagguccacaacgccaaaacaaaaccacgcgaggaacaauacaacuccaccuaccgcgucguaucaguccucaccguacuccaccaggacuggcuaaacggaaaagaauacaaaugcaaagucucaaacaaagcccuccccgccccaaucgagaaaacaaucuccaaagccaaaggccaaccccgcgaaccgcaagucuacacacuaccaccaucccgcgacgaacuaacgaaaaaccaagucucccuaaccugccucgucaaaggcuucuauccuucagacaucgccgucgaaugggaauccaacggccaaccagaaaacaacuacaaaaccaccccaccuguccuugacucagacggcuccuucuuccuuuacucaaaacugaccgucgacaaaucccgcuggcaacagggcaacguauucagcugcuccgucaugcacgaagcccuacacaaccacuacacccaaaaaucccucucccuaucccccggcaaa

SEQ ID NO: 54178 - RNA, 645 nt, Artificial Sequence
  derived and/or modified sequence opt11 from Perakizumab_LightChain1
gacauccaaaugacccaaucccccuccucacucuccgcauccgucggcgaccgcgucaccaucacaugccgcgccucccaagacaucaacuccuaccucuccugguuccaacaaaaacccggaaaagcccccaaaucccucaucgucagagccaaccgccucgucgacggcguccccucacgauucagcggcuccggauccggacaagacuacucacucaccaucuccucccuccaacccgaagacuucgccaccuacuacugccuacaauacgacgccuucccacccuacaccuucggccaaggcaccaaacucgaaaucaaacgcaccgucgccgcccccuccguauucaucuucccacccuccgacgaacaacucaaaucaggcacagccuccgucgucugccuccucaacaacuucuacccccgcgaagccaaaguccaauggaaagucgacaacgcccuccaauccggcaacucccaagaauccgucaccgaacaagacuccaaagacuccacauacucccucuccuccacccuaacccucuccaaagccgacuacgaaaaacacaaagucuacgccugcgaagucacccaccaaggccucuccucacccguaaccaaauccuucaaccgaggagaaugc

SEQ ID NO: 54179 - RNA, 1332 nt, Artificial Sequence
  derived and/or modified sequence opt11 from Pertuzuab_HeavyChain1
gaagugcaacucgucgaaucaggaggcggccucguccaaccuggcggcagccuccgccuuucaugcgcagcauccggcuucacauucaccgacuacaccgacuggguuagacaagcuccuggaaaaggccucgaaugggucgccgacguuaaucccaacuccggaggcucgaucuacaaccaacgauucaaaggucgcuuuacccucucaguagaccgcuccaaaaacacccucuaccuccaaaacucauuacgagcagaagacaccgccguauacuacugcgcgagaaaccucggccccucauucuacuucgauuacuggggccaaggaacccucgucacagucucauccgccuccaccaaaggccccuccgucuucccccucgcccccuccucaaaguccaccagcggcggcacagccgcccucgguugccucguaaaagacuacuuccccgaacccgucacgguaucauggaacuccggcgcacuaaccuccggcguccacaccuuccccgccguccuacaguccucuggccuauacucucucucaucagucgucacaguacccucauccucccucggcacccaaaccuacaucugcaacgucaaccacaaacccucaaauaccaaagucgacaagaaagucgaacccaaaucgugcgacaaaacccacaccugucccccaugcccugcccccgaauuauuaggcggcccaucagucuuucucuucccucccaaacccaaagacacccucauaucccgcaccccagaaguaaccugcguugucgucgacgugucacacgaagaccccgaggucaaauucaacugguacgucgacggcgucgaaguccacaacgccaaaaccaaaccacgcgaagaacaauacaacucaaccuacagagucgucuccguccucaccguccuacaccaagacuggcucaacggcaaagaauacaaaugcaaagucuccaacaaagcacuccccgccccuauagagaaaaccaucuccaaagccaaaggacaaccacgcgaaccccaagucuacacccuaccacccucccgcgaagaaaccaaaaaccaagucucacuaaccugccucgucaaaggcuucuaccccucagacaucgcaguagaaugggaauccaacggccaacccgaaaacaacuacaaaaccaccccaccaguccucgacuccgacggcucuuucuuucucuacagcaaacuaaccgucgacaaaucaagauggcaacaaggcaacgucuucuccugcucaguacacgaagcucuccacaaccacuacacacagaaaucacucucccucucucccggcaaa

SEQ ID NO: 54180 - RNA, 639 nt, Artificial Sequence
  derived and/or modified sequence opt11 from Pertuzuab_LightChain1
gacauccaaacccaaucgcccucaucccucuccgccuccguaggcgaccgcgucaccaucacaugcaaagccucccaagacgucuccaucggcgucgccugguaccaacaaaaaccaggcaaagcccccaaacuccucaucuacuccgcauccuaccgcuacaccggugucccaucccgcuucuccggcucaggcucaggcaccgacuucacccucaccaucuccucccuccaacccgaagacuucgccaccuacuacugccaacaauacuacaucuaccccuacaccuucggccaaggcaccaaagucgaaaucaaacgcaccgucgccgccccuuccgucuucaucuucccacccucagaugaacaacuaaaauccggcaccgccuccgucgucugccuccucaacaacuucuacccccgcgaagccaaaguccaauggaaagucgacaacgcccuccaauccggaaacucccaagaauccgucaccgaacaagacuccaaagacuccaccuacucccucuccucaacacucacacucuccaaagccgacuacgaaaaacacaaagucuacgccugcgaagucacacaccaaggccucuccucccccgucaccaaauccuucaaccgcggcgaaugc

SEQ ID NO: 54181 - RNA, 642 nt, Artificial Sequence
  derived and/or modified sequence opt11 from Pertuzumab_HeavyChain
gacauccaaaugacccaaucccccuccucccucuccgccagcgucggcgaccgcgucaccauaaccugcaaagccucccaagacgucucaaucggcgucgccugguaccaacaaaaacccggaaaagcccccaaacuccucaucuacagcgccuccuaccgcuacaccggcguccccucccgcuucuccggcucaggcuccggcaccgacuucacccucaccauauccucacuccaacccgaagacuucgccaccuacuacugccaacaauacuacaucuaccccuacacauucggccaaggcaccaaaguagaaaucaaacgcaccgucgccgcccccuccgucuucaucuucccacccuccgacgaacaacuuaaauccggcaccgccuccgucgucugccuccucaacaacuucuacccccgagaagccaaaguccaauggaaagucgacaacgcacuccaaucuggaaacucccaagaauccgucaccgaacaagacuccaaagacuccaccuacucccucuccuccacccucacccucuccaaggccgacuacgaaaaacacaaagucuacgccugcgaaguaacacaccaaggccuauccucccccguaaccaaauccuucaaccgcggcgaaugc

SEQ ID NO: 54182 - RNA, 1344 nt, Artificial Sequence
  derived and/or modified sequence opt11 from Pertuzumab_LightChain
gaaguccagcuagucgaaucaggcggaggccucguacagcccggcggcucacuccgacuaucaugcgccgcaucaggcuucacauucaccgacuacacuauggacuggguacgccaagccccuggaaaaggccucgaauggguagccgacguaaaccccaacuccggcggaucaaucuacaaccaacgcuucaaaggccgauucacacucuccgucgacagauccaaaaacacccucuaccuccaaaugaacucccuacgcgccgaagacaccgccgucuacuacugugcccgcaaccuaggacccuccuucuacuucgacuacuggggucaaggcacccuagucaccgucuccucugcauccacaaaaggcccauccgucuucccccuggccccgucaucaaaauccaccuccggcggcaccgccgcccucggaugccucgucaaagacuacuucccugaacccgucaccguauccuggaacucaggcgcccucaccucugggguacacacauuccccgccguccuacaguccuccggccucuauucccuuuccuccgucgucacugucccaucuuccucacuaggcacacaaaccuacaucugcaacgucaaccacaaacccucgaacacaaaagucgacaagaaagucgaacccaaauccugcgauaaaacccacacuugcccacccugcccugcacccgaacuccuaggaggcccaucaguauuccuauucccacccaaacccaaagacacacugaugaucucccgaaccccagaaguaacaugcgucgucgucgacgucucccacgaagaccccgaagugaaauucaacugguacgucgacggcgucgaaguccauaacgcaaaaaccaaacccagagaagaacaauacaauagcaccuaccgcgucguauccguccuuacuguacuccaccaagacuggcuaaacggaaaagaauacaaaugcaaagugagcaacaaagcccuccccgcccccauugagaaaacaaucuccaaagccaaaggccaaccccgagaaccccaagucuacacccucccgcccucccgcgaagaaaugaccaaaaaccaagucucacugaccugccucgucaaaggguucuaccccuccgacauagccguugaaugggaaucaaacggccaacccgaaaacaacuacaaaaccaccccacccguacucgacuccgacggcuccuucuuccuauacucaaaauuaaccgucgacaaaagucgcuggcaacaaggcaaugucuucucaugcucgguaaugcacgaagcucuacauaaccacuacacccaaaaaucccugucccucucccccggc

SEQ ID NO: 54183 - RNA, 750 nt, Artificial Sequence
  derived and/or modified sequence opt11 from Pexelizumab_h5g1.1-scFv
auggccgacauccagaugacgcaaucgcccucaagccugagcgcgagcgugggcgaccgaguaaccauaacaugcggcgcgagcgagaacauauacggagcccugaacugguaccagcgaaagcccgggaaagcgcccaagcuccugaucuacggcgcgacaaaccucgcagacggggucccaagcagguucucgggcucgggcucgggcacagacuacacccugaccauaagcucacuccagcccgaagacuuugccacguacuauugccagaacgugcucaacaccccgcucacguucggacaagggaccaaggucgagaucaagcgaacgggcgggggcggaagcgggggcgggggcucaggcgggggcgggagccagguccagcuugugcaaucgggagcggaaguggaaaagcccggagcaucagucaagaaaguaagcugcaaagcgagcggguacauauucucaaacuacuggauacaaugggucaggcaagcacccgggcaaggacucgaguggaugggagaaauccuacccgggagcggaagcacggaauacgcccagaaauuccaaggacgcgugaccaugaccgcggacacgagcacaagcacggcauacauggagcuuucgagcuuaagaucggaagacaccgcagucuauuacugugccagauacuucuucgggagcucgccaaauuacugguacuucgacguaugggggcaagggacccugguaacggucucaagc

SEQ ID NO: 54184 - RNA, 345 nt, Artificial Sequence
  derived and/or modified sequence opt11 from Pexelizumab_h5g1.1VHC_+_F_Heavy_Chain_V-Region
caagugcaauugguccagagcggggccgaggucaagaaaccgggcgcgagcgugaaagugagcuguaaagcgagcggguacauauucucgaacuauuggauacaaugggucaggcaagcgcccgggcaagggcucgaguggaugggcgagaucuugcccgggagcgggagcacggaauaugcccagaaauuucaagggcgcgugaccaugacagcggacacgagcacgagcacggccuauauggagcucucgagcuugcgcucggaagauaccgcggucuauuacugugccagguacuuuuucgggagcucgcccaauugguauuucgugugggggcaagggacc

SEQ ID NO: 54185 - RNA, 318 nt, Artificial Sequence
  derived and/or modified sequence opt11 from Pexelizumab_h5g1.1VHC_+_F_Light_Chain_V-Region
gacauccaaaugacccaaucccccucacucuccgccuccgucggcgaccgcgucaccaucaccugcggcgcauccgaaaacaucuacggcgcccucaacugguaccaacgcaaacccggcaaagcccccaaacuccucaucuacggcgcaaccaaccucgccgacggaguccccucccgauucuccggcuccggcuccggcaccgacuacacccucaccaucuccucccuccaacccgaagacuucgccaccuacuacugccaaaacguccucaacaccccccucaccuucggccaaggcaccaaagucgaaaucaaa

SEQ ID NO: 54186 - RNA, 1326 nt, Artificial Sequence
  derived and/or modified sequence opt11 from PF-05082566_HeavyChain1
gagguccaacucguccaauccggcgcugaagucaagaaacccggagaaucacuccgcaucuccugcaaaggauccggcuacucauucagcaccuacuggaucuccuggguucgccaaaugccaggcaaaggccucgaauggaugggcaaaaucuaccccggagacucauacaccaacuacucacccuccuuccaaggucaagucacaaucuccgccgacaaaucaaucuccaccgccuaccuccaauggucgucccucaaagccucagacaccgcuauguacuacugcgcacgcggcuacggcaucuucgacuacuggggacaaggcacccucguaaccguuucauccgccuccaccaaaggacccuccguauucccacucgcaccaugcucacgauccaccucggaauccaccgcagccuuaggcugccucguaaaagacuacuucccagaaccaguuacagucucauggaacucaggcgcacucaccuccggcguccacaccuucccagccguccuccagucauccggccucuacucccucuccuccgucguaacaguccccagcuccaacuucggaacccaaacauauaccugcaacguggaccacaaacccuccaacaccaaagucgacaaaacagucgaacgcaaaugcugcgucgaaugcccacccugccccgccccacccguagccggccccuccgucuuccucuucccacccaaacccaaagacacccucaugauaucccgaacacccgagguuaccugcgucgucgucgacguaagccacgaagaccccgaaguccaauucaacugguacgucgacggcgucgaaguccacaaugcaaaaacgaaaccccgugaggaacaauucaacuccacauucagagucguauccguacucaccgucguccaccaagacuggcuaaauggcaaagaguacaaaugcaaagucucuaacaaaggccuacccgcccccauugaaaagaccaucucaaaaaccaaaggccaaccccgcgaaccccaagucuauacccuaccacccucccgcgaggaaaugaccaaaaaccaagucucccucacaugccucgucaaaggcuucuaccccuccgacaucgccgucgaaugggaaucgaacggccaacccgaaaacaauuauaaaacaacacccccaaugcucgacuccgacgguuccuucuuccucuacuccaaacucaccgucgacaaaucccgcuggcaacaaggcaacgucuucuccugcuccgucaugcacgaagcacuccacaaccacuacacacaaaaaucacucuccuuauccccaggcaaa

SEQ ID NO: 54187 - RNA, 642 nt, Artificial Sequence
  derived and/or modified sequence opt11 from PF-05082568_LightChain1
uccuacgaacuaacccaaccccccuccgucuccgucucacccggacaaaccgccucaaucacuugcuccggcgacaacauaggcgaccaauacgcccacugguaccaacaaaaacccggacaaucacccguccucgucaucuaccaagacaaaaaccgccccuccggcauccccgaacgcuucuccggcuccaacuccggcaacacagccacccuaaccaucuccggcacccaagccauggacgaagccgacuacuacugcgccaccuacaccggcuucggcucccuagccgucuucggcggcggcaccaaacucacaguccucggccaacccaaagccgcccccuccgucacacuauuccccccauccuccgaagaacuucaagccaauaaagccacccucgucugccucaucucagacuucuaccccggcgccgucaccguagccuggaaagccgacuccucacccgucaaagccggcgucgaaaccaccaccccauccaaacaauccaacaacaaauacgccgccuccuccuaccucucccucaccccagaacaauggaaaucucaccgcuccuacuccugccaagucacccacgaaggcuccaccgucgaaaaaacagucgcccccaccgaaugcucc

SEQ ID NO: 54188 - RNA, 1341 nt, Artificial Sequence
  derived and/or modified sequence opt11 from Pidilizumab_HeavyChain1
caaguccagcuaguccaaucaggcuccgagcucaaaaagcccggagccuccguaaaaaucuccugcaaagccucuggcuacaccuucacaaacuacggaaugaacuggguucgccaagcccccggacaaggccuacaauggaugggauggaucaacacugacucaggggaauccacguacgcagaagaauuuaaaggucgcuucgucuucucccucgacacuucagucaacaccgccuaccuacaaaucacaucccuuaccgcugaagacacaggcauguacuucugcguccgcguaggcuacgacgcccucgacuacuggggacaaggcacccuagucaccguuagcucagccuccacaaaaggcccauccguauucccccucgccccaucauccaaauccacuucaggcggcaccgccgcccucggaugccucguaaaagacuacuuccccgaacccgucaccguauccuggaacaguggagcccuaaccagcggcguccacacuuucccagcaguccuacaaucaucaggccucuauagccucuccuccgucgucaccguccccuccagcucacucggcacccaaacauacaucugcaacgucaaccacaaacccucaaacaccaaagucgacaaacgcguagaacccaagagcugcgacaaaacccacaccugucccccuugccccgcaccagagcuacuaggcggcccaagcgucuuccucuucccacccaaacccaaagacacccucaugaucucccgcacccccgaaguaaccugcgucguaguagacgucucucacgaagauccagaagucaaauucaacugguauguugacggaguagaaguccacaacgcaaaaaccaaaccccgcgaagaacaauacaacuccaccuaccgcgucgucagcguccucaccguccuccaccaagacuggcuaaacggcaaagaauacaaaugcaaagucagcaacaaagcccuccccgcacccaucgagaaaaccaucagcaaagcaaaaggccaaccccgcgaaccccaagucuacacacucccaccaucccgcgaagaaaugaccaaaaaccaagucucccuaacuugccuaguaaaaggcuucuaccccagcgacaucgccgucgaaugggaaucaaacgggcaacccgaaaacaacuacaaaaccacacccccaguccucgacuccgacggcuccuucuuccucuacucaaaacuaaccgucgacaaaucccgcuggcaacaaggcaacgucuucuccugcuccgucaugcacgaagcccuucacaaccacuacacccagaaaucccucucccucucccccgguaaa

SEQ ID NO: 54189 - RNA, 639 nt, Artificial Sequence
  derived and/or modified sequence opt11 from Pidilizumab_LightChain1
gaaaucguccucacccaaucccccucuucacucucggcauccgucggcgaccgcgucaccauuaccugcuccgcccgcuccuccgucuccuacaugcacugguuccaacaaaaacccggcaaagcacccaaacucuggaucuaccgcaccagcaaccucgccuccggcguccccucccgcuucuccggcuccggcuccggaacauccuacugccucacaaucaacucccuccaacccgaagacuucgccaccuacuacugccaacaacgcuccuccuucccccucacauucggaggcggcaccaaacucgaaaucaaacgcacagucgccgcccccuccgucuucaucuucccacccuccgacgaacaacuaaaauccggcacagccuccguagucugccuccuuaacaacuucuacccccgcgaagccaaaguccaauggaaagucgacaacgcacuccaauccggcaacucacaagaauccgucaccgaacaagacuccaaagacuccaccuacucccuauccucaacccuuacccucuccaaagccgacuacgaaaaacacaaagucuacgccugcgaagucacccaccaaggccucuccucacccguuaccaaauccuucaaccgcggcgaaugc

SEQ ID NO: 54190 - RNA, 1350 nt, Artificial Sequence
  derived and/or modified sequence opt11 from Pinatuzumab_vedotin_HeavyChain1
gaaguacaacucgucgaaucaggcggaggucucguccaacccgguggaucccuccgucucuccugcgccgccagcggcuacgaguucucccgcucauggaugaacuggguccgccaagcacccggaaaaggccucgaauggguaggccgaaucuaucccggagacggcgacaccaacuacucaggcaaauucaaaggccgcuucaccaucucagccgacaccagcaaaaacaccgccuaccuccaaaugaacucacuccgggccgaagacacagcugucuacuacugcgcacgagacggaagcuccugggacugguacuucgacgucuggggccaaggcacccucguaaccgucagcucagcauccaccaaaggccccagcguauuuccacucgccccauccucgaaaucaaccuccggaggaaccgcagcacucggcugccuagucaaagacuacuuuccugaacccgucaccgucucauggaacucaggcgcccuaacauccggcguacacacauucccagcaguccuccaauccuccggccucuacucccucuccuccguagucaccguacccucgucaagccuaggcacccaaaccuacaucugcaaugucaaccacaagcccagcaacaccaaagucgacaagaaagucgaacccaaauccugcgacaaaacacacaccuguccacccugccccgccccggaacuacucggcgggcccuccguguuccucuucccacccaaacccaaagacacccucaugauaucaagaacccccgaaguaaccugcguaguagucgacgugucucacgaagaccccgaagucaaauucaacugguacgucgacggcgucgaaguacacaacgccaaaaccaaaccccgcgaagaacaauacaacagcacauaccgcgucguaagcguccucaccguccuacaccaggacugguugaacggcaaagaauacaaaugcaaaguaucaaacaaagcccuacccgcccccaucgagaaaaccaucuccaaagcgaaaggccaaccccgagaaccacaagucuauacccuaccacccagccgcgaagaaaugacuaaaaaccaagucucccuaaccugccuggucaaaggcuucuaccccucagacaucgccgucgaaugggaauccaacggacaacccgaaaacaacuacaaaacaacaccacccguucuagacuccgacggaucauucuuccucuacuccaaacucaccgucgacaaaagccgauggcaacagggcaacgucuucagcugcuccgugaugcacgaagcucuccacaaccauuacacacaaaaaucccucucccucucucccggcaaa

SEQ ID NO: 54191 - RNA, 657 nt, Artificial Sequence
  derived and/or modified sequence opt11 from Pinatuzumab_vedotin_LightChain1
gacauccaaaugacccaaagccccuccucacucuccgccuccgucggcgaccgcgucaccauaaccugccgcuccucccaauccaucguccacuccgucggcaacaccuuccucgaaugguaccaacaaaaacccggcaaagcacccaaacuccucaucuacaaagucuccaaccgcuucuccggcguccccucccgcuucuccggcuccggauccggcacagacuucacccucaccaucuccucccuccaaccagaagacuucgccacauacuacugcuuccaaggcucccaauuccccuacacauucggccaaggaaccaaagucgaaaucaaacgcaccgucgccgcccccuccguauucaucuucccacccuccgacgaacaacucaaauccggcaccgccuccgucgucugccuccucaacaacuucuacccccgcgaagccaagguccaauggaaaguagacaacgcucuccaauccggcaacucccaagaauccgucaccgaacaagacucaaaagacucaaccuacucucucuccuccaccuuaacccucuccaaagccgacuacgaaaaacacaaagucuacgccugcgaagucacccaccaaggccuaucaucccccguaaccaaauccuucaaccgcggcgaaugc

SEQ ID NO: 54192 - RNA, 1023 nt, Artificial Sequence
  derived and/or modified sequence opt11 from Placulumab_chain1
gacauccaaaugacccagucacccucaucccucuccgccuccguaggcgaccgagucaccaucacaugccgcgccagccaagccaucgacuccuaccuacacugguaccaacaaaaacccggcaaagcacccaaacuccucaucuacucagccuccaaccucgaaaccggcgucccuuccagauucuccggcuccggcucugggaccgacuucacccucaccaucuccucccuccuucccgaagacuucgcuacauacuacugccaacaagucgucuggcgaccauucaccuucggacaaggcaccaaagucgaaaucaaacgcguagaaccaaaauccuccgacaaaacacacacuugcccaccaugcccagcccccgaacuacucggcggcccaucaguauuccucuucccucccaaacccaaagacacccucaugaucucacgcacccccgaaguuaccugcgucgucgucgacgucucccacgaagacccagaagucaaauucaacugguacguagacggcguagaagugcacaacgccaaaaccaaaccucgcgaagaacaauacaacuccaccuaccgcgucgucucaguccuaaccguccuacaccaagacuggcuaaacggaaaagaauacaaauguaaaguauccaacaaagcccuccccgcccccaucgaaaagaccaucuccaaagccaaaggccaaccccgcgaaccccaagucuacacccucccacccucacgcgacgaacucaccaaaaaccaagucucccuuaccugccucgucaaaggcuucuaccccucagacaucgccguugaaugggaauccaacggccaaccagaaaacaacuacaaaaccacaccacccguccucgacagcgacggcuccuucuuccucuacucaaaacucaccguagacaaaagccgcuggcaacaaggcaacgucuucuccugcuccguuaugcacgaagcccuccacaaccacuacacccaaaaaucccuaucccucucacccggcaaa

SEQ ID NO: 54193 - RNA, 1023 nt, Artificial Sequence
  derived and/or modified sequence opt11 from Placulumab_HeavyChain1
gacauccaaaugacccaaucccccuccucacucuccgccuccguaggcgaccgcgucaccauaaccugccgagcuucacaagccaucgacuccuaccuacacugguaccaacaaaaacccggcaaagcccccaaacuacucaucuacuccgccuccaaccucgaaacgggcguccccucccgcuucucuggcuccggaucuggaaccgacuucacucuaaccaucucaucacuacuacccgaagacuucgcaaccuacuacugccaacaagucgucuggcgacccuucaccuucggccaagguacaaaagucgaaaucaaacgcgucgagcccaaauccuccgauaaaacucauaccugcccucccugccccgcccccgaacuccucggaggacccucugucuuucuauucccucccaaacccaaagacacccucaugaucucccgcacccccgaaguaaccugcgucgucguagacguaucacacgaagaccccgaagucaaauucaacugguacgucgacggagucgaaguccacaacgccaaaacuaaaccccgcgaagaacaauacaauuccaccuaccgcgucgucuccguccugaccguccuccaccaggacuggcucaacggcaaagaauauaaaugcaaagucuccaacaaggcccuccccgcccccaucgagaaaaccauauccaaagccaaaggccaaccccgcgaaccccaagucuacacccuaccacccucccgcgacgaacucaccaaaaaccaagucucccuaaccugccucguuaaaggcuucuaccccuccgacaucgccgucgaaugggaauccaacggccaacccgaaaacaacuacaaaaccaccccgcccguccucgacuccgacggcuccuucuuccucuacucaaaacucaccguggacaaaucccgauggcaacaaggcaacgucuucuccugcuccgucaugcacgaagcccuacacaaucacuacacccaaaaaucccucucccucucgcccggcaaa

SEQ ID NO: 54194 - RNA, 1341 nt, Artificial Sequence
  derived and/or modified sequence opt11 from Plozalizumab_HeavyChain1
gaaguccagcuaguugaaucaggcggaggccucgucaaacccggcggaucacuccgccucucaugcgccgccucaggcuucacauucuccgcauaugccaugaacuggguccgacaagcccccggcaaaggccuagaaugggucggccgcauccguaccaaaaacaacaacuacgccaccuacuacgccgacuccguaaaggaccguuucaccauuucccgcgacgacucgaagaacacacuauaccuccaaaugaacucccucaaaacugaagacacagcaguauacuacugcacaaccuucuacggcaacggaguauggggccaaggcacccuaguaacagucucauccgcaucaacaaaaggacccuccgucuucccccucgcaccauccuccaaaucaaccuccggcggcacggccgcccucgguugccucgucaaagacuacuuccccgaacccguuaccguauccuggaacagcggcgcccucaccucuggcguccacaccuuccccgccguacuccaaagcucaggccuauacucacucuccuccgucgucaccgucccauccucuagccucggcacacaaaccuacaucugcaacgucaaccacaaacccuccaacaccaaaguagacaagaaaguagaacccaaaucaugcgacaaaacccacacaugcccucccugccccgcccccgaacucgcaggcgcacccucagucuuccucuuuccuccaaaacccaaagacacccuaaugaucucccgaacccccgaagucacaugcgucgucguagacgucucucacgaagauccagaagucaaauucaacugguacgucgacggagucgaaguccacaacgccaaaaccaaaccccgagaagaacaauacaacucaaccuaccgagucguguccguccucaccgucuuacaccaagacuggcuaaacggcaaagaauacaaaugcaaaguaagcaacaaagcucuccccgcccccauagagaaaacaaucucaaaagccaaaggccaaccacgcgaaccccaaguauauacccugccacccucucgcgacgaacucaccaaaaaccaagucucccuaaccugccuaguuaaaggauucuaccccuccgacaucgcagucgaaugggaauccaacggccaacccgaaaacaacuacaaaaccaccccacccguccucgacucagacggcagcuucuuccuauacucaaaacucaccguagacaaaucccgcuggcaacaaggaaacgucuucucuuguuccguaaugcacgaagcccuacacaaccacuacacccagaaaagccugucccucucccccggaaag

SEQ ID NO: 54195 - RNA, 657 nt, Artificial Sequence
  derived and/or modified sequence opt11 from Plozalizumab_LightChain1
gacguagucaugacccaaucaccccucucccuucccgucacccucggccaacccgccuccaucucaugcaaauccucccaaucccuacucgacuccgacggcaaaaccuuccucaacugguuccaacaacgccccggccaaucaccccgccgccucaucuaccucgucuccaaacucgacagcggcgucccagaccgcuucucaggcuccggcuccggcaccgacuucacccucaaaaucucccgcgucgaagccgaagacgucggcgucuacuacugcuggcaaggcacccacuucccauacacauucggccaaggcacccgacucgaaaucaaacgcaccgucgccgcccccuccgucuucaucuucccacccucagacgaacaacucaaauccggaacagcauccgucgucugccuccuaaacaacuucuacccccgcgaagcaaaaguccaauggaaagucgacaacgcccuccaauccggcaacucccaagaauccguaaccgaacaagacucaaaagacuccaccuacucccuuuccuccacccucacccucuccaaagccgacuacgaaaaacacaaagucuacgccugcgaagucacacaccaaggccucucuucacccgucaccaaaucauucaaccgcggcgaaugc

SEQ ID NO: 54196 - RNA, 1341 nt, Artificial Sequence
  derived and/or modified sequence opt11 from Pogalizumab_HeavyChain1
gaaguccaacucguccaauccggcgccgaagucaagaaacccggagccuccgucaaaguauccugcaaagccuccggcuacaccuucacugacucauacaugagcugggucagacaagccccaggccagggacucgaauggaucggugacauguaccccgauaacggcgauuccagcuacaaccaaaaauuccgcgaacgagucaccaucacccgcgacaccucaacaagcaccgcauaccucgaacucuccucccuccgcuccgaagacacagccguuuacuacugcguacucgcuccccgaugguacuucagcguauggggccaaggcaccuuagucaccgucuccagcgccuccacaaaaggccccuccguauucccccucgcccccagcagcaaauccaccuccggcggcacagccgcccucggaugccucgucaaagacuacuuccccgaacccguaacagucagcuggaacucaggcgcccucacauccggaguccacaccuuucccgccguccuucaaaguuccggccucuauucccuauccagcguagucaccgucccauccagcucccucggcacccaaaccuacaucugcaacgucaaccauaaaccaagcaacacuaaagucgacaagaaagucgaaccgaaaucuugcgacaaaacccacaccuguccacccugccccgcccccgagcugcucggcggccccuccguauuccucuucccacccaaacccaaagacacccucaugaucucccgcacccccgaagucacaugcguagucgucgacgucucacacgaagaccccgaaguaaaauuuaacugguacgucgacggagucgaaguccacaaugccaaaaccaaaccccgagaagaacaauacaacucaaccuaccgcguugucucuguccucacaguccuccaccaagacuggcuuaacggcaaagaauacaaaugcaaagucucuaacaaagcccugcccgcccccaucgagaaaacaaucagcaaagccaaaggccaaccccgagaaccucaagucuacacccucccacccucaagagaagaaaugaccaaaaaccaagucucacuaaccugccucguaaaaggauucuaccccuccgacauagccgucgaaugggaauccaacggccaacccgaaaacaacuacaaaaccacacccccaguccucgacucagacggcuccuucuuccucuacuccaaacucaccgucgacaaaucccgauggcagcagggcaacguauuuucuugcucaguaaugcacgaagcccuccacaaccacuacacccaaaaaucacucucccucucccccggaaaa

SEQ ID NO: 54197 - RNA, 642 nt, Artificial Sequence
  derived and/or modified sequence opt11 from Pogalizumab_LightChain1
gacauccaaaugacccagucccccucaucccuauccgccuccgucggcgaccgcguaaccaucacaugccgcgcaucccaagacaucucaaacuaccucaacugguaccaacaaaaacccgguaaagcccccaaacuccucaucuacuacaccucccgccuccgcuccggcguccccucccgauucuccggcuccggcuccggcaccgacuucacccucaccaucuccucccuccaacccgaagacuucgccaccuacuacugccaacaaggacacacccucccacccaccuucggccaaggcaccaaagucgaaaucaaacgcaccgucgccgcccccuccgucuucaucuucccacccuccgacgaacaacucaaauccggcaccgccuccgucguaugccuacucaacaacuucuacccccgcgaagccaaaguccaauggaaagucgauaacgcccuccaauccggcaacucacaagaauccgucaccgaacaagacuccaaagacucaaccuacucucucuccucaacccuuacccucuccaaagcagacuacgaaaaacacaaagucuacgcaugcgaagucacccaccaaggacucuccucccccguuaccaaauccuucaaccgaggcgaaugc

SEQ ID NO: 54198 - RNA, 1341 nt, Artificial Sequence
  derived and/or modified sequence opt11 from Polatuzumab_vedotin_HeavyChain1
gaaguucagcuagucgaauccggcggcggccucguccaacccggcggcucucuacgacucucuugcgcagccuccggauacaccuucuccucauacuggaucgaaugggucagacaagcccccgguaaaggccucgaauggaucggcgaaauccuacccggaggcggcgacaccaacuacaacgaaaucuucaaaggccgcgccaccuuuuccgcggacacauccaaaaacacagccuaccuccaaaugaacucacuccgggcagaagacaccgccguauacuacugcacacgacgcguccccauucgacuggacuacuggggccaaggcacgcucgucacagucuccuccgccuccacaaaaggacccucagucuucccccucgcccccucaucgaaaucaaccuccggcggaaccgccgcacucggcugccucguuaaagacuacuuccccgaaccagucaccguuucauggaacagcggagcauuaaccaguggaguccacacauuccccgcgguccuccaaucaucuggcuuguacucccuauccuccgucguaaccguccccuccuccucccuaggcacccaaacguacaucugcaacgugaaccacaaaccuuccaacaccaaagucgacaagaaaguagaacccaaaucaugcgacaaaacacacacaugcccacccugccccgccccagaacuccuaggcggccccucagucuuccuauucccacccaaacccaaagacacccugaugaucucccgcacccccgaaguaacaugugucguagucgacgucucccacgaagacccagaagucaaauucaacugguacgucgacgguguggaaguccacaacgccaaaaccaaaccgcgagaagaacaauacaacuccaccuaccgcgucgucuccguacucacuguccuccaccaagacuggcucaacgguaaagaauacaaauguaaagucuccaacaaagcacuccccgcccccaucgaaaagacuaucagcaaagccaaaggacaaccccgugaaccccaagucuacacccucccacccucccgcgaagaaaugaccaaaaaccaagucucacucacaugccuagucaaaggcuucuaccccucagacaucgccgucgaaugggaaucaaacggccaacccgaaaacaacuacaaaacaaccccaccaguccucgacuccgacggcuccuucuuccuguacuccaaacucaccgucgacaaaucccgauggcaacaaggcaacguauucuccugcuccgucaugcacgaagcacugcacaaucacuacacacaaaaaucccucuccuuaucaccuggcaaa

SEQ ID NO: 54199 - RNA, 654 nt, Artificial Sequence
  derived and/or modified sequence opt11 from Polatuzumab_vedotin_LightChain1
gacauccaacucacucaaucccccuccucccuuagugccucagucggcgaccgcgucaccauaaccugcaaagcaucacaauccgucgacuaugaaggcgacuccuuccucaacugguaccaacaaaaacccggcaaagcccccaaacuccucaucuacgccgccucaaaccucgaauccggcguacccucccgauucuccggcuccggcuccggcacagacuucacccucaccaucuccucccuccaacccgaagacuucgccacauacuauugccaacaauccaacgaagacccccucaccuucggccaaggcaccaaaguagaaaucaaacgcaccgucgccgcccccuccgucuucaucuucccacccuccgacgaacaacuaaaauccggcaccgccucagucgucugccuccucaacaacuucuacccccgcgaagccaaaguccaauggaaaguagacaacgcccuccaauccggcaacucccaagaauccgucaccgaacaagacuccaaagacuccacauacucacuauccucaacucucacccucuccaaagccgacuacgaaaaacacaaagucuacgccugcgaagucacccaccaaggacucuccucccccgucaccaaauccuucaaccgcggcgaaugc

SEQ ID NO: 54200 - RNA, 1326 nt, Artificial Sequence
  derived and/or modified sequence opt11 from Ponezumab_HeavyChain1
caaguccagcucguacaaucaggcgccgaaguaaagaaacccggcgccuccgucaaagucuccugcaaagcauccggcuacuacaccgaagcauacuacauacacuggguccgacaagcccccggccaaggacucgaauggaugggccgcaucgaccccgccacaggcaacacuaaguacgcccccagacuccaagaccgggucaccaugacccgcgauacauccaccucaaccgucuacauggaacuaagcucacuaagauccgaagacaccgcagucuacuacugcgcuucccucuacucccucccagucuauuggggccaaggcaccacagucaccgucucauccgcaagcaccaaaggcccauccgucuucccccucgcacccugcucucgaucaaccuccgaauccaccgccgcccucggcugccucgucaaagacuacuucccugaaccuguaaccgucagcuggaacucaggcgcacuaacauccggaguccacacauuucccgccguccuacaaagcuccggccucuauucucucuccucagucguuacaguaccuuccuccaacuucggaacccaaacauacaccuguaacgucgaccacaaacccuccaacaccaagguugacaaaacagucgaacguaaaugcugcgucgaaugcccacccugccccgcucccccagucgccggccccucaguauuccuguuuccuccaaaacccaaagacacacucaugaucucccgaacccccgaagucacuugcgucguaguggacgucucacacgaagaccccgaaguccaauucaacugguacgucgacggcgucgaaguacacaacgcaaaaacaaaaccccgcgaagaacaauucaacucgaccuuccgaguagucucaguccucacaguaguacaccaagacugguuaaacggaaaagaauacaaaugcaaagucucaaacaaaggccuccccuccagcaucgagaaaaccaucuccaaaaccaaaggccaaccccgcgaaccacaagucuacacacucccacccucacgcgaagaaaugaccaagaaccaagucucccuaaccugccucgucaaaggcuucuaccccucagacaucgcagucgaaugggaaagcaacggccaacccgaaaauaacuacaaaacaacaccucccaugcucgacuccgacggauccuucuuccucuacuccaaacuaaccgucgacaaaucacgcuggcaacaagguaacgucuucucaugcucagucaugcacgaagcccuacauaaucacuacacccaaaaaucacuaucccuaucccccggcaag

SEQ ID NO: 54201 - RNA, 657 nt, Artificial Sequence
  derived and/or modified sequence opt11 from Ponezumab_LightChain1
gacgucguaaugacccaaucaccccucucccucccagucacccucggccaacccgccuccaucuccugcaaauccucccaaucccuucucuacuccgacgccaaaaccuaccucaacugguuccaacaacgccccggacaaucuccccgccgacucaucuaccaaaucucccgacucgacccaggaguccccgaccgcuucuccggcucaggcuccggcaccgacuucacccucaaaauaucccgcgucgaagccgaagacgucggcgucuacuacugccuccaaggaacccacuaccccguccucuucggacaaggcacccgacucgaaauuaaacgcaccguugccgcccccuccgucuucaucuucccacccucagacgaacaacuaaaauccggcaccgccuccgucgucugccuacuaaacaacuucuacccccgcgaagccaaaguccaauggaaagucgauaacgcccuccaauccggcaacucacaagaauccgucacagaacaagacuccaaagacuccaccuacucccucuccuccacccuaacacucuccaaagccgacuaugaaaaacacaaagucuacgccugcgaagucacccaccaaggccucuccucccccgucaccaaauccuucaaccgaggcgaaugc

SEQ ID NO: 54202 - RNA, 1362 nt, Artificial Sequence
  derived and/or modified sequence opt11 from Pritoxaximab_HeavyChain1
caaguccagcuccaagaauccggcgcagaacucguccgcuccggagccucaguacgcauguccugcaaagccucaggcuacaccuucacauccuacaacaugcacugggucaaacaaaccccuggccaaggacuagaauggauaggcuacauuuaccccggcaacggcggcaccaacuacauccaaaaauucaaaggaaaagccauccuaaccgcagacacuucuuccucuaccgcauacaugcaaaucucaucacuaaccuccgaagacucagccgucuacuucugcacccgcuccccaucucacuacuccucagaccccuacuucgacuacuggggccagggcaccacccuaaccgucuccucugaguucgccuccacaaaagguccguccgucuucccacuagcccccuccuccaaauccaccuccggcggcacagccgcccuuggcugccuagucaaagacuacuuucccgaacccgucacggucuccuggaacuccggugccuuaaccucaggcguacacaccuucccagccguccuccaauccucuggccucuacucccucuccucgguagucaccguccccuccuccucacucggcacacagaccuacaucugcaacgucaaccacaaacccucaaacacaaaaguagacaagaaaguagaaccaaaauccugcgacaaaacccacacaugcccacccugcccagccccagaacuccucggcggaccauccguauuccuauuuccucccaaacccaaagacacccuaaugauaagccgcacccccgaaguaaccugcgucgucgucgacguaucacacgaagacccagaagucaaauucaacugguacgucgacggcgucgaaguacacaacgcaaaaaccaaaccucgcgaagaacaauacaacuccacauaccgcguugucucaguccucacaguccuccaccaagacuggcucaacggcaaagaauacaaaugcaaagucuccaacaaagcccuccccgcccccaucgaaaagaccaucuccaaagccaaaggucagccccgagaaccccaagucuacacccuacccccaucccgcgacgaacuaaccaaaaaucaagucucacuaacaugccucgucaaaggcuucuacccaagcgacaucgcaguugaaugggaauccaacggccaacccgaaaacaacuacaaaacaaccccucccguccucgauucugauggaucauucuuccuauacuccaaacuaacaguagacaaaucucgcuggcaacaaggaaaugucuucuccugcuccgucaugcacgaagcccuccacaaccacuacacccagaaaucccucucacucucacccggaaaa

SEQ ID NO: 54203 - RNA, 642 nt, Artificial Sequence
  derived and/or modified sequence opt11 from Pritoxaximab_LightChain1
gacaucgucaugucccaaucucacaaauucaugucaaccuccguaggagaccgagucuccauaaccugcaaagccucccaagacgucggcaccgccgucgccugguaccaacaaaaccccggacaaucccccaaauuccucaucuacugggccuccacccgccacaccggaguccccgaccgauucacaggcucaggcucaggcaccgacuucacccucaccaucaccaacguccaaagcgaagaccucgccgacuacuucugccaacaauacuccucauacccccucaccuucggcgccggcaccucccucgaacucaaacgcaccgucgccgcccccuccguauucaucuucccacccuccgacgaacaacucaaauccggcaccgccuccgucgucugccuccucaacaacuucuacccccgcgaagccaaaguccaauggaaagucgacaacgcccuccaauccggcaacucccaagaauccguaaccgaacaagacucuaaagacuccaccuacucacucuccuccacccucacacuauccaaagccgacuacgaaaaacacaaagucuacgccugcgaagucacccaccaaggccucuccucacccgucaccaaauccuucaaccgcggcgaaugc

SEQ ID NO: 54204 - RNA, 1350 nt, Artificial Sequence
  derived and/or modified sequence opt11 from Pritumumab_HeavyChain1
gaaguccaacuccuagaaucgggcggcgaccucguccaacccgguggaucccuccgccuuucaugcgccgcauccggauucacauucagcaacuacgccaugagcuggguccgccaagcccccggcaaaggacucgaauggguaagcgccauaacacccuccggcggcucaaccaacuacgccgacuccgucaaaggccgcuucaccauaucgcgcgacaacucacaaaacacucuauaccuccaaaugaacagccuucgcgucgaagacaccgcagucuacauaugcggcagagugcccuaccgaucaaccugguacccccucuacuggggccaaggaacccucgucaccgucucauccgcaucgaccaagggaccgucaguauucccacuagcccccuccuccaaauccaccagcggcggaaccgcagcccucggcugccuagucaaagacuacuuccccgaacccgucaccgucuccuggaacuccggagcccucacgagcggcguccacaccuuccccgccguacuccaaucuucaggacucuacucccuaucauccgucgucaccguucccuccucaucacucggaacccaaaccuacaucugcaacgucaaccacaaacccucuaacaccaaaguagacaagaaaguagagccaaaauccugcgacaaaacccacacaugcccacccugccccgcccccgaacuccuaggcggccccuccguauuccucuuucccccaaaacccaaagacacccucaugaucucccgcacaccagaagugaccugcgucgucgucgacgucucucacgaagauccggaaguaaaauucaacugguacgucgacggcgucgaaguccacaacgcgaaaacuaaaccacgcgaagaacaauacaacuccaccuaccgcguaguaucuguccucacuguacuacaccaagacuggcucaacggaaaagaauacaaaugcaaagucuccaacaaagcccuccccgcaccaaucgagaaaacaaucuccaaagcuaaaggccaaccccgcgaaccccagguauacacccuuccacccucccgagacgagcucaccaaaaaucaagucucccuaaccugccucguaaaaggcuucuaccccuccgacaucgccguagaaugggaauccaacgggcaacccgaaaacaacuacaaaaccacucccccuguccucgacuccgacggcagcuucuuccuuuacucaaaacuaaccgucgauaaaagcagauggcaacaaggcaacguguucucaugcucagucaugcaugaagcacuccacaaccacuacacccagaaaagccucucccucucccccggaaaa

SEQ ID NO: 54205 - RNA, 642 nt, Artificial Sequence
  derived and/or modified sequence opt11 from Pritumumab_LightChain1
gacauccaaaugacacagucccccuccucccucuccgccuccgucggagaccgcgucaccaucaccugccgcgccucccaagacaucuccaacuaccucgccugguuccaacaaaaacccggcaaagcccccaaaucccuaauauacgccgccuccucccuccacuccaaaguccccacccaauucuccggcucuggcuccggcaccgacuucacccuaaccaucuccucccuccaacccgaagacuucgccacauacuauugccuccaauacuccaccuaccccaucaccuucggcggaggcaccaaagucgaaaucaaacgcaccgucgccgcacccuccgucuucaucuucccccccuccgacgaacaacucaaauccggcaccgccuccguagucugccuccucaacaacuucuacccccgcgaagccaaaguccaauggaaaguugacaacgcccuccaauccggcaacucccaagaauccgucaccgaacaagacuccaaagacuccaccuacucccuauccuccacccucacccuauccaaagccgacuacgaaaaacacaaagucuacgccugcgaaguaacccaccaaggccucuccucccccgucaccaaauccuucaaccguggcgaaugc

SEQ ID NO: 54206 - RNA, 1341 nt, Artificial Sequence
  derived and/or modified sequence opt11 from Quilizumab_HeavyChain1
gaaguccaacucguagaaucaggcggcggccucguccaacccggcggaucccuccgccucucaugcgcagccuccggcuucaccuucucugacuacggcaucgccuggguccgacaagccccaggcaaaggccuggaaugggucgccuucauuucagaccuugccuauaccauauacuacgccgacaccguaaccggcagauucacaauaagccgcgacaauuccaaaaacacccucuaccuccaaaugaacucacuccgagccgaagacaccgcugucuacuacugcgcccgagacaacugggacgccauggacuacuggggccaaggcacacucgucaccgucuccuccgccagcaccaaaggcccaucaguguucccccucgcaccgucaagcaaaucuaccuccggcggcaccgcagcccucggcugccucgucaaagacuacuucccugaacccgucaccgucagcuggaacucaggcgcccucacauccggaguccacaccuuccccgccguccuccaauccuccggccuauacagccucagcucugucgucacuguccccuccuccucccucggcacacaaacauacauaugcaacgucaaccauaaacccuccaacacaaaagucgacaagaaagucgaacccaaauccugcgacaaaacccauaccugcccacccugccccgcccccgaacuacucggcggccccagcgucuuccucuucccacccaaacccaaagacacccuaaugaucucccgcacccccgaaguaacaugcgucgucgucgacgucucccacgaagaccccgaaguaaaauucaauugguacgucgacggagucgaaguccacaacgccaaaaccaaaccccgcgaagaacaguauaacagcacauaccgcgucgucuccguacuaaccguccuccaccaagacuggcucaacggaaaagaauacaaaugcaaaguguccaacaaagcccuccccgccccaaucgaaaagacaaucagcaaagccaaaggccaaccacgcgaaccgcaaguuuacacacuaccaccaucucgcgaagaaaugaccaaaaaccaagucucucuaacaugccucgucaaaggcuucuaccccuccgacaucgccguagaaugggaguccaacggccaaccagaaaacaacuacaaaacaaccccucccguccucgacucagacggcucauucuuccuauacucaaaacuuaccgucgacaaaucccguuggcaacaaggaaacgucuucagcugcucagucaugcacgaagcccuucacaaucacuacacacaaaaauccuuaucucucucccccggaaaa

SEQ ID NO: 54207 - RNA, 657 nt, Artificial Sequence
  derived and/or modified sequence opt11 from Quilizumab_LightChain1
gacauccaaaugacccaaucccccuccucccucuccgccucagucggcgaccgcgucaccaucacuugccgcuccucacaaucccucguacacaacaacgccaacaccuaccuacacugguaccaacaaaaacccggcaaagcccccaaacuccucaucuacaaagucuccaaccgcuucuccggcguacccucccgcuucucaggcuccggauccggcaccgacuucacacuaaccaucuccucacuccaacccgaagacuucgccaccuacuacugcucccaaaacacccucguccccuggacauucggacaaggcaccaaagucgaaaucaaacgcaccgucgccgcccccuccgucuucaucuucccacccuccgacgaacaacucaaauccggcacagccuccgucgucugccuacucaacaacuucuacccccgcgaagccaaaguccaauggaaagucgauaacgcccuccaauccggcaacucacaagaauccgucaccgaacaagacagcaaagacuccaccuacucccuaucauccacccuaacccucuccaaagccgacuacgaaaaacacaaagucuacgccugcgaaguaacccaccaaggccucuccucccccgucaccaaauccuucaaccgcggcgaaugc

SEQ ID NO: 54208 - RNA, 1335 nt, Artificial Sequence
  derived and/or modified sequence opt11 from Racotumomab_HeavyChain1
caaguacaacuucaacaauccggcgccgaacucguuaaacccggagccuccgucaaacucagcugcaaagccuccggcuacacuuucacauccuacgacaucaacuggguccgacaacgccccgaacaaggccucgaauggauaggcuggaucuuccccggcgacggcucaacuaaauacaacgaaaaauucaaaggcaaagccacccucaccaccgacaaauccuccagcaccgcuuacaugcaacucucccgccucaccucagaagacuccgcagucuacuucugcgcccgcgaagacuacuacgacaacuccuacuacuucgacuacuggggccaaggcaccacccuuaccgucucuuccgccaaaaccacaccacccucagucuacccccucgcccccggcucugccgcccaaaccaauuccaugguaacccucggcugccucgucaaaggcuacuuccccgaacccgucacagucaccuggaacuccggcucacucucauccggcguccacaccuucccagcaguucugcaauccgaccuauacacccucucauccuccgucacaguccccucaucaccccgcccaagcgaaacaguaaccugcaacgucgcgcaccccgcauccucaacaaagguugacaagaaaauagucccccgcgacugcggcugcaaacccugcaucugcaccguacccgaaguaucauccgucuucaucuuuccacccaaacccaaagacguccuuaccaucacucucaccccaaaaguaaccugcgucgucgucgacauaagcaaggacgacccugaaguccaauucuccugguucgucgacgacguugaaguccacaccgcccaaacacaaccccgugaagaacaauucaacuccaccuuccgcuccgucuccgagcuaccaaucaugcaccaagacuggcucaacggaaaagaguucaagugcagagucaacuccgcugccuuccccgccccgaucgagaaaacaaucuccaagacaaaaggccggcccaaagcaccccaagucuacaccaucccaccacccaaagaacaaauggccaaagacaaagucucccucacaugcaugaucaccgacuuuuuccccgaagacaucaccguagaauggcaauggaacggccaacccgccgaaaacuacaaaaauacccaacccaucaugaacacaaacggaucuuacuucgucuacuccaaacuaaacguccaaaaauccaacugggaagccgguaauacauuuaccugcuccguccuacacgaaggacuacacaaccaucacaccgaaaaaucccuuucacacucccccggcaaa

SEQ ID NO: 54209 - RNA, 642 nt, Artificial Sequence
  derived and/or modified sequence opt11 from Racotumomab_LightChain1
gacauacaaaugacccaaaccaccucaucccucucagccucccucggcgaccgcguaaccaucuccugccgcgccucccaagacaucuccaacuaccucaacugguaccaacaaaaacccgacggcaccgucaaacuccuaaucuacuacaccucccgccuccacuccggcguccccucccgauucuccggauccggcuccggcaccgacuacucccucaccaucucaaaccucgaacaagaagacaucgccacuuacuucugccaacaaggcaacacccuacccuggaccuucggaggcggcaccaaacuagaaaucaaacgagccgacgccgcccccaccgucuccauauucccacccuccuccgaacaacucaccuccggcggcgccuccgucguaugcuuccucaacaacuucuaccccaaagacaucaacgucaaauggaaaaucgacggcuccgaacgacaaaacggcguacucaacuccuggaccgaccaagacagcaaagacuccaccuacuccaugucaucaacccucacacucaccaaagacgaauacgaacgucacaacuccuacacaugcgaagcaacccacaaaaccuccaccucccccauagucaaauccuucaaccgcaacgaaugc

SEQ ID NO: 54210 - RNA, 1089 nt, Artificial Sequence
  derived and/or modified sequence opt11 from Racotumomab_scVH-VH'-VH_chain
gagguccagcuaguagaaucaggaggaggccugguccagcccggaggcucgcuaaggcucucgugcgcggccucaggauucaccuucagcgacuacuggauguacugggugcgccaggccccgggaaagggcuuagaaugggucucggaaauaaacacgaacgggcucauaacaaaguacccggacucggucaaaggcagauucacgaucucacgcgacaacgcgaaaaacacccuguaccuacaaaugaacucgcuaaggcccgaagacacggccguguauuacugcgcgcgcagucccucaggcuucaacaggggccagggaacgcucguaaccgugagcucgggagggggcgggagcgggggcgggagugagguacagcugguagaaucggguggaggacugguccagccaggaaauucgcuaagacuaucuugcgcggcaucaggguucaccuucagcucguucggaaugagcugggugagacaagccccggguaagggcuuggaauggguuucgagcauaagcggaagcgggagcgacacacuguaugcggacucggucaagggccgauucacaaucagccgcgacaacgcgaaaacgacucuguacuugcaaaugaacucacuccggcccgaggacacggccguguacuacugcacaaucgggggcucgcuaucgagaucaagccagggcacgcucgugacgguaagcuccggcgggggaggaagcgggggcgggagcgagguccagcuaguggaaucgggcgggggauugguucagcccgggggcucgcuuagacucucgugcgcggccucaggauucaccuucagugacuacuggauguacugggugcgccaagccccaggcaaaggcuuagaaugggucucggaaauuaacacaaacgggcucaucacaaaguacccagacucggucaagggcagauucacgaucucgcgcgauaacgcgaaaaacacccuguaccugcaaaugaacucgcucagaccagaggacacggcaguauacuauugcgcacgcucacccucaggcuucaacagaggccagggcacgcuagugaccguaagcucg

SEQ ID NO: 54211 - RNA, 1071 nt, Artificial Sequence
  derived and/or modified sequence opt11 from Radretumab_HeavyChain1
gaaguccaacuccucgaauccggaggcggucucguccaacccggcggcucacuccgacuauccugcgccgccucuggcuucaccuucucauccuucucaaugucauggguccgccaagccccuggcaaaggccuugaauggguaucguccauauccggaagcuccggaacaaccuacuacgccgacuccgucaaaggaagguucacaauaucccgcgacaacuccaaaaacacccucuaccuccaaaugaacucacuacgcgccgaagacacagccguauacuacugcgcaaaacccuucccauacuucgacuacuggggacaaggcacccuagucaccgucucuagcggcgacggcuccucaggaggcucaggcggcgccuccgaaaucguccuaacacaaucacccggaacccucagcuuaagccccggcgaacgcgccacacucuccugccgcgcuucccaauccgucuccucuuccuuccuagcaugguaccaacaaaaacccggccaagccccacgacuccuaauauacuacgccuccucccgagccaccggcaucccagaccgcuucucaggcagcggauccggcaccgacuucacacucacaaucucucgccucgaaccagaagacuucgccgucuacuacugccaacagaccggccgcaucccucccaccuucggccaaggcacaaaagucgaaaucaaaucuggaggcuccggcggcccacgcgccgcacccgaaguuuacgccuucgccacccccgaauggcccggaucccgcgacaaacgcacccuagccugccuaauccaaaacuucaugccugaagacaucucuguacaauggcuccacaacgaaguacaacugcccgacgcccgccacucaaccacccaaccccgaaaaacaaagggcuccggcuucuucgucuucucccgccuggaagucaccagagccgaaugggaacaaaaggacgaauucaucugccgagccguacacgaagccgccucccccucacaaaccguccaacgcgccgucagcgucaaccccgaauccagccgccgaggaggcugc

SEQ ID NO: 54212 - RNA, 414 nt, Artificial Sequence
  derived and/or modified sequence opt11 from Radretumab_j_chain
ggcgacgacgaagccaccauccucgccgacaacaaaugcaugugcacccgcguaaccucccgcaucauccccuccacagaagaccccaacgaagacaucgucgaacgcaacauccgcaucgucgucccccucaacaaccgcgaaaacauauccgaccccaccuccccccuccgccgcaacuucgucuaccaccucuccgacgucugcaaaaaaugcgaccccgucgaagucgaacucgaagaccaagucgucaccgccacccaauccaacaucugcaacgaagacgacggaguccccgaaaccugcuacauguacgaccgcaacaaaugcuacaccaccauggucccccuccgcuaccacggcgaaaccaaaaugguccaagccgcccucacccccgacuccugcuaccccgac

SEQ ID NO: 54213 - RNA, 1368 nt, Artificial Sequence
  derived and/or modified sequence opt11 from Rafivirumab_HeavyChain1
caaguucaacucguccaaucaggcgccgagguaaagaaaccuggcucauccguaaaaguauccugcaaagccuccggagguaccuucaaucgauacaccgucaacuggguccgccaagcacccggccaaggacuggaauggaugggcggcaucaucccaauauucggcaccgccaacuacgcacaacgcuuccaaggccgacucacaaucaccgcagacgaaucaacauccacagccuacauggaacucucuagccuucgcuccgacgacacagccgucuacuucugcgcucgagaaaaccucgacaacucuggcaccuacuacuacuucuccggaugguucgaccccuggggccaaggaacccuagucacagucuccagcgccucaacaaaaggaccauccguauuccccuuagcccccucauccaaaucaacauccggaggcacagccgcacuaggaugccuagucaaagacuacuucccagaacccguaaccgucuccuggaacucaggcgcucucaccagcggaguccacacauuccccgcuguacuucaaucaucaggccucuacagccucuccuccgucgucacaguccccuccucaucccuaggaacccaaaccuacauaugcaacguaaaucacaaaccuuccaacaccaagguagacaaacgagucgaacccaagucaugcgacaaaacccauaccugcccacccugccccgcccccgaacuacucggcggccccucaguuuuccuauucccacccaaacccaaagauacucuaaugaucucacgcacacccgaaguaaccugcgucgucgucgacgucagccacgaagaccccgaagucaaauucaacugguacgucgauggagucgaaguccacaacgcaaaaaccaaaccccgagaagaacaguacaacuccacauacagaguagucuccguacucacaguccuacaccaagacuggcucaacggaaaagaauacaaaugcaaaguaucaaacaaagcccuccccgcucccauagagaaaacaauauccaaagcaaaaggacaaccccgagaaccccaagucuacacccuaccacccucccgagaagaaaugaccaagaaccaagugucgcucacaugccucgucaaaggcuucuaucccucagacaucgccgucgaaugggaauccaauggccaacccgaaaacaacuauaaaaccacacccccaguccuggacucagacggcuccuuuuuccucuacuccaaacuaaccguagacaaauccagauggcaacaaggaaacguauucuccugcuccgucaugcacgaagcccuccacaaccacuacacccagaaaucccucucccuaagccccggc

SEQ ID NO: 54214 - RNA, 1368 nt, Artificial Sequence
  derived and/or modified sequence opt11 from Rafivirumab_HeavyChain
gaaguccaacucguccaauccggcgccgaagucaagaaacccggcuccagcgucaaaguaucgugcaaagcaucaggcggaaccuucaaccgcuacacaguaaacuggguccgacaagcacccggccaaggucucgaauggaugggaggcaucauacccauuuucggcaccgccaacuacgcccaacgcuuccaaggacgccuaaccaucaccgccgacgaauccaccuccacagcauacauggaacucuccucacuccgaagcgacgacaccgccgucuacuucugcgcccgcgaaaaccucgacaacucgggaaccuacuacuacuucuccggcugguucgaccccuggggucaaggcacccucgucaccgucagcuccgccucuaccaaaggccccucuguauucccccucgccccaucaagcaaauccacaucaggcggcaccgccgcacuaggcugccuagucaaagacuacuuccccgaacccguaacagucuccuggaacuccggcgcccucacaagcggcguccacaccuucccugccguccuccaauccuccggacuauauucucucucuuccgucguaacuguacccuccuccucacucggcacccaaacauauaucuguaacgucaaccacaaacccuccaacaccaaagucgacaaacgcgucgaacccaaguccugcgacaaaacccacaccuguccgcccugccccgcccccgaacuacucggcggccccucagucuuccuauuucccccaaagcccaaagacacccucaugaucucccgcacgcccgaagucacaugcgucgucgucgacguaucucacgaagacccagaagucaaauucaacugguacgucgacggagucgaaguccacaacgccaaaaccaaaccccgcgaagaacaauacaacuccaccuaccgcguugucucuguccucacaguacuccaccaagacuggcuuaacggcaaagaauacaaaugcaaagucucaaacaaagcucuccccgccccuaucgagaaaacaaucagcaaagccaaaggacaacccagggaaccacaagucuacacccuacccccaucucgcgaagaaaugaccaaaaaccaaguaucccuaacaugccuagucaaaggauucuaccccuccgacauugccguagaaugggaauccaacggccaacccgaaaacaacuacaaaacaacaccucccguucuugacucggacggcuccuucuuccucuacuccaaacucacagucgacaaaucccgauggcaacaaggcaacguauucuccugcucagucaugcaugaagcccuucacaaccacuacacccaaaaaucacucucccucagccccgga

SEQ ID NO: 54215 - RNA, 654 nt, Artificial Sequence
  derived and/or modified sequence opt11 from Rafivirumab_LightChain1
caaucagcacucacccaaccccgcuccgucagcggaucccccggacaauccgucaccaucuccugcaccggcaccucauccgacaucggcggcuacaacuucgucuccugguaccaacaacaccccggaaaagcacccaaacucaugaucuacgacgcaaccaaacgccccuccggcguccccgaccgcuucuccggauccaaauccggcaacaccgccucacucaccaucuccggccuccaagccgaagacgaagccgacuacuacugcugcuccuacgccggcgacuacacuccaggagucgucuucggcggcggcaccaaacucaccguccucggacaacccaaagccgcaccaucagucacccuauucccccccuccuccgaagaacuccaagcaaacaaagccacccucgucugccucaucucugacuucuaccccggcgccguaaccgucgccuggaaagccgacuccucccccguaaaagccggcgucgaaaccacaacacccagcaaacaaucaaacaacaaauacgccgccuccagcuaccuaucccuaacccccgaacaauggaaaucccaccgaucauacuccugccaagucacacacgaaggaucaaccgucgaaaaaaccgucgcccccaccgaaugcucc

SEQ ID NO: 54216 - RNA, 654 nt, Artificial Sequence
  derived and/or modified sequence opt11 from Rafivirumab_LightChain
gaaagcgcacucacccaaccccgcucagucuccggaucgcccgggcaauccgucacaaucuccugcacaggcacauccuccgacaucggcggcuacaacuucgucagcugguaccaacaacaccccggaaaagcacccaaacucaugaucuacgacgccaccaaacgccccuccggagucccagaccgcuucuccggaucaaaauccggcaacaccgccucccuaaccaucuccggacuccaagccgaagacgaagccgacuacuacugcugcagcuacgccggcgacuacacacccggcgucgucuucggcgggggcacaaaacucacaguccucggacaacccaaagccgccccuuccgucacccuuuucccacccucaagcgaagaacuacaagccaacaaagccacccucgucugcuuaaucucggacuucuaccccggcgccgucaccguagccuggaaagccgacagcucacccgucaaagccggcgucgaaaccaccacacccuccaaacaaagcaacaacaaauacgcagcaucaagcuaccucucccucacccccgaacaauggaaaucccaccgaagcuacagcugccaagucacccacgaaggcagcacagucgaaaaaaccgucgccccaaccgaaugcagc

SEQ ID NO: 54217 - RNA, 1332 nt, Artificial Sequence
  derived and/or modified sequence opt11 from Ralpancizumab_HeavyChain1
caaguccaacucguccaauccggagccgaagucaagaaaccaggcgccucagucaaagucuccugcaaagccucaggcuacaccuucaccucuuacuacaugcacuggguucgucaagcccccggccagggacuagaauggaugggcgagauacaccccuccggaggccgcacaaacuauaacgaaaaauucaaaucacgcgucacuaugacccgagacaccucgaccuccaccgucuauauggaacucuccucccuccguuccgaagacacagccgucuacuacugcgcccgugaacgaccccucuacgccucagaccuauggggacaaggcacaacagucaccgucucauccgcauccacaaaaggcccuucagucuucccucuagccccgugcucccguucgaccagcgaauccaccgcagcccucggcugccucguaaaagacuacuucccagaacccgucaccguaucauggaacucuggagcccuaaccuccggcguacacaccuuccccgccguccuccaauccuccggacucuacucauuauccuccgucgucaccguaccaucaucaaacuucggcacccaaaccuauaccugcaacguagaccauaaacccuccaacaccaaagucgacaaaacaguagaacgcaaaugcugcguagaaugcccacccugucccgcaccaccgguagccggacccuccguuuuccucuucccacccaaacccaaggacacccucaugaucucccgcacccccgaaguaaccugcgucgucgucgacguuagccacgaagaccccgaagugcaauucaacugguacgucgacggcgucgaaguccacaacgcaaaaaccaaaccucgcgaggaacaauucaacuccaccuuccgcguagucucaguacucacagucguccaccaagacuggcuaaacggcaaagaauacaaaugcaaagucuccaacaaaggacuccccagcucuaucgagaaaaccauaucaaaaaccaaaggccagccccgagaaccccaagucuacacacucccacccucccgagaagaaaugaccaaaaaucaagucucacuaaccugccuaguaaaaggcuucuaccccuccgacaucgccgucgaaugggaaucaaacggccaacccgaaaacaacuacaaaacaacgcccccaaugcucgacucggacggcuccuucuuccucuacuccaaacucaccgucgacaaaucacgcuggcaacaaggcaacgucuucucgugcuccguuaugcacgaagcccuccacaaccacuacacccaaaaaucacuuucccucuccccaggaaaa

SEQ ID NO: 54218 - RNA, 642 nt, Artificial Sequence
  derived and/or modified sequence opt11 from Ralpancizumab_LightChain1
gacauccaaaugacacaaucccccuccucccucuccgccagcgucggcgaccgcgucaccauaaccugcaaagccucccaagacguccacaccgcagucgccugguaccaacaaaaacccggcaaagcccccaaacuccuaaucuaccacgccuccuaccgauacaccggcguccccucccgcuucuccggcucaggcucaggcaccgacuucaccuucaccaucucaucccuccaacccgaagacaucgccaccuacuacugccaacaacgcuacucacucuggcgaaccuucggccaaggcaccaaacucgaaaucaaacgcaccgucgccgcccccuccguauucaucuucccacccuccgacgaacaacucaaauccggcaccgccuccgucgucugccuacucaacaacuucuacccccgcgaagccaaaguccaauggaaagucgacaacgcccuccaauccggcaacucgcaagaauccgucaccgaacaagacuccaaagacuccaccuacucacucuccuccacccuuacccucuccaaagccgacuacgaaaaacacaaagucuacgccugcgaagucacccaccaaggacucucaucccccgucaccaaauccuucaaccgcggcgaaugc

SEQ ID NO: 54219 - RNA, 1338 nt, Artificial Sequence
  derived and/or modified sequence opt11 from Ramucirumab_HeavyChain1
gaaguccaacucguacaauccggcggcggccucguaaaaccuggcggaucauuacgccuaucaugcgcagccucaggcuucaccuucucaucguacucaaugaacuggguacgacaagcccccggcaaaggccucgaaugggucuccuccaucucauccuccuccuccuacaucuacuacgccgacuccguuaaaggccgauucaccaucagccgcgacaacgcgaaaaacucacucuaccuccaaaugaacucacuccgcgccgaagacaccgccguauauuacugugcccgcgucacagacgccuuugacaucuggggacaaggcaccauggucaccgucagcucagcuuccacaaaaggacccucagucuucccacucgcaccaagcuccaaaagcaccagcggaggcaccgcggcacuuggcugccucgucaaagacuacuuccccgaacccgucacugucuccuggaacuccggcgcacuaaccagcggcguacauacauuccccgccguccuccaaagcuccggccucuacucgcuauccuccgucgucacaguccccucauccucccucggcacucaaaccuacaucugcaacguaaaccauaaacccuccaacaccaaagucgacaagaaagucgaacccaaaagcugcgacaaaacccacaccuguccacccugccccgcccccgaacuccucggcggccccuccguauuccucuucccucccaagcccaaagacacccuuaugauuuccagaacccccgaaguuaccugcgucguaguagacgucucacacgaggaccccgaagucaaauucaacugguacguugacggcguagaaguacacaacgccaaaaccaaaccccgcgaggaacaauacaacucaaccuacagagucguaucaguucucaccguccuccaccaagacuggcuaaacggcaaagaauacaagugcaaagucuccaacaaggcccucccagcacccaucgagaaaaccaucuccaaagcuaaaggucaaccccgcgaaccccaggucuacacccucccacccucccgcgaagaaaugaccaagaaccaaguuucccucacaugucuagucaaaggauucuaccccuccgacaucgccguagaaugggaaucuaacggccaaccagaaaacaacuacaaaaccacaccacccguacucgacuccgacggauccuucuuccucuauuccaaacucaccguagauaaaagccgcuggcaacaaggaaacguguucucuugcuccguaaugcacgaagcacuccacaaccacuauacacaaaaaucacuaucccucucacccgggaaa

SEQ ID NO: 54220 - RNA, 642 nt, Artificial Sequence
  derived and/or modified sequence opt11 from Ramucirumab_LightChain1
gacauccaaaugacacaaucccccucuuccgucuccgcauccaucggcgaccgcgucaccaucaccugccgcgccucccaaggcaucgacaacuggcucggcugguaccaacaaaaacccggcaaagcccccaaacuacucauauacgacgccuccaaccucgacaccggcguccccagccgcuucuccggcuccggcucaggcaccuacuucacacucaccaucuccucacuccaggccgaagacuucgccguauacuucugccaacaagccaaagccuucccccccaccuucggcggcggcaccaaaguagacaucaaaggcaccgucgccgccccuuccgucuucauauucccccccuccgacgaacaacucaaauccggcaccgccuccgucgucugccuccucaacaacuucuacccccgcgaagccaaaguccaauggaaagucgauaacgcacuccaaagcggaaacucccaagaauccguaaccgaacaagacucaaaagacuccaccuacucccucuccuccacccucacccuauccaaagccgacuacgaaaaacacaaagucuacgcaugcgaagucacccaccaaggccuauccucccccguaaccaaauccuucaaccgaggcgaaugc

SEQ ID NO: 54221 - RNA, 687 nt, Artificial Sequence
  derived and/or modified sequence opt11 from Ranibiziuab_HeavyChain1
gaaguccaacucgucgaauccggcggcggccucguccaaccuggcggcucccuccgacucuccugcgccgccuccggcuacgacuucacacacuacggcaacuggguccgccaagccccuggcaaaggccuagaaugggucggcuggaucaacaccuacaccggcgaacccaccuacgccgccgacuucaaacgccgcuucaccuucucccuagacaccuccaaaucaaccgcauaccuccaaaacucccuccgcgccgaagacaccgccgucuacuacugcgccaaauaccccuacuacuacgguaccucccacugguacuucgacgucuggggccaaggcacccucguaacagucucguccgccuccaccaaaggccccagcgucuucccccucgcccccuccucaaaaucuaccuccggcggcaccgccgcccucggcugccuaguaaaagacuacuucccagaacccgucaccgucuccuggaacuccggcgcccucaccuccggcguccacacuuuccccgccguccuacaauccuccggacuauacucccucuccagcgucgucaccguccccuccuccucccucggcacccaaaccuacaucugcaacgucaaccacaaacccucaaacaccaaagucgacaaaaaagucgaacccaaauccugcgacaaaacccaccuc

SEQ ID NO: 54222 - RNA, 642 nt, Artificial Sequence
  derived and/or modified sequence opt11 from Ranibiziuab_LightChain1
gacauccaacucacccaaucccccucaucccucuccgccuccgucggcgaccgcguaaccaucacaugcuccgccucccaagacaucuccaacuaccucaacugguaccaacaaaaacccggcaaagcccccaaaguacucaucuacuucaccuccucucuccacuccggcguccccucccgauucuccggcuccggauccggcaccgacuucacccuuaccaucuccucccuccaacccgaagacuucgccaccuacuacugccaacaauacuccaccgucccauggaccuucggccaaggcaccaaagucgaaaucaaacgcaccguagccgcacccuccguauucaucuucccacccucagacgaacaacucaaauccggcaccgccuccgucguaugccuccucaacaacuucuacccccgcgaagccaaaguccaauggaaagucgauaacgcccuucaauccggcaacucccaagaauccgucaccgaacaagacuccaaagacuccaccuacucccucuccuccacccucacccucuccaaagcagacuacgaaaaacauaaaguauacgccugcgaagucacccaccaaggccuauccucccccguaaccaaauccuucaaccgcggcgaaugc

SEQ ID NO: 54223 - RNA, 639 nt, Artificial Sequence
  derived and/or modified sequence opt11 from Ranibizumab_fab_fragment
gacauccaacucacccaaucccccucaucccucuccgccuccgucggcgaccgcgucaccaucacaugcuccgccucccaagacaucucuaacuaccucaacugguaccaacaaaaacccggaaaagcacccaaaguccucaucuacuucaccuccucacuccacuccggcgucccaucccgcuucuccggcucaggcuccggcaccgacuucacucuaaccaucuccucccuccaacccgaagacuucgccaccuacuacugccaacaauacuccaccguccccuggaccuucggccaaggcaccaaagucgaaauaaaacgcaccgucgccgcccccuccguauucaucuucccacccuccgacgaacaacucaaauccggcaccgccuccgucgucugccuccucaacaacuucuacccccgcgaagccaagguccaauggaaagucgacaacgcccuccaauccggcaacucccaagaauccgucaccgaacaagacuccaaagacuccacauacucccucuccuccacccucacccucuccaaagccgacuacgaaaaacacaaagucuacgcaugcgaagucacccaccaaggccucuccucccccgucaccaaauccuucaacagaggcgaa

SEQ ID NO: 54224 - RNA, 693 nt, Artificial Sequence
  derived and/or modified sequence opt11 from Ranibizumab_HeavyChain
gaaguccaacucgucgaauccggcggcggccuaguccaacccggaggcucccuccgacuaucaugcgccgccuccggcuacgacuucacccacuacggaaugaacuggguccgacaagcuccaggaaaaggccucgaaugggucggcuggaucaacaccuacaccggcgaaccaacauacgccgccgacuucaaacgccgauucaccuucucacucgacaccuccaaauccaccgcauaccuccaaaugaacucacuccgcgccgaagacaccgcagucuacuacugcgccaaauaccccuacuacuacggaaccucccacugguacuucgacgucuggggccaaggcacccucgucaccgucuccuccgccuccacaaaaggccccuccgucuucccacucgcacccuccuccaaauccaccuccggcggcaccgccgcccucggcugccucgucaaagacuacuuccccgaacccgucaccguauccuggaacucaggcgcacuaaccucaggcguccacaccuuccccgccguccuccaauccuccggacuuuacucccuuucauccgucgucaccguccccuccuccucccucggcacccaaaccuacaucugcaacgucaaccacaaacccuccaacaccaaagucgacaagaaagucgaacccaaauccugcgacaaaacucaccua

SEQ ID NO: 54225 - RNA, 654 nt, Artificial Sequence
  derived and/or modified sequence opt11 from Ranibizumab_LightChain
gaaguccaacuagucgaaagcggcggcggccucguccaacccggcggcucccuacgccucuccugcgccgccuccggcuacgacuucacccacuacggcaugaacuggguccgccaagcccccggcaaaggccucgaaugggucggcuggaucaacacauacaccggcgaacccaccuacgcagcagacuucaaacgccgcuucaccuucucccucgacacauccaaauccaccgccuaccuccaaaugaacucccuccgagcagaagacacagccgucuacuacugcgccaaauaccccuacuacuacggcaccucccacugguacuucgacgucuggggacaaggcacacucguaaccgucuccuccgccucaaccaaaggccccucugucuucccccucgcccccuccggcaccgcagcccucggcugccucgucaaagacuacuucccagaacccgucacagucuccuggaacuccggcgcacucacauccggcguacacacauuccccgccguccuccaauccucaggccucuacucacucuccuccgucgucaccguccccuccuccucccucggcacacaaaccuacaucugcaacguuaaccacaaacccuccaacaccaaagucgacaaaaaagucgaacccaaa

SEQ ID NO: 54226 - RNA, 642 nt, Artificial Sequence
  derived and/or modified sequence opt11 from Ranibizumab_LightChain_variant
gacauccaacucacucaaucccccuccucccucucagccuccgucggcgaccgcgucaccauaaccugcucagcaucccaagacaucuccaacuaccucaacugguaccaacaaaaaccaggcaaagcacccaaaguccucaucuacuucaccuccucccuacacuccggcgucccaucccgauucuccggcuccggcucaggcacagacuucacccucaccaucuccucccuccaacccgaagacuucgccacauacuacugccaacaauacuccaccguccccuggaccuucggccaaggcacuaaagucgaaaucaaacguaccgucgcagcccccuccgucuucaucuucccacccuccgacgaacaacucaaauccggcaccgccuccgucgucugccuccucaacaacuucuacccccgcgaagccaaaguccaauggaaagucgacaacgcacuccaauccggaaacucccaagaauccgucaccgaacaagacuccaaagacuccaccuacucccucuccuccacccuuacccucuccaaagccgacuacgaaaaacacaaagucuacgccugcgaagucacccaccaaggccucuccucccccgucaccaaauccuucaaccgcggcgaaugc

SEQ ID NO: 54227 - RNA, 1368 nt, Artificial Sequence
  derived and/or modified sequence opt11 from Refanezumab_HeavyChain1
caaguccaacucguacaaagcggcuccgaacucaagaaacccggcgcauccgucaaagucuccugcaaagcgucaggcuacaccuucaccaacuacggcaugaacuggguaagacaagcgcccggccaaggccucgaauggaugggcuggaucaacaccuacaccggcgagccaaccuacgcugacgacuucaccggccgcuuuguauucagccucgacaccucuguaagcaccgccuaccuacaaaucuccucccuaaaagcagaagacacagccguauacuacugcgcucgcaacccaaucaacuacuacggaaucaacuaugaaggauacguaauggacuacuggggccaaggcacccuagucacaguauccuccgccucuaccaaaggccccuccgucuucccccucgcccccuccucaaaaucaaccucaggaggcaccgccgcccucggcugccuagucaaagacuacuuccccgaaccaguaaccguguccuggaacucaggcgcacucaccucaggaguccacaccuuccccgccguccuccagucaucaggccuauacucacucucauccgucgucacaguaccgucauccucccucggcacacaaaccuacaucugcaaugucaaccauaaacccuccaauaccaaagucgacaagaaaguagaacccaaaucaugcgacaaaacccacacgugcccacccugccccgcccccgaacuagccggcgcccccagcgucuuccucuuuccacccaaacccaaagacacccucaugauaucucgcacccccgaaguaaccugcgucgucgucgacgucucccacgaagaccccgaagucaaauucaacugguacgucgauggugucgaaguacacaacgcaaaaacaaaaccccgugaggaacaauauaacuccaccuacagagucguaucaguccucacaguacuacaccaggacuggcuaaacggaaaagaauauaaaugcaaagucucaaacaaagcacugccagcccccauugagaaaaccaucagcaaagcaaaaggccaaccccgcgaaccccaaguauacacacuaccacccucccgagacgaacucaccaaaaaccaagucucacuaaccugccucguaaaaggcuucuaccccuccgacaucgccgucgaaugggaaagcaacggccaacccgaaaacaacuacaaaaccacacccccgguccucgacucagacggauccuucuuccucuacuccaaacucaccgucgacaaaucccgcuggcaacaaggaaacguauuuucaugcucagucaugcacgaggcccuccacaaccacuacacccaaaaaucccucucccucucucccggcaag

SEQ ID NO: 54228 - RNA, 657 nt, Artificial Sequence
  derived and/or modified sequence opt11 from Refanezumab_LightChain1
gacaucgucaugacccaaucccccgacucccucgccgucucccucggcgaacgcgcaaccaucaacugcaaauccucccacucaguccucuacucaucaaaccaaaaaaacuaccucgcaugguaccaacaaaaacccggccaaccccccaaacuacucaucuacugggccuccacccgcgaaucuggcguccccgaccgcuucuccggcuccggcuccggaaccgacuucacccucaccaucuccucccuccaagcagaagacgucgcugucuacuacugccaccaauaccucuccucccucacauucggccaaggcaccaaacucgaaaucaaacgcaccgucgccgcccccuccguauucaucuucccccccuccgacgagcaacucaaaucuggcaccgccuccgucgucugccuccucaacaacuucuacccccgcgaagccaaaguccaauggaaagucgacaacgcacuccaauccggcaacucacaagaauccgucaccgaacaagacuccaaagacuccacauacucccucuccuccacccucacccucuccaaagccgacuacgaaaaacacaaagucuacgccugcgaagucacccaccaaggccucuccucccccgucaccaaauccuucaaccgcggcgaaugc

SEQ ID NO: 54229 - RNA, 1314 nt, Artificial Sequence
  derived and/or modified sequence opt11 from REGN2810_HeavyChain1
gaaguacaacuccuagaauccggaggcguccuugugcaacccggcggaagccuacgccucuccugcgcugccuccggcuucaccuucucaaacuucggcaccuggguccgccaagcucccggcaaaggacuugaaugggucuccggcauaucaggaggcggacgcgacaccuacuucgccgacuccgucaaaggcagauucaccaucucccgcgacaacuccaaaaacacucucuaccuccagaacucacucaaaggcgaagacacggccgucuacuacugcguuaaguggggcaacaucuacuucgacuacuggggacagggaacccucguaacagucuccagcgcaucgaccaaaggacccuccgucuucccacuugcacccugcuccagauccaccuccgaaagcacagccgcucuuggcugccuagucaaagacuacuucccagaacccgucacaguauccuggaacuccggcgcacucaccucaggaguccacaccuucccagccguccuccaaucuuccggacuauacucacuaucauccgucguaaccgugcccucauccucccuaggcaccaaaaccuacacaugcaacguagaccacaaaccaagcaauaccaaaguagacaaacgagucgaauccaaauacggcccacccugcccucccugccccgcacccgaguuccuaggcggacccucagucuuccucuucccacccaaacccaaagacacccuuaucucucgcacccccgaaguaaccugcgucgucgucgacgucucgcaggaagaccccgaaguccaauucaacugguacgucgacggcguagaaguccacaacgccaaaaccaaaccccgcgaagaacaauucaacuccacauaccgcgucgucucaguacugaccgucuuacaccaagacuggcucaacggaaaagaauacaaaugcaaagucuccaacaaaggccuacccuccucaauagagaaaaccaucucaaaagccaaaggccaaccccgugaaccccaaguauacacccuaccacccucccaagaagaaaccaaaaaccaaguaucccuaaccugccucgucaaaggcuucuaccccuccgacaucgccgucgaaugggaaucaaacggucaacccgagaacaacuacaaaaccacucccccaguccucgacuccgacggaucauucuuccuauacucacgacucaccguagacaaguccagauggcaagaaggcaacgucuuuucaugcagcguccacgaagcccuacacaaccacuacacccaaaaaucccuuucacucucacucggc

SEQ ID NO: 54230 - RNA, 639 nt, Artificial Sequence
  derived and/or modified sequence opt11 from REGN2810_LightChain1
gacauucaaacccaaucacccuccucacuauccgccuccgucggcgacuccaucaccaucacaugccgcgccucccucuccaucaacaccuuccucaacugguaccaacaaaaacccggcaaagcacccaaccuccucauauacgccgcaucaucacuccacggcggcgucccaucccgcuucuccggcucaggcucaggcacagacuuuacccucaccauccgcacccuccaacccgaagacuucgccaccuacuacugccaacaauccuccaacacaccauucaccuucggccccggaaccgucgucgacuuccgccgcaccgucgcagcccccucagucuucaucuucccacccuccgacgaacaacucaaauccggcaccgccuccgucguaugccuacucaacaacuucuacccccgcgaagccaaaguccaauggaaaguagacaacgcccuccaaucaggaaacucacaagaauccguaaccgaacaagacuccaaagacuccaccuacucccucuccuccacccucacacucuccaaagccgacuacgaaaaacacaaagucuacgccugcgaagucacccaccaaggccucuccucccccgucaccaaauccuucaaccgcggcgaaugc

SEQ ID NO: 54231 - RNA, 651 nt, Artificial Sequence
  derived and/or modified sequence opt11 from rhuMab_HER2(9CI)_LightChain
guccacuccgacauccaaaugacccaaucccccuccucucucucugccucagucggcgaccgcgucaccaucacaugcaaagccucacaagacgucuccaucggcguagccugguaccaacaaaaacccggcaaagcccccaaacuccucaucuacuccgccuccuaccgcuacaccggcguccccucccgauucuccggcucaggcucaggcaccgacuucacccucaccaucuccucccuccaacccgaagacuucgccaccuacuacugccagcaauacuacaucuaccccuacaccuucggccaaggcaccaaagucgaaaucaaacgaaccgucgcagcacccuccgucuucaucuucccacccuccgacgaacaacucaaauccggcaccgccuccgucguuugccuacuaaacaacuucuacccccgcgaagccaaaguccaauggaaagucgacaacgcccuccaauccggcaacucccaagaauccgucaccgaacaagacuccaaagacucaaccuacucacucuccucuacccucacccucuccaaagccgacuacgaaaaacacaaagucuacgccugcgaagucacccaccaaggacuuuccucacccguaaccaaauccuucaaccgcggcgaaugc

SEQ ID NO: 54232 - RNA, 1215 nt, Artificial Sequence
  derived and/or modified sequence opt11 from rhuMab_HER2_HeavyChain
gaaguccaacuugucgaauccggcggcggccucguacaacccgguggaucacuccgccucucaugcgccgccucaggauucaccuucacagacuacacaauggacuggguccgccaagcccccggcaaaggacuaacagccgucuacuacugcgcccguaaccuuggccccucauucuacuucgauuacuggggccaaggcacacucguaaccguaucauccgcaagcaccaaaggccccucgguauucccccucgcccccucaucaaaauccaccucaggcggaacagcugcccucggcugccuaguuaaagacuacuuccccgaacccgucaccgucuccuggaacucuggcgcacucaccuccggcguccacacauuccccgccguccuacaauccucaggccucuacucccugucaucagucgucaccguccccuccagcucccuaggcacccaaaccuacaucugcaacgucaaccacaaacccagcaacaccaaaguagacaagaaagucgagcccaaauccugcgacaaaacucacacaugcccacccugccccgcacccgaacuucuaggcggcccauccgucuuccuuuucccuccaaaacccaaagacacccugaugaucucccgcacacccgaagucacaugcguaguagucgacgucucacacgaagaccccgaagucaaauucaacugguacgucgacggcgucgaaguccacaacgcaaaaaccaaaccccgcgaggaacaguacaacuccacauaccgcgucgucuccguacucacaguccuccaccaagacuggcucaacggcaaagaauacaaaugcaaagucucaaauaaagcccuccccgcucccauugagaaaaccauauccaaagccaaaggccaaccccgcgaaccccaagucuacacccuacccccaucccgagaagaaaugaccaaaaaucaagucucccuaaccugccucgucaaaggcuucuacccauccgacaucgccgucgaaugggaauccaacggacaacccgaaaacaacuacaaaaccacaccacccguacucgacuccgacggaucauucuuccucuacucaaaacuaaccguagacaaaucccgauggcaacaaggcaacguauucaguugcuccgucaugcacgaagcccuccacaaccacuacacccaaaaaucacugucccucucccccggccccaaa

SEQ ID NO: 54233 - RNA, 645 nt, Artificial Sequence
  derived and/or modified sequence opt11 from rhuMab_HER2_LightChain
uccgacauccaaaugacccaaucccccuccagccucuccgccuccgucggcgaccgcgucaccaucaccugccgcgcaucacaagacgucaacaccgccgucgcuugguaccaacaaaaacccggcaaagcccccaaacuccucaucuacuccgcauccuuccuauacuccggaguccccucccgcuucucaggcucccguucuggaaccgacuucacccucaccaucuccucgcuccaacccgaagacuucgccaccuacuacugccaacaacacuacaccaccccacccaccuucggccaaggaaccaaagucgaaaucaaacgcaccgucgccgcccccuccgucuucaucuucccccccuccgacgaacaacucaaauccggcacagccuccgucgucugccuccucaacaacuucuacccccgcgaagccaaaguccaauggaaaguagacaacgcccuccaauccggaaacucccaagaauccgucaccgaacaagacuccaaagacuccaccuacucccucuccucaacacucacccuaucuaaagccgacuacgaaaaacacaaagucuacgccugcgaaguaacacaccaaggccucuccucacccguaacaaaauccuucaaccgcggcgaaugc

SEQ ID NO: 54234 - RNA, 318 nt, Artificial Sequence
  derived and/or modified sequence opt11 from rhuMab_HER2_LightChain_variant1
accgucgccgcccccuccgucuucaucuucccccccuccgacgaacaacucaaauccggcaccgccuccgucgucugccuccucaacaacuucuacccccgcgaagccaaaguccaauggaaagucgacaacgcccuccaauccggcaacucccaagaauccgucaccgaacaagacuccaaagacuccaccuacucccucuccuccacccucacccucucuaaagccgacuacgaaaaacacaaagucuacgccugcgaagucacccaccaaggccucuccucccccgucaccaaauccuucaaccgcggcgaaugc

SEQ ID NO: 54235 - RNA, 642 nt, Artificial Sequence
  derived and/or modified sequence opt11 from rhuMab_HER2_LightChain_variant2
gauauccaaaugacccaaucccccucaucccucagcgccuccgucggcgaccgcgucaccaucacaugccgcgccucacaagacguaaacaccgccgucgcaugguaucaacaaaaacccggaaaagcccccaaacuccucaucuacucagccucuuuccucuacuccggaguccccucccgcuucuccggcucacgcucaggcaccgacuucacccuaaccaucucuucccuccaacccgaagacuucgccaccuacuacugccaacaacacuacaccaccccacccaccuucggacaaggaaccaaagucgaaaucaaacgaaccugcgccgcacccuccgucuucaucuucccacccuccgacgaacaacucaaauccggcaccgccucagucguaugccuucucaacaacuucuacccccgcgaagccaaaguacaauggaaagucgacaacgcccuccaauccggcaacucccaagaauccgucaccgaacaagacuccaaagacuccaccuacucccucuccucaacccuaacccucuccaaagccgacuacgaaaaacacaaagucuacgcaugcgaagucacccaccaaggccucucaucccccgucaccaaauccuucaaccgcggcgaaugc

SEQ ID NO: 54236 - RNA, 642 nt, Artificial Sequence
  derived and/or modified sequence opt11 from rhuMab_HER2_LightChain_variant3
gacauccaaaugacccaaucacccuccucucucuccgcauccguaggcgaccguguaaccaucaccugccgcgccucccaagacgucaacaccgccgucgccugguaccaacaaaaacccggcaaagcccccaaacuccuaaucuacuccgccuccuuccuauacuccggcguccccucccgcuucuccggcucccgcuccggcaccgacuucacccucaccaucuccucccuccaacccgaagacuucgccaccuacuacugccaacaacacuacaccaccccacccaccuucggccaaggcaccaaagucgaaaucaaacgcacagucgccgcccccuccguauucaucuucccccccuccgacgaacaacuaaaauccggcaccgccuccgucguaugccuacucaauaacuucuacccccgcgaagccaaaguccaauggaaagucgacaacgcccuccaaucaggcaacucccaagaauccgucaccgaacaagacucaaaagacucaaccuacucccuauccuccacccucacccucuccaaagcagacuacgaaaaacacaaagucuacgcaugcgaagucacccaccaaggccucagcucccccgucaccaaauccuucaaccgcggcgaaugc

SEQ ID NO: 54237 - RNA, 645 nt, Artificial Sequence
  derived and/or modified sequence opt11 from rhuMab_HER2_LightChain_variant4
uccgacauccaaaugacccaaucccccucaucccucuccgccuccgucggcgaccgcguaaccaucacaugccgcgccucccaagacgucaacaccgccgucgccugguaccaacaaaaacccggcaaagcccccaaacuccucaucuacuccgccuccuuccucuacuccggcguccccucccgauucuccggcucccgcucaggaaccgacuucacccuaaccaucuccucccuccaacccgaagacuucgccacauacuacugccaacaacacuacacaaccccacccaccuucggucaaggcaccaaagucgaaaucaaacgcacagucgcagcccccuccgucuucaucuucccacccuccgacgaacaacucaaauccggcacugcauccgucgucugccuccuaaacaacuucuacccccgcgaagccaaaguccaauggaaagucgacaacgcccuccaauccggcaacucccaagaauccgucaccgaacaagacuccaaagacuccaccuacucccucuccuccacccucacccucuccaaagccgacuacgaaaaacauaaaguauacgccugcgaagucacacaccaaggccucagcucccccguaacuaaauccuucaaccgcggcgaaugc

SEQ ID NO: 54238 - RNA, 321 nt, Artificial Sequence
  derived and/or modified sequence opt11 from rhuMab_HER2_LightChain_V-Region
gacauccaaaugacccaaucccccucaucccucuccgccuccguaggcgaccgcgucaccaucaccugccgcgccucccaagacgucaacaccgccgucgccugguaccaacaaaaacccggcaaagcccccaaacuccucaucuacuccgccuccuuccucuacuccggcguccccucccgcuucuccggcucccgcuccggcaccgacuucacccucaccaucuccucccuccaacccgaagacuucgccaccuacuacugccaacaacacuacaccaccccccccaccuucggccaaggcaccaaagucgaaaucaaa

SEQ ID NO: 54239 - RNA, 1350 nt, Artificial Sequence
  derived and/or modified sequence opt11 from rhuMab_HER2_gamma1-Chain
gaaguacaacucgucgaaucgggcggcggccucguacaaccaggaggcucacuucggcucuccugcgccgcauccggauucaacauaaaagacaccuacauccacuggguccgacaagcccccggcaaaggccucgagugggucgcacgaauauaccccaccaacggauacacccgcuacgccgacuccgucaaaggccgcuucacaauaucagccgauacauccaaaaacaccgccuaccuccaaaugaacucacuacgcgccgaagacacagcaguauacuacugcucacgcuggggcggcgacggcuucuacgccauggacuacuggggccaagguacccucguaacagucucauccgccagcacaaaagggcccucugucuucccacuagcacccuccuccaaaucuacauccggcggcacagccgcccucggcugccuagucaaagacuacuuccccgaaccaguaacagucuccuggaacucgggcgcacuuaccucaggcguacacaccuuccccgccguacuccaaucaagcggccucuacucgcuauccuccguagucaccguccccagcagcagccucggcacccaaaccuacaucugcaacgucaaccacaaacccuccaacaccaaagucgacaagaaagucgaacccaaaagcugcgacaaaacccacacaugcccaccgugccccgcacccgaacuacucggaggacccuccguauuccucuucccacccaaacccaaagacacccucaugauaucaagaacccccgaaguuaccugcgucgucgucgacguaucccacgaagacccagaagucaaauucaacugguauguagacggcguagaaguccacaacgccaaaaccaagcccagagaagaacaauacaacucaaccuaccgcgucgucucaguacuuaccguccuccaccaagacuggcucaacggaaaagaauauaaaugcaaagugucaaacaaggcacugcccgcccccaucgaaaagaccaucagcaaagccaaaggacaaccacgagaaccccaagucuacacacuuccacccucccgagaggagaugaccaaaaaccaagucucccuaaccugccuagucaaaggcuucuaccccucugacaucgccgucgaaugggaaaguaacggccaacccgaaaacaacuacaaaaccacacccccaguacuagacuccgauggauccuucuuucuauacuccaaacuaacagucgacaagucacgcuggcaacaagggaacgucuucucuugcucaguaaugcacgaagcacuccacaaccacuacacacaaaaaucacucucccuaagccccggcaaa

SEQ ID NO: 54240 - RNA, 1350 nt, Artificial Sequence
  derived and/or modified sequence opt11 from rhuMab_HER2__gamma1-Chain
gaaguccaacucgucgaguccggaggaggacucguacaacccggcggaucacuccgccucuccugcgccgccuccggauucaacaucaaagacaccuacauccacuggguccgccaagcccccggcaaaggccuagaauggguagcccguaucuaccccacaaacggguacacccgcuaugcagacagcgucaagggccgcuucaccauuucagccgacacaagcaagaacaccgccuaccuccaaaugaacucuuuacgcgccgaagacacagccgucuacuacugcucacgcuggggcggagacggcuucuacgccauggacuacuggggccaaggcacccucgucaccgucucaucaugcucuaccaaaggaccauccgucuucccccucgcccccucguccaaaagcacaucuggcggcaccgccgcccucggcugccuagucaaagacuacuucccagaacccgucacaguauccuggaacagcggcgcccuuaccuccggcguccacaccuuccccgccguacuacaaagcucgggccucuacagccuaucauccguagucacaguaccauccucauccuuaggcacccaaacauacaucugcaacgucaaccacaagccauccaacaccaaagucgacaagaaaguagaacccaaauccugcgacaaaacacacaccuguccacccugccccgcccccgagcuacucggcggccccuccgucuuccuauucccacccaaacccaaagacacccuaaugaucucccgaacccccgaaguaaccugugucgucgucgaugucucacacgaggaccccgaaguuaaauucaacugguacgucgacggagucgagguacacaaugcuaaaaccaaaccccgcgaagaacaguacaacuccacauaccgcgucgucuccguccucaccguacuacaucaagacuggcucaacggaaaagaauacaaaugcaaagucuccaauaaagcccucccagcccccaucgagaaaacaaucuccaaagccaaaggccaaccacgagaaccacaagucuauacgcucccaccaucccgagaagaaaugaccaaaaaccaaguaucccucacaugccucguaaaaggcuucuacccauccgauauagccgucgaaugggaauccaacggccaaccggaaaacaacuacaaaaccaccccucccguauuagacuccgacggcagcuucuuccucuacuccaaacucaccguagacaaaucccgcuggcaacaaggaaacgucuucuccugcucaguuaugcacgaggcccuccacaaccacuacacacaaaagucacucagccuuucccccggcaaa

SEQ ID NO: 54241 - RNA, 729 nt, Artificial Sequence
  derived and/or modified sequence opt11 from rhuMab_HER2_gamma1-Chain__rhuMab_HER2_LightChain_sc4D5
gaagugcaauuggucgagagcggaggcgggcucgugcaaccaggcgggagucugcgccugagcugugccgcgagcggcuucaauaucaaggacacauacauacacugggucaggcaagcacccgggaaaggacuagaguggguggcaaggaucuauccaacgaacggguacacgcgauaugccgacagcgugaaagggcgcuucaccauaagcgcggacacgagcaagaacacggccuaucuccagaugaauagccugcgcgcggaagauaccgcggucuauuacuguagcagauggggcggggacggcuuuuacgcgauggauuacuggggccaaggcacgcuagugaccgugagcucgggcggaggcgggagcgggggcgggggcucgggcggaggcggaagcgauauccagaugacgcaaucaccaucgagcuugagcgcgagcgugggcgaucgcgugaccauaaccugucgagcaagccaggacgugaacacggccguggcaugguaccagcaaaagcccgggaaagcgcccaagcucuuaaucuauagcgcgagcuuccucuacagcggggucccaagcagguucucgggcucgcgcucgggaacagacuuuacccuaaccaucagcucacuccagcccgaggacuuugccacguacuauugccagcaacauuacacaacaccgcccacguucgggcaagggaccaaggucgagaucaagcgc

SEQ ID NO: 54242 - RNA, 1350 nt, Artificial Sequence
  derived and/or modified sequence opt11 from rhuMab_HER2_gamma1-Chain_variant1
gaaguacaacucgucgaaucagguggcggccuaguccaaccugguggcucacuccgacuaagcugcgccgccuccggcuucaacaucaaagacacuuacauccacuggguacgacaagcacccggaaaaggccuagaauggguagccagaaucuaccccaccaacggcuacacuagauacgccgacuccguaaaaggccgcuucaccaucucagccgacaccagcaaaaauaccgccuaccuacaaaugaacucccugcgcgcugaagacaccgcgguauacuacugcucccgauggggcggagacggcuucuacgccauggacuacuggggacaaggaacccucguaaccguauccuccgccuccaccaaaggacccuccgucuucccacucgcacccucaucaaaauccaccagcggcggcaccgcugcccuaggaugccucgucaaagacuacuuccccgagcccguuacagucuccuggaacagcggcgcacuaaccagcggcguacacacauuccccgcaguccuacaaucauccggccucuacucacucuccuccgucgucaccguccccuccucaucccucggcacccaaacauacaucugcaacgucaaccacaaacccucaaacaccaaaguagacaagaaagucgaaccaaaaucaugcgacaaaacccacacaugcccacccugcccagcucccgaacuccucggcggccccuccguauuccucuucccaccaaaacccaaagauacccucaugaucucccgcaccccugaaguaaccugcgucgucguagacguaucgcacgaagaccccgaagucaaauucaacugguacgucgacggagucgagguacacaacgccaaaaccaaaccuagagaagaacaauacaacagcaccuaccgcgucgucuccguccucacaguccuucaccaagacuggcucaacggcaaagaauacaaaugcaaaguuucuaacaaagcccucccggcccccauagagaaaacuauauccaaagccaaaggccaaccacgcgaaccccaagucuauacccuacccccaucccgcgaagaaaugaccaaaaaccaagucucccuaaccugccucguaaaagguuucuaccccuccgacaucgccguggaaugggaaucaaacgggcaacccgaaaacaacuacaaaaccaccccacccgugcuagacuccgacggaucauucuuccuauacucaaaacuuaccgucgacaaaucccgcuggcaacaaggcaacgucuucuccugcuccgucaugcacgaagcccuccacaaccacuacacucaaaagagucuaucccucagccccggaaaa

SEQ ID NO: 54243 - RNA, 1350 nt, Artificial Sequence
  derived and/or modified sequence opt11 from rhuMab_HER2_gamma1-Chain_variant2
gaaguccaacucgucgaauccggcgguggccuaguucaacccggcggcucccuccgccucuccugcgccgcauccggcuucaacaucaaagacaccuacauccacuggguccgacaagcccccggaaaaggccuagaaugggucgcacgcauauaccccacaaacggcuacacccgcuacgccgacuccgucaaaggcagauucaccauuuccgcagacaccuccaaaaacaccgccuaccuccaaaugaacucucuccgcgcugaagacaccgccgucuacuacuguucccgauggggcggcgacggauucuaugccauggacuacuggggccaaggcacacucgucacaguauccucaugcuccaccaaaggccccagcgucuucccccucgcccccuccaguaaaagcaccuccgguggaaccgccgcacuaggaugccuggucaaagacuacuuccccgaacccguaaccguaagcuggaacucaggcgcccucacauccggcguccacaccuuccccgccguccuccaaucaucgggccuuuacucacugucaucagucgucaccguccccucauccucccucggaacgcaaacguacaucugcaaugucaaccacaaacccuccaacacaaaagucgacaagaaaguagaaccaaaaagcugcgacaaaacccacacaugcccacccuguccagcccccgaacuccucggcggccccuccgucuuccucuuucccccaaaacccaaagacacccucaugaucucccgcaccccagaaguaaccugcgucgucgucgacgucucucacgaagacccagaagucaaauucaauugguaugucgacggcguagaaguccacaacgccaaaaccaaaccccgagaagaacaauacaacuccacauaccgcgucguauccguccuaaccguccuucaccaagacuggcucaacggcaaagaauacaaaugcaaaguauccaacaaggcccuccccgccccgaucgagaaaaccauaucaaaagccaaaggacaaccgagagaaccucaaguauacacacuaccacccagccgagaagaaaugaccaaaaaccaagucucccuuacaugccucgucaaaggcuucuaccccuccgacaucgccgucgaaugggaauccaacggccaacccgaaaacaacuacaaaacaacaccacccguccucgacucagacggcucauucuuccucuacuccaaauuaacagucgacaaaucacgcuggcaacaaggaaacgucuucuccugcuccgucaugcacgaagcccuccacaaccacuacacucaaaaaucccucagccugagccccggcaaa

SEQ ID NO: 54244 - RNA, 1350 nt, Artificial Sequence
  derived and/or modified sequence opt11 from rhuMab_HER2_gamma1-Chain_variant3
gaaguccaacucguugaaucaggcggaggccuaguccaaccaggaggcucacuccgacucuccugcgccgccucaggcuucaacaucaaagacaccuacauccacuggguacgccaagcucccggcaaaggccuggaaugggucgcccgaaucuaucccacaaacggcuacacccgcuacgccgacuccgucaaaggccgauucacaaucuccgcagacacaagcaaaaacaccgccuaccuccaaaugaacucacuccgaugcgaagacacagccgucuacuacugcucucgcugggguggagacggauucuacgccauggauuacuggggccaaggcacccucgucaccguaucauccgcuagcaccaagggccccucagucuuuccacuugccccgucaucaaaauccacaucaggcggaacagcagcccucggcugccucgucaaagacuacuucccugaacccgucaccgucuccuggaacuccggcgcccucaccucuggcguacacaccuuuccagcaguacuccaaucauccggccucuacucccuauccucagucgucacaguccccuccucaucccuuggaacccaaacauacaucugcaacgucaaccacaaaccuuccaacaccaaaguagacaagaaaguagaacccaaauccugcgacaaaacccauaccugcccacccugccccgcucccgaacuacucggcggccccuccguauuccuauuuccacccaaaccgaaagacacccuaaugaucucaagaacccccgaaguuaccugcgucguugucgacgucucccacgaagaccccgaagucaaauucaacugguacgucgacggcgucgaaguccacaacgccaaaacaaaaccacgcgaagaacaauacaacuccaccuaccgaguaguuuccguccuuaccguccuccaccaagacuggcucaacggcaaagaauacaaaugcaaagucuccaacaaagcucucccagccccaaucgagaaaacaauauccaaggccaaaggccaaccccgcgaaccacaaguuuacacacucccgcccucccgcgaagaaaugaccaaaaaccaaguuucgcuaaccugccuugucaaaggcuucuaccccagcgacaucgccgucgaaugggaauccaacggccaaccagaaaacaacuacaagaccaccccacccguccuagacagcgacggcuccuucuuccuauacuccaaacucaccguagacaaaucacgauggcaacaaggcaacguauuuucaugcucggucaugcacgaagcccuacacaaccacuacacacagaaaagccucucccuauccccaggaaaa

SEQ ID NO: 54245 - RNA, 360 nt, Artificial Sequence
  derived and/or modified sequence opt11 from rhuMab_HER2_gamma1-Chain_V-Region
gaagugcaauuggucgagagcgggggcgggcuagugcaaccgggcgggagcuugcgauugagcugugccgcgagcggguucaauaucaaggacacguacauacacugggucaggcaagcgcccgggaaagggcucgaguggguggccaggaucuaucccacgaacggguacacgcgcuaugccgauagcgugaaagggcgcuuuaccauaagcgcggacacgagcaagaacacggccuaucuccagaugaauagcuugcgcgcggaagauaccgcggucuauuacuguucgagguggggcggggauggcuuuuacgcgauggauuacuggggccagggcacgcucgugaccgugagcagc

SEQ ID NO: 54246 - RNA, 1359 nt, Artificial Sequence
  derived and/or modified sequence opt11 from rhuMAb-VEGF_HeavyChain1
gaaguccagcucgucgaauccggaggaggacucguccaacccggaggcucucuucgccuaagcugcgccgccucaggcuacacauucacuaacuacggaaugaacuggguccgacaagcccccggcaaaggccucgagugggucggcuggauaaacaccuacaccggcgaacccaccuacgccgcugacuucaaacgccgauucacuuucucucuagacacaucaaaguccaccgccuaccuccaaaugaacucacuccgcgccgaagacacagcagucuacuauugcgccaaauacccccacuacuacggcuccucccacugguacuucgaugucuggggccaaggcacacucgucaccgucagcucagcauccaccaaaggccccuccguguucccccucgcccccucauccaaaucaaccuccggaggcaccgccgcccucggcugccucgucaaagacuacuuccccgaaccagucacaguauccuggaacucgggcgccuugacauccggcguacacaccuuccccgccguccuucagucaucaggacuauacucacuuuccuccguaguaaccgucccauccucauccuuaggcacccaaaccuacaucugcaaugucaaccacaaacccagcaacaccaaaguagacaagaaagucgaacccaaauccugcgacaaaacgcacacaugcccacccugccccgccccagaacuucuaggcggccccuccgucuuccucuucccaccaaaacccaaagacacccuaaugauaucccgaaccccagaaguaaccugcgucgucgucgacgucagccacgaagacccagaaguaaaauucaacugguacgucgacggagucgaaguccacaacgccaaaacaaaaccccgagaagaacaauacaacucgaccuaccgcguagucucaguccuaacaguccuacaccaagacuggcucaacggcaaagaauacaaaugcaaggucuccaacaaagcacuccccgcaccaaucgagaaaaccaucucaaaagcaaaaggccaaccccgcgaaccccaagucuauacccuacccccuucacgcgaagaaaugaccaaaaaccaagucagccuaaccugccucguaaagggcuuuuaccccuccgacaucgccguagaaugggaaucaaacggccaacccgaaaacaacuacaagaccacaccucccguccucgacucagacggauccuucuuccucuacucaaaacucaccguagacaaaagccgcuggcagcaagguaacgucuucagcugcagcgucaugcacgaagcccuccacaaccacuauacacaaaaaucacucucccucucacccggcaaa

SEQ ID NO: 54247 - RNA, 642 nt, Artificial Sequence
  derived and/or modified sequence opt11 from rhuMAb-VEGF_LightChain1
gacauccaaaugacccaaucacccuccucccucucagccuccgucggcgaccgcgucaccaucacaugcuccgcaucccaagacaucuccaacuaccuaaacugguaccaacaaaaacccggcaaagcccccaaaguccuaaucuacuucaccuccucccuccacuccggcgucccaucacgcuucuccggcucaggcucuggcaccgacuucacccucaccaucucuucccuccaacccgaagacuucgccaccuacuacugccaacaauacuccacaguccccuggaccuucggccaaggcaccaaagucgaaaucaaacgcaccgucgccgcccccuccgucuucaucuucccacccuccgacgaacaacucaaauccggcaccgccucugucgucugccuccucaacaacuucuacccccgagaagccaaaguccaauggaaagucgacaaugcccuccaauccggcaacucccaagaauccguuaccgaacaagacuccaaagacuccaccuacucccucucuuccacccuuacccucuccaaagccgacuacgaaaaacacaaagucuacgccugcgaagucacccaccaaggccucuccucccccguaaccaaauccuucaaccgcggcgagugc

SEQ ID NO: 54248 - RNA, 642 nt, Artificial Sequence
  derived and/or modified sequence opt11 from rhuMAb-VEGF_LightChain
gacauccaaaugacccaaucccccuccucccucuccgccuccguaggugaccgcgucaccauaaccugcucagccucccaagacaucagcaacuaccuaaacugguaccaacaaaaacccggcaaagcccccaaaguccuaaucuacuucaccuccucacuacacuccggcguccccuccagauucuccggauccggcuccggcaccgacuucacccuaaccaucuccucacuccaacccgaagacuucgccacauacuacugccaacaauacuccaccguccccuggaccuucggccaaggcaccaaagucgaaaucaaacgcacagucgccgcccccuccgucuucaucuucccacccuccgacgaacaacucaaauccggcaccgcauccgucgucugccuacucaacaacuucuacccccgcgaagccaaaguccaauggaaagucgacaacgcccuccaaucaggcaacucccaagaauccgucaccgaacaagacuccaaagacuccaccuacucccucuccuccacccucacccucuccaaagcagacuacgaaaaacacaaagucuacgccugcgaagucacccaccaaggccucuccucacccgucaccaaauccuucaaccgcggcgaaugc

SEQ ID NO: 54249 - RNA, 321 nt, Artificial Sequence; identical to SEQ ID NO: 53589
  derived and/or modified sequence opt11 from rhuMAb-VEGF_LightChain__VG-Region

SEQ ID NO: 54250 - RNA, 1359 nt, Artificial Sequence
  derived and/or modified sequence opt11 from rhuMAb-VEGF_gamma1-Chain
gaaguccaacucgucgaauccggcggcggacucguccaacccggcggcucccucagacucagcugcgcagccucaggauacaccuucaccaacuacggcaugaacuggguacgacaagcccccggcaaaggacucgaaugggucggauggaucaacaccuacaccggcgaacccaccuacgccgcagacuucaaacgccgauucaccuuuucccuugauaccucuaaauccaccgccuaucuccaaaugaacucccuccgcgcugaagacacagcagucuacuacugcgcaaaauacccccacuacuacggcuccucccacugguacuucgacgucuggggacaaggcacccuuguaacaguaucauccgccucaacaaaaggccccuccgucuucccccucgcccccucaucaaaaucaaccucaggaggcaccgccgcccucggaugccucguaaaagacuacuucccagaaccaguaaccgucuccuggaacaguggcgcccucacauccggcguccacaccuuccccgccguacuccaaagcuccggccuauacucccuuuccucagucgucaccgucccuucuuccucacuuggcacccaaacauacaucugcaacgucaaccacaaacccagcaacacaaagguagacaagaaagucgagccaaaauccugcgacaaaacccacaccuguccacccugccccgcaccugagcuccucggcggcccaucaguauuccucuucccacccaaacccaaagauacacucaugaucucccgaacccccgaaguaaccugcgucgucguagauguuucccacgaagaccccgaagucaaauuuaacugguacguagacggcgucgaaguacacaaugcaaaaaccaaaccccgcgaagaacaauacaacucaaccuaccgaguagucucuguacucaccguccuacaccaagacuggcuuaacggcaaagaauacaaaugcaaagucuccaacaaagcccuccccgcccccaucgagaaaaccaucagcaaagcaaaaggccaaccccgagaaccccaaguauacacccuacccccaucacgcgaagaaaugaccaaaaaccaagucucccuaacaugccuagucaaaggcuucuaccccuccgacaucgcagucgaaugggaaucaaacggacaacccgaaaacaacuacaaaacaacaccacccguccucgacagcgacggguccuucuuccuuuacuccaaacuuaccguagacaaaucccgauggcaacaaggaaacgucuucucgugcucggucaugcacgaggcccuacacaaccacuacacccagaaaagucucucacucucacccggaaaa

SEQ ID NO: 54251 - RNA, 369 nt, Artificial Sequence
  derived and/or modified sequence opt11 from rhuMAb-VEGF_gamma1-Chain_VDG-Region
gaaguccaacucgucgaaucaggcggcggccucguccaacccggcggcucccuccgccucuccugcgccgccuccggcuacaccuucaccaacuacggcaugaacuggguccgccaagcccccggcaaaggccucgaaugggucggcuggaucaacaccuacaccggcgaacccaccuacgccgccgacuucaaacgacgcuucaccuucucacucgacaccuccaaauccaccgccuaccuccaaaugaacucccuccgcgccgaagacaccgccgucuacuacugcgccaaauacccccacuacuacggcuccucccacugguacuucgacguauggggccaaggcacccucgucaccgucuccuca

SEQ ID NO: 54252 - RNA, 1338 nt, Artificial Sequence
  derived and/or modified sequence opt11 from Rilotumumab_HeavyChain1
caaguccaacuccaagaauccggacccggccucgucaaacccuccgaaacccucagccuaaccugcacugucuccggcggcuccaucucgaucuacuacuggucauggauaagacaaccucccggcaaaggacuagaauggaucggcuacgucuacuacucaggcuccaccaacuacaaccccucacuaaaaucccgcgucaccauauccgucgauaccuccaaaaaccaauucucacucaaacucaauuccguaaccgccgccgacaccgccguauacuacugcgcccguggaggcuacgacuucugguccggcuacuucgacuacuggggccaaggaacccuaguaacagucucauccgccuccaccaaaggccccuccguauucccccuagcccccugcagccgauccaccuccgaaucaacugccgcccucggcugccucguaaaagauuacuuccccgaacccguaacagucagcuggaacucaggcgcccuaaccagcggcguccacaccuuccccgcaguccuccaaucauccggccucuacucacucuccuccguagucaccguccccucuuccaacuuugggacccaaaccuauaccugcaacgucgaccacaaacccuccaacacuaaagucgacaaaacgguagaacgcaaaugcugcgucgaaugucccccaugccccgcacccccaguggccggacccuccgucuuccucuucccacccaaaccaaaagacacacucaugaucucucgcacccccgagguaaccugcgucgucgucgacgucucccacgaagacccagagguccaguucaacugguacgucgacggcgucgaaguccacaacgccaagaccaaaccccgcgaagaacaauucaacagcacauuucgugucgucucaguccucacagucguccaucaagacuggcucaacggcaaagaauacaaauguaaaguaucaaacaaaggccuaccagcccccauagagaaaaccaucagcaaaaccaaaggccagccccgcgagccgcaagucuacacccucccacccucucgagaggaaaugaccaaaaaccaagucucacuaaccugccucguaaaaggcuucuaccccuccgacaucgccgucgaaugggaauccaacggccaacccgagaacaacuacaaaaccaccccucccaugcuagauagcgacggcucauucuuccuuuauuccaaacugaccgucgacaaaucccgauggcaacaaggcaacgucuucucuugcuccgucaugcacgaagcccuccacaaucacuacacccaaaaaucccucucucucucccccggcaaa

SEQ ID NO: 54253 - RNA, 645 nt, Artificial Sequence
  derived and/or modified sequence opt11 from Rilotumumab_LightChain1
gaaaucguaaugacccaaucccccgccacccucucagucuccccaggagaacgagccacccucuccugccgcgccucacaauccgucgacuccaaccucgccugguaccgccaaaaacccggccaagccccccgccuccucaucuacggcgccagcacccgcgccacaggcauccccgcacgcuucuccggcuccggcuccggaaccgaauucacccucaccaucucaucccuccaaucagaagacuucgccgucuacuacugccaacaauacaucaacuggccccccaucaccuucggccaaggcacccgccuagaaaucaaacgcaccgucgccgcccccucagucuucaucuuccccccauccgacgaacaacucaaauccggcaccgccuccgucgucugccuccucaacaacuucuacccccgcgaagccaaaguacaauggaaagucgacaacgcacuccaauccggcaacucccaagaauccgucaccgaacaagacuccaaagacuccaccuacucccuaagcuccacccucacccucuccaaagccgacuacgaaaaacacaaagucuacgccugcgaagucacccaccaaggccucuccucccccgucacaaaaucauucaaccgcggcgaaugc

SEQ ID NO: 54254 - RNA, 1071 nt, Artificial Sequence
  derived and/or modified sequence opt11 from Rilotumumab_scFv-CH_chain
gaaguccagcuccuagaaucuggaggcggccuaguccaacccggcggcucccucagacuauccugcgccgcauccggcuucacauucucuuccuucucaauguccuggguccgccaagcccccggaaaaggccuagaaugggucucauccaucucuggcucauccggcacuacauacuacgccgacuccgucaaaggucgcuucaccaucucaagagacaacuccaaaaacacccucuaccuacaaaugaacucccugcgcgccgaagacaccgcaguauacuacugcgccaaaccguuccccuacuucgacuacuggggacaaggcacacucgucacaguauccagcggcgacggcuccucaggcggauccggcggcgccucagaaaucguccucacccagucccccggcacccuaucgcucucucccggcgaacgcgccacccucuccugcagagcaucccaaucaguauccuccuccuuccucgcaugguaccaacaaaaacccggccaagcaccccgccuccucauauacuacgccuccucaagagccaccggcauccccgaccgcuucucaggcuccgguagcgguaccgacuucacccucaccaucucccgacucgaaccagaagacuucgccgucuacuacugccaacaaaccggccgcauacccccaaccuucggacaaggaacaaaagucgaaaucaaguccgguggcuccggcggccccagagccgcaccagaagucuacgcguucgccacccccgaauggcccggcucccgagacaaacgcacacucgccugccuaauccaaaacuucaugcccgaagacaucuccguucaauggcuacacaacgaaguucaacuccccgacgcccgacacuccacaacacaaccacgcaaaaccaaaggcucaggcuucuucgucuucucccgccuagaagucacacgcgcagaaugggaacagaaagacgaauuuaucugccgcgccguccacgaagccgccucacccucccaaacaguccagcgagccgucuccguaaaucccgaauccuccagacgaggcggaugc

SEQ ID NO: 54255 - RNA, 1347 nt, Artificial Sequence
  derived and/or modified sequence opt11 from Rinucumab_HeavyChain1
caacuacaacuacaagaauccggccccggccucgucaaacccuccgaaacacucucccuaaccugcaccguguccggcggcuccaucaccuccucauccuacuauuggggcuggaucagacaaccacccgguaaaggccuagaauggauaggcuccaucuacuaccgcggaucaaccaacuacaaccccucccucaaaagcaggguaaccauaucagucgacuccuccaaaaaccaauucuaccuaaaaguaucuuccgucaccgccguagacacugccguauacuacugcgcccgccaaaacggcgccgcccgccccucaugguucgaccccuggggccaaggcacccucguuacagucuccuccgccucaaccaaaggccccuccgucuuuccccucgcccccugcucccgcuccacaagcgaguccacagccgcacucggaugccucguaaaagacuacuucccagaacccguaaccgucuccuggaacuccggcgccuuaacaucaggcguccacacauuucccgccguccuccaauccuccggacucuacuccuuaucguccguagucaccgucccaucaucuagccuaggcacaaaaacauauaccugcaacguugaccauaaacccuccaacacaaaaguagacaagcgagucgaaagcaaauacggaccacccugcccucccugccccgcucccgaguuccuaggcggacccucugucuuccucuucccacccaagcccaaagacacccucaugaucuccagaacacccgaaguuaccugcgucgucgucgacgucucccaagaagacccagaaguccaguucaacugguacgucgacggcguagaaguccacaacgccaagacaaaaccacgcgaggaacaauucaacuccaccuacagaguugucuccguccucacaguacuccaccaggacuggcuuaacggaaaagaauacaaaugcaaagucagcaacaaaggucuccccuccuccaucgagaaaacaauauccaaggccaaaggacaaccucgcgaaccccaagucuacacccucccacccucccaagaagaaaugaccaaaaaccaaguaucccucacaugccucgucaaaggauucuaccccucagacaucgcagucgaaugggaauccaacggccaacccgaaaacaacuacaaaaccaccccgcccguacuagacuccgacggcuccuucuuccucuauucccggcucaccguagacaaaagccgcuggcaagaaggaaacgucuucuccugcagcgucaugcaugaagcccuacacaaccacuacacacaaaaaucacucucacucucacuaggcaaa

SEQ ID NO: 54256 - RNA, 1344 nt, Artificial Sequence
  derived and/or modified sequence opt11 from Rinucumab_HeavyChain
caacuccaacuacaagaaucaggccccggccucgucaaacccucagaaacccucucgcucacauguaccguuuccggaggcucuaucacuagcucaagcuacuacuggggcuggauacgccaaccacccggcaaaggacucgaauggaucggaucaauauacuaccguggaagcacaaacuacaacccuucacucaaaucacgcguaaccaucucagucgacucauccaaaaaccaauucuaccucaaagucuccuccgucaccgccgucgauaccgccgucuacuacugugccagacaaaacggcgccgcccgccccucaugguucgacccauggggccaaggcacccucguaaccguuuccucagccagcacaaaaggccccuccgucuucccacucgcaccaugcucacgcuccaccuccgaaagcaccgccgcacuaggaugccucgucaaagacuacuuucccgaacccguaaccgucuccuggaacucuggugcacucaccuccgguguccacacuuuuccagccguccuccaguccuccggccuauacucccucuccuccgucguaaccguacccuccucaucccuaggcaccaaaacguauaccugcaacguagaucacaaacccuccaacaccaaagucgacaaacgcgucgaauccaaauacggaccacccugcccacccugccccgcccccgaauuucuaggcggccccuccgucuucuuauucccacccaaacccaaggacacacuaaugauaucccgcacccccgaagucacuugcgucgucgucgacgucucacaagaagaucccgaaguccaauucaacugguacguagauggcgucgaaguccacaacgccaaaaccaaacccagagaagaacaguucaacagcacauaccguguuguaucaguccucaccguccuacaccaagacuggcucaacgguaaagaauacaaaugcaaagucucuaacaaaggccugcccuccagcaucgaaaagacaaucuccaaagccaaaggccaaccccgcgaaccccaagucuacacacuaccacccucacaagaagaaaugacuaaaaaccaagucucacucacaugccuagucaaaggcuucuaccccucugacauagccgucgaaugggaaucaaauggucaacccgaaaauaacuacaaaaccaccccacccguacucgacuccgacggcuccuucuuccuauacucccgccucaccgucgacaaaucccguuggcaagaaggcaaugucuucuccugcucuguaaugcacgaagcccuccacaaccacuacacacaaaaaucacucucauuaucccuaggc

SEQ ID NO: 54257 - RNA, 645 nt, Artificial Sequence
  derived and/or modified sequence opt11 from Rinucumab_LightChain1
gaaaucguucucacccaaucccccgacaccaucucccucucacccggcgaacgagccacccucuccugccgcgccucccaauccaucuccuccaucuaccucgccugguaccaacaaaaacccggccaagcaccccgccuccucaucuacggcgccuccucccgagucaccggcauccccgaccgcuucucagucuccggcuccggaaccgacuucacccucaccaucucacgccucgaaccagaagacuucgccgucuacuacugccaacauuacggcaucucccccuucaccuucggccccggcaccaaagucgacauccgccgcaccgucgccgcccccuccgucuucaucuucccacccuccgacgaacaacucaaauccggcaccgccuccgucgucugccuccucaacaacuucuacccccgcgaagccaaaguccaauggaaagucgacaacgcccuccaauccggcaacucccaagaauccgucaccgaacaagacuccaaagacucaaccuacucccucuccucaacucucacacucuccaaagccgacuacgaaaaacacaaagucuacgccugcgaagucacccaccaaggccucucgucccccgucaccaaauccuucaaccgaggcgaaugc

SEQ ID NO: 54258 - RNA, 1347 nt, Artificial Sequence
  derived and/or modified sequence opt11 from Risankizumab_HeavyChain1
cagguacaacuaguccaaucaggcgcagaaguaaaaaaacccgguucaucagucaaagucucuuguaaagcaucaggcuacaccuucaccgaccaaaccauccauuggaugcgccaagccccaggccaaggccuagaauggauaggcuacauauacccccgcgacgacucccccaaauacaacgaaaacuucaaaggcaaagucaccaucaccgcagacaaauccacaucuaccgcguacauggaacucagcagcuuacggagcgaagacaccgccgucuacuacugcgccauccccgaccgcucaggcuacgccugguucaucuacuggggccaaggcacccucguaaccgucuccuccgccuccacuaaaggccccuccgucuucccacucgcccccuccucaaaaucgaccucaggaggcaccgccgcccuuggcugccucgucaaagacuacuuuccugaacccguaacaguauccuggaacagcggcgcccuaacauccggcguccacaccuuccccgccguccuccaaucauccggacucuauucacucuccucaguagucacuguuccuucaucuucucucggaacccaaaccuacaucugcaacguaaaccacaaaccaucaaacacaaaagucgacaaacgagucgaacccaaauccugcgacaaaacccacaccuguccccccugccccgcacccgaagccgccgggggccccucaguauuccucuucccccccaaaccaaaagacacacucaugaucucccgcacacccgaaguaaccugcgucguaguagacgucucccacgaagacccugaagucaaauucaacugguacguugacggcguagagguccacaaugccaaaaccaaaccccgagaagaacaauacaacuccacuuaccgcgucgucuccguacucaccguauuacaccaagacuggcuaaacggaaaagaauacaaaugcaaagucuccaacaaagcacuccccgcucccauagaaaaaaccauaucaaaagcaaaaggccaaccccgagaaccacaagucuacacacucccccccucccgcgaagaaaugaccaaaaaccaagucucccuuaccugccucgucaaaggcuucuacccauccgacauagccgucgaaugggaauccaauggccagcccgaaaacaacuauaaaacuacucccccaguccucgacucagacggguccuucuuccucuacagcaaacucaccguagacaaaucccgcuggcaacaaggcaacgucuucuccugcucagucaugcacgaagcccuccacaaccacuacacacaaaaaucccucucccucuccccaggc

SEQ ID NO: 54259 - RNA, 642 nt, Artificial Sequence
  derived and/or modified sequence opt11 from Risankizumab_LightChain1
gacauccaaaugacccaaucccccuccucccucuccgccucugucggcgaccgcguaaccauaacaugcaaagccucccgcgacguagccaucgccgucgccugguaccaacaaaaacccggcaaaguccccaaacuccucaucuacugggccuccacccgccacaccggaguccccucccguuucucaggcucaggcucccgcaccgacuucacccucaccaucuccucacuccaacccgaagacguagccgacuacuucugccaccaauacucaucauaccccuucaccuucggcuccggcaccaaacuagaaaucaaacgcaccgucgcagccccauccgucuucauauucccacccuccgacgaacaacucaaauccggcaccgccuccgucguaugccuccucaacaacuucuacccccgcgaagccaaaguccaauggaaagucgacaacgcccuccaauccggcaacucccaagaauccguaaccgaacaagacuccaaagacuccaccuacucccuauccuccacccucacccucuccaaagccgacuacgaaaaacacaaagucuacgcaugcgaagucacccaccaaggccuauccucccccgucaccaaauccuucaaccgcggcgaaugc

SEQ ID NO: 54260 - RNA, 1353 nt, Artificial Sequence
  derived and/or modified sequence opt11 from Rituximab_HeavyChain
caaguccaacuccaacaacccggcgcagaacucgucaaacccggcgcuucgguuaaaauguccugcaaagccagcggcuacaccuucacaucuuauaacaugcacugggucaaacaaacacccggcagaggacuagaauggaucggcgccaucuaccccggcaacggcgacacaucauacaaccaaaaauucaaaggcaaagccacccuaaccgcagacaaauccucauccacagccuacaugcaauuauccucccucaccuccgaagacagcgccguuuacuacugugcccgaucaaccuacuauggcggcgacugguacuucaacgucuggggagccggaaccacuguaaccgucuccgccgccuccaccaaaggacccucaguauucccacuggcccccucaucaaaaucaacaucaggcggcaccgcagcccuaggcugccuagucaaagacuacuuccccgaaccugucaccguaagcuggaacuccggcgcccuaacauccgguguccacaccuuccccgcaguccuacaaucauccggccucuacucccucuccucaguaguaaccguaccguccagcucgcucggcacccaaaccuacaucugcaacgucaaccacaaacccagcaacaccaaggucgacaagaaagucgaaccaaaauccugcgacaaaacccacaccugucccccuugcccagcaccagaacucuuaggaggcccuucagucuuccuauuuccacccaaacccaaagacacccucaugaucucccgcaccccagaagugaccugcgucgucguagacguuucacacgaagaccccgaaguaaaauucaacugguacgucgacggcgucgaaguccacaacgccaaaaccaaacccagagaagaacaauacaacucaacuuaccgagucgucuccguccucacaguccuacaucaagacuggcucaacggcaaagaauacaaaugcaaaguauccaacaaagcccuccccgcacccaucgagaaaaccaucucaaaagccaaaggccaaccacgcgaaccacaagucuacacacugccgcccucacgagacgaacuaaccaaaaaccaaguaucccuaaccugccucguaaaaggcuucuacccauccgacaucgccguugaaugggaauccaacggacaacccgaaaacaacuacaaaaccacaccacccguucuagacucugacggcuccuucuuccucuacagcaaacucacagucgacaaaagccgcuggcaacaaggcaacguuuucucuugcuccguaaugcacgaagcacuccacaaccacuacacccagaaaucccucucccucucacccggaaaa

SEQ ID NO: 54261 - RNA, 1353 nt, Artificial Sequence
  derived and/or modified sequence opt11 from Rituximab_HeavyChain_variant
caaguccaacuacaacaacccggcgcagagcucgucaaacccggcgccuccgucaaaauguccugcaaggccagcggauacacauucacauccuacaacaugcacugggucaaacaaacccccggccgagggcucgaauggaucggcgcaauauaccccggcaacggcgacacauccuacaaccaaaaauucaagggcaaagccacccucaccgccgacaaauccucaucaacagcauacaugcagcucagcucccugaccuccgaagacuccgcagucuacuacugcgcacgauccacauacuacggcggcgauugguacuuuaacgucuggggcgccggaacaacagucaccguauccgcagccuccaccaaaggacccuccgucuucccucuagcacccagcuccaaauccaccucuggaggcaccgcagcccucgggugucuagucaaagacuacuucccagaacccgucaccguaagcuggaacuccggcgcccuaacaagcggcguacacacuuucccagccguacuacaauccuccggacucuacucccuauccagcguagucacaguccccuccucuucccuaggcacacaaacguacaucugcaaugucaaccacaaacccucaaacaccaagguagacaagaaagcagaacccaaaagcugcgacaaaacccacaccugucccccaugccccgcccccgaacuacucggaggccccagcguauuccucuucccacccaaacccaaagacacacucaugaucucccgcaccccagaaguaaccugcgucgucgucgacgucucccacgaagaccccgaagucaaauucaacugguaugucgacggcgucgaaguacacaacgccaaaaccaaaccccgcgaagaacaauacaacucuaccuaucguguagucuccguccuaaccguccuccaccaagacuggcucaacggaaaagaguacaaaugcaaagucagcaacaaagcccuccccgcccccaucgagaaaaccauuuccaaagccaaagggcaaccacgagaaccgcaagucuacacccucccacccucccgugacgaacucaccaaaaaccaagucucacuaacgugccucgucaaaggcuucuaccccucagauaucgcagucgaaugggaauccaauggccaacccgaaaacaacuacaaaacaacgccaccaguacuagacucagacgguuccuucuuccuauacucaaaacucacagucgacaaaagccgcuggcaacaaggcaacgucuucucaugcagcgucaugcacgaagcacuccacaaccacuauacucagaaaagccuaucccucuccccaggaaaa

SEQ ID NO: 54262 - RNA, 639 nt, Artificial Sequence
  derived and/or modified sequence opt11 from Rituximab_LightChain
caaaucguccucucccaaucccccgccauccucuccgccucccccggcgaaaaagucaccaugaccugccgcgccuccuccuccgucuccuacauccacugguuccaacaaaaacccggcuccuccccaaaacccuggaucuacgccaccuccaaccuugccuccggcguccccguccgcuucuccggcuccggcuccggcaccuccuacucccucaccaucucccgcgucgaagccgaagacgccgccaccuacuacugccaacaauggaccuccaacccccccaccuucggcggcggcaccaaacucgaaaucaaacgcaccguagccgcccccuccgucuucaucuucccccccucagacgaacaacucaaaucagguacagccucagucguaugccuccucaacaacuucuacccccgcgaagccaaaguccaauggaaagucgacaacgcccuccaauccggcaacucccaagaauccgucaccgaacaagacuccaaagacuccaccuacucccucucaucaacccucacccucuccaaagccgacuacgaaaaacacaaagucuacgccugcgaagucacccaccaaggacucuccucccccguaacaaaaucauucaaccgaggcgaaugc

SEQ ID NO: 54263 - RNA, 714 nt, Artificial Sequence
  derived and/or modified sequence opt11 from Rivabazumab_pegol_HeavyChain1
gaaguccaacucguagaauccggcggcggcgucguccaacccggcagaucccuacgccucuccugcgccgccuccggcuucaccuucuccaacuaccccaugcacuggguuagacaagcccccggcaaaggccucgaaugggucgccgucaucucauacgacggcucugaaaaaugguacgccgacucaguaaaaggccgauucacaaucagcagagauaacucaaaaaacacccucuaccuagaaaugaacagccuccgcccagaagacaccgccgucuacuacugcgcccgcaaccgaggcgacaucuacuacgacuucaccuacgccauggacaucuggggccaaggcaccaccguaaccgucucauccgcauccaccaaaggcccauccgucuucccacucgcccccuccagcaaaucaaccuccggcggcaccgccgcccucggcugccucgucaaagacuacuuccccgaaccagucaccgucucauggaacuccggcgcccucaccucaggaguccacaccuuccccgccguccuccaauccuccggccucuacucccucuccuccgucgucaccgucccaagcuccucccucggcacacaaaccuacaucugcaacguaaaccacaaacccagcaacaccaaagucgacaaaaaaguagaaccuaaaucauccgacaaaacccacaccugccccccaugcccagcc

SEQ ID NO: 54264 - RNA, 642 nt, Artificial Sequence
  derived and/or modified sequence opt11 from Rivabazumab_pegol_LightChain1
gacauacaacucacccaauccccauccacccucucagccuccgucggcgacuccguaaccaucacaugccgagccuccgaaggcgucgaccgcuggcucgccugguaccaacaaaaacccggccgcgcccccaaacuccuaaucuacgacgccuccacccuacaauccggcguccccucccgauucucuggcuccggcuccggcaccgaauucucccucaccaucucuucccuucaacccgacgacgucgcuaccuacuacugccaacacuucuggggcacccccuacacauucggccaaggcaccaaacucgaaauaaaacgaaccgucgccgcccccuccgucuucaucuucccacccuccgacgaacaacucaaauccggcaccgccuccguagucugccuccucaacaacuucuacccccgcgaagccaaaguccaauggaaagucgacaacgcccuccaauccggcaacucccaagaauccgucaccgaacaagacucaaaagacuccaccuacucccucuccuccacacucacacucucaaaagccgacuacgaaaaacacaaaguauacgccugcgaagucacccaccaaggacucuccucccccgucaccaaauccuucaaccgcggcgaaucc

SEQ ID NO: 54265 - RNA, 1344 nt, Artificial Sequence
  derived and/or modified sequence opt11 from Robatumumab_HeavyChain1
gaaguccagcucguccaaucuggcgguggccuaguaaaacccggagggucccuccgccuuucaugcgccgcaagcggcuucaccuucuccagcuucgccaugcacugggucagacaagcaccaggaaaaggccuagaauggauuuccguaaucgacacccgcggugccacguacuacgccgacagcgucaaaggccgauucaccaucucaagagacaacgccaaaaacucccucuaucuccaaaugaacucccuccgagcagaagacacugccguuuacuacugcgcccgccuuggaaacuucuacuacggcauggacgucuggggacaaggaaccacagucaccguuuccuccgccuccaccaaaggaccauccgucuucccccuagccccaucauccaaauccaccuccggaggcaccgccgcccuaggaugccuagucaaagacuacuuucccgaacccgucaccgucuccuggaacuccggcgcucucacaucuggcguccacaccuuccccgccguacuccaaucaucaggacucuacucacuaucauccgucguaacgguccccuccuccucacuaggcacacaaaccuacaucugcaacgucaaccacaagccauccaacaccaaagucgacaagaaagucgagccaaaauccugcgacaaaacccauaccugcccacccugccccgcccccgaacuucucggaggacccuccgucuuccucuucccacccaaacccaaagacacacuuaugaucucccgaacacccgaaguaaccugcgucguagucgacgucucacacgaagaccccgaagucaaauucaacugguacguugauggagucgaaguccacaacgccaaaaccaaaccccgagaagaacaauacaacuccaccuaccgugucguaagcguccucacaguacuccaccaagacuggcuaaacggaaaagaauacaaaugcaaaguaagcaacaaagccuuaccagcccccaucgagaagaccauauccaaagcaaaaggccaaccccgagaaccccaaguauacacccucccgcccucccgagacgaacuaaccaaaaaccaaguaucacuaaccugccuagucaaaggcuucuaccccuccgacaucgcaguugaaugggaauccaacggccaaccagagaacaacuacaagaccacaccacccguccucgacucggacggcagcuuuuuccucuacuccaaacuaacagucgacaaaucccgcuggcaacaaggaaacguauucucaugcucagucaugcacgaagcccuccacaaccacuacacccagaaaagccucucacucucccccggaaaa

SEQ ID NO: 54266 - RNA, 642 nt, Artificial Sequence
  derived and/or modified sequence opt11 from Robatumumab_LightChain1
gaaaucguacucacccaaucccccggaacccucagcgucucccccggcgaacgcgcaacccuaagcugccgcgcaagccaauccaucggcucuagccuccacugguaccaacaaaaacccggccaagcccccagacuacucaucaaauacgccucacaaucccuuuccggcauccccgaccgauucucaggcuccggauccggcacagacuucacccucaccaucagccgacuagaacccgaagacuucgccgucuacuacugccaccaauccucccgacucccccacaccuucggacaaggaaccaaagucgaaaucaaacgcaccgucgccgcccccagcgucuucauauucccacccuccgacgaacaacucaaauccggcacagccucagucguaugccuacucaacaacuucuacccccgcgaagcaaaaguccaauggaaaguagacaacgcccuccaauccggcaacucacaagaauccguaaccgaacaagacuccaaagacuccaccuacucccuaagcucaacccuaacccuaagcaaagccgacuacgaaaaacacaaagucuacgcaugcgaagucacccaccaaggccucuccucacccguaaccaaauccuucaacaggggcgaaugc

SEQ ID NO: 54267 - RNA, 1368 nt, Artificial Sequence
  derived and/or modified sequence opt11 from Roledumab_HeavyChain1
caaguacaacucgucgaauccgggggcggugucguacagcccggccgcagcuuacgccuuuccugcacagccuccggauucacauucaagaacuacgccaugcacuggguccgacaagcgcccgccaaaggccucgaaugggucgcuacaaucuccuacgacggccgcaacauccaauacgccgacuccgucaaaggccgcuucaccuucuccagagacaacucacaagacacccucuaccuucaacugaacucgcuacgacccgaagacaccgccguauacuacugcgcccgccccguccgcucccguuggcuccaacucggccucgaagacgcuuuccacaucuggggccaaggcaccauggucaccguuucauccgccucaaccaagggccccuccgucuucccacucgcaccauccuccaaguccaccuccggcggaaccgccgcccugggaugcuuaguaaaagacuacuuccccgaacccgucaccguaucauggaacuccggcgcacucaccuccggcguccacacauuccccgcuguccuccagucauccggccucuacucccucagcuccgucgucaccguacccuccucaucccucggcacccaaaccuauaucugcaacgucaaccacaaacccuccaacaccaaagucgacaagaaaguagaacccaaauccugcgacaaaacccauaccugcccacccugcccugcacccgaacuccucggaggccccucagucuuccuguucccacccaagcccaaagacacucugaugaucucacgaacccccgaaguaacaugcgucgucgucgacgucucacacgaggacccugaagucaaauucaacugguacgucgacggcgucgaaguccacaacgcuaaaaccaaaccccgcgaggaacaauauaacuccaccuauagagucguguccguacucacaguucuucaccaagacuggcuaaacggcaaagaauacaaaugcaagguaucaaacaaagcacuacccgcacccaucgaaaagacaaucuccaaagcuaaaggccaaccccgcgaaccccaagucuacacccucccacccucccgcgacgaacuaacgaaaaaccaggucucacuaaccugccucgucaaaggcuucuaccccuccgacauagccgucgaaugggaauccaacggacaacccgaaaacaacuacaaaacgaccccacccguccucgacuccgacggcuccuucuuccucuacagcaaacucaccgucgacaagucccgcuggcaacaaggcaacgucuucuccugcucggucaugcacgaagcacuacacaaccacuacacacaaaaaucccuaucccucucacccgguaaa

SEQ ID NO: 54268 - RNA, 642 nt, Artificial Sequence
  derived and/or modified sequence opt11 from Roledumab_LightChain1
gccauccgcaugacccaaucccccuccuccuucuccgccucuaccggcgaccgcgucaccaucacaugccgcgccucccaagacauccgcaacuacgucgccugguaccaacaaaaauccggcaaagcacccaaauuccuuaucuacgcagccuccacccuccaaucaggcguccccagcagauucuccggcuccggcucaggcacagacuucacccucaccaucaacucccuacaauccgaagacuucgccacauacuacugccaacaauacuacaacuccccacccacauucggccaaggcacccgagucgaaaucacccgcaccgucgccgcccccuccgucuucaucuucccacccuccgacgaacaacucaaaucuggcaccgccuccgucguaugccuccucaacaacuucuacccccgagaagccaaaguccaauggaaagucgacaacgcccuccaaucuggaaacucucaagaauccgucaccgaacaagacuccaaagacuccaccuacucccucuccuccacccucacccucuccaaagccgacuacgaaaaacacaaagucuacgccugcgaagucacccaccaaggccuauccucccccgucaccaaauccuucaaccgaggcgaaugc

SEQ ID NO: 54269 - RNA, 639 nt, Artificial Sequence
  derived and/or modified sequence opt11 from Romosozumab_fab_fragment
gacauacaacucacccaaucacccucaucccuaucagccuccgucggcgaccgcgucaccauaaccugcuccgccucccaagacaucucaaacuaccuaaacugguaccaacaaaaacccggcaaagcccccaaaguccucaucuacuucaccucaucacuccacagcggaguccccucccgauucuccggcucuggcuccggcaccgacuucacccucaccaucucaucacuccaacccgaagacuucgccaccuacuacugccaacaauacuccacaguccccuggaccuucggccaaggcaccaaagucgaaaucaaacgcaccgucgccgcccccuccgucuucaucuucccacccuccgacgaacaacucaaauccggcacagccuccguagucugccuccucaacaacuucuacccccgcgaagccaaaguccaauggaaagucgacaacgcccuucaauccggcaacucccaagaauccgucaccgaacaagacuccaaagacucaaccuacucccucucauccacccuaacccucuccaaagccgacuacgaaaaacacaaagucuacgccugcgaagucacccaccaaggacucuccucccccgucaccaaauccuucaaccgcggagaa

SEQ ID NO: 54270 - RNA, 1347 nt, Artificial Sequence
  derived and/or modified sequence opt11 from Romosozumab_HeavyChain1
gaaguccaacucguccaaaguggcgccgaagucaagaaaccaggagccuccgucaaagucuccugcaaagcauccggauacacauucaccgacuacaacaugcacuggguacgacaagcccccggccaaggacuagaauggaugggagaaaucaacccaaacuccgggggcgccggcuacaaccaaaaauucaaaggccgagucacuaugaccaccgacaccagcacgucaacagccuacauggaacuacgaucccuacgauccgacgauaccgccguauacuacugcgcccgacuaggcuacgacgacaucuacgacgacugguacuuugauguauggggucaaggcaccaccgucaccgucucaucagccuccacaaaaggacccuccguguucccccuugcgcccugcucccgcuccaccuccgaauccaccgcagcccucggaugccucgucaaagacuacuuccccgaacccgucaccguguccuggaacucaggcgcccugaccagcggcguccacaccuuccccgcgguccuacaaucaagcggccuuuacucccuaagcucagucgucacagucccaagcagcaacuucggcacccaaacuuacacuugcaacgucgaccacaaacccagcaacaccaaagucgacaaaaccguagaacgaaaaugcugcgucgaaugcccacccugccccgccccucccguagccggacccagcgucuuccuauucccacccaaacccaaagacacccuaaugaucucacgcacccccgaagugaccugcgucgucgucgacguaagccacgaagaccccgaaguccaauucaacugguacguagacggcguagaaguccacaacgcaaaaaccaaacccagagaagaacaauucaacucuacauuccgaguagucuccguccuaacagucguccaccaagacuggcuaaacggaaaagaauacaaaugcaaagucucaaacaaaggccugcccgcccccaucgaaaagacaauaagcaaaaccaaaggccaaccacgagaaccccaagucuacacucucccucccucccgcgaagaaaugaccaaaaaccaaguaucccuaacaugccucgucaaaggcuucuacccauccgacauagccguugaaugggaauccaacggacaacccgaaaacaacuacaaaacaaccccucccaugcucgacuccgacggcuccuucuuccuguacucuaaacuaacagucgacaaaucuagauggcaacaaggcaacguauucucuugcuccgucaugcaugaagcgcuccacaaccacuacacccaaaaaucacucucccuaucccccggcaaa

SEQ ID NO: 54271 - RNA, 642 nt, Artificial Sequence
  derived and/or modified sequence opt11 from Romosozumab_LightChain1
gacauccaaaugacccaaucucccuccagccucuccgccucagucggcgaccgcgucaccaucacaugccgcgccucccaagacaucuccaacuaccucaacugguaccaacaaaaacccggcaaagcccccaaacuacucaucuacuacaccucccgacuccucuccggcguccccagcagauucuccggcuccggcuccggcaccgacuucacacuaaccaucuccucacuccaacccgaagacuucgccaccuacuacugccagcaaggagacacccuccccuacaccuucggcggcggaaccaaagucgaaaucaaacgcaccguagccgcacccuccguauucaucuucccacccucugacgaacaacucaaauccggcaccgccucagucgucugccuccucaauaacuucuacccccgcgaagccaaaguccaauggaaagucgacaacgcccuccaauccggcaacucccaagaaucagucaccgaacaagacuccaaagacuccaccuacucacucagcucaacccuaacccuauccaaagccgacuacgaaaaacacaaagucuacgccugcgaagucacccaccaaggccucagcucccccgucaccaaauccuucaaccgcggcgaaugc

SEQ ID NO: 54272 - RNA, 1326 nt, Artificial Sequence
  derived and/or modified sequence opt11 from Rontalizuab_HeavyChain1
gaaguccaacucgucgaauccggaggcggccuaguacaacccggaggcagccuacgccucuccugcgccaccagcggguacacauucaccgaauacaucauccacuggguucgccaagccccaggaaaaggacucgaaugggucgccuccaucaaccccgacuacgacauaaccaacuacaaccaacgguucaaaggccgcuucaccauuucucucgacaaauccaaacgcaccgccuaccuccaaaacucccuccgcgcagaagacacagccguauacuauugcgccucuuggaucucagauuucuucgacuauuggggccaaggaacccucguaacagucuccucagccuccaccaaaggccccuccgucuucccccucgccccauccuccaaauccaccuccggaggaaccgccgcccucggaugccucguaaaagacuacuuccccgaacccguaaccguguccuggaacagcggcgcccuaaccuccggcguccacacguuccccgccgugcuccaauccucaggucucuacagccucucaucggucgucacaguccccuccucaucccucgguacccaaaccuacaucugcaauguaaaccacaaaccauccaacacuaaagucgacaagaaagucgaacccaaauccugcgacaaaacacacaccuguccacccugccccgcacccgaacuacuaggcggccccuccgucuuccucuucccacccaaacccaaagacacccuaaucucccgcacacccgaagucacaugcgucguagucgauguaucucacgaagaccccgaagucaaauucaacugguacgucgacggcguagaagugcacaacgccaaaaccaaacccagggaggaacaauacaacuccaccuaccgugucgucuccgugcucacuguauuacaccaagacuggcucaacggcaaagaauacaaaugcaaaguuuccaacaaagcucuaccagccccuaucgagaaaaccauauccaaagccaaaggccaacccagagaaccccaaguauacacacucccacccagccgcgaagaaaccaaaaaccaaguaucacuuaccugccucgugaaaggcuucuacccuuccgacauugccgucgaaugggaaucaaacggccaaccggaaaauaacuacaaaacaacaccacccguccucgacucagacggcuccuucuuccucuacagcaaacuaacggucgacaaaucacguuggcaacaaggcaacgucuucuccugcuccguccacgaagcccuacacaaccacuacacccaaaaaucccuaucucucucccccgga

SEQ ID NO: 54273 - RNA, 648 nt, Artificial Sequence
  derived and/or modified sequence opt11 from Rontalizuab_LightChain1
gacauccaaacccaaucccccuccucacucuccgccuccgucggagaccgagucaccaucacaugccgcgccucccaauccgucuccaccuccuccuacuccuaccacugguaccaacaaaaacccggcaaagcacccaaaguccuaaucucauacgccuccaaccucgaauccggcguccccucacgauucuccggcuccggcuccggcaccgacuucacccucaccaucuccucccuccaacccgaagacuucgccacauacuacugccaacacuccuggggaaucccacgcaccuucggccaaggcaccaaagucgaaaucaaacgcaccgucgccgcccccuccguauucaucuucccucccucagacgaacaacucaaauccggcacagccuccgucgucugccuccucaacaauuucuacccccgcgaagccaaaguccaauggaaaguagacaacgcccuacaaucaggcaacucccaagaauccgucaccgaacaagacuccaaagacuccaccuacucccuuuccuccacccucacccucuccaaagccgacuacgaaaaacacaaagucuacgccugcgaagucacccaccaaggccucuccucccccgucaccaaaucuuucaaccgcggcgaaugc

SEQ ID NO: 54274 - RNA, 1341 nt, Artificial Sequence
  derived and/or modified sequence opt11 from Rontalizumab_HeavyChain1
gaaguacagcuagucgaauccggcggaggccuuguacaacccggaggcucucuacgccucucaugcgccacauccggcuacaccuucaccgaauacaucauccacuggguccgccaagcccccggcaaagggcucgaauggguagccuccauuaaccccgacuacgauauaaccaacuacaaccaacgcuuuaaaggacgcuucacaaucuccuuagacaaauccaaacgcaccgccuaccuccaaaugaacucacuucgcgcagaagacacagccgucuacuacugcgccagcuggauaucagacuucuucgacuacuggggccaaggcacgcucgucacagucucaucugccuccacaaaaggccccucagucuucccccuagccccuuccuccaaaagcaccuccggcggcaccgccgcacucggcugccucgucaaagacuacuuccccgaaccugucacagucuccuggaacuccggcgcacucacauccggcguccacacauuccccgccguccuacaaucaucaggccuauacucccuuucaagcgucgucaccgucccuagcuccucccucggcacccaaacuuacaucugcaacgucaaucacaaaccauccaacaccaaaguagacaagaaaguagaaccaaaauccugcgacaaaacccacacaugcccacccugccccgcacccgaacuccucggaggacccuccgucuuucucuucccacccaaacccaaagacacccucaugaucucacgcacacccgaaguaaccugcgucgucgucgacgucucccacgaagaccccgaagucaaguucaacugguauguagacggcguagagguacacaacgccaaaaccaaaccccgcgaagaacaauacaauuccaccuaccgagucgucagcguccuaacaguacuccaccaggacuggcucaacggcaaggaauacaaaugcaaagucucuaacaaagcccucccagccccaaucgagaaaacuaucuccaaagccaaaggccaaccacgcgaaccccaaguuuacacccuacccccaucccgugaagaaaugaccaaaaaccaagucucccucaccugucucgucaaaggauucuacccauccgacaucgccgucgaaugggaauccaacggccaaccagaaaacaacuacaaaaccaccccucccguccuagacuccgacggcuccuucuuccucuacucuaaacuaaccgucgacaaaucacgcuggcaacaaggcaacgucuucuccugcuccguaaugcacgaagcccuucacaaccacuacacacaaaaaucacucucccuuucccccgguaag

SEQ ID NO: 54275 - RNA, 654 nt, Artificial Sequence
  derived and/or modified sequence opt11 from Rontalizumab_LightChain1
gacauccagaugacgcaaucgcccucgagccugagcgcgagcgugggcgaucgcgugaccauaaccugccgcgcgagccagagcgugagcacgagcucguacucguacaugcacugguaccagcaaaagcccggaaaagcgcccaaggucuugaucucguacgcaagcaaucucgagagcggagucccaagcagguucucgggcucgggcucgggcacggacuucacccugaccauaagcucacuccagcccgaggacuuugccacguacuacugccagcacucgugggggaucccacgcacauucgggcaagggaccaaggucgagaucaagcgcacagucgcagccccaagcguauucauauucccgcccucagacgagcaacugaaaucaggcacggccucagucguaugccuacucaacaacuucuacccgcgcgaggccaagguccaguggaaggucgauaacgcacuccaauccgggaacucacaagagagcgugaccgagcaagacagcaaagacucgacauauagccugaguucaacccugaccuugagcaaggccgauuacgagaaacauaaaguguacgcgugcgaggucacacaccagggccugagcucacccgugaccaagagcuucaacaggggcgagugc

SEQ ID NO: 54276 - RNA, 1341 nt, Artificial Sequence
  derived and/or modified sequence opt11 from Rovalpituzumab_tesirine_HeavyChain1
caaguccaacucguucaaaguggagccgaagucaagaaacccggcgcuucugucaaaguauccugcaaagccucgggauacaccuuuaccaacuacggcaugaacuggguccgccaagcccccggacaaggccucgaauggaugggcuggaucaacaccuacaccggcgaacccaccuacgcagacgacuucaaaggacgugucaccaugaccacagacacgucgaccuccaccgccuacauggaacuacgcagccuccgcagcgacgacaccgcagucuacuacugcgcacgcauaggagacuccuccccauccgacuacuggggacaaggaacccucgucacaguauccucagccuccaccaaaggcccgucagucuucccccucgcccccuccuccaaaagcaccuccggcggcaccgccgcccuaggcugccucgucaaagacuacuucccagaacccguaaccgucuccuggaacuccggcgcacugaccucaggcgugcacaccuucccagcaguccuccaaagcucaggccucuauucccucucauccgucgucaccguccccuccuccagccuaggcacucaaaccuacaucugcaacgucaaccacaaacccagcaacaccaaagucgacaagaaaguagaacccaaauccugugacaaaacccacaccugucccccuugcccagccccagaacuauuaggcggccccuccgucuuccucuucccacccaaacccaaagauacccucaugaucucucggacacccgaagucacaugcguugucgucgacguaucccacgaagaccccgaagucaaauucaacugguacgucgacggcguagaaguccacaacgcaaaaaccaaaccccgcgaagaacaauauaacucuaccuaccgaguagucagcguccucacaguccuccaucaagacuggcucaacgggaaagaauacaaaugcaaagucuccaacaaggcccuacccgcccccaucgagaaaaccaucucaaaagccaaaggccaacccagagaaccacaagucuacacccucccucccucacgcgacgaacuaaccaaaaaccaaguuucccuaaccugccucgucaaaggcuucuaccccuccgacauagccguagaaugggaauccaacggccagcccgaaaacaacuauaaaaccacacccccaguacucgacucagacggcuccuucuuccucuacucaaaacuaaccgucgacaagucccgcuggcaacaaggcaacgucuucuccugcucagucaugcacgaagcccuccacaaccacuacacccagaaaagccucucacuaagccccggc

SEQ ID NO: 54277 - RNA, 642 nt, Artificial Sequence
  derived and/or modified sequence opt11 from Rovalpituzumab_tesirine_LightChain1
gaaaucgucaugacccaaucacccgccacccucuccguaucccccggcgaacgagccacccucuccugcaaagccucccaauccgucuccaacgacguagucugguaccaacaaaaacccggccaagccccccgccuccuaaucuacuacgcauccaaccgcuacaccggcauccccgcccgauucuccggcuccggcucaggcaccgaauucacccuaaccaucagcucccuccaauccgaagacuucgccguauacuacugccaacaagacuacaccucccccuggaccuucggccaaggaaccaaacucgaaaucaaacgaaccgucgccgcccccuccgucuucaucuucccccccucagacgaacaacucaaauccggcaccgccuccgucgucugccuccucaacaacuucuacccccgcgaagccaaaguccaauggaaagucgacaacgcccuacaauccggaaacucccaagaauccgucaccgaacaagacuccaaagacucaacauacucccucuccucaacccucacccucuccaaggcagacuacgaaaaacacaaagucuacgccugcgaagucacacaccaaggccuuuccucccccguaaccaaauccuucaaccgcggcgaaugc

SEQ ID NO: 54278 - RNA, 1341 nt, Artificial Sequence
  derived and/or modified sequence opt11 from Rovelizumab_HeavyChain1
caaguacaacugguccaauccggagccgaagucaagaaaccaggcgccucagucaaagucuccugcaaagccagcggauacaccuucacaaacaacuggaugcaaugggucagacaagcccccggccaaggacucgaguggaugggcgcaaucuuccccggcgacgacgaaacccgcuacacccaaaaauuccgaggcaaagcaacuaucaccgcggacaccuccaccuccaccgccuacauggaacuaucaagccuccgcucggaagacaccgcgguauauuacuguggccgaggaggaaaacuccgcccauucgcccucgacuacuggggacaaggcacccucguaaccgucucaucagccucaaccaaaggccccuccguauucccgcuagcgcccugcagccgcuccaccuccgaaagcaccgcugcacucgggugccuagucaaggacuauuuuccugaaccagucacaguauccuggaacuccggagcccuaaccuccggaguucacacauucccagcaguacuccagagcucuggccuguacucacucucaagcguagucaccguuccaucauccagccuaggaacaaaaaccuacacaugcaacgucgaccacaagcccuccaacaccaaagucgacaaacgcgucgaaucgaaauauggcccucccugccccucaugccccgcccccgaauuucuaggaggacccagcgucuuccucuucccacccaaacccaaagacacccuaaugaucucccgaacacccgagguuaccugcgucgucgucgacguaagccaagaagaccccgaaguccaauucaacugguaugucgacggugucgaaguccacaacgccaaaaccaaacccagagaagaacaauucaacucuaccuaccgaguaguauccguccuaaccgucuuacaccaagacuggcucaaugggaaagaguacaaaugcaaagucucaaacaagggacuccccucaagcaucgagaaaaccaucagcaaagcuaaaggccaaccccgcgaaccccaagucuacacccucccaccaucgcaagaagaaaugaccaaaaaccaagucucucucacaugccuggucaaaggcuucuaccccuccgacauugccgucgaaugggaaagcaacggccaacccgaaaacaacuacaaaacaaccccucccguccucgacagcgacggcagcuuuuuccuguacucacgccucaccgucgauaaaucccgauggcaggaaggaaacguauucucgugcucaguaaugcacgaagcccuacacaaccacuacacccaaaaaucacucucacucucccucggcaaa

SEQ ID NO: 54279 - RNA, 654 nt, Artificial Sequence
  derived and/or modified sequence opt11 from Rovelizumab_LightChain1
gacauccagaugacacaaucaccaucaagccucagcgcaagcguaggcgaccgcgugaccauaaccugccgcgcaagcgaaagcguagaaucguacggaaacaacuucauguacugguaccaacaaaaacccgggaaagcacccaaacuccuaaucuaccucgcaagcaaccucgaaagcggagucccgagcagauucuccggcucaggcucaggcacagacuucacccugaccauaagcucacuccaacccgaagacuucgcaacguacuacugccaccaagacaacgaagacccacccacauucggacaaggaaccaaacucgaaaucaaacgcacggucgcagccccaagcguauucauauucccacccucagacgaacaacuaaaaucaggcacagccucagucgugugccuccucaacaacuucuacccacgcgaagccaaaguccaauggaaagucgacaacgcacuccaaagcggaaacucacaagaaagcgugaccgaacaagacagcaaggacucaaccuacucccugagcucgacacuaacccuaagcaaggccgacuacgaaaaacacaaaguauacgcgugcgaagucacacaccaaggccuaagcucacccguaaccaaauccuucaacagaggcgaaugc

SEQ ID NO: 54280 - RNA, 1341 nt, Artificial Sequence
  derived and/or modified sequence opt11 from Ruplizumab_HeavyChain1
caaguacagcuaguacaauccggcgccgaagucgucaaacccggcgccuccgucaaacucuccugcaaggcauccggcuacaucuucacauccuacuacauguacugggucaagcaagcccccggacaaggccucgaauggauaggugagaucaaccccuccaacggagacacgaacuucaacgaaaaauucaaaagcaaagccacccucaccgucgacaaaucagcauccaccgccuacauggagcuauccucucuccgcuccgaagacaccgccgucuacuacugcacccgcucagacggacgaaacgauauggacucauggggccaaggaacucuagucacagucucuucugccagcacaaaaggccccucagucuucccccucgcccccuccucaaaguccaccagcggaggaaccgcagccuuaggcugccucguuaaagacuacuucccagaacccgucaccgucuccuggaacuccggagcccuaaccucaggcguacacacauuccccgcaguccuccaaucauccggccuauacucucucucaucagucguaacaguccccucauccucacucggcacacaaacauacaucugcaacgucaaccacaaacccagcaacacaaaggucgacaagaaaguagaacccaaaagcugcgacaaaacucacacaugcccacccugccccgccccagaacuacucggaggccccucagucuuccucuucccacccaaacccaaagacacccuaaugauaucccgaacucccgaaguuaccugcgucgucgucgacgucucccacgaagaccccgaagucaaauucaacugguacgucgacggcgucgagguccacaacgcuaaaaccaaaccccgcgaggaacaguacaacuccaccuaccgaguugucuccguccuaacaguacuccaccaagacuggcucaacggcaaagaauacaaaugcaaaguauccaacaaagcccucccggcucccaucgagaaaaccaucucaaaagccaaaggccaaccccgcgaaccucaggucuacacccuacccccaucacgcgacgaacucaccaaaaaccaaguaagccugacaugccucguuaagggcuucuaucccuccgacaucgccguagaaugggagucaaacggacaacccgaaaacaacuacaaaaccaccccacccguacuugacuccgacggcucauucuuccucuacagcaaacucacagucgacaaaucccgcuggcaacagggcaacguauucucaugcuccguaaugcacgaagcccuacacaaccauuacacccaaaaaucccugucccucucccccggc

SEQ ID NO: 54281 - RNA, 654 nt, Artificial Sequence
  derived and/or modified sequence opt11 from Ruplizumab_LightChain1
gacaucguacucacccaaucccccgcaacccucuccgucagccccggcgaacgcgccaccauauccugccgcgcuucccaacgcgucuccucaucaaccuacucuuacaugcacugguaccaacaaaaacccggccaaccacccaagcuacucaucaaauacgccuccaaccucgaaucaggcgucccagcccgauucucuggcuccggcuccggcaccgacuucacccucaccaucuccucagucgaacccgaagacuucgccaccuacuacugccaacacuccugggaaaucccacccaccuucggcggcggcaccaaacucgaaaucaaacgcacagucgccgcccccagcgucuucaucuucccacccuccgacgaacaacuaaaaucuggcaccgccuccgucgucugccuccucaacaacuucuacccccgcgaagccaagguccaauggaaagucgacaacgcccuccaauccggcaacucacaagaaagcgucaccgagcaagacuccaaagacucaacuuacucccucuccuccacccuaacccucuccaaagccgacuacgaaaaacacaaaguauacgcaugcgaagucacccaccaaggccucuccucccccgucaccaaauccuucaaccgcggcgaaugc

SEQ ID NO: 54282 - RNA, 1353 nt, Artificial Sequence
  derived and/or modified sequence opt11 from Sacituzumab_govitecan_HeavyChain1
caaguacaacuccaacaauccggaagcgaacucaagaaacccggugccuccguaaaagucucaugcaaagccucuggcuacacauucaccaacuacggaaugaacugggucaaacaagcucccggacaaggccucaaauggaugggcuggauaaacaccuacaccggagaaccaacuuacacagacgacuucaaaggucgauuugccuucucccucgacaccucagucucaaccgccuaccuccaaauuucgucccucaaagcagacgacacagccgucuacuucugcgcacgcggcggcuucggcucaucauacugguacuucgauguguggggccaaggaucccuugucacuguaaguucagcaucuacgaaaggccccagcgucuucccccucgcccccagcucaaaauccaccuccggcggcaccgccgcccuaggcugccuaguuaaagacuacuuccccgagccagucaccgucucguggaacagcggagcccucaccuccggaguccacaccuuccccgccguccuccaauccuccggacuauacucccucuccuccgucgucaccguaccaucaucaucacucggaacacaaaccuacaucugcaacgucaaccauaaacccuccaacaccaaagucgacaaacgagucgaacccaaaagcugcgacaaaacccacaccugucccccaugccccgccccagaacuacuuggcggccccuccgucuuccucuucccucccaaaccaaaagacacccuaaugaucucccggacacccgaaguaaccugcgucgucgucgacgucucccacgaagaccccgaagucaaauucaacugguacgucgacggcgucgaaguccacaacgccaaaaccaaacccagagaagaacaauacaacuccacauaccgagucgucuccguccuaaccguccuacaccaagacuggcucaacggcaaagaauacaaaugcaaagucuccaacaaagcccuccccgcccccaucgagaaaaccaucuccaaagccaaaggacaaccacgcgaaccucaaguauacacccuacccccgagccgcgaagaaaugaccaaaaaccaagucucccuaaccugccucgugaaaggcuucuaccccuccgacauagccguagaaugggaaucaaacggacaacccgaaaacaacuauaaaaccacacccccuguucucgacucagacggcuccuucuuccucuacuccaaacucaccgucgacaaaucccgcuggcaacaaggcaacguauucucaugcagugucaugcacgaagcccuccacaaccacuacacccaaaaaucgcuuagccuaagccccggcaaa

SEQ ID NO: 54283 - RNA, 642 nt, Artificial Sequence
  derived and/or modified sequence opt11 from Sacituzumab_govitecan_LightChain1
gacauccaacucacccaaucccccucaucccucuccgccuccgucggcgaccgagucuccauuaccugcaaagcaucccaagacgucuccaucgccgucgccugguaccaacaaaaacccggcaaagcacccaaacuccuaaucuacuccgccuccuaucgauacaccggcguccccgaccgcuucuccggcucaggcucaggcaccgacuucacccucaccaucuccucacuccaacccgaagacuucgccgucuacuacugccaacaacacuacaucacaccccucaccuucggcgccggcaccaaagucgaaaucaaacgaacaguagccgcccccuccgucuucaucuucccacccuccgacgaacaacucaaauccggcaccgccuccgucgucugccuccucaacaacuucuacccccgcgaagccaaaguccaauggaaagucgacaacgcccuccaaucaggcaacucccaagaauccgucaccgaacaagacuccaaagacuccaccuacucccucuccuccacacucacccucuccaaagcugacuacgaaaaacacaaagucuacgcaugcgaaguaacccaccaaggcuuauccucccccgucaccaaauccuucaacagaggcgaaugc

SEQ ID NO: 54284 - RNA, 1326 nt, Artificial Sequence
  derived and/or modified sequence opt11 from Samalizumab_HeavyChain1
caaguacaacuccaacaaagcggaagcgaacuuaagaaaccaggugccucagucaaaauaagcugcaaagccagcggcuacucauucaccgacuacaucauacuauggguacgacaaaauccaggcaaaggacucgaauggauaggacacaucgaccccuacuacggcagcucaaacuacaaccucaaauucaaaggccggguaaccauaaccgccgaccaaucaaccaccaccgcguacauggaacucucaucccuccgcucagaagacaccgcagucuacuacugcggacgauccaaacgagacuacuucgacuacuggggccaaggcaccacccucaccgucucaucagccuccaccaaaggccccuccgucuucccccucgccccuugcucgagaucaacaucagaauccaccgccgcccucggcugccucgucaaagacuacuuccccgaacccguaacagucucuuggaacucaggagcccuuaccucaggcguccacaccuuuccugccguacuccaguccuccggucuauacucccucuccuccgucgucaccguccccuccuccaacuucggcacccaaacauauaccugcaacguagaccauaaaccaucuaacaccaaaguugacaaaaccgucgaacgcaaaugcugcguagaaugcccacccugucccgccccucccgucgccggacccuccgucuuccucuucccacccaaacccaaagacacccucaugaucucacgcacccccgaagucacaugcguagucguagacguaucccaagaagaccccgaaguccaauucaacugguacgucgacggcgucgaaguccacaacgccaaaaccaaacccagggaagaacaauucaacuccacauaccgaguaguuuccguccucaccguacuccaccaagacuggcuaaacggaaaagaauacaaaugcaaagucucaaacaaaggccuccccuccuccaucgagaaaaccaucuccaaagcaaaaggucaacccagagaaccccaagucuacacgcuucccccaagccaagaagaaaugaccaaaaaccaagucucacuaaccugccucguaaaaggcuucuacccaagugauaucgccgucgaaugggaaucaaacggacaacccgaaaacaacuacaaaaccacacccccaguacucgauucagacggaucauucuuccuauacucacgauuaaccgucgacaaaucccgauggcaagaaggcaacguauucucaugcagugucaugcacgaagcccuccacaaccacuacacccaaaaaucccuuuccuuaucgcuagga

SEQ ID NO: 54285 - RNA, 642 nt, Artificial Sequence
  derived and/or modified sequence opt11 from Samalizumab_LightChain1
gacauccaaaugacacaaucacccucaagccuuuccgcauccauaggcgaccgcgucaccaucaccugcaaagcaucccaagacauuaacuccuaccucagcugguuccaacaaaaaccaggcaaagccccaaaacuccucauauaccgcgccaaccgccucgucgacggcguccccucccgcuucuccggcuccggcuccggcaccgacuacacccucaccauauccucccuccaacccgaagacuucgcagucuacuacugccuccaauacgacgaauucccauacacuuucggaggcggcaccaaacucgaaaucaaacgcaccgucgccgcccccuccgucuucaucuucccccccuccgacgaacaacucaaauccggcacagccucagucgucugccuacucaacaacuucuacccccgcgaagccaaaguccaauggaaagucgacaacgcacuccaauccggcaacucccaagaauccgucaccgaacaagacuccaaagacuccaccuacucccucuccucaacccucacacucuccaaagccgacuacgaaaaacacaaagucuacgccugcgaagucacccaccaaggccucuccucucccguaaccaaaucauucaaccgcggcgaaugc

SEQ ID NO: 54286 - RNA, 1338 nt, Artificial Sequence
  derived and/or modified sequence opt11 from Sarilumab_HeavyChain1
gaaguccaacucguagaauccggcggcggccucguucaacccggccgcucccugcgccucucaugcgccgcaagccguuucacuuucgacgacuacgcaaugcacuggguacgccaagcccccggaaaaggacucgaaugggucucaggcaucagcuggaacuccggcagaauagguuacgccgacucaguuaagggcagauucacaaucucccgcgacaacgccgaaaacucacucuuccuucagaugaacggacucagagccgaagacaccgcccuauacuacugcgcaaaaggaagagacuccuucgacauauggggccaagguaccaugguuaccgucuccuccgccucuaccaaaggacccucagucuucccccucgcacccuccucaaaauccaccagcggaggaaccgccgcacucggcugccucgucaaggacuacuuccccgaaccagucacaguauccuggaacuccggcgcccucaccucuggaguccacaccuuccccgccguccuccaaucauccggccucuauucacuaucauccgucguaacaguaccauccuccucccucggcacccaaaccuacaucugcaacgucaaccacaaaccauccaacaccaaaguugacaaaaaggucgaacccaaauccugcgacaaaacccacacaugcccaccaugccccgcaccagaacuacuaggaggccccuccgucuuccuauucccacccaaacccaaagacacccuaaugaucagccguacccccgaaguaaccugcgucgucguugacgucagccacgaagacccagaaguaaaauucaacugguacgucgacggcgucgaagugcacaaugccaaaaccaaaccacgagaagaacaguacaacagcaccuaccgaguagucucaguacucacaguccuccaccaagacuggcucaacggcaaagaauacaaaugcaaaguaagcaauaaagcccuccccgcccccaucgagaaaaccauauccaaagccaaaggccaaccccgcgaaccacaagucuacacacugccucccucccgcgacgaacucaccaaaaaccaaguaucacuaacaugucucgucaaaggauucuaccccagcgacauagccgucgaaugggaaucaaacggccaacccgaaaacaacuacaaaaccacacccccaguccucgacuccgacggcagcuucuuccuauacuccaaacuaaccgucgacaaaucccgcuggcaacaaggcaacgucuucuccugcucagucaugcacgaagcccuucacaaccacuacacccaaaaaucgcucucccuaucccccggcaaa

SEQ ID NO: 54287 - RNA, 642 nt, Artificial Sequence
  derived and/or modified sequence opt11 from Sarilumab_LightChain1
gacauccagaugacccaaucacccuccuccguauccgccuccgucggcgaccgcguaaccauaaccugccgcgccucccaaggcaucuccucauggcuagccugguaccaacaaaaacccggcaaagcccccaaacuccuaaucuacggcgccuccucccucgaauccggaguccccucccgcuucuccggcucuggaucaggcaccgacuucacccucaccaucuccucccuccaaccagaagacuucgcauccuacuacugccaacaagccaacuccuucccuuacacauucggccaaggcaccaaacucgaaaucaaacgcaccguagccgcccccucagucuucaucuucccaccauccgacgaacaacucaaauccggcacagccucugucguaugccuacucaacaacuucuacccccgcgaagccaaaguccaauggaaagucgacaacgcacuccaauccggcaacucccaagaauccgucaccgaacaagacuccaaagacucaaccuacucccucuccuccacccucacccucuccaaagccgacuacgaaaaacacaaagucuacgcaugcgaagucacccaccaaggcuuaucuucccccgucaccaaauccuucaaccgcggcgaaugc

SEQ ID NO: 54288 - RNA, 1296 nt, Artificial Sequence
  derived and/or modified sequence opt11 from Satumomab_pendetide_HeavyChain
caaguacaacuacaacaauccgacgccgaacucgucaaacccggcgccuccguaaaaaucuccugcaaagccuccggcuacaccuucacggaccacgccauacacugggccaaacaaaaaccugaacaaggccuagaauggaucggguacauuuccccaggcaacgacgacaucaaauacaacgaaaaauucaaaggaaaagccacacucaccgccgacaaaucuuccuccaccgccuacaugcaacucaacucacucaccagcgaagacuccgccgucuacuucugcaaacgcagcuacuacggacacuggggacaaggcacaacacucaccguauccuccgccuccaccaaaggaccuuccguauucccccucgcacccugcucacgcuccaccuccgaauccaccgccgcccuuggcugccucgucaaagacuacuucccagaacccgucacagucuccuggaacuccggcgcccucacauccggcguccacaccuuccccgccguccugcaauccuccggacucuacucacucuccagcguaguaacaguccccucaucuucacuaggaacaaaaacauauaccugcaacguagaccacaaacccucaaacaccaaaguagacaaacguguaugcccacccugcaaaugccccgcccccaaccugcuaggcggucccuccgucuucaucuucccaccaaagaucaaggacguccuaaugaucucccuaucccccaucgucacgugcguugucgucgacgucuccgaagacgaccccgacguucaaaucucuugguucgucaacaauguagaaguacacaccgcccagacccaaacgcaccgcgaagacuacaacuccacacuccgcgucguauccgcccuccccauccaacaccaagacuggauguccggcaaagaguucaaaugcaaaguaaacaacaaagaccuccccgcccccaucgaacgcaccauaucaaaacccaaaggcuccgucagagcaccccaagucuacguccucccacccccagaagaagaaaugacaaagaaacaaguaaccuuaaccugcauggucacagacuucaugcccgaagauauuuacgucgaauggacaaacaacggcaaaaccgaacucaacuacaaaaacaccgaaccaguacucgacuccgacggaucauacuucauguacuccaaacuucgcgucgaaaagaaaaacuggguagaacgcaacucauacuccugcuccgucguccacgaaggccuucacaaccaccacaccaccaaauccuucucccgc

SEQ ID NO: 54289 - RNA, 630 nt, Artificial Sequence
  derived and/or modified sequence opt11 from Satumomab_pendetide_LightChain
gacauccaaaugacccaaucucccgccucccucagcgucuccgucggagaaaccgucaccauaaccugccgcgccuccgaaaacaucuacuccaaccucgccugguaccaacaaaaacaaggcaaaucaccccaacuccucgucuacgccgccaccaaccucgccgacggcgucccaucccgauucuccggcuccggcuccggcacccaauacucccuuaaaaucaacucccuccaauccgaagacuucggcuccuacuacugccaacacuucuggggcaccccauacaccuucggcggcggaacccgccucgaaaucaagcgcgccgacgccgcccccaccgucuucaucuucccacccuccgacgaacaacugaaauccggcaccgccuccgucgucugccuacucaacaacuucuacccccgcgaagccaaaguccaauggaaagucgacaacgcccuccaauccggcaacucccaagaauccgucaccgaacaagacucaaaagacuccaccuacucacucucaucaacccucacccucuccaaagccgacuacgaaaaacacaaagucuacgccugcgaagucacccaccaaggccucuccucccccgucaccaaauccuucaac

SEQ ID NO: 54290 - RNA, 1371 nt, Artificial Sequence
  derived and/or modified sequence opt11 from Secukinumab_HeavyChain1
gaaguccaacucgucgaaucaggcggcggccuuguccaacccggcggcucccuccgauuauccugcgccgccuccggcuucaccuucuccaacuacuggaugaacuggguacgucaggccccuggcaaaggacucgaaugggucgccgccauaaaccaagacggcuccgaaaaauacuacguaggcucagucaaaggcagauucaccaucucccgcgacaacgccaaaaacucccucuaccuucaaaugaacucccuaagaguugaagacaccgcaguauacuacugcguacgcgacuauuacgauauccuaacagacuauuacauccacuacugguacuucgaccucuggggccgcggaacucucgucaccgucagcuccgccuccacuaaaggccccucaguauucccccuagcuccaucuuccaaaagcacaaguggaggcacagcagcccuagguugccucguaaaagacuacuuccccgaacccgucaccguaucauggaacagcggcgcccucaccucuggcguccacaccuucccagccguccuccaauccagcggucucuacagccucagcuccgucgucaccguccccuccuccucccucggcacacaaaccuacaucugcaacgucaaccacaaaccaucuaacacaaaagucgauaaacgcgucgaacccaaauccugcgacaaaacacacacauguccacccugccccgcccccgaacuacuaggcggccccuccgucuuccuguucccacccaaacccaaagacacccucaugauaagccgcacacccgaaguaaccugcgucgucguagacgucucccacgaagaccccgaagucaaauucaacugguacguggacggcgucgaaguccacaacgccaaaacaaaaccccgcgaagaacaauacaacucaaccuaccgagucgucuccguccucaccguccuacaccaagacuggcucaacggcaaggaauacaaaugcaaagucagcaacaaggcccuccccgccccaaucgaaaagaccauaucaaaagccaaaggccaaccacgcgaaccacaagucuacacccucccacccucccgcgaagaaaugaccaaaaaccaaguuucccucacaugccucguaaaaggguucuaccccuccgacaucgcagucgaaugggaauccaauggacaaccagaaaacaacuacaaaacaaccccucccguccucgacagcgacggcuccuucuuccuauacucaaaacucaccgucgacaaaucccgauggcaacaagguaacgucuucuccugcuccgucaugcacgaagcacuccacaaccacuacacgcaaaaaucccucucacucucccccggcaaa

SEQ ID NO: 54291 - RNA, 645 nt, Artificial Sequence
  derived and/or modified sequence opt11 from Secukinumab_LightChain1
gaaaucguccucacccaauccccaggcacacucucccucucccccggagaacgcgccacccucuccugccgcgccucccaauccgucuccuccucauaccucgcaugguaccaacaaaaacccggccaagcaccccgccuccuaaucuacggcgccuccucccgcgccacaggcauccccgaccgcuucuccggauccggcuccggcaccgacuucacccuaaccaucucccgccucgaacccgaagacuucgccgucuacuacugccaacaauacggcuccucccccugcacauucggccaaggcacacgccucgaaaucaaacgcacagucgccgcccccucaguauucaucuucccacccucagacgaacaacucaaauccggcaccgccucagucguaugccuccuaaacaacuucuacccccgcgaagccaaaguacaauggaaagucgacaacgcccuccaauccggcaacucacaagaaucagucaccgaacaagacuccaaagacuccaccuacucccucagcuccacccucacccucuccaaagccgacuacgaaaaacacaaagucuacgccugcgaagucacccaccaaggccucucaucccccgucaccaaaucauucaaccgcggcgaaugc

SEQ ID NO: 54292 - RNA, 1335 nt, Artificial Sequence
  derived and/or modified sequence opt11 from Seribantumab_HeavyChain1
gaaguacaacuccucgaaucaggcggcggccuaguccaacccggcggaucucuucgccucuccugcgccgccucaggauucaccuucucacacuacguaauggccuggguccgccaagcccccggaaaaggucucgaaugggucuccucaauaucauccuccggcggcuggacccuauacgccgacucagucaaaggccgcuucaccauaagccgugacaacucuaaaaacacccucuaccuccaaaugaacucccuacgcgcggaagacaccgccgucuacuacugcacucgcggucucaaaauggcaaccauauucgacuacuggggccaaggcacccucguaacugucucauccgccuccaccaaaggcccaucagucuucccccuagccccaugcuccagauccaccuccgaaucgacagcagcacucggaugccucguaaaagacuacuuuccagaacccguuacuguauccuggaacuccggcgcccuaacaagcggcguacacacauuccccgccguccuccagucaucaggccucuacucccuauccuccgucguaaccguaccaucauccaacuucggcacccaaacauacacaugcaacgucgaccacaaacccucaaacaccaaaguagacaaaaccgucgaacgaaaaugcugcgucgaaugcccacccugccccgcgcccccaguagccggacccagcguauuccucuucccacccaaacccaaggacacccuaaugaucucccgaacccccgaggucacaugcgucguagucgacguaucccacgaagaccccgaaguacaauucaacugguacgucgacggcgucgagguacacaacgccaaaacaaagcccagagaagaacaauucaacuccaccuuccgagucgucucaguccugacagucguccaccaagacuggcucaacgggaaagaauacaaaugcaaagucucaaacaaaggccucccagcccccaucgagaaaacuaucagcaaaacaaaaggacaaccccgagaaccccaaguauacacgcucccucccucacgagaagaaaugaccaaaaaccaagucucccugaccugccucgucaaaggauucuaccccucggacaucgcagucgaaugggaaagcaacggacaacccgaaaacaacuacaaaaccaccccacccaugcucgacuccgacggcagcuucuuucuguacucaaaacucacaguagacaaaucccgcuggcaacaaggaaacgucuucuccuguuccgucaugcacgaagcccuccacaaccacuacacccaaaaaucucucucacucucccccggcaaa

SEQ ID NO: 54293 - RNA, 651 nt, Artificial Sequence
  derived and/or modified sequence opt11 from Seribantumab_LightChain1
caauccgcccuaacacaacccgccucagucuccggcucccccggccaauccaucacaaucuccugcaccggcaccucauccgacguaggauccuacaacguugucucaugguaccaacaacaccccggcaaagcccccaaacucaucaucuacgaagucucacaacgccccuccggcgucuccaaccgcuucuccggcuccaaauccggcaacaccgccucccucaccaucuccggccuccaaaccgaagacgaagcagacuacuacugcugcuccuacgccggcucuuccaucuucguaauuuucggcggcggcacaaaagucacaguccucggccaacccaaagccgcacccuccgucacacucuucccccccuccuccgaagaacuccaagccaacaaagccacccuagucugccucgucucagacuucuaccccggcgccgucaccgucgccuggaaagccgacggcucacccgucaaaguaggcgucgaaaccaccaaacccucaaaacaaagcaacaacaaauacgccgccuccuccuaccuaucccucacccccgaacaauggaaaucucaccgcuccuacuccugccgagucacacacgaaggauccacagucgaaaaaaccgucgcccccgccgaaugcucc

SEQ ID NO: 54294 - RNA, 1353 nt, Artificial Sequence
  derived and/or modified sequence opt11 from Setoxaximab_HeavyChain1
gaaguacagcuccaacaaccuggcccagaacucgaaaaacccggcgccuccgucaagcucagcugcaaagccucaggauacucuuucacagacuacaacaugaacugggucaaacaaaacaacggagaaucacuagaauggaucgguaaaaucgaccccuacuacggcggcccauccuacaaccaaaaauucaaggacaaggcaacccucacagucgacaaaucauccuccaccgccuacaugcaacuuaaaucccucaccucagaagacucagcugucuacuacugcacccgcggcggcaaccgcgacugguacuucgacgucuggggcgccggcaccacccucaccgucuccgcagaguucgccucaaccaaaggacccucagucuucccccuagccccauccucaaaauccaccucaggaggcaccgccgcacuaggaugccuagucaaagacuacuuccccgaacccguaacggucuccuggaacucuggcgcacucaccuccggaguucauaccuucccagccguccuacaguccucgggccucuacucccucuccucagucgucaccguccccuccagcagccuaggcacacaaaccuacauaugcaacgucaaccacaaaccaucaaacaccaaagucgacaagaaagucgaaccaaaauccugcgacaaaacccacacaugcccaccgugcccagcacccgaauugcucggcggccccucaguauuccuauucccacccaaaccaaaagacacccuuaugauaucccgaacccccgaagucacaugcgucgucgucgacgucucccacgaagaccccgaagucaaauucaacugguacgucgacggcguggaaguucacaacgccaaaaccaaaccccgagaagaacaauacaacaguaccuaccgcgucgucucuguccucaccguccuacaccaagacuggcucaacgguaaagaauacaaauguaaaguauccaacaaagccuuaccagccccuaucgaaaagaccauaucuaaagccaaaggccaaccccgugaaccccaagucuacacacucccgcccucuagagacgaacuaaccaaaaaucaagucucccuaaccugccucguaaaagguuucuaccccucggacaucgccgucgaaugggaauccaacggacaacccgaaaacaacuacaaaacgaccccacccguccucgauuccgacggcucauucuuccucuacagcaaacucacaguugacaaauccagauggcaacaaggcaacguauucucaugcucagucaugcaugaagcccuccacaaccacuacacacaaaaaucucucucccucucccccggcaaa

SEQ ID NO: 54295 - RNA, 660 nt, Artificial Sequence
  derived and/or modified sequence opt11 from Setoxaximab_LightChain1
gacaucguccucucccaaucccccuccucacucgucgucuccgucggcgaaaaagucaccauguccugcaaauccucccaaucccuccucuacucccgaaaccaaaaaaacuaccucgccugguaccaacaaaaacccggccaaucccccaaaguccucaucuacugggcauccacccgcgaaucuggcgucccagaccgacucacaggcuccggcuccggcacagacuucacacucacaaucuccucugucaaagccgaagaccucgccgucuacuacugccaacaauacuacuccuacccucuaaccuucggcgccggcacaaaacucgaacucaaacgcaccgucgccgcucccuccguauucaucuucccacccuccgacgaacaauuaaaaucaggcaccgccucugucgucugccuccucaacaacuucuacccccgcgaagccaaaguccaauggaaagucgacaacgcccuccaauccggaaacucccaagaauccgucaccgaacaagacuccaaagacuccaccuacucccuauccuccaccuuaacccucucaaaagccgacuacgaaaaacacaaagucuacgccugcgaagucacccaccaaggccucuccucccccgucaccaaauccuucaacagaggcgaaugc

SEQ ID NO: 54296 - RNA, 1338 nt, Artificial Sequence
  derived and/or modified sequence opt11 from Sifalimumab_HeavyChain1
caaguccaacucguccaaucaggcgcagaagucaagaaaccaggagcauccgucaaagucuccugcaaagccuccggcuacaccuucacaucauacuccaucuccuggguccgccaagcccccggccaaggccuagaauggaugggcuggauauccguuuacaacggcaauaccaacuacgcccaaaaauuccaaggccgcgucaccaugacaaccgacaccuccacauccaccgcauaucuggaacuucgaucacuacgauccgacgacacagccgucuacuacugcgcccgcgacccuauagcagccggcuacuggggccaaggcacccuaguaaccguuagcucagccuccacaaaaggcccauccgucuucccucucgcccccuccuccaaauccacauccggcggaaccgccgcacuaggaugccuggucaaagacuacuuccccgaaccaguaaccguuucuuggaacuccggagcccuuaccagcggaguacacaccuuccccgccguccuccaauccuccggacuauacuccuuauccucaguagucacaguacccagcuccucacucggaacccaaaccuacauaugcaaugucaaccacaaacccucaaacaccaaaguugacaagaaagucgaacccaaaagcugcgacaaaacccacacaugcccaccaugccccgcccccgaacuccucggcggccccucagucuuccuauucccaccaaaaccaaaagacacccuaaugauaagccgaaccccagaaguaaccugcgucguagucgaugucucccacgaagaccccgaggucaaauucaacugguacgucgacggcguagaaguccacaacgcaaaaaccaaaccacgagaagaacaauacaacagcaccuaccgcguggucuccguccucaccguacuacaccaagacuggcucaacgguaaagaauacaaaugcaaagucuccaacaaagcccuuccagcaccaauagagaaaaccaucuccaaagccaaaggucaaccccgcgaaccacaagucuacacacuaccaccaucacgcgaagaaaugaccaaaaaccaagucucccucacaugccuagucaaaggcuucuaccccuccgacaucgccgucgaaugggaauccaacggccaacccgagaacaacuacaaaaccacaccacccguacucgacucugacggcucauucuuccuauacucaaaacuuaccgucgacaagucccgcuggcaacaaggaaacgucuucuccugcuccgucaugcacgaagcccuacacaaccacuacacccaaaaaucccucagccucucccccggaaaa

SEQ ID NO: 54297 - RNA, 645 nt, Artificial Sequence
  derived and/or modified sequence opt11 from Sifalimumab_LightChain1
gaaaucguccucacccaaucccccggcacccuaucccucucccccggcgaacgagccacacucuccugcagagccucccaaucagucuccuccaccuaccuagccugguaccaacaaaaacccggccaagcaccccgccuacucaucuacggcgccuccucccgcgccaccggcauccccgaccgcuucuccggcuccggcuccggcaccgacuucacacucaccaucucccgccucgaacccgaagacuucgcagucuacuacugccaacaauacggcuccucaccccgcaccuucggccaaggcaccaaagucgaaaucaaaagaaccgucgcagcccccuccgucuucaucuucccucccuccgacgaacaacucaaauccggcacagccuccgucgucugccuccucaacaacuucuacccccgcgaagccaaaguccaauggaaagucgacaacgcccuacaaucaggcaacucccaagaauccgucacugaacaagacucaaaagacuccaccuacucacucuccuccacccucacacucuccaaagccgauuacgaaaaacacaaagucuacgccugcgaagucacccaccaaggacucuccucccccgucaccaaaucauucaaccgcggcgaaugc

SEQ ID NO: 54298 - RNA, 1347 nt, Artificial Sequence
  derived and/or modified sequence opt11 from Siltuximab_HeavyChain1
gaaguacagcuaguagaaucaggaggcaaauuacucaaacccggcggaucccucaaacucuccugcgccgcauccggauucacauucuccucauucgcaaugagcugguuccgacaaucccccgaaaaacgccuagaauggguagccgagaucuccucaggcgguuccuacaccuacuaucccgacaccgucaccggaagauucaccaucucccgcgacaacgccaaaaacacccucuacuuagaaaugucuucgcuacgauccgaagacaccgccauguacuacugcgcccgaggccucuggggcuacuacgcacuagauuacuggggccaaggcaccucggucaccguaucuuccgccuccaccaaaggccccuccgucuuccccuuagcacccuccucaaaauccacuuccggcggaaccgccgcccucggaugccuagucaaagacuacuuucccgaacccgucacagucuccuggaacucaggcgcccucaccuccggcguccacacauucccagcuguacuccaauccuccggccucuacucccucuccuccgucgucaccguccccuccucuucccucggaacccaaaccuacaucugcaacgucaaccacaaaccuucaaacaccaaagucgacaagaaagucgaacccaaaucuugcgacaaaacccacacaugcccacccugccccgcccccgaacuccucggcggcccauccguauuccucuucccacccaaacccaaagacacgcucaugauuagccgaacccccgaaguaaccugcgucguagucgacgucucccacgaagacccagaagucaaauuuaacugguacgucgacggcgucgaaguacacaacgcaaaaaccaaaccucgcgaagaacaauacaacucaacauaccgagucgucucaguccucacaguccuccaccaagacuggcuaaacggcaaagaauacaaaugcaaagucucaaauaaagcccuccccgccccaauugagaaaacaauaucuaaagccaaaggacaaccccgagaaccccaagucuacacacucccucccucccgcgacgaacucaccaaaaaccaagucucacuaaccugccucgucaaaggcuucuaccccuccgacaucgccgucgaaugggaaucuaacggccaacccgaaaacaacuacaaaaccaccccacccguccucgacucagacggcuccuucuuccuauacucaaaacucaccguagacaaaucccguuggcaacaaggcaacguauucuccugcuccgucaugcacgaagcacuccacaaccauuacacccaaaaaucccucucccucagccccggcaaa

SEQ ID NO: 54299 - RNA, 639 nt, Artificial Sequence
  derived and/or modified sequence opt11 from Siltuximab_LightChain1
caaaucguccucauccaaucccccgccaucaugucagccucccccggcgaaaaagucaccaugaccugcuccgccucauccuccgucuccuacauguacugguaccaacaaaaacccggcuccucaccccgccuccuaaucuacgacaccuccaaccucgccucuggaguccccguccgcuucucaggcuccggcuccgguaccuccuacucccucaccaucucccgaauggaagccgaagacgccgccaccuacuacugccaacaaugguccggcuaccccuacaccuucggcggcggcacaaaacuagagaucaaacgaaccgucgccgcccccuccgucuucaucuucccacccuccgacgaacaacucaaauccggcacugccuccgucguuugccuccuaaacaacuucuacccccgcgaagccaaaguccaauggaaagucgacaacgcccuccaauccggcaacucccaagaauccguaaccgaacaagacuccaaagacuccaccuacucccucuccuccacccucacccucuccaaagccgacuacgaaaaacacaaagucuacgccugcgaagucacccaccaaggccucuccucacccgucaccaaaucauucaaccgcggcgaaugc

SEQ ID NO: 54300 - RNA, 1329 nt, Artificial Sequence
  derived and/or modified sequence opt11 from Simtuzumab_HeavyChain1
caaguccaacucgugcaauccggcgccgaagucaagaaacccggcgccuccgucaaaguuuccugcaaagccucaggcuacgcauucaccuacuaccuaaucgaauggguacgccaagcacccggacagggccuagaauggaucggcgucaucaacccaggcuccggcggcaccaacuacaacgaaaaauucaaaggcagagccaccauaaccgcagacaaaucaaccuccacagcauacauggaacucagcucacuccgcucagaagauaccgccguauacuucugcgcccgaaacuggaugaacuucgacuacuggggacaaggcaccaccgucaccguaucauccgccuccaccaaaggccccagcgucuucccacuugcacccugcucccgcuccacauccgaaagcaccgccgcccugggcugccucgucaaagacuacuuccccgaaccaguaacugucagcuggaacuccggagcccucaccucaggcguccacaccuucccagccguacuccaaucuucaggucuauauucccucuccuccgucgucaccguccccagcucauccuuagguacaaaaaccuacacaugcaacguagaccacaaaccauccaacaccaaagucgacaaacgcguagaaucuaaauacggcccacccugcccacccugcccagccccggaguuccucggcggccccuccgucuuccuauuucccccuaagccuaaagacacacucaugaucucccgaaccccagaagucacuugcgucgucgucgacgugucccaagaagaucccgaaguccaauucaacugguacgucgauggagucgaaguccacaacgcaaagaccaagccccgcgaagaacaauucaacuccacguaccgcgucguauccguccucaccguccuccaccaggacuggcucaacggcaaagaauauaaaugcaaagucuccaacaaaggccuaccuuccucaaucgagaaaaccaucucaaaagcaaaaggccaaccccgcgaaccccaaguguacacacucccacccucccaagaagaaaugaccaaaaaccaagucucccuaaccugccucguaaaaggcuucuaccccuccgacaucgcugucgaaugggaaucaaacggccaaccagagaacaacuacaaaaccacacccccaguccucgacagcgacggcuccuucuuccucuacagccgccucaccgucgacaaaagccgcuggcaagaaggcaacgucuucucuugcuccgucaugcacgaagcccuacacaaccauuacacccaaaaaucgcucucccucucacuuggaaaa

SEQ ID NO: 54301 - RNA, 657 nt, Artificial Sequence
  derived and/or modified sequence opt11 from Simtuzumab_LightChain1
gacaucgucaugacccaaacaccccucucccuauccguaacccccggccaacccgccuccaucuccugcagauccuccaaaucccuccugcacuccaacggcaacaccuaccuuuacugguuccuacaaaaacccggccaaucaccccaauuccuaaucuaccgcaugagcaaccucgccuccggaguccccgaccgcuucuccggaucaggcuccggcaccgacuucacccucaaaaucucccgagucgaagccgaagacgucggcgucuacuacugcaugcaacaccucgaauacccauacaccuucggcggcggcaccaaagucgaaaucaaacgcaccgucgccgcccccuccgucuucaucuucccacccucagacgaacaacucaaaucaggcaccgccuccgucgucugccuccuaaacaacuucuacccacgcgaagccaaaguccaauggaaagucgacaacgcccuccaauccggaaacucacaagaauccgucaccgaacaagacuccaaagacuccaccuacucccucuccuccacccuaacccucagcaaagccgacuacgaaaaacacaaagucuacgccugcgaagucacccaccaaggacuauccucccccguuaccaaaucauucaaccgaggcgaaugc

SEQ ID NO: 54302 - RNA, 1347 nt, Artificial Sequence
  derived and/or modified sequence opt11 from Sirukumab_HeavyChain1
gaaguccagcucgucgaauccggcggaggccucguccaacccggcggcucccuccgccuauccugcgcagccuccggcuucaccuucucccccuucgcaauguccuggguccgccaagcccccggcaaaggacucgaauggguagccaaaaucagcccgggcggcuccuggaccuacuacuccgacaccgucaccggccgcuucacaaucucccgagacaacgcaaaaaacucacucuaccuccaaaugaauagccuccgugccgaagacacugccgucuacuacugcgcacgccaacuauggggcuacuacgcacucgacauuuggggacaaggcaccaccguaaccgucuccucagcuucaaccaaaggccccuccguauucccccucgcuccauccagcaaaucuaccuccgggggcaccgcagcacuaggaugccucguaaaagacuacuuccccgaacccgucacagucucuuggaacucaggugcccucacaucuggcguccauacguuccccgcuguccuacaauccucaggacucuacucccucucaucaguagucaccguccccuccuccucccucggaacccaaacauacauaugcaacgucaaccacaaacccuccaacaccaaaguagacaaaaaaguagaaccaaaaucgugcgacaaaacccacaccugcccacccugccccgcucccgaacuccuaggcggcccaagcguuuuccuuuuccccccaaaacccaaagacacccuaaugauaucucgaacccccgaagucaccugcgucguagucgacgucucccacgaagaccccgaaguaaaauuuaacugguacgucgauggcgucgaaguacauaaugcaaaaaccaaaccccgcgaagaacaauacaauucaaccuaccgaguugucucaguacuaacuguacuccaccaagacuggcucaacggcaaagaauacaaaugcaaagucuccaacaaagcacucccagcaccaaucgaaaaaaccaucuccaaagccaaaggacagccccgcgaaccacaagucuacacccucccaccaucacgcgacgagcucaccaaaaaucaagucucacucacaugccuagucaaaggcuucuaccccucagacaucgccgucgaaugggaauccaacgggcaacccgaaaacaacuacaaaaccacuccacccguacucgacuccgacggcuccuucuuccuauacuccaaacucaccguagacaaaucacgcuggcaacaaggcaacgucuucuccugcagcgucaugcacgaagcccuccacaaccacuacacccaaaaaagccucucacucucacccggcaaa

SEQ ID NO: 54303 - RNA, 639 nt, Artificial Sequence
  derived and/or modified sequence opt11 from Sirukumab_LightChain1
gaaaucguccucacccaaucccccgccacccucucacucucccccggcgaacgcgccacccucuccugcuccgcauccaucuccgucuccuacauguacugguaccaacaaaaacccggccaagcaccccgccuccucaucuacgacauguccaaccucgccuccggcauccccgcccgcuucuccggcuccggcuccggcaccgacuucacccucaccaucuccucccucgaacccgaagacuucgccguauacuacugcaugcaaugguccggcuaccccuacaccuucggcggcggaaccaaagucgaaaucaaacgcaccgucgccgcccccuccguauucaucuucccacccuccgacgaacaacucaaauccggcaccgccuccgucguuugccuacucaacaacuucuacccccgcgaagccaaaguccaauggaaagucgacaacgcccuacaauccggcaacucccaagaauccguaaccgaacaagacucaaaagacuccaccuacucacuaucaucaacccuuacccucuccaaagccgacuacgaaaaacacaaagucuacgccugcgaaguaacccaccaaggccuaucaucccccgucaccaaauccuucaaccgcggcgaaugc

SEQ ID NO: 54304 - RNA, 1338 nt, Artificial Sequence
  derived and/or modified sequence opt11 from Sofituzumab_vedotin_HeavyChain1
gaaguccagcucgucgaauccggcggcggccuaguccaacccggaggcucccuccgacuaucaugcgcagccucaggauacucaaucacaaaugacuacgcauggaacuggguccgccaagccccaggcaagggccuagaaugggucggauacauaucuuacucaggcuacaccaccuacaacccaagccuaaaaucacgcuucacaaucucccgcgacacauccaaaaacacacucuaccuccaaaugaacagccuacgugcagaagacaccgccgucuacuacugcgccagauggaccucaggccucgacuacuggggccagggaacccuugucaccgucuccucagccuccacaaagggccccucagucuucccccuugcacccuccuccaaauccaccuccggaggaaccgccgcccucggcugccuagucaaagauuacuucccagaacccgucaccgucucguggaacuccggcgcucucacaucaggcguccacaccuucccagcaguccuacaauccuccggccucuacucacucuccuccguagucacaguacccuccuccucccuaggcacccaaaccuacaucuguaacgucaaccacaaaccaucaaacaccaaagucgacaagaaaguagaacccaaauccugcgacaaaacacacacaugcccacccugccccgccccugaacuacucggaggccccuccgucuuccucuucccacccaaacccaaagacacccuaaugauuucccgcacccccgagguaacauguguaguagucgacgucucucacgaagacccugaagucaaauucaacugguacgucgacggcguagaaguccacaacgccaaaaccaaaccccgcgaagaacaauacaacuccaccuaccguguagucuccguccucaccguccuccaccaagauuggcucaacggcaaagaauauaaaugcaaggucuccaacaaagcacuccccgccccaauagagaaaaccaucucaaaagcuaaaggccaaccacgcgaaccccaaguauacacccugcccccuucacgcgaagaaaugaccaaaaaccaagucucccuaaccugccucgucaaagguuucuacccauccgacauagcagucgaaugggaauccaacggacaaccagaaaacaacuacaaaacaacaccacccguccucgacuccgacggaucauucuuccucuauucaaaacuaaccgucgacaaaucccgcuggcaacaaggcaacgucuucuccugcuccgucaugcacgaagcucuacacaaccacuacacacaaaaaucccuaucccucucaccuggcaaa

SEQ ID NO: 54305 - RNA, 642 nt, Artificial Sequence
  derived and/or modified sequence opt11 from Sofituzumab_vedotin_LightChain1
gacauccaaaugacccaaucccccucaucccucuccgccucagucggcgaccgagucaccauaaccugcaaagccuccgaccucauccacaacuggcucgccugguaccaacaaaaacccggcaaagcacccaaacuccucaucuacggagcaaccucacucgaaaccggcgucccauccagauucucaggcuccggcuccggcaccgacuucacccuaaccaucuccucacuccaacccgaagacuucgccaccuacuacugccaacaauacuggaccacccccuucacuuucggccaaggcaccaaagucgaaaucaaacgcaccgucgcugcccccuccgucuucaucuucccucccucagacgagcaacucaaauccggcacagccuccgucguaugccuccucaacaacuucuacccccgcgaagccaaaguccaauggaaagucgacaacgcccuccaauccgguaacucccaagaaucagucaccgaacaagacuccaaagacuccaccuacucccucuccucaacccucacccucuccaaagccgacuacgaaaaacacaaagucuacgccugcgaagucacccaccaaggccucuccucacccgucaccaaauccuucaaccgcggcgaaugc

SEQ ID NO: 54306 - RNA, 1323 nt, Artificial Sequence
  derived and/or modified sequence opt11 from Solanezumab_HeavyChain1
gaaguacagcuagucgaauccggcggcggauuaguccaacccggaggcagccuccgucucucaugcgccgccucaggauucaccuucucccgcuacuccauguccuggguccgccaagccccaggaaaaggccucgaacuugucgcacaaaucaacagcguagguaacucaacauacuaccccgacaccgucaaaggcagauucacaaucucacgagacaacgccaaaaacacccucuaccuacaaaugaacucccuccgcgcagaagacaccgcagucuauuacugcgccuccggcgacuacuggggucaagguacccuagucacagucucauccgcauccaccaaaggccccuccgucuucccacucgcacccuccucaaaauccaccucuggaggaacagccgcccucggcugccuaguaaaagacuacuuccccgaacccgucaccgucucuuggaacucaggagcccucaccuccggaguccacacuuuccccgcaguacugcaauccuccggccuauacucccucucauccgucguuaccguccccuccagcucacuaggcacccaaaccuacaucugcaacgucaaccacaaacccucuaacacuaaagucgacaaaaaagucgaacccaaauccugcgacaaaacccacaccugccccccaugucccgcgcccgaacuccucgguggccccucuguauuccucuuuccccccaaacccaaagacacccucaugauaucccgcaccccagaaguuaccugcgucgucgucgacgucucccacgaagaccccgaagucaaauucaacugguacguagacggcgucgaaguccacaacgcaaaaacaaaaccacgagaagaacaauacaacuccaccuaccgugucgucuccguacucaccguccuccaccaggacuggcuaaacggaaaggaauacaaaugcaaaguuucaaacaaagcccucccagcccccaucgaaaaaaccaucucuaaagcaaaaggccaaccacgugaaccccaagucuacacccucccacccucacgcgacgaacucaccaaaaaccaagucucgcuaaccugucucgucaaaggcuucuauccaucagacaucgcagucgaaugggaauccaacggacaacccgaaaacaacuacaaaacaaccccccccguccucgacuccgacggcuccuucuuucucuacagcaaacuaaccgucgacaaaucccgauggcaacaaggcaacgucuuuuccugcuccgucaugcaugaagcccugcacaaccacuacacacaaaaaucccucagccucuccccaggu

SEQ ID NO: 54307 - RNA, 1326 nt, Artificial Sequence
  derived and/or modified sequence opt11 from Solanezumab_HeavyChain
gaaguacaacucgucgaaucaggaggaggccuaguucaacccggaggcucccuuagacucucaugcgccgccucagguuucaccuucagccgauacuccaugucuuggguccgccaagcaccugguaaaggccucgaacuugucgcccaaauaaacuccgugggaaacuccaccuacuaucccgacaccgucaaaggccgcuucaccaucucccgagacaacgccaaaaacacccuuuaccuacaaaugaacucacuccgagccgaagacaccgcagucuacuacugcgcguccggggacuacuggggccagggcacccucguaaccguguccuccgccuccacaaaaggccccagcguauucccccucgccccauccuccaaauccaccuccggcggcaccgcugcccucggaugccucgucaaagacuauuuccccgaacccgucaccguuagcuggaacucaggcgcccucacaucaggaguacacaccuuccccgcaguacuccaaucuucaggacucuacucgcuaucuuccgucguaaccguccccuccuccucccucggcacacaaaccuacaucugcaauguaaaccacaaacccagcaauacaaaagucgacaagaaagucgaacccaaaagcugcgacaaaacccacaccuguccacccugccccgcccccgaacuccuaggcggccccucggucuuccucuucccacccaaacccaaagacacucucaugaucucccgcacaccagaaguaaccugcgucgucgucgacgucucccaugaagaccccgaagucaaauucaacugguacgucgacggcgucgaaguccacaacgcaaaaaccaaaccccgagaagaacaauacaacuccacauaccgcgucgucuccguccucacaguacuacaucaagacuggcucaacggcaaagaauacaaauguaaagucuccaauaaagcccuacccgccccaaucgagaaaaccauaucaaaagccaaaggccaaccccgcgaaccccaagucuacacccucccacccucgcgcgacgaacucacaaagaaccaagucucacucacaugucucgucaaaggcuucuaccccuccgacaucgcagucgaaugggaauccaauggacaacccgaaaacaacuacaaaaccaccccaccaguccucgacuccgacggaucauucuuccucuacucuaaacucaccgucgacaaaucccgcuggcaacaaggcaacgucuucuccugcuccgucaugcacgaagcacuccacaaccauuacacccaaaaaucccucucacucucccccggaaaa

SEQ ID NO: 54308 - RNA, 657 nt, Artificial Sequence
  derived and/or modified sequence opt11 from Solanezumab_LightChain1
gacgucgucaugacacaaucaccccucucccuccccguaacacucggacaacccgccuccauauccugccgauccucccaaucccuaaucuacuccgacggaaacgccuaccuccacugguuccuccaaaaacccggccaaucaccccgccuccucaucuacaaagucuccaaccgcuucuccggcguccccgaccgcuucuccggcuccggcuccggcacagacuucacccucaaaaucucccgcgucgaagccgaagacguaggagucuacuacugcucccaauccacccacguccccuggaccuucggccaaggcaccaaagucgaaaucaaacgaaccgucgccgcccccuccgucuucauauucccacccucagacgaacaacucaaaucaggcacagccucagucgucugccuccucaacaacuucuacccccgcgaagccaaaguccaauggaaagucgacaacgcccuccaauccggcaacucacaagaauccgucaccgaacaagacucaaaagacuccaccuacucucucuccucaacccugacccuuuccaaagccgacuacgaaaaacacaaagucuaugccugcgaagucacccaccaaggccucuccucacccgucaccaaauccuucaaccgcggcgaaugc

SEQ ID NO: 54309 - RNA, 1506 nt, Artificial Sequence
  derived and/or modified sequence opt11 from Solitomab_HeavyChain1
gaacucguaaugacacaaucgccaagcagccuaaccgucacagcaggcgaaaaagucaccaugagcugcaaaucgagccagagccuccuaaacucaggaaaccagaaaaacuacuuaaccugguaccaacaaaaacccggccaaccacccaaacuucucauauacugggccagcacacgcgaauccggaguccccgacagauucacagggucggguucaggcaccgacuucacccuaaccaucuccucgguccaagccgaagaccuagccgucuacuauugccaaaacgacuacuccuacccacuaaccuucggggcuggaaccaaacucgaaaucaaaggaggcggcggcucaggaggcgggggauccggaggaggcggcuccgagguacaacuccucgaacaaagcggggcagaacucguacgcccaggcaccagcguaaaaauaagcugcaaagccagcggcuacgcauucacaaacuacuggcucggcugggucaagcaacggcccggacacggacucgaguggauaggcgacaucuucccaggcagcggcaacauacacuacaaugaaaaauucaaaggaaaagcaacacuaacagccgacaaaucaagcagcacagccuacaugcaacuauccagccucaccuucgaagacagcgccgucuacuucugcgcccgacuuagaaacugggacgaacccauggacuacuggggacaaggaacaacagucacagucucaagcggaggcggaggaucagacguacaacucguccaaagcggagccgaagucaagaaaccaggcgcgagcgugaaaguaagcugcaaagcaagcggcuacacauucacccgauacacaaugcauugggucagacaagcacccggacaaggacucgaauggaucggcuacaucaacccaagccgcggcuacaccaacuacgcagacagcguaaaaggccgcuucaccaucaccacugacaaauccacuuccaccgccuauauggaacugagcagccuucgcuccgaagacaccgcaaccuacuacugcgcaagguacuaugaugaccacuacugccucgacuacuggggacaaggaaccacaguaaccguuucuuccggagaaggaaccagcaccggcucaggaggcucagguggcagcgggggcgcagacgacauaguacucacacaaucgcccgcuacccuuagccugucccccggcgaacgcgccacccugaguugccgagccucccaaagcguaagcuacaugaacugguaucaacaaaaacccggcaaagccccaaagagguggauauacgacaccucaaaaguggccagcggagugcccgcacgcuucagcggaagcggaaguggcaccgacuacagccuaacaauaaacagccuagaggccgaagacgcagcaaccuacuacugccaacaaugguccagcaacccccuaacauucggcggcggcacaaaaguagaaauaaagcaccaucaccaccaccac

SEQ ID NO: 54310 - RNA, 1506 nt, Artificial Sequence
  derived and/or modified sequence opt11 from Solitomab_SingleChain
gagcuaguaaugacacaaagccccucaagccuaacgguaacagcaggagaaaaaguaaccaugagcugcaaguccucccaaucccuccuaaacuccggaaaccagaaaaauuaccucaccugguaccaacaaaaaccaggacaaccacccaagcuccuaaucuacugggcgagcacccgcgaauccggaguccccgacagguucacaggcucuggcucaggcaccgacuuuacccuaacaauaagcucaguacaagcagaagaccuagcugucuacuacugccagaacgacuacagcuaccccuuaacauuuggggccggaaccaaacucgaaaucaaaggaggcggcggaagcggcggaggcggauccggaggcggcggaagcgaaguccaacuccuagaacaaucaggagcagaauuaguccgacccggcacaagcguaaaaaucagcugcaaagcaucaggauacgcauucaccaauuacuggcuaggaugggucaagcaaagacccggacacggccuggaauggaucggcgacauauucccaggaagcggaaacauccacuacaacgaaaaauucaagggaaaagcaacccuaaccgcugacaagagcagcuccaccgcauacaugcaacucucaucacuaaccuuugaagacuccgccguauacuucugcgccaggcuaaggaacugggacgaacccauggacuacuggggacaaggcaccacgguaaccgucucaaguggaggaggaggcuccgacguccaauuaguacaauccggcgcagaagucaagaaaccaggagcaagcgucaaagucuccuguaaagcauccgguuacaccuucacacgcuauaccaugcacuggguacgacaagcacccggccaaggacuggaauggauuggauacaucaaccccuccagaggcuacacaaacuacgccgacagcguaaaagggagauucaccauaaccaccgacaaaagcacaucaaccgccuacauggaacuauccagccugcgcagcgaagauacagcaaccuacuacugcgcaagguacuacgacgaucacuacugccucgacuacugggggcaaggaaccacagucaccguauccuccggagagggcacuuccaccggcaguggcggaucgggcggcagcggcggcgcggacgacaucguacucacacaaucacccgccacccucucccucuccccuggcgaacgagccacccucucaugccgcgccagccaaagcgugucauacaugaacugguaccaacaaaaaccaggcaaagcacccaaacgauggauauacgacaccuccaaagucgccucaggcguacccgcacgcuucagcggaaguggaucaggcacagacuacagccucacaaucaacagccuagaagcagaagacgcagcaaccuacuacugccagcaaugguccuccaacccccuaaccuucggaggcggaaccaaaguggaaaucaagcaccaccaccaccaccac

SEQ ID NO: 54311 - RNA, 702 nt, Artificial Sequence
  derived and/or modified sequence opt11 from Sonepcizumab_LightChain_Precursor
auguccguccccacccaaguacucggccuccuccuccucuggcucaccgacgcccgaugcgaaaccaccgucacccaaucacccucauuccucuccgccuccguaggcgaccgcgucaccauaaccugcaucaccaccaccgacaucgacgacgacaugaacugguuccaacaagaacccggcaaagcccccaaacuacuaaucucagaaggcaacauccuccgcccaggcgucccaucccgcuucuccuccuccggcuacggcacagacuucacccuaaccaucuccaaacuccaacccgaagacuucgccaccuacuacugccuccaauccgacaaccuccccuucacuuucggccaaggcacuaaacucgaaaucaaacgcaccgucgcagcccccuccgucuucaucuucccacccuccgacgagcaacuaaaaucaggcaccgccuccgucgucugcuuacuuaacaacuucuacccccgcgaagccaaaguccaauggaaagucgacaacgcccuccaauccggcaacucccaagaauccguaaccgaacaagacuccaaagacuccaccuacucccuauccuccacccucacccucucaaaagccgacuacgaaaaacacaaaguauacgccugcgaagucacccaccaaggccuauccucccccguaaccaaauccuucaaccguggcgaaugc

SEQ ID NO: 54312 - RNA, 1365 nt, Artificial Sequence
  derived and/or modified sequence opt11 from Sonepcizumab_gamma1-Chain_Precursor
auggagugguccugggucuuccucuucuuccuuuccguaaccaccggaguccacuccgagguccaacucguccaauccggcgccgaagucaagaaacccggcgaaucacucaaaauaucgugccaauccuucggcuacaucuucaucgaccacaccauccacuggaugcgccagaugccgggacaaggacucgaauggaugggagccaucagcccucgccacgacaucaccaaauacaacgaaauguuccgaggccaagucaccaucuccgcagacaaaucguccuccaccgccuaccuacaauggaguucacucaaagcaucagacaccgccauguacuuuugcgcccgcggcggcuucuacggcuccaccaucugguucgacuucuggggccaaggcaccaugguaaccgucuccucggcauccaccaaaggcccauccgucuucccacuagcccccuccuccaaauccacauccggaggcacggccgcccucggcugucucgucaaagacuacuucccggaaccagucaccgucuccuggaacuccggcgcccucacuuccggaguccacaccuuccccgcaguccuccaauccucaggccuauacucccucuccuccguaguaaccgucccguccuccagcuuaggcacgcaaacauacaucugcaacguaaaucacaaaccaucaaacaccaaagucgacaaacgaguagcacccgaacuccugggcggccccuccgucuuccuauuucccccgaaacccaaagacacccucaugaucucccgcacccccgaaguuaccugcgucgucgucgacguaagccacgaggaccccgaagucaaauucaacugguacgucgacggaguugaaguacacaaugccaaaacaaaaccccgggaagaacaauacaacuccaccuaccgaguagucuccguccuuaccguacuccaccaagacuggcuaaacggcaaagaauacaaaugcaaagucuccaacaaagcccucccggcgcccaucgagaaaacaaucuccaaagccaaaggccagccccgggaaccucaaguauacacccucccacccucucgcgaagaaaugaccaaaaaccaagucucccucacuugccuugucaaaggcuucuaccccuccgacaucgcagucgaaugggaauccaacggccaaccugaaaacaauuacaaaaccacacccccaguccuagacuccgacggcuccuucuucuuauacucaaaacucaccgucgacaaaucacgcuggcaacaagguaacguauucucaugcuccgucaugcacgaagcccuccacaaccacuauacccagaaaucccucucccucucacccggcaaa

SEQ ID NO: 54313 - RNA, 1338 nt, Artificial Sequence
  derived and/or modified sequence opt11 from Stamulumab_HeavyChain1
guucaacucguccaauccggcgccgaagucaaaaaacccggcgccagcgucaaaguauccugcaaagcauccggcuacacauucaccuccuacuacaugcacuggguccgccaagcccccgggcaaggacuagaauggaugggcaucauuaaucccuccggcgguuccaccuccuacgcccaaaaauuccaaggacgcgucaccaugacccgagacaccuccaccuccaccguauacauggaacucucaagccuacgaagcgaagacaccgccgucuacuacugcgcccgagacgaaaacuggggcuucgaccccuggggccaaggaacccucgucacagucucgagcgccuccacaaaaggcccuuccgucuucccccuagccccgagcagcaaauccaccucaggcggcaccgccgcccucggcugccuagucaaagacuacuuccccgaacccgucaccgucagcuggaacuccggcgcacuaacaucaggcguccauacauuccccgccguacuucaaucuuccggccuauacucacuuucaucaguaguaaccguucccucaagcucccuaggcacacaaaccuacauaugcaacgucaaccauaaaccauccaauaccaaagucgacaaaaaaguagaacccaaaagcugcgacaaaacccacaccugcccccccugcccugccccagaacuccucggcgggcccuccgucuuccuauucccccccaagcccaaagacacccuaaugaucuccagaaccccugaagucaccugcgucguaguagacgucucccacgaagaccccgaagugaaauucaacugguacgucgacggagucgaaguucacaacgccaaaacuaaacccagagaagaacaauacaacuccacauaccgagucgucuccguccucacaguccuacaccaagacugguugaacggaaaagaauacaaaugcaaagucuccaacaaagcccugcccgcccccaucgaaaaaaccauuucaaaagccaaaggacaaccaagagaaccccaaguauacacuuuaccccccucccgcgaagaaaugaccaaaaaccaagucucccucacaugccucgucaaaggcuucuaccccagcgacauagccguagaaugggaaagcaacggccaacccgaaaacaacuacaaaaccacuccccccguacuugauucagacggcuccuucuuccucuacucaaaacucaccgucgacaaaucccgauggcaacaaggcaacgucuucucaugcuccgucaugcacgaagcccuacacaaccacuacacccaaaaaucccucucccucuccccaggaaaa

SEQ ID NO: 54314 - RNA, 633 nt, Artificial Sequence
  derived and/or modified sequence opt11 from Stamulumab_LightChain1
uccuacgaacucacccaaccccccuccgucuccgucucccccggccaaaccgccuccaucacaugcagcggccacgcccucggcgacaaauucgucuccugguaccaacaaaaacccggacaaucccccguccuagucaucuacgacgacacccaacgacccucaggcauccccgaacgcuucuccggcuccaacuccggcaacaccgcaacccucaccaucuccggcacccaagccauggacgaagccgacuacuacugccaagccugggacuccuccuucguauucggcggaggcacaaaagucaccguccucggccaacccaaagccgccccauccgucacccucuucccacccucuucagaagaacuccaagccaacaaagccacccuugucugccuaaucuccgacuucuaccccggcgccgucaccguagccuggaaagcagacuccucccccgucaaagccggcgucgaaaccaccacccccuccaaacaaucuaacaacaaauacgccgccuccagcuaccucucccucacccccgaacaauggaaaucacacagauccuacuccugccaagucacacacgaaggcuccaccgucgaaaaaaccgucgcccccaccgaaugcucc

SEQ ID NO: 54315 - RNA, 1356 nt, Artificial Sequence
  derived and/or modified sequence opt11 from Suptavumab_HeavyChain1
gaaguccaauuagucgaaucaggcggcgaccucguccaacccggccgaucccuccgccuguccugcguagcauccggcuucaccuucgacgacuacgccaugcacuggguccgacaagcgcccggcaaaggacuagaaugggucuccggagucaguuggucgggauccaccguuggcuacgccgauucagucaaaggccgcuuuaccgucucacgcgacaacgcccaaaaaucccucuaccuacagaugaacucccuccgcgccgaagacaccgcucuauacuacugcguaaaagacgcauacaaauucaacuacuacuacuacggccucgacgucuggggccagggaacaacagucacagucuccuccgccuccaccaaaggccccuccgucuucccccuagcccccuccucaaaaucuacaucuggaggcacagccgcucucggaugccucguaaaagacuacuuccccgagccaguaaccgucagcuggaacuccggugcacuaacaucaggaguccacaccuuccccgcaguccuacaauccucaggccucuacagccuauccuccguugucacagucccaucauccucucucggaacacaaaccuacauaugcaacgucaaccacaaaccauccaacaccaaaguagacaagaaagucgaaccaaaauccugcgacaaaacccacaccuguccacccugccccgcccccgaacuccucggaggcccaucagucuuccucuucccacccaaacccaaagacacacucaugaucucccgcacccccgaagucacaugcgucgucguagacguaucccacgaagaccccgaaguaaaauucaacugguacgucgacggcgucgaaguccacaacgccaaaaccaaaccccgcgaagaacaauacaacuccaccuacagagucgucuccguccucaccguccuacaccaagacuggcuuaacggcaaagaauacaaaugcaaagucucuaacaaagcccuucccgcaccaaucgaaaagaccaucagcaaagcaaaaggucaaccucgcgaaccccaagucuacacccuacccccuucccgcgacgaacucaccaaaaaccaagucucccucacaugccucgucaaaggcuuuuaccccuccgacaucgccguggaaugggaaagcaacggccaacccgaaaacaacuacaaaaccaccccacccguccuagacuccgacggcucauucuuccuauacuccaaacucaccguggacaaaucacgcuggcaacaaggcaacgucuucuccugcuccgucaugcacgaggcccuccacaaccacuacacacaaaaaucccucucacuaucccccgga

SEQ ID NO: 54316 - RNA, 642 nt, Artificial Sequence
  derived and/or modified sequence opt11 from Suptavumab_LightChain1
gaaaucguaaugacacaaucacccgcaacccucuccgucucccccggcgaacgcgcaacccuauccugccgcgccucccaaaccauccucuccaaccucgccugguaccuccaaaaacccggacaagccccccgacuccucaucuacggcgccuccacacgcgcaaccggacucccagcccgcuucuccggcuccggcuccggcaccgaauucacccuaaccaucuccucccuccaauccgaagacuucgccgucuacuacugccaacaauacaacaacuggccacucacauucggcggcggcaccaaagucgaaaucaaacgcaccgucgccgcccccucagucuucaucuucccacccucagacgaacaacucaaaucaggcaccgccucagucguaugccuccuaaacaacuucuacccccgcgaagccaaaguccaauggaaagucgauaacgcccuccaauccggcaacucccaagaauccguaaccgaacaagacuccaaagacuccaccuacucccucucauccacccucacccucuccaaagccgacuacgaaaaacacaaaguuuacgccugcgaagucacacaccaaggacucuccucccccgucaccaaauccuucaacagaggcgaaugc

SEQ ID NO: 54317 - RNA, 1344 nt, Artificial Sequence
  derived and/or modified sequence opt11 from Suvizumab_HeavyChain1
caaguccagcuaguccaauccggcgccgaagucaagaaacccggcgccuccgucaaagucucaugcaaagccucaggauacaccuucacgaacuccuggaucggcugguuccgacaagcccccggccaaggccucgaauggaucggcgacaucuaccccggaggcggcuacaccaacuacaacgagaucuucaaaggaaaagccaccaugaccgccgacaccagcaccaacacugccuacauggaacucuccucccugcgaucagaagacaccgccgucuacuacugcuccagaggaaucccaggcuacgccauggacuacuggggacaaggcacccucgucaccguuucaagcgccucaacaaaaggcccauccgucuucccccuagccccauccuccaaaucaacaagcggaggcaccgccgcucuaggaugccucgucaaagacuacuucccggaaccaguuacaguaucauggaacucaggcgcccucaccuccggaguccacaccuuccccgcaguacuccaauccuccggccuauacucccucucuuccguggucaccgucccauccucaagccucgguacccaaacauacaucugcaacgucaaccacaaacccuccaacacaaaaguagacaagaaaguagaacccaaauccugcgacaaaacccacacaugcccucccugcccagcccccgagcuccucggcggacccuccgucuuccuguuucccccuaaacccaaagauacccucaugaucucacgcaccccagaaguaaccugcgucgucgucgacguaucccacgaagacccagaaguaaaauucaacugguacguagacggagucgaaguccacaaugcaaaaaccaaaccucgcgaagaacaauacaacuccaccuaccgagucgucuccguacuaacaguccuccaccaagacuggcuaaacggaaaagaauacaaaugcaaagucagcaacaaagcccuccccgcccccauagagaaaaccauauccaaagccaaaggacaaccucgagaaccccaagucuacacccuaccaccuucccgcgacgaacucaccaaaaaccaaguaagccugacaugccucgucaaaggcuucuaccccucugacaucgccguugaaugggaaucaaacggccaaccagaaaacaauuacaaaaccaccccacccguacucgacuccgacggcucauucuuccucuacuccaaacuuaccgucgauaaaucccgcuggcaacaagggaacguauucuccugcucaguaaugcacgaagcccuacauaaccacuacacccagaaaagccuaucacucuccccaggcaag

SEQ ID NO: 54318 - RNA, 660 nt, Artificial Sequence
  derived and/or modified sequence opt11 from Suvizumab_LightChain1
gacauccaaaugacccaacgccccgacagccucuccgccuccgucggugaccgcgucaccaugagcugcaaauccucacaaucccuccucaacuccggcgaccagaaaaacuaccucaccugguaccaacaaaaacccggacaaccacccaaacuccucaucuacugggccuccacaggcgaauccggcguccccgaccgauucucaggcuccggcuccggaaccgacuucaccuucaccauaagcucccuccaacccgaagacaucgccaccuacuacugccaaaacgacuacucauaccccuggaccuucggccaaggcaccaaaguagaaaucaaacgcaccgucgccgcccccuccgucuucaucuucccacccuccgacgaacaacuuaaaucaggcaccgccuccgucgucugccuccucaacaacuucuacccccgcgaagccaaaguccaauggaaagucgacaacgcccuccaauccggcaacucccaagaauccgucaccgaacaagacuccaaagacuccaccuacucccuauccuccacccucacccucagcaaagccgacuacgaaaaacacaaagucuacgccugcgaagucacccaccaaggucuauccucccccgucaccaaauccuucaaccgcggcgaaugc

SEQ ID NO: 54319 - RNA, 1350 nt, Artificial Sequence
  derived and/or modified sequence opt11 from Tabalumab_HeavyChain1
cagguccaacuccaacaauggggcgcaggccuccucaaacccuccgaaacccucucacucacaugcgcgguauacggcggcuccuucuccggcuacuacugguccuggauccgccaacccccaggaaaaggccuagaauggaucggcgaaauuaaccacuccggcagcacaaacuacaaccccucacuaaaaucccgaguaaccaucuccgucgacacuucuaaaaaucaauucucacucaaacucucuagcguaaccgccgccgacaccgccgucuacuacugugcccgcggcuacuacgacauccucacaggcuacuacuacuacuucgacuacuggggccaaggcacccuaguaaccgucuccucagcuuccacuaaaggaccauccgucuucccucucgccccaugcucacgguccaccucggaauccaccgccgcucuaggcugccucgucaaagacuacuucccggaacccgucaccgucuccuggaacuccggcgcccuaacauccggcguacacacauuccccgccguccuacaguccucuggccucuacucacucuccagcguagucaccguccccagcuccucccucggcaccaaaaccuacacuugcaacguugaccacaagcccuccaacaccaaagucgauaaacgcgucgaauccaaauacggaccacccugcccgcccugcccagcccccgaguuccucggcggcccuuccgucuuccucuucccacccaagcccaaagacacccucaugauaucgcgcacccccgaagucaccuguguaguagucgacgucucccaagaagaccccgaaguccaauucaacugguacgucgacggcgucgaaguccacaacgccaagaccaagccaagagaagaacaauucaacucuaccuaccgcgucguuuccguacucaccguacuccaccaagacuggcuaaacggaaaagaguacaaaugcaaggucuccaacaaaggccuacccuccuccaucgaaaagacaaucucaaaagcaaaaggccaaccaagagaaccccaaguauacacgcucccuccuagccaagaggaaaugaccaaaaaccaaguaucacuaaccugcuuagucaaagguuucuaccccuccgacaucgccguagaaugggaauccaacggucaaccugaaaacaacuacaaaaccacuccacccguacucgacuccgacggcucauucuuccuauacucccgacucacaguagacaaaagccguuggcaagaaggcaacgucuucuccugcucagucaugcacgaagcccuacacaaccacuacacccaaaaaucccucucacucucacuaggcaaa

SEQ ID NO: 54320 - RNA, 642 nt, Artificial Sequence
  derived and/or modified sequence opt11 from Tabalumab_LightChain1
gaaaucguccucacacaaucccccgccacccucucccuaucccccggcgaacgcgcaacccuuagcugccgcgccucccaaagcgucucccgcuaccuugcaugguaccaacaaaaacccggucaagcaccccgacuccucauauacgacgccuccaaccgagccaccggcauccccgcccgcuucuccggcucaggcucuggcacagacuccacccuaaccaucuccucccucgaacccgaagacuucgccgucuacuacugccaacaacgaucaaacuggccccgcaccuucggacaaggcaccaaagucgagaucaaacgcaccguagccgcccccuccgucuucaucuucccacccuccgacgaacaacucaaauccggcaccgccuccgucgucugccuccucaacaacuuuuacccccgcgaagccaaaguccaauggaaagucgacaacgcccuccaauccggcaacucacaagaauccguaaccgaacaagauuccaaagacucaaccuacucccuauccaacacccucacccuaucaaaagccgacuacgaaaaacacaaaguauacgccugcgaagucacacaccaaggccucuccucccccgucaccaaauccuucaaccgcggcgaaugc

SEQ ID NO: 54321 - RNA, 1332 nt, Artificial Sequence
  derived and/or modified sequence opt11 from Tacatuzuab_HeavyChain1
caaguccaacuccaacaauccggcgccgaagucaagaaacccggcuccucgguaaaagucucaugcaaagccuccggcuacgccuucaccuccuacgucauccacuggguccgccaagcccccggccaaggacuauacuggaucggcuacauccaccccuacaacggcggcaccaaguacaacgaaaaauucaaaggcaaagccaccaucacagccgacgaauccaccaacaccgccuacgaacucuccucccugcgcuccgaagacaccgccuucuacuucugcgcaagauccggcggcggcgaccccuucgccuacuggggccaaggaucacucgugaccgucagcagcgccagcaccaaaggcccaucaguguucccccuagcacccucaagcaaaucaacaucuggcggcacagccgcccuaggcugccucguaaaagacuacuucccagaaccugucacagucucuuggaacuccggcgcacucacauccggaguccacacguuccccgcaguacuacaaucaucgggccuguacucccucucauccgucgucacagugcccucauccucccuaggaacccaaaccuacaucugcaacgucaaccacaaacccuccaacacaaaagucgacaaacgaguugaacccaaaucaugcgauaaaacccauaccugcccacccugccccgcacccgaacuccuuggcggccccuccgucuuccucuucccacccaaacccaaagacacacucaucagccgcacccccgaaguaaccugcgucgucgucgauguaagccacgaagaccccgaagucaaauucaacugguacguagacggaguugaaguucacaacgccaaaacaaaacccagagaggaacaauacaacucaacauaccgcgucgucucaguuuuaacaguccuccaccaagacuggcucaacggcaaagaauacaaaugcaaaguuuccaacaaagcccugcccgcacccaucgagaaaaccauaucaaaggccaaaggacaaccccgagaaccccaagucuacacccucccaccaucccgcgaagaaaccaaaaaucaggucucccuaaccugccuagucaaaggguucuaccccucagacaucgccguagaaugggaauccaacggacaaccagaaaauaacuacaaaacaaccccucccguccucgacagcgacggcucauucuuccucuacuccaaacucacaguagacaaaucccgcuggcaacaaggcaacgucuucagcugcucuguccacgaagcccuccacaaccacuacacccaaaaaucccuaucacucucccccggcaaa

SEQ ID NO: 54322 - RNA, 636 nt, Artificial Sequence
  derived and/or modified sequence opt11 from Tacatuzuab_LightChain1
gacauccaacucacacaaucaccauccucccucucagccuccgucggcgaccgcgucaccauaaccugcaaagcaucccaagacaucaacaaauacaucggcugguaccaacaaaaacccggcaaagcccccaaacuccuccacuacaccuccgcccuccucccaggcauccccucccgcuucuccggauccggcuccggccgcgacuacaccuucacaaucuccucccuccaacccgaagauaucgccaccuacuacugccuccaauacgacgaccucuggaccuucggaggcggcaccaaacuccaaaucaaacgcacagucgcagcccccucagucuucaucuucccacccuccgacgaacaacuuaaauccggcaccgccucagucgucugccuccucaacaacuucuacccccgcgaagccaaaguccaauggaaagucgacaacgcccuccaauccggcaacucccaagaauccgucaccgaacaagacuccaaagacuccaccuacucccucuccuccacccuaacacucuccaaagccgacuacgaaaaacacaaagucuacgccugcgaagucacccaccaaggccucucaucacccgucaccaaaucuuucaaccgcggcgaaugc

SEQ ID NO: 54323 - RNA, 678 nt, Artificial Sequence
  derived and/or modified sequence opt11 from Tadocizumab_fab_fragment_HeavyChain
caaguccaacucguccaaucaggagccgaaguaaaaaaacccggcuccuccguaaaagucuccugcaaagcauccggcuacgccuucaccaacuaccucauagaauggguccgccaagcacccggccaaggacucgaauggaucggcgucaucuauccaggcucuggcggaaccaacuacaacgaaaaauucaaaggccgcgucacccucaccgucgacgaauccacaaacaccgccuacauggaacucucaucccuccgcuccgaagacaccgccgucuacuucugcgcacgacgcgacggcaacuacggcugguucgccuacuggggccaaggaacccucgucaccguauccuccgccuccaccaaaggccccuccgucuucccccucgcccccuccucuaaauccaccagcggcggcaccgccgcacucggcugccucgucaaagacuacuucccugaacccgucaccgucucauggaacuccggcgcccucaccuccggcguccacaccuuccccgccguccuccaauccuccggccucuacucccucuccucagucgucaccguccccuccuccucccucggcacccaaaccuacaucugcaacgucaaccacaaacccuccaacaccaaagucgacaaaaaagucgaacccaaauccugugacaaaacccac

SEQ ID NO: 54324 - RNA, 582 nt, Artificial Sequence
  derived and/or modified sequence opt11 from Tadocizumab_fab_fragment_LightChain
gacauccaaaugacccaaacccccuccacacuuuccgccuccgucggcgaccgcgucaccaucuccugccgcgccucacaagacaucaacaacuaccucaacugguaccaacaaaaacccggcaaagcccccaaacuccucaucuacuacaccucaacccuccacuccggaguccccucccgcuucucaggcucaggcucaggcaccgacuacacccucaccaucuccucccuccaacccgacgacuucgccaccuacuucugccaacaaggcaacacccuccccuggacauucggacaaggaaccaaagucgaagucaaacgcaccgucgcagcccccuccguauucaucuucccacccuccgacgaacaacuaaaauccggcaccgccuccgucgucugccuucuaaacaacuucuacgaauccgucaccgaacaagacuccaaagacucaaccuacucccucuccuccacccucacccucuccaaagccgacuacgaaaaacacaaagucuacgccugcgaggucacacaccaaggccucuccucccccgucaccaaauccuucaaccgcggcgaaugc

SEQ ID NO: 54325 - RNA, 1359 nt, Artificial Sequence
  derived and/or modified sequence opt11 from Talizumab_HeavyChain1
caaguccaacucguccaauccggcgccgaagucaagaaacccggcgccuccgucaaagucuccugcaaagccagcggcuacaccuucuccauguauuggcuugaauggguccgacaagcacccggccacggacuugaauggguaggcgagaucucccccggcaccuuuaccacuaacuacaacgaaaaauuuaaagcccgcgccaccuucaccgcagacacgagcaccaacacagccuacauggaacucuccuccuuacgcuccgaagacaccgcaguauacuacugcgcccgauucucacacuucuccggcuccaauuaugacuacuucgacuacuggggacaaggaacacucgucacagucucaucagccucaaccaaaggccccucagucuucccccuugcccccucauccaaauccacuuccggcgguaccgcagcccugggaugccuugucaaagacuacuuccccgaacccgucaccgucagcuggaacuccggcgcccucacaucaggcguccacaccuuccccgccguccuccaauccucaggacuauacagccucagcuccgucgucacaguccccuccucaucccucggaacccaaacauacaucugcaacgucaaccacaaacccucaaacaccaaagucgacaagaaaguagaacccaaauccugcgacaaaacccauacaugcccacccugcccagcccccgaacuccucggcggcccaucagucuuccucuuuccgcccaaacccaaagacacccucaugaucucccguacccccgaaguaaccugcgucgucgucgacguaucccacgaagaccccgaggucaaauucaacugguacguagacggcguagaaguccacaacgccaaaacaaaaccccgcgaagaacaauacaacuccaccuaucgcgucgucuccguccucacuguccuucaccaagacuggcuaaacggcaaagaauacaaaugcaaagucuccaacaaagcacuacccgcacccauugagaaaaccaucagcaaagcaaaaggccaaccacgcgaaccgcaagucuauacacuaccacccucccgcgacgaacucaccaaaaaccaagucucucucacaugccucguaaaaggcuucuaccccuccgauauagcaguagaaugggaauccaauggccaacccgaaaacaacuacaaaaccaccccucccguacucgacuccgacggcuccuucuuccuauacucuaaacucaccgucgacaaaucccgguggcaacaaggcaacguauucuccugcagcgucaugcacgaagcccuccacaaccacuacacccagaaaagccugucccucucacccggaaaa

SEQ ID NO: 54326 - RNA, 642 nt, Artificial Sequence
  derived and/or modified sequence opt11 from Talizumab_LightChain1
gacauccuccucacacaaucccccggaacccucucccuaagccccggcgaacgcgccacccuauccugccgcgccucccaauccaucggcaccaacauccacugguaccaacaaaaacccggacaagcgccccgccuacucaucaaauacgccagcgaaagcaucuccggcauccccucccgcuucuccggcucaggcuccggcacagacuucacccucaccaucucccgccucgaacccgaagacuucgccauguacuacugccagcaaucagacucauggccaaccaccuucggacaaggcaccaaagucgaaaucaaacgcaccgucgccgcccccucagucuucauauucccacccucagacgaacaacuaaaauccggcacugccucugucgucugccuacucaacaacuucuacccccgcgaagccaaaguccaauggaaagucgacaacgcccuccaauccggcaacucacaagaauccgucaccgaacaagacagcaaagacucaacauacucccucuccuccacccucacccuauccaaagccgacuacgaaaaacacaaagucuacgccugcgaagucacccaccaaggccucuccucacccgucaccaaauccuucaaccgcggcgaaugc

SEQ ID NO: 54327 - RNA, 1368 nt, Artificial Sequence
  derived and/or modified sequence opt11 from Tamtuvetmab_HeavyChain1
gaagucaaacuccuggaaucuggcggcggccucguccaacccggcggauccaugcgccucucaugcgcgggaucaggauucacauucaccgacuucuacaugaacuggauacgccaacccgccggcaaagcacccgaauggcucggguucauacgcgacaaagccaaaggcuacaccaccgaauacaaccccucagucaaaggacgcuucaccauuucacgcgacaacacacaaaacaugcuauaccuccaaaugaacacgcuccgagccgaagacacagccaccuacuauugcgcacgcgagggccacaccgcugcccccuucgauuacuggggacaaggcacgcucguaacaguaagcucagccucaaccacagcacccuccgucuucccccucgcacccucaugcggaucaaccuccggcucaacgguagcgcucgcaugccucguaucgggcuacuuccccgagccagucaccguauccuggaacuccgggagccuaacauccggcguccacaccuucccaagcguacuccaguccucaggacuauacucgcuuucaucaaugguaacagucccauccucccgcuggccuuccgaaaccuucacaugcaacgucgcccacccggccuccaaaaccaaaguagacaaacccgucccaaaacgcgaaaacggccgcguaccccgacccccagacugccccaaaugccccgccccugaaaugcucggcggccccagcgucuucauauucccacccaagcccaaggacacacuacugaucgcccgcacgcccgaagugaccugcgucgucgucgaccucgaccccgaagaucccgaaguacaaaucuccugguucgucgacggcaaacaaaugcaaaccgcuaaaacccaaccccgcgaagaacaauucaacggaacauaccgaguagucuccguccucccaauaggucaccaagacuggcucaaaggcaaacaauuuaccugcaaagucaacaacaaagcccugcccucccccaucgaacgaaccaucucaaaagcacgcggucaagcccaccaaccauccgucuacguccuuccucccucgcgcgaggaacuaagcaaaaacacagucuccuuaaccugccucaucaaggacuucuucccucccgacauagacgucgaauggcaaucuaacggccaacaagaacccgaaagcaaauaccgaaccacaccaccccaacucgacgaggacggaucauacuuccuguacucaaaacuauccguagacaaaucccgcuggcaacgaggagacacguucaucugcgcagucaugcacgaggcccugcacaaccacuacacccaaaaaucccucucgcacucacccggaaaa

SEQ ID NO: 54328 - RNA, 639 nt, Artificial Sequence
  derived and/or modified sequence opt11 from Tamtuvetmab_LightChain1
gacauaaaaaugacacaaucccccuccuuccucuccgccuccgucggcgaccgcguaacccuaaacugcaaagccucccaaaacaucgacaaauaccucaacugguaccaacaaaaacucggcgaaucccccaaacuccucaucuacaacaccaacaaccuccaaaccggaauccccucccgauucuccggcuccggcuccggcaccgacuucacacucaccaucuccucccuccaacccgaagacguagccaccuacuucugccuucaacacaucucccgcccccgcaccuucggcggcggcacccaccucaccguccucggccaacccaaagcaucccccuccgucacccucuucccccccuccuccgaagaacucggagccaacaaagccacccucgucugccucaucuccgacuucuaccccagcggagucaccgucgccuggaaagccgacggcucccccaucacccaaggcguugaaaccaccaaacccuccaaacaauccaacaacaaauacgccgccuccuccuaccucucacucaccccagacaaauggaaaucucacuccuccuucuccugccucguaacccacgaaggcuccacagucgaaaaaaaagucgcccccgccgaaugcucc

SEQ ID NO: 54329 - RNA, 360 nt, Artificial Sequence
  derived and/or modified sequence opt11 from Tanezumab_HeavyChain
caaguccaacuccaagaauccggccccggacucgucaaacccuccgaaacccuaucccucaccugcaccgucuccggcuucucccucaucggcuacgaccucaacuggauccgccaaccccccggcaaaggccucgaauggaucggcaucaucuggggcgacggcaccaccgacuacaacuccgccgucaaaucccgcgucaccaucuccaaagacaccuccaaaaaccaauucucccucaaacucuccuccgucaccgccgccgacaccgccgucuacuacugcgcccgcggcggcuacugguacgccaccuccuacuacuucgacuacuggggccaaggcacccucgucaccgucuca

SEQ ID NO: 54330 - RNA, 327 nt, Artificial Sequence
  derived and/or modified sequence opt11 from Tanezumab_LightChain
gacauccaaaugacccaaucccccucaucccucuccgccuccgucggcgaccgcgucaccaucaccugccgcgccucccaauccaucuccaacaaccucaacugguaccaacaaaaacccggcaaagcccccaaacuccucaucuacuacaccucccgcuuccacuccggcguccccucccgcuucuccggcuccggcuccggcaccgacuucaccuucaccaucuccucccuccaacccgaagacaucgccaccuacuacugccaacaagaacacacccuacccuacaccuucggccaaggcaccaaacucgaaaucaaacgcacc

SEQ ID NO: 54331 - RNA, 1323 nt, Artificial Sequence
  derived and/or modified sequence opt11 from Tarextumab_HeavyChain1
gaaguccaacucgucgaauccggaggcggacucguccaacccggcgguucacuacgccuauccugcgccgccagcggcuucacauucuccagcucuggcauguccuggguccgccaggcccccgggaaaggacuagaauggguuuccgucaucgccagcuccggcuccaacaccuacuacgcugacucaguaaaaggccgcuucaccaucucccgcgacaacagcaaaaacacccucuaccuccaaaugaacucacuccgagccgaagacaccgcagucuacuacugcgcacguagcaucuucuacaccaccuggggccaaggaacccucgucaccguaucaagcgccucaacaaaaggacccuccgucuucccccucgcccccuguucacgcucaacaucagaaucaacagccgcccucggcugccucgucaaagacuacuuccccgaacccgucaccgucucauggaacucaggcgcacucaccagcggaguacacaccuuccccgcaguccuccaauccucaggacucuauucccugagcuccgucgucaccguacccuccuccaacuucggaacccaaaccuauacaugcaacguagaccacaaacccuccaacaccaaagucgauaaaaccguagaacgcaaaugcugugucgaaugcccacccugccccgccccacccgucgccggccccuccgucuuccucuucccacccaaacccaaagacacgcucaugaucucucgaacacccgaagugaccugcgucguagucgacgucucccacgaagaccccgaaguccaauucaacugguacgucgacggagucgaaguccacaacgccaaaaccaaaccccgcgaggaacaauucaacuccaccuuccgcguuguauccguccucacugucguacaucaagacuggcucaacggaaaagaauacaaaugcaaaguauccaacaagggccuccccgcccccaucgagaaaaccaucagcaaaaccaaaggccaaccccgcgaaccccaaguguacacccuaccacccucacgcgaagaaaugaccaaaaaccaagucucgcucacaugccuaguuaaaggcuucuaccccucugauaucgcggucgaaugggaauccaacggccaacccgaaaacaacuacaaaacaacaccacccaugcucgacucagacggcagcuucuuccuauacucuaaacucacagucgacaaaagcagauggcaacaaggaaacguuuucuccugcuccguaaugcacgaagcccuccacaaccacuauacccagaagucccucucccucucucccggcaaa

SEQ ID NO: 54332 - RNA, 645 nt, Artificial Sequence
  derived and/or modified sequence opt11 from Tarextumab_LightChain1
gacaucguccucacccaaucccccgccacccucucccucucccccggcgaacgcgccacccucuccugccgcgccucccaauccguccgcucuaacuaccucgccugguaccaacaaaaacccggccaagcaccccgccuccucaucuacggcgccuccucccgcgccaccggcguccccgcccgcuucuccggcucaggcuccggcaccgacuucacccuaaccaucuccucccucgaacccgaagacuucgccgucuacuauugccaacaauacuccaacuucccaaucaccuucggccaaggcacaaaagucgaaaucaaacgcaccguagccgcccccuccgucuucaucuucccacccuccgacgaacaacucaaauccggcaccgccucagucgucugccuccucaacaacuucuacccccgcgaagccaaaguccaauggaaagucgacaacgcccuccaaucaggcaacucacaagaauccgucaccgaacaagacuccaaagacuccaccuacucccucuccuccacccucacccuauccaaagccgacuacgaaaaacacaaagucuacgccugcgaagucacccaccaaggccuguccucccccgucaccaaauccuucaaccgaggcgaaugc

SEQ ID NO: 54333 - RNA, 363 nt, Artificial Sequence
  derived and/or modified sequence opt11 from Tefibazumab_HeavyChain1
caagugcaauugaaagagagcgggcccgggcucgugaaaccgagccagaccuugagcauaaccuguaccauaagcggguucucgcucucgcgcuauagcgugcacugggucaggcaaccgcccgggaaagggcucgagugguugggcaugaucuggggcgggggcaauaccgauuacaauagcgcgcucaagagcaggcucucgaucucgaaagauaacucgaaaaaucaaguguucuugaaaaugaacucacuaacggccgcggacacggccguguacuauugcgcgcgaaagggcgaguucuauuacggguacgauggcuuugucuauugggggcaagggaccuuggucacggucucgagc

SEQ ID NO: 54334 - RNA, 336 nt, Artificial Sequence
  derived and/or modified sequence opt11 from Tefibazumab_LightChain1
gacaucgucaugacccaaucccccgacucccucgccgucucccucggcgaacgcgucaccaugaacugcaaauccucccaauccguccuauacuccuccaaccaaaaaaacuaccucgccugguaccaacaaaaacccggccaaucccccaaacuccucaucuacugggccuccacccgcgaauccggcguccccgaccgcuucucaggcuccggcuccggcaccgacuucacccucaccaucuccuccguccaagccgaagaccucgccgucuacuacugccaccaauaccucuccuccuacaccuucggcggcggcaccaaacucgaaaucaaa

SEQ ID NO: 54335 - RNA, 1368 nt, Artificial Sequence
  derived and/or modified sequence opt11 from Tenatumomab_HeavyChain1
gaaauccaacuacaacaaucuggacccgaacuaguuaaaccaggcgccucgguaaaagucucgugcaaagccuccggcuacgcauucaccuccuacaacauguacugggucaaacaaucacacggcaaaucccucgaauggaucggcuacaucgaccccuacaauggcgucacaucauacaaccaaaaauucaaaggaaaagccacccucaccgucgacaaauccucguccacagccuacaugcaccucaacagucucaccuccgaagacucagcagucuacuacugcgcccgcggcggaggcuccaucuacuacgcaauggacuacuggggccaaggcacauccgucaccguauccuccgccaaaacaaccccccccagcgucuacccacuggccccaggcugcggcgacacuaccggaagcuccgucacacucgguugccucgucaaaggauacuuccccgaaagcgucaccgucaccuggaacagcggcucccucucuuccuccguccacaccuuucccgcgcuccuccaauccggccucuacacaauguccuccuccguaaccgugcccucgucaacauggcccagccagacagucaccugcucaguagcccacccagccucuucaaccaccgucgacaaaaaacucgaacccuccgggccuaucucaacaaucaaccccugcccccccugcaaagaaugccacaaaugccccgccccaaaccucgaaggaggccccucugucuucaucuucccuccuaacaucaaagacguccucaugaucucacuaacccccaaagucaccugcguagucguagaugucucagaagacgaccccgacguacaaaucucaugguucgucaacaaugucgaaguccacacagcccaaacucaaacccaccgcgaggacuacaauuccacaaucagaguagucucaacacuacccauccaacaccaagacuggauguccggcaaagaauucaaaugcaaaguaaacaacaaggaccucccaucccccauagaacguaccaucucaaaaauaaaaggccuuguccgagcaccccaagucuacauccuccccccccccgccgaacaacucucccgaaaagacgucagccucaccugccucguagucggauucaacccuggcgacaucuccguagaauggacuuccaacggccacaccgaagaaaauuacaaagacacagcccccguccuagacucugacggcuccuacuucaucuacucaaaacuaaacaugaaaaccagcaaaugggaaaaaacagacucauuuuccugcaacguccgacacgaaggccuaaaaaacuacuaccuuaaaaaaacaaucucacgcagccccggaaaa

SEQ ID NO: 54336 - RNA, 657 nt, Artificial Sequence
  derived and/or modified sequence opt11 from Tenatumomab_LightChain1
gacaucgucaugacccaagccgcccccucaguccccgucacccccggcgaauccgucucaaucuccugccgcuccucaaaaucacuccuccacuccaacggaaacaccuaccucuacugguuccuacaacgccccggccaaucaccccaacuccuaauauaccgcaugucaaaccucgccuccggcguccccgaccgcuucucaggcucaggcuccggcaccgccuucacccuccgcaucucccgcgucgaagccgaagacgucggagucuacuacugcaugcaacaccucgaauacccccucaccuucggcgccggcaccaaacucgaacuaaaacgcgccgacgccgcccccacaguauccaucuucccacccuccuccgaacaacucaccuccggcggcgccuccgucguaugcuuccucaacaacuucuaccccaaagacaucaacgucaaauggaaaaucgacggcuccgaacgccaaaacggcguccuaaacuccuggacagaccaagacuccaaagacucaaccuacucaauguccuccacccucacacucacuaaagacgaauacgaacgccacaacuccuacacaugcgaagccacccacaaaaccuccaccucacccaucguaaaauccuuuaaccgaaacgaaugc

SEQ ID NO: 54337 - RNA, 1356 nt, Artificial Sequence
  derived and/or modified sequence opt11 from Teneliximab_HeavyChain1
caaauccaacucguccaaucaggccccgaacucaagaaacccggugaaacuguccgcaucuccugcaaagccuccggcuacgccuucacaacgaccggcaugcaauggguacaagaaaugcccggcaaaggccuuaaauggaucggcuggaucaacacccacaguggcguacccaaauacgucgaagacuucaaaggccgcuucgccuucucccucgaaacaucagccaacacagcauaccuccaaaucagcaaccucaaaaaugaagacacagcaaccuacuucugcguccgcuccggcaacggaaacuacgaccucgcauacuucgcuuacuggggccaaggaacccuaguaacaguaucagccgccuccacaaaaggccccucagucuucccccucgcccccuccuccaaauccaccucaggaggcaccgcagcacucggcugccucgucaaggacuacuucccagaacccgucaccgucuccuggaacuccggcgcccuaacuuccggcguccacaccuucccagcaguacuccaauccuccggccucuacucacuauccucagucguaacaguacccuccucaucccuaggcacccaaaccuacaucugcaacgucaaccauaaaccguccaacaccaaagucgacaagaaaguagagcccaaauccugcgacaaaacccacacaugcccacccugccccgcccccgaacuccuaggcggucccuccguguuccuauucccacccaaacccaaagacacacuuaugaucucccguaccccagagguuaccugcgucgucgucgacgucucccacgaagacccagaagucaaauucaacugguaugucgacggcguagaaguacacaacgccaaaaccaaaccccgagaagaacaauacaacuccaccuaccgcgucgucuccguccuuacaguacuacaccaagacuggcucaacggcaaagaauacaaaugcaaagucucaaacaaagcacugccagcccccauagagaaaacaaucagcaaagccaaaggccaaccaagagaaccgcaagucuacacacucccacccuccagagacgaacuaacaaagaaccaggucucucuuaccugccucgucaagggcuucuaccccagcgacaucgccgucgaaugggaauccaacggccaacccgaaaacaacuacaaaaccaccccacccguacucgacucagacggaucguucuuccuauacagcaaacucacaguugacaaaagccgauggcaacaaggaaacguauucuccugcuccguaaugcacgaagcccuccacaaccacuacacgcagaaaagccuaucgcucucccccggcaaa

SEQ ID NO: 54338 - RNA, 642 nt, Artificial Sequence
  derived and/or modified sequence opt11 from Teneliximab_LightChain1
gacaucguccucacccaaucccccgccacccuauccgucacccccggcgaccgcguaucccucuccugccgcgccagccaauccaucuccgacuaccuccacugguaccaacaaaaaucccaugaaucuccccgacuccucaucaaauacgccucccacuccaucuccggaauccccucccgauucuccggcuccggcucaggcuccgacuucacccucuccaucaacuccgucgaaccagaagacguaggcaucuacuacugccaacacggccacuccuuccccuggacauucggcggcggcaccaaacucgaaaucaaacgcaccgucgccgcccccuccguuuucaucuucccacccuccgacgaacaacucaaauccggcacagccuccgucgucugccuccucaacaacuucuacccccgcgaagccaaaguccaauggaaagucgacaaugcccuccaauccggcaacucccaagaauccgucaccgaacaagacucaaaagacucaaccuacucccucagcucgacccucacccucuccaaagcagacuacgagaaacacaaagucuacgccugcgaagucacccaccaaggccucuccucccccgucaccaaauccuucaaccgaggcgaaugc

SEQ ID NO: 54339 - RNA, 1347 nt, Artificial Sequence
  derived and/or modified sequence opt11 from Teplizumab_HeavyChain1
caaguacaacucguccagagcggaggcggaguaguccagcccggccgaagccugcgacucuccugcaaagccucaggcuacaccuucacccgcuacaccaugcacuggguccgacaagcccccggaaaaggacuagaauggauaggcuacaucaauccuucccgagguuauaccaacuacaaccaaaaagucaaagaccgcuucacuaucucccgagacaacuccaaaaacacagcauuucuccaaauggacucccuccgccccgaagacacagggguauauuucugcgcccgcuacuacgacgaccauuacugccucgacuauuggggccaaggcaccccagucacagucuccagcgcauccaccaaaggacccucagucuucccccuggcucccuccagcaaaucaaccucaggaggcaccgcagcccucggaugccucguaaaagacuacuuccccgaacccgucacagucuccuggaacuccggcgcccucaccuccggcguccacaccuuccccgccguacuacaaucaagcggccuguacucccucuccagcgucgucacagugcccuccuccucacuaggcacacaaaccuacauaugcaacguaaaccacaaaccaucgaacaccaaagucgacaagaaagucgaacccaaauccugcgacaaaacacacacaugucccccuugccccgccccggaagccgcaggaggccccuccguauuccucuuucccccaaaacccaaagacacgcucaugauaucccgcaccccugaaguaaccugcgucgucgucgacgucucccacgaagaccccgaagucaaauucaacugguacgucgacggcgucgaagugcacaacgccaaaaccaagccccgcgaagaacaauacaauuccaccuaccgcguagucuccguucucaccguccuccaccaagacuggcucaacggcaaagaguacaaaugcaaggucucaaacaaagcccuaccugcacccaucgagaaaaccaucucaaaagcaaaaggucaaccccgcgaaccccaagucuacacccucccacccucgcgagacgaacuaaccaaaaaccaagucucccuaacaugccucgucaaaggcuucuaccccuccgacaucgccguugaaugggaauccaauggccaaccagaaaacaacuacaaaacaaccccacccguccucgauucagacggcucauucuuccucuacucaaaacucaccguagacaaaucccgcuggcaacaaggaaacgucuucuccugcuccgucaugcacgaagcacuacacaaccacuacacacaaaaaucgcucucucucucacccggaaaa

SEQ ID NO: 54340 - RNA, 639 nt, Artificial Sequence
  derived and/or modified sequence opt11 from Teplizumab_LightChain1
gacauccaaaugacccaaucccccuccucccucuccgccucagucggcgaccgcgucaccauaaccugcuccgccuccuccuccguaucauacaugaacugguaccaacaaacucccggcaaagcccccaaacgcuggaucuacgauaccuccaaacucgccuccggcguccccucccgcuucuccggcuccggcuccggcaccgacuacaccuucaccaucuccucccuccaacccgaagacaucgccaccuacuacugccaacaaugguccucuaacccauucaccuucggccaaggaaccaaacuccaaaucacacgcaccgucgccgcccccuccgucuucaucuucccacccuccgacgaacaacucaaauccggcaccgccuccgucguuugccuacucaacaacuucuacccccgcgaagccaagguccaauggaaagucgacaacgcccuccaauccggcaacucccaagaauccgucaccgaacaagacucaaaagacuccacauacagccuauccuccacccucacccucuccaaagccgacuacgaaaaacacaaagucuacgccugcgaaguaacccaccaaggccucuccucccccgucaccaaauccuucaaccgcggcgaaugc

SEQ ID NO: 54341 - RNA, 1344 nt, Artificial Sequence
  derived and/or modified sequence opt11 from Teprotumumab_HeavyChain1
caagucgaacucguugaauccggcgggggcguaguccaacccggacguucucaacgacuaucaugcgcagccuccggauucaccuucuccucauacggcaugcacugggugcgacaagcccccggcaaaggccuugaauggguagccaucaucugguucgacggcuccucaaccuacuacgccgacuccguacgaggccgauucacaaucucccgagacaacagcaaaaacacucuauaccuccaaaugaacucccuacgagcagaagacaccgcggucuauuucugcgcacgugaacucggccgccgcuacuucgaucucuggggucgcggcaccuuaguaucugucuccuccgccuccacgaaaggccccuccgucuucccccucgcacccuccuccaaaucaaccagcggcggcacugccgcccucggaugccuagucaaagacuacuuucccgaacccgucacuguauccuggaacuccggcgcccucacaagcggcguccacacauuccccgcaguacuccaauccucaggccuuuacucccucuccuccgucgucaccguccccucauccagccucggaacccaaacauacaucugcaacgucaaccacaaacccucaaacacaaaaguugacaaaaaggucgaacccaaaucaugcgacaaaacacacacuugcccacccugucccgcccccgaacuccucggcggccccagcgucuuccuauucccacccaagcccaaagacacacucaugauauccagaacacccgaaguaaccugcgucgucgucgaugucagccacgaggaccccgaagucaaauucaacugguacgucgacggcgucgaaguccacaacgcuaaaaccaaaccccgagaagaacaguacaacuccaccuaccgcgucgucuccguccuaacaguccuccaccaagacugguugaacggaaaagaauacaaaugcaaggucucgaacaaagcccucccagcacccaucgagaaaacaauaagcaaagcaaaaggccaaccacgagaaccucaaguauacacccuacccccuucacgagaugaacuaaccaaaaaccaagucucccuaaccugccucguaaaaggcuucuaccccucagauaucgccgucgaaugggaauccaacggacaacccgaaaacaacuacaaaaccaccccacccguccucgacucagacggcucauucuuccucuacucaaaacuaaccguagacaaaucccgcuggcaacaaggcaacguuuucucuugcuccgucaugcacgaagcccuccacaaccacuacacccaaaaaucacuaucccucucacccggcaaa

SEQ ID NO: 54342 - RNA, 645 nt, Artificial Sequence
  derived and/or modified sequence opt11 from Teprotumumab_LightChain1
gaaaucguacucacccaaucccccgccacccucucccucucacccggcgaacgcgccacccucuccugccgagccucccaaucagucucauccuaccucgccugguaccaacaaaaacccggccaagccccacgccuccucaucuacgacgccuccaaacgcgcuaccggaauccccgcccgauucuccggcuccggcuccggcaccgacuucacccucacaauauccucccucgaacccgaagacuucgccgucuacuacugccaacaacgcuccaaauggccacccuggaccuucggccaaggcaccaaagucgaauccaaacgaaccgucgccgcccccuccgucuucaucuucccacccuccgacgaacaacucaaauccggcaccgccucagucguaugccuccucaacaacuucuacccccgcgaagccaaaguccaauggaaagucgacaacgcccuccaaucaggcaacucccaagaauccguaaccgaacaagauuccaaagacuccaccuacucccucuccuccacccucacacucuccaaagccgacuacgaaaaacacaaagucuacgccugcgaagucacccaccaaggacucuccucccccgucaccaaaucauucaaccgcggcgaaugc

SEQ ID NO: 54343 - RNA, 1338 nt, Artificial Sequence
  derived and/or modified sequence opt11 from Tesidolumab_HeavyChain1
gaaguccaacucguccaaucaggcgccgaagucaagaaacccggcuccuccguaaaagucucaugcaaagcauccggcggcaccuucucauccuaugccauauccuggguccgucaagcccccggacaaggccucgaauggaugggcggcauaggccccuucuucggcacagcaaacuacgcucagaaauuccaaggccguguaacaaucacagcagacgaaucaaccuccaccgccuacauggagcucucuucacuccgcagcgaagacaccgccguauauuacugcgcccgcgacacacccuacuucgacuacuggggacagggcacacucgucaccguaucuucagcuucaaccaaaggacccagcgucuucccccuagcccccuccucuaaauccaccucaggaggcacagccgcucucggcugccucguuaaagacuacuuccccgagcccguaaccguaucauggaacucgggagcacucacaagcggaguacacacauuccccgccguacuccaauccuccggacucuacucccucuccuccgucgucacaguaccauccagcucacuugggacucaaaccuacauaugcaacguaaaccacaaaccaucaaacaccaaaguagacaaacgagucgaaccaaaauccugcgacaaaacccacaccuguccacccugccccgcccccgaagccgcaggcggccccuccgucuuccuauucccacccaaacccaaagacacccuaaugaucucccgaacacccgagguaaccugcguagucguagacgucucccacgaagaccccgaaguaaaauucaacugguacgucgacggagucgaaguacacaacgccaaaaccaaaccacgagaagaacaauacaacucaaccuaccgcgucgucuccguccucaccguccuccaccaagacuggcuaaacggaaaagaauacaaaugcaaagucuccaacaaagcccuaccagccccaaucgagaaaacaaucuccaaagccaaaggccaaccccgcgaaccccaagucuacacccuaccacccucacgagaagagaugaccaaaaaccaaguaucacuuaccugccucguaaaaggcuucuaccccucagacauugccgucgaaugggaaucaaacggccaacccgaaaacaacuacaaaacuacuccacccguccuugacuccgacggcagcuucuuucuauacagcaaacucacagucgacaaaucccgcuggcaacaaggaaacgucuucucaugcuccguuaugcacgaagcucuccacaaccacuacacccaaaaaucccucucccucucccccggaaaa

SEQ ID NO: 54344 - RNA, 642 nt, Artificial Sequence
  derived and/or modified sequence opt11 from Tesidolumab_LightChain1
ucuuacgaacuaacccaaccccucuccgucuccgucgcccucggucaaacagcccgcaucaccugcucaggcgacuccauccccaacuacuacgucuacugguaccaacaaaaacccggccaagcacccguccucgucaucuacgacgacuccaaccgccccucaggcaucccagaacgcuucucaggcuccaacuccggcaacacagccacacucaccaucucacgcgcccaagccggcgacgaagcagacuacuacugccaauccuuugacuccucccucaacgcagaagucuucggcggcggaaccaaacucaccguccucggccaacccaaagccgcccccuccgucacacucuuuccccccuccuccgaagaacuccaagccaacaaagccacacuagucugccucaucuccgacuucuaccccggcgccgucaccguagccuggaaagccgacuccuccccagucaaagccggcgucgaaaccaccacaccauccaaacaaucaaacaacaaauacgccgccuccuccuaccucucccucacccccgaacaauggaaaucccaccgauccuacuccugccaagucacacacgaaggauccacagucgaaaaaaccgucgcccccaccgaaugcucc

SEQ ID NO: 54345 - RNA, 1344 nt, Artificial Sequence
  derived and/or modified sequence opt11 from Tezepelumab_HeavyChain1
caaaugcaacuuguagaaucuggcgggggcgucguccaacccggacgcucccucagacucuccugugcagccuccggcuucacuuuccgcaccuacggaaugcauuggguccgccaagcccccggaaaaggacuagaaugggucgccgucaucugguacgacggcuccaacaaacacuacgccgacucaguaaaaggacgcuucaccaucacacgcgacaacuccaaaaacacccucaaucuccaaaugaacucccuccgcgccgaggacacagccgucuacuacugcgcgcgagccccacaaugggagcucguccacgaagccuucgacaucuggggucaaggcaccauggucaccguauccagcgccuccacaaaaggacccuccgucuucccccucgcucccugcucaagaucaaccuccgaaucaaccgcugcccuaggcugccucgucaaagacuacuucccagaaccagucacugucagcuggaacuccggcgcgcucaccuccggcguccacacuuuuccugccguccuacaauccucaggucucuacucacuuagcucagucguaaccguccccagcuccaacuucggcacccagacauacacaugcaacguugaccacaaacccucaaacaccaaaguagacaaaacagucgaacgcaaaugcugcgucgaaugcccacccugccccgccccacccgucgcaggccccuccgucuuccucuucccacccaaacccaaagacacacucaugaucucccgcacccccgagguuaccugcgucgucguagacgucagccacgaagaucccgaaguccaauucaacugguacgucgacggagucgaagugcacaacgccaaaaccaaacccagggaagaacaauucaacucaaccuuccguguaguauccguccucaccgucguccaccaagacuggcuaaacggcaaagaauacaaaugcaaagucucaaacaaaggacuucccgcacccauagaaaagaccauaagcaaaaccaaaggccaaccccgcgaaccccaaguauacacacuaccgcccucacgagaggaaaugaccaaaaaccaagucucccuaaccugccucguaaaaggcuucuaccccuccgacaucgccgucgaaugggaaucaaacggccaacccgaaaauaacuacaaaacaacacccccaaugcuggacucugacgggagcuucuuccucuacucaaagcuaaccgucgauaaaucccgcuggcaacaaggaaacguauucuccugcucagucaugcacgaagcccuacacaaccacuacacccagaaaucccucucacucucgcccggaaaa

SEQ ID NO: 54346 - RNA, 642 nt, Artificial Sequence
  derived and/or modified sequence opt11 from Tezepelumab_LightChain1
uccuacguccuaacccaaccccccuccgucuccgucgcccccggacaaacagcccgaaucacaugcggcggcaacaaccucggcucaaaauccguccacugguaccaacaaaaacccggccaagcccccguccucgucgucuacgacgacuccgaccgaccauccuggauccccgaacgcuucuccggcucaaacuccggcaacaccgccacccucaccaucucacgcggcgaagccggcgacgaagccgacuacuacugccaagucugggacucaagcuccgaccacgucgucuucggcggcggcaccaaacucaccguccucggccaacccaaagcagcccccuccgucacccucuuccccccauccuccgaagaacuccaagccaacaaagccacccucguuugccucaucuccgacuucuaccccggcgccgucacagucgccuggaaagccgacuccucacccgucaaagccggcgucgaaaccaccacccccuccaaacaaucaaacaacaaauacgccgccucaucauaccucucccucacccccgaacaauggaaaucccaccguuccuacucuugccaagucacccacgaaggcuccacaguagaaaaaacaguagcccccaccgaaugcuca

SEQ ID NO: 54347 - RNA, 1338 nt, Artificial Sequence
  derived and/or modified sequence opt11 from ThioMAb-chMA79b-HC(A118C)_HeavyChain
gaaguccaacuucaacaauccggagcagaacucaugaaacccggcgccucagucaaaaucucuugcaaagccacaggcuacaccuuuuccagcuacuggaucgaaugggugaaacaacggcccggccacggccuugaauggaucggagaaauccuccccggcggcggcgacaccaacuacaacgaaaucuucaaaggaaaagccaccuucaccgcagacacauccuccaacaccgccuacaugcagcucuccagccucaccucagaagacagcgccgucuacuacugcacccgccgcgucccugucuacuucgacuacuggggccaaggcaccagcgucaccgucagcuccugcucgaccaaaggaccauccguauucccccuagcccccucgucaaaaucaaccuccggcggcaccgccgcacucggcugucucgucaaagacuacuuccccgaacccgucacugucucauggaacuccggagcgcucacguccggaguacacaccuuccccgcaguccuacaaaguucuggccucuacucacucucaucagucguaaccgucccaagcuccucacucggaacacaaacauacaucugcaacgucaaccacaaacccucgaacaccaaagucgacaagaaagucgaacccaaauccugcgacaagacccacacaugcccacccugccccgcacccgaacuccucggcggccccuccguauuccucuucccacccaaacccaaagacacccucaugaucagccgcacacccgaaguuaccugcgucgucgucgacgucucccacgaagaucccgaaguaaaauucaacugguacgucgacggagucgaaguacacaacgcaaaaacaaaaccccgcgaggaacaauacaacuccaccuaccgaguaguauccguccuaaccguccuacaccaagacuggcucaacggcaaagaauacaagugcaaagucucaaauaaagcacuccccgccccaauagagaaaacaaucuccaaagcaaaaggccaaccccgcgaaccccagguauauacccucccacccucccgcgaagaaaugaccaaaaaccaaguuagccuaaccugccuagucaaagguuucuacccauccgacaucgcaguagaaugggaauccaacggccaacccgaaaacaacuacaaaacaaccccacccgugcucgacucagacggcucauucuuucucuacucaaaacucaccgucgacaaaucccgauggcaacaaggcaaugucuucuccugcucaguaaugcacgaagcccuccacaaccacuacacccaaaaaucacuaucacuaagccccgga

SEQ ID NO: 54348 - RNA, 1347 nt, Artificial Sequence
  derived and/or modified sequence opt11 from ThioMab-hu10A8.v1-HC(A118C)_HeavyChain
gaaguccagcuaguagaauccggcggcggccuaguccaacccggcggcucccuccgucuaucaugcgccgccuccggcuucaccuucuccuccuacgccgucuccuggguacgccaagccccaggaaaaggacucgaaugggucgccaccaucuccuccggcggcucccuaaccuucuaccucgacucaguacgcggccgcuucacuauaucacgcgauaacuccaaaaacacacucuaccuccaaaugaacucccuacgagccgaggacaccgccgucuauuacugcgcccguccuauccccgacuauuacgcccucgacuacuggggccaaggcacccucguaaccguaucauccugcuccacuaaaggccccuccgucuucccacucgcccccuccuccaaguccaccagcggcggcaccgccgcccucggcugccucguaaaagacuauuuccccgaaccugucaccgucuccuggaacuccggcgcccucaccuccggcguccacacguuccccgcaguccuccaaagcagcggccuauauucucucuccucagucgucacaguaccuuccuccagccucgguacccaaaccuacaucugcaacguuaaccacaaacccuccaacaccaaagucgacaagaaaguggaacccaaaucaugcgacaaaacccacaccuguccacccugcccugccccagaacuccuaggcggacccucagucuuccucuucccacccaaacccaaagacacccucaugaucucccgaacccccgaagucacgugcguuguagucgacgucucucacgaagaccccgaaguuaaauuuaacugguacgucgacggcguagaaguccacaacgccaaaaccaaaccacgcgaagaacaauacaacagcaccuaccgcgucgucagcguucuaacuguacuacaccaagacuggcucaacggcaaagaauacaaaugcaaaguaucaaacaaagcccuaccugccccaaucgagaaaaccaucuccaaagccaaaggccaaccccgcgaaccacaaguauacacucuaccacccucacgcgaagaaaugaccaaaaaccaagucagccucacaugccucgucaaaggcuucuaccccuccgacaucgccguagaaugggaauccaacggccaacccgaaaacaacuacaaaacaacacccccaguccuugauuccgacggauccuucuuccucuacuccaaacucaccgucgacaaaucacgcuggcaacaaggcaacgucuucuccugcucagucaugcacgaagcccuccacaaccacuacacccaaaaaucacucagccuaucccccggcaaa

SEQ ID NO: 54349 - RNA, 1347 nt, Artificial Sequence
  derived and/or modified sequence opt11 from ThioMab-hu10A8.v1-HC(V205C)_HeavyChain
gaaguacaacucguggaaucaggcggaggccuaguccaaccuggaggcucccuacgccucucgugcgccgccagcggcuucacauucuccuccuacgcaguaucauggguccgccaagcacccggaaaaggacucgaaugggucgcaacuauauccucaggaggaucccucacguucuaccucgacuccguccgaggccguuucaccaucucccgcgacaacuccaaaaacacacucuaccuucaaaugaacucccuuagagcagaagacaccgcugucuacuacugcgccagaccaauaccagacuacuacgcucuagauuacuggggacaaggcacucucgucaccgucuccucagcauccacaaagggcccaucagucuucccucucgccccuuccagcaaaucaaccucaggcggcacagccgcccucggcugccucguuaaagacuacuucccagaacccgucacagucuccuggaacagcggcgcacucaccagcggcguccauaccuuccccgcaguccuccaaucuucaggacucuacagccucuccuccgucgucacaguccccucauccucacucggcacccaaacauacauaugcaacguaaaccacaaacccuccaacacaaaggucgacaagaaaguugaaccaaaaucaugcgacaagacccauaccugcccacccugccccgcccccgaacuacucggcgggcccuccgucuuccucuucccaccaaaacccaaagauacccucaugauaagccgaacccccgaagucacaugcgucgucguagacguaucccacgaagaccccgaaguaaaauucaacugguacgucgacggcgucgaaguacacaacgccaaaaccaaaccccgagaagaacaauacaacuccaccuaccgcgucgucuccguccuuacaguacuccaccaagauuggcuaaacggcaaagaauacaaaugcaaagucagcaacaaagcccucccagcccccauagaaaagaccaucuccaaagccaaaggccaaccccgagaaccacaagucuacacacuacccccgucccgcgaagaaaugacuaaaaaccaaguuucccucaccugucuaguaaaagguuuuuacccauccgacauagccgucgaaugggaauccaacggacaacccgaaaacaacuacaaaaccaccccucccguccuagacagcgacggcagcuucuuccucuacuccaaacucacagucgacaaaucccgauggcaacaagggaacgucuuuuccugcucaguaaugcacgaagcacuucacaaccacuacacccaaaaaucccuaucccuaucccccggcaaa

SEQ ID NO: 54350 - RNA, 642 nt, Artificial Sequence
  derived and/or modified sequence opt11 from ThioMab-hu10A8.v1-LC(A118C)_LightChain
gacauccaaaugacccaaucacccuccucucucuccgccuccgucggcgaccgcguaaccaucacaugcaaagcaucccaagacguauccaccgccgucgccugguaccaacaaaaacccggcaaagcccccaaacuccucaucuacuccgccagcuaccgauacaccggcguccccucccgcuucucaggcuccggcuccggcaccgacuucacccuaaccaucuccucccuccaacccgaagauuucgccaccuacuacugccaacaacacuucucauccccacgcaccuucggacaaggcaccaaagucgaaaucaaacgcaccguagccgcccccuccgucuucaucuucccacccuccgacgaacaacucaaauccggcaccgccuccguagucugccuacucaacaacuucuacccccgcgaagcaaaaguacaauggaaagucgacaacgcccuccaaagcggcaacucccaagaaucugucaccgaacaagacuccaaagacuccaccuacucccucuccucaacccuaacccucucaaaagccgacuacgaaaaacacaaaguauacgccugcgaagucacccaccaaggccucuccuccccagucaccaaauccuucaaccgcggcgaaugc

SEQ ID NO: 54351 - RNA, 642 nt, Artificial Sequence
  derived and/or modified sequence opt11 from ThioMab-hu10A8.v1-LC(V205C)_LightChain
gacauccaaaugacccaaucccccuccucccucuccgcauccgucggcgaccgcgucaccaucaccugcaaagccucccaagacgucuccacagccgucgccugguaccaacaaaaacccggcaaagcccccaaacuccucaucuacuccgccuccuaccgauacaccggcguacccucccgcuucuccggcuccggcuccggcaccgacuucacccucacaaucuccucccuccaacccgaagacuucgccaccuacuacugccaacaacacuucuccuccccccgcacauucggccaaggcaccaaaguagaaaucaaacgcacagucgccgcacccuccgucuucaucuucccccccuccgacgaacaacucaaauccggaaccgccuccgucgucugccuccuaaacaacuucuacccccgcgaagccaaaguccaauggaaagucgacaacgcccuccaauccggcaacucccaagaauccgucaccgaacaagacuccaaagacuccaccuacucccuauccuccacucucacucucuccaaagccgacuacgaaaaacacaaagucuacgcaugcgaagucacccaccaaggccuauccucccccuguaccaaauccuucaaccgaggcgaaugc

SEQ ID NO: 54352 - RNA, 1338 nt, Artificial Sequence
  derived and/or modified sequence opt11 from ThioMAb-huMA79b.v17-HC(A118C)_HeavyChain
gaaguccaacucguagaauccggaggcggccucguccaaccaggcggcucccuccgccucuccugcgccgcauccggcuacaccuucuccagcuacuggaucgaauggguacgccaagccccuggaaaaggccucgaauggaucggcgaaauccuacccggaggaggugacaccaacuauaacgaaaucuucaaaggccgagcaacuuucucagcagacaccuccaaaaacaccgccuaccuccaaaugaacucucuccgcgcggaagacaccgccgucuacuacugcacccgccgcguacccgucuacuucgacuacuggggccaaggcacccucgucacugucuccuccugcuccaccaaaggccccucaguguucccccuagcuccaucauccaaauccaccuccggaggcaccgcugcccuaggcugccuaguuaaagacuacuuccccgaaccagucacagucuccuggaacucaggcgcccuaaccuccggcguucacaccuucccggccguccuacaaucaagcggacuauacucccuaagcuccguagucaccguacccuccagcucccuuggaacccaaaccuacaucugcaacguuaaucacaaacccuccaacacuaaagucgacaaaaaagucgaacccaaaagcugcgacaaaacccacaccugcccccccugccccgcccccgaacuacucggcggaccuucugucuuccuguucccgcccaaacccaaagacacccucaugaucucccgcacccccgagguaaccugcgucguggucgacgucucacacgaagaccccgaagucaaauucaacugguacgucgacggcguugagguccacaacgccaaaaccaaacccagagaagaacaauauaacucaaccuaccgcgucgucucaguccucaccguucuccaccaggacuggcucaacggcaaagaauauaaaugcaaagucucaaacaaagcucuccccgccccaauagaaaaaacgauauccaaagcaaaaggccaaccccgcgaaccccaagucuacacccucccacccucccgagaagaaaugacaaaaaaccaaguaucacucacuugccuagucaaaggcuucuacccaucggacaucgcugucgaaugggaaucaaacggacaacccgaaaacaacuacaaaacuacaccccccguccuagacuccgacggauccuuuuuccuauacucuaaacuaaccguagacaaaucucgcuggcaacaaggcaacgucuucuccugcuccguaaugcacgaagcccuccauaaccacuacacccaaaaaucccuaagccucucccccggc

SEQ ID NO: 54353 - RNA, 654 nt, Artificial Sequence
  derived and/or modified sequence opt11 from ThioMAb-huMA79b.v17-HC(A118C)_LightChain
gacauccaacucacccaaagccccuccucccuaagcgccagcgucggcgaccgcguaaccauaaccugcaaagcaucccaaagcguagacuacgacggcgacuccuuccucaacugguaccaacaaaaacccggaaaagcacccaaacuacuaaucuacgccgccuccaaccuugaaagcggcguccccagcagauucuccggcucaggcucaggcacagacuucacccuaaccaucagcucacuacaacccgaagacuucgccacauacuacugccaacaauccaacgaagacccccucaccuucggacaaggcaccaaagucgaaaucaaacgcacagucgccgcacccuccgucuucaucuucccacccucagacgaacaacuaaaauccggcaccgccucagucgucugccuccucaacaacuucuacccccgcgaagccaaaguccaauggaaagucgacaacgcccuccaauccggcaacucacaagaaagcguaaccgaacaagacagcaaagacucaaccuacucccuaagcucaacacuaacccuguccaaagccgacuacgaaaaacacaaaguguacgccugcgaagucacacaccaaggccucagcucacccgucaccaaaucauucaaccgcggcgaaugc

SEQ ID NO: 54354 - RNA, 1338 nt, Artificial Sequence
  derived and/or modified sequence opt11 from ThioMAb-huMA79b.v18-HC(A118C)_HeavyChain
gaaguccagcuaguagaauccggcggaggccuaguccaacccggcggcucacucagacuuuccugcgcagcauccggcuacacauucucaagcuacuggauagaauggguccgccaagcaccaggcaaaggacuugaauggauaggcgaaauccuccccggaggcggcgacacuaacuacaacgaaauauucaaaggccgcgccacauucuccgccgacacaagcaaaaacacggccuaccuccaaaugaacucccuccgcgccgaagacacagcugucuacuacugcacccgucguguccccauccgucuagauuacuggggacaaggcacauuagucaccguguccagcugcucaaccaaagguccauccgucuuuccucucgcacccuccucaaaguccaccagcggaggaacagcagcccucggaugccucguaaaagacuacuuccccgagcccgucacagucucauggaacuccggcgcacuaacaucuggaguacacaccuuccccgcaguccuccaauccuccggccucuacucccucucauccguaguuacaguuccaucauccagccucggcacccaaaccuacaucugcaacgucaaccacaaacccucuaacaccaaaguagacaagaaaguagaacccaaaaguugcgacaaaacccacacaugcccacccugccccgcacccgaacuccuaggaggccccuccguauuccucuucccacccaaacccaaagacacacucaugaucucccgaacccccgaggucacuugcgucgucgucgacguuucccacgaagaccccgaagucaaauucaacugguacgucgacggcgucgaaguccacaacgcuaaaaccaaaccccgagaggaacaauacaacuccacauaccgcgucguaucaguccucaccguacuucaccaagacuggcucaacggcaaagaauacaagugcaaagugucaaacaaagcccuacccgcccccauugaaaagaccaucaguaaagccaaaggccagccacgagaaccacaagucuacacccugccacccucccgcgaggaaaugaccaaaaaccaaguaucccuaaccugccucgucaaagguuucuaccccuccgacauagccguugaaugggaauccaacggccaacccgaaaacaacuacaaaacaaccccaccaguccucgacucagacggcuccuucuuccuauacuccaaacucacagucgacaaaagccgauggcaacaaggcaacgucuuuagcugcuccgugaugcacgaagcacuacacaaccacuacacucaaaaaucccucucacucucacccggc

SEQ ID NO: 54355 - RNA, 654 nt, Artificial Sequence
  derived and/or modified sequence opt11 from ThioMAb-huMA79b.v28-HC(A118C)_LightChain
gacauccaacucacacaaucacccuccucucuauccgccuccgucggcgaccgcguuacaaucacaugcaaagccucccaauccguagacuacgaaggcgacuccuuccucaacugguaccaacaaaaaccaggcaaagcccccaaacuccuaaucuacgccgccuccaaccucgaguccggcguccccucccgcuucucaggcucugguuccggcaccgacuucacccucaccaucuccucacuccaacccgaagacuucgccaccuacuacugccaacaaucaaacgaagacccccucacauucggccaaggcaccaaagucgaaaucaaacgcaccgucgcagcccccuccgucuucaucuucccacccuccgacgaacaacucaaauccggaacagccucaguagucugccuccucaacaacuucuacccccgagaagccaaaguccaauggaaagucgacaacgcccuccaauccggcaacucacaagaaucugucaccgaacaagacuccaaagacuccaccuacucccucuccuccacccucacccuauccaaagccgacuacgaaaaacacaaagucuacgcaugcgaagucacacaccaaggccucucaucccccgucaccaaauccuucaaccgcggcgaaugc

SEQ ID NO: 54356 - RNA, 654 nt, Artificial Sequence
  derived and/or modified sequence opt11 from ThioMAb-huMA79b.v28-LC(V205C)_LightChain
gacaucguucucacccaaucccccgcaucccuagccgucucccucggccaacgcgccaccaucuccugcaaagccucccaauccgucgacuacgacggcgacucauuccucaacugguaccaacaaaaacccggccaaccccccaaacucuucaucuacgccgccuccaaccucgaauccggcauccccgcccgcuucucaggcucgggcucaggcaccgacuucacccuaaacauccaccccgucgaagaagaagacgccgccaccuacuacugccaacaaucaaacgaagacccacucacauucggcgccggaaccgaacucgaacuaaaacgcaccgucgccgcccccuccgucuucauauucccccccucagaugaacaacucaaauccggcacagccuccgucguaugccuccucaacaacuucuacccccgcgaagccaaaguccaauggaaagucgacaacgcccuccaauccggcaacucacaagaaucaguaaccgaacaagacuccaaagacuccacauacucccucucaucaacccucacccucagcaaagccgacuacgaaaaacacaaagucuacgcaugcgaagucacccaccaaggccucucaucucccugcaccaaguccuucaaccgcggcgaaugc

SEQ ID NO: 54357 - RNA, 1332 nt, Artificial Sequence
  derived and/or modified sequence opt11 from Ticiliuab_HeavyChain1
caaguacagcuagucgaauccggcggcggcgucguacaacccggccgaucacuccgacucucaugcgccgcauccggauucacauucuccuccuacggccacuggguccgccaagcccccggcaaaggccucgaaugggucgcaguaaucugguacgacggcucuaacaaauacuacgccgacuccgugaaagggcgauuuaccaucuccagagacaacuccaaaaacacccucuaccuccaaaacucacuccgcgccgaagacacagccgucuacuacugcgcacgcgacccccgaggcgcaacccucuacuacuacuacuacggcgacguauggggccaaggcaccacuguaacagucucauccgccuccacuaaaggccccucagucuucccccucgcacccugcucccgaucaacauccgaaucaaccgcggcccucggaugccuagucaaagacuacuuccccgaacccguaaccgucagcuggaacucaggcgcccucacauccggcguccacaccuuccccgccguccuacaauccuccggccucuacucauuaucaucuguaguaacuguccccuccuccaacuucggaacccaaaccuauaccugcaacgucgaccacaagcccuccaacaccaaaguagauaaaaccgucgaacgcaaaugcuguguagaaugcccucccugccccgcaccacccgucgccggacccucaguauuccuuuucccucccaaacccaaagacacccucaucucccgcacccccgaaguaaccugcguuguagucgacgucucacacgaagaccccgaaguacaauucaacugguacgucgacggcgucgaaguccacaacgccaaaacaaaaccucgcgaggaacaauucaacucuacauuccguguagucucaguucuaaccgucguacaccaagacuggcucaacggcaaagaauacaaaugcaaaguaucaaacaaaggccuaccagccccaaucgagaagaccaucuccaagacuaaaggccaaccacgcgagccacaagucuacacccuaccacccucucgcgaagaaacgaaaaaccaagucucucugacaugccucguaaaaggcuucuaccccuccgacaucgccguagaaugggaauccaauggacagcccgagaacaacuacaaaaccacaccaccccucgacuccgacggcuccuucuuccucuacuccaaacucacagucgacaaaucccgcuggcaacaaggaaacguauuuucaugcuccguccacgaggcccuccauaaucacuacacccaaaaaucccuaucccuaucucccggcaaa

SEQ ID NO: 54358 - RNA, 639 nt, Artificial Sequence
  derived and/or modified sequence opt11 from Ticiliuab_LightChain1
gacauccaaacccaaucacccucuucccucuccgccuccgucggagaccgcgucaccaucacuugccgugccucccaauccaucaacuccuaccucgacugguaccaacaaaaacccggaaaagcccccaaacuccucaucuacgccgccucuucacuccaauccggcgucccaucacgcuucuccggcuccggcuccggcaccgacuucacccucaccaucuccucccuccaacccgaagacuucgccaccuacuacugccaacaauacuacuccacccccuucaccuucggccccggcaccaaagucgaaaucaaacgcaccgucgccgcacccuccgucuucaucuucccacccucagacgaacaacucaaaucuggcaccgccuccgucgucugccuccucaacaacuucuacccccgcgaagcaaaaguccaauggaaagucgacaacgcccuacaguccggcaacucccaagaauccgucaccgaacaagacuccaaagacucaaccuacucccucuccucaacccucacccuauccaaagccgacuacgaaaaacacaaagucuacgccugcgaagucacccaccaaggccucuccucccccgucaccaaauccuucaaccguggcgaaugc

SEQ ID NO: 54359 - RNA, 1347 nt, Artificial Sequence
  derived and/or modified sequence opt11 from Tigatuzumab_HeavyChain1
gaaguacaacucgucgaauccggaggcggccuuguacaaccaggcggcucccuccggcucucaugcgccgcauccggcuuuacauucucaagcuacgucauguccuggguccgccaagcccccggcaagggccuugaauggguagccacaaucuccucaggaggauccuacaccuacuaccccgacuccgucaagggucgauucaccauaucacgcgacaacgccaaaaauacccucuaccuccaaaugaacucccuacgagcagaagacacagccgucuacuauugcgccagacgaggcgacuccaugaucaccacagacuacuggggccaaggcacccuuguaaccgucuccucagcauccacuaaaggcccuucggucuucccccucgcaccaucauccaaauccaccuccggcggaacugcugcacucggaugccuugucaaagacuacuuccccgaaccagucaccgucucauggaacucaggugcccucacauccggcguccacaccuuccccgcaguccuccaauccuccggccucuacucacuaucaucuguagucacuguaccaagcuccucacucggcacccagacauacauaugcaacgucaaccacaaacccuccaacaccaaaguagacaaacgagucgaaccaaaauccugcgacaaaacccacacaugcccacccugcccggccccggaacuccucggcggacccuccgucuuccuauucccacccaaacccaaggauacacucaugaucucccgcacacccgaaguaaccugcgucgucgucgacgucucccacgaagaccccgaagucaaauucaacugguacgucgacggcgucgaaguccacaacgcgaaaacuaaaccccgcgaagaacaguacaacucaacauaccgcgucguauccguacucaccguccuccaccaagacuggcucaacggcaaagaauacaaaugcaaagucucaaacaaagcccuccccgcccccauagaaaagaccaucucaaaagccaaaggccaaccccgagaaccccaagucuacacccucccuccaucccgcgaagaaaugaccaaaaaccaaguaucccucacaugccuugucaaaggcuucuaccccagcgacaucgcagucgaaugggaauccaacggccaacccgaaaacaacuauaaaaccacacccccaguccucgauucagacggcuccuuuuuccucuacagcaaacuuaccgucgacaaaucucgauggcaacagggcaacgucuucucaugcagcguaaugcacgaagcacuccacaaccacuauacccagaaaucccuuucacugucuccaggaaaa

SEQ ID NO: 54360 - RNA, 1347 nt, Artificial Sequence
  derived and/or modified sequence opt11 from Tigatuzumab_HeavyChain
gaaguucaacucgucgaaucuggcggcggccucguccaacccggcggaucacuccgccuauccugcgcugccucaggcuucaccuuuuccuccuacguaauguccuggguccgacaagcacccggcaaaggccuugaauggguagccacuauauccucaggcggcuccuacaccuacuaccccgacagcguaaaaggccguuucacaauaucacgagacaacgccaaaaacaccuuauaccuacaaaugaacucccuccgcgccgaagacaccgccgucuacuacugcgcccgccgcggcgacuccaugaucaccaccgacuacuggggacaaggaacccucgucaccgucucgucugccuccaccaaaggaccauccguuuucccacucgcccccucauccaaaucuaccagcgguggaacagccgcccucggcugucucguaaaagacuacuuccccgaaccgguaaccgugucuuggaacucaggcgcccucaccucaggcguccacacauucccagcaguacuccaauccuccggacucuacucccucucaagcgucguaaccguacccuccuccucacuagguacacaaaccuacaucugcaacgucaaccacaaacccuccaauaccaaagucgacaaacgcguggaacccaaauccugugacaaaacucacacaugcccacccugccccgcccccgaacuacuaggcggacccucagucuuucucuucccacccaaacccaaagacacccucaugauaucccgcacccccgaaguuaccugcgucgucgucgacguaucacacgaagaccccgaagucaaauucaacugguacgucgauggagucgaaguccacaacgccaaaaccaaaccccgcgaagaacaauacaacuccacauaccgcgucgucuccguccuaacaguccuccaccaagacuggcucaacggcaaagaauacaaaugcaaagucuccaacaaagcccuccccgcacccauagagaaaaccaucucaaaagcaaaaggccaaccucgagaaccccaaguauacacacuacccccaucacgcgaagaaaugaccaaaaaccaagucucccuaaccugccucgucaaaggcuucuacccaucagauaucgccgucgaaugggaaucaaacggacaacccgaaaauaacuacaaaaccacaccacccguccucgacuccgacggcuccuucuuccucuacucaaaacucaccguagacaaaucccgcuggcaacaagguaacgucuucuccugcagcgucaugcacgaagcgcuccacaaccacuacacacaaaaaucacucucccucucccccggcaaa

SEQ ID NO: 54361 - RNA, 639 nt, Artificial Sequence
  derived and/or modified sequence opt11 from Tigatuzumab_LightChain1
gacauccaaaugacccaaucccccucuucccuauccgccucagucggcgaccgcgucacaauaaccugcaaagccucccaagacgucggcaccgccgucgccugguaccaacaaaaacccggaaaagcccccaaacuccucaucuacugggcauccacccgacacaccggcguccccucacgcuucuccggcuccggcuccggcaccgacuucacccuaaccaucuccucccuccaacccgaagacuucgccaccuacuacugccaacaauacuccucuuaccgaaccuucggccaaggcaccaaagucgaaaucaaacgcacagucgccgcccccucagucuucaucuucccacccuccgacgaacaacucaaauccggcaccgcuucagucgucugccuccucaacaacuucuacccccgcgaagccaaaguccaauggaaagucgacaacgcccuccaauccggaaacucccaagaauccgucaccgaacaagacuccaaagacuccaccuacucccucuccucaacccucacccuguccaaagccgacuacgaaaaacacaaagucuacgccugcgaagucacccaccaaggccuaucaucccccgucacaaaaucauucaaccgaggcgaaugc

SEQ ID NO: 54362 - RNA, 639 nt, Artificial Sequence
  derived and/or modified sequence opt11 from Tigatuzumab_LightChain
gacauccaaaugacccaaucccccuccucccucuccgccucaguaggcgaccgcgucaccaucacaugcaaagccucccaagacgucggcacagccgucgccugguaccaacaaaaacccggcaaagcccccaaacuacuaaucuacugggccuccaccagacacaccggcguccccucccgauucuccggcucaggcuccggaacagacuucacccucaccaucuccucccuacaacccgaagacuucgccacauacuacugccaacaauacuccuccuaccgcacauucggccaaggcaccaaagucgaaaucaaacgaaccgucgccgcccccuccgucuucaucuucccacccuccgacgaacaacucaaauccggcaccgccucagucguaugccuacuaaacaacuucuacccccgcgaagccaaaguccaauggaaagucgacaacgcccuccaauccggaaacucccaagaauccgucaccgaacaagacuccaaagacuccaccuacucccucucauccacccuaacccucuccaaagccgacuacgaaaaacacaaagucuacgccugcgaaguaacccaccaaggccuuuccucccccgucaccaaauccuucaaccgaggcgaaugc

SEQ ID NO: 54363 - RNA, 1338 nt, Artificial Sequence
  derived and/or modified sequence opt11 from Tildrakizumab_HeavyChain1
caaguccaacucguccaauccggagcagaagucaagaaacccggcgcaagcgucaaagucuccugcaaagccagcggauacaucuucaucaccuacuggaugacauggguacgacaagcccccggacaaggccucgaauggaugggccaaaucuuccccgccucuggaagcgccgacuacaacgaaaaauucgagggccgcgucacaaugacaacagacaccuccacaagcaccgccuauauggaacuccgaucacuacgcuccgacgacaccgccgucuacuauugcgcaaggggcggaggcggcuucgcguacuggggacaaggaacgcucgucaccgucucaucugccuccacaaaaggaccaucaguauucccacucgcacccuccagcaaaucaaccuccggcggcaccgccgcccucggcugccuagucaaagacuacuuccccgaacccgucaccgucuccuggaacucaggcgcacucacuucaggagugcacacguucccagccguacuccaaagcagcggacucuacucacucuccucugucguuaccgucccauccagcagccucggaacgcaaacauacaucugcaacgucaaccacaaacccuccaacacaaaaguggacaagaaaguagagccaaaauccugcgacaaaacacacacgugcccacccugccccgcacccgaacuucuagguggccccuccgucuuccucuucccacccaaacccaaagacacccucaugaucuccagaacacccgaaguaaccugcgucgucgucgacgucucccacgaagacccagaagucaaauucaacugguacgucgacggcgucgaaguucacaacgcaaaaacaaaaccccgcgaagaacaauacaacuccaccuaccgcgucguaagcguccucaccguccuacaccaagacuggcuaaacggcaaagaauacaaaugcaaaguuagcaacaaggcacuccccgcccccauugagaaaaccauuucaaaagcaaaaggccaaccacgcgaaccacaagucuacacccucccucccagccgggacgaacucaccaaaaaccaagucucacuaacuugccucguuaaagguuucuaccccucagacaucgccgucgaaugggaaucgaacggccaacccgaaaacaacuacaaaaccaccccacccguacucgacucagacggauccuucuuccuauacuccaaacucacaguagacaaaucccguuggcaacaaggcaacgucuucagcugcuccgucaugcacgaagccuuacacaaccacuacacacagaaaagccucagccugucccccggcaaa

SEQ ID NO: 54364 - RNA, 642 nt, Artificial Sequence
  derived and/or modified sequence opt11 from Tildrakizumab_LightChain1
gacauccaaaugacccaaucacccuccucccuauccgccucagucggcgaccgcguaaccauaaccugccgcaccuccgaaaacaucuacuccuaccucgccugguaccaacaaaaaccaggcaaagcccccaaacuuuuaaucuacaacgccaaaacacucgcagaaggcguccccuccagauucuccggcucaggcuccggcacagacuucacacucaccaucagcucccuccaacccgaagacuucgccaccuacuacugccaacaccacuacggcauccccuucacauucggccaaggcaccaaagucgaaaucaaacgcaccgucgccgcccccuccgucuucauauucccuccauccgacgaacaacucaaauccggaaccgccuccgucgucugccuccuaaacaacuucuacccccgcgaagccaaaguccaauggaaagucgacaacgcccuccaauccggcaacucccaagaauccgucaccgaacaagacuccaaagacuccaccuacucccuauccucaacccuaacccucuccaaagccgacuacgagaaacacaaagucuacgccugcgaagucacccaccaaggccucuccucacccgucaccaaauccuucaaccgcggcgaaugc

SEQ ID NO: 54365 - RNA, 1344 nt, Artificial Sequence
  derived and/or modified sequence opt11 from Tisotumab_vedotin_HeavyChain1
gaaguacaacuccucgaaucaggcgggggccucguacaacccggcggcucccuccgccucuccugugccgccagcggcuucaccuucucaaacuaugccaugucuuggguacgacaagcccccggcaaaggccucgaauggguauccucaaucucaggaagcggcgacuacaccuacuacacagacuccguaaaaggccgcuucacuaucucccgagacaacuccaaaaacacgcucuaccuacaaaugaacagcuuacgagccgaagacacagccguauacuacugcgccagaucccccuggggguacuacuuagacuccuggggccaaggcacccuuguaacggucuccuccgccuccaccaaaggcccaucaguauucccccucgcccccuccucaaaauccaccagcggcggcaccgcugcccucggaugccucgucaaagacuacuuucccgaaccaguaacagucagcuggaacucaggagcccuaaccuccggcguacacacauuccccgccguccuccaauccuccggccucuacagccucuccuccgucguuaccguacccuccucaucccucggcacccaaaccuacaucugcaacgucaaccacaaacccuccaacacuaaagucgacaaacgcguagaaccaaaauccugugacaaaacacacaccugucccccaugcccagcccccgaacuucucgguggacccagcgucuuccucuucccacccaaacccaaggacacccucaugaucucccgaacccccgaaguaaccugcgucgucgucgacgucucccacgaagaccccgaagucaaauucaacugguacgucgacggagucgaaguacacaacgcaaaaacaaagccccgugaggaacaauacaacuccaccuaccgaguaguaucuguacuuacaguccugcaccaggacuggcucaacgguaaagaguacaaaugcaaaguauccaacaaagcccuccccgcccccaucgagaaaaccauauccaaagccaaaggccaaccccgagaaccccaagucuacacccuaccacccucgcgcgaagaaaugaccaaaaaccaagucucacucacaugccuaguuaaaggcuucuaccccuccgacaucgccgucgaaugggaaucaaacggacagcccgaaaacaacuacaagaccacaccgcccguccuugacuccgacggauccuucuuccucuacagcaaacucaccguggacaaaucccgauggcaacaaggcaacguauucucaugcuccgucaugcacgaagcacuacacaaccacuacacccaaaaaucacuuucacuuucccccggcaaa

SEQ ID NO: 54366 - RNA, 642 nt, Artificial Sequence
  derived and/or modified sequence opt11 from Tisotumab_vedotin_LightChain1
gacauccaaaugacccaaucaccccccucccuaucugcauccgccggcgaccgagucaccaucaccugccgcgccucccagggaaucuccucccgccucgccugguaccaacaaaaacccgaaaaagcccccaaaucccuaaucuacgcagcauccucccuccaauccggcgucccaagccgcuucucuggcuccggcuccggcacagacuucacccucaccaucuccucccuacaacccgaagacuucgccacuuacuauugccaacaauacaacucuuaccccuacaccuucggccaaggaaccaaacucgaaaucaaacgcaccgucgcagcccccucagucuucaucuucccccccuccgacgaacaacucaaaucaggcaccgccuccgucgucugccuacucaacaacuucuacccccgcgaagccaaaguccaauggaaagucgacaacgcccuccaauccggcaacucccaagaaucagucaccgaacaagacuccaaagacucuaccuacucucucuccuccacacuuacacuauccaaagccgauuacgaaaaacacaaagucuacgccugcgaagucacccaccaaggccuauccucccccgucacuaaauccuucaaccgcggcgaaugc

SEQ ID NO: 54367 - RNA, 1341 nt, Artificial Sequence
  derived and/or modified sequence opt11 from Tocilizumab_HeavyChain1
guccaacuacaagaauccggccccggccucguccgccccagccaaacccuuagccucacaugcaccgucucaggauacucuaucaccuccgaccacgccuggucuuggguacgacaacccccaggccgcggccuugaauggaucggguacaucuccuacuccggcaucaccaccuacaacccaucccuaaaaagccgcgucaccaugcuacgcgacacaagcaaaaaccaauucucccuacgucuuucuuccgucacagccgcugacacagccgucuauuacugcgcgcguagccucgcccgcaccaccgccauggacuacuggggacaaggaucacucguaacagucucauccgccagcaccaaaggcccaucagucuucccccucgcucccuccuccaaauccacaucaggcggaaccgcagcccucggcugccuuguuaaagacuacuucccagaacccgucaccguuuccuggaacuccggagcccucaccagcgguguccacaccuuccccgccguccuacaauccucaggacucuacucccuauccucggucguuaccgucccauccagcucccuaggaacacaaaccuacaucugcaacguaaaccacaaacccuccaacacuaaaguagacaagaaagucgaacccaaaucuugcgacaaaacccacacuugcccucccugccccgcccccgaacuccucggcggccccucugucuuccucuuuccacccaaacccaaagacacccucaugaucucccgcacucccgaaguaaccugcgucgucgucgacguaucucacgaagaccccgaaguaaaauucaacugguacguugacggagucgaaguacacaacgccaaaaccaaaccccgcgaagaacaauacaacuccaccuaccgcgucgucucaguccuaaccguccuccaccaagacuggcucaacggcaaagaauacaaaugcaaaguaucuaacaaagcacuacccgcccccauagaaaagaccauaucaaaagccaaaggccaaccccgcgaaccccaaguauacacccucccacccucccgcgacgaacucaccaaaaaccaaguaucucucacuugccuugucaaaggcuucuaccccagcgauaucgcaguugaaugggaaucaaacggccaacccgaaaacaauuacaaaacaacacccccuguucuugacucugacggauccuucuuccucuacuccaaacucaccgucgauaaaucccgcuggcaacaaggcaacgucuucuccugcuccgucaugcaugaagcccuacacaaccacuacacccaaaagucccucucgcucucccccggc

SEQ ID NO: 54368 - RNA, 642 nt, Artificial Sequence
  derived and/or modified sequence opt11 from Tocilizumab_LightChain1
gacauacaaaugacccaaucccccuccucacucuccgccuccgucggcgaccgcgucaccauaaccugccgcgccucccaagacaucuccuccuaccucaacugguaccaacaaaaacccggcaaagcccccaaacuacuaaucuacuacaccucccgccuccacuccggcguccccucccgcuucucaggcuccggcucaggcaccgacuucaccuucaccaucuccucccuucagcccgaagacaucgccaccuacuacugccaacaaggaaacacccuccccuacacauucggccaaggcaccaaagucgaaaucaaacguaccgucgccgcccccuccgucuucaucuucccacccuccgacgaacaacucaaauccggcaccgccuccgucguaugccuccucaacaacuucuacccccgcgaagccaaaguccaauggaaagucgacaacgcccuccaauccggcaacucccaagaauccgucacagaacaagacuccaaagacucaaccuacucccucuccucaacccucacccucuccaaagccgacuacgaaaaacacaaagucuacgccugcgaagucacccaccaaggccucuccucacccguaaccaaauccuucaaccgcggcgaaugc

SEQ ID NO: 54369 - RNA, 1353 nt, Artificial Sequence
  derived and/or modified sequence opt11 from Tosatoxumab_HeavyChain1
gaaguccagaugguccagagcggcgccgaagucaaaaagcccggagaaccccuaaaaauauccugcaaaggcuccggcuacaaauucggaacacacuggauuggcugggucagacaacgcccaggaaaaggccucgaauggauggggauaauccacccagccgacuccgaaaccaaguacucccccucauuccaaggccaagucucauucucagccgacaaaucauccaacaccgcauaccuucacugguccacccuccgugcauccgacacagccauguacuacugcgcccgcagauccggcuccucaagcugguacgcccucgacuucuggggccagggcaccauggucaccgucuccucagccuccaccaaaggcccauccgucuucccccuggcaccuuccuccaaaagcaccuccggcggcacggcagcccuaggcugccucgucaaagacuacuuccccgagcccgucaccgucucauggaacuccggcgcacucacaucaggcguccacaccuuccccgccguccuccaaucaucaggccucuacucccuaucaagcgucgucaccgucccaucauccucccucggaacccaaacauacaucugcaaugucaaccacaaacccuccaacacaaaagucgacaaacgagucgaacccaaaucaugcgacaaaacgcauaccugucccccaugccccgcacccgaacuacucggcggacccuccguauuccucuucccacccaaacccaaagacacccuaaugaucucacgaacacccgaaguaaccugcgucgucgucgacguaucccacgaagaucccgaagucaaauucaacugguacgucgacggagucgaaguccacaacgccaaaaccaaaccccgagaagaacaauacaacagcaccuaccgcgucguauccguccucaccgugcuccaccaagacuggcuaaacggcaaagaauacaaaugcaaagucuccaacaaagcccuacccgccccaauagagaaaacaaucuccaaagccaaaggccaaccccgcgaaccccaagucuacacacuacccccuucacgagaagaaaugaccaaaaaccaagucucccuuaccugccucgucaaaggguucuaccccuccgacaucgccgucgaaugggaaucaaacggccaacccgaaaacaacuacaaaaccaccccucccguccucgacuccgacggcuccuucuuucuauacuccaaacuaaccgucgacaaaucccgcuggcaacaaggcaacgucuucucaugcucaguaaugcacgaagcacuacacaaccacuacacccaaaaaucacuaucacucucacccggcaag

SEQ ID NO: 54370 - RNA, 651 nt, Artificial Sequence
  derived and/or modified sequence opt11 from Tosatoxumab_LightChain1
caauccguccucacccaaucccccuccgccuccggcacccccggccaacgcgucaccaucuccugcuccggaggauccuccaacauaggcuccaacaccgucaacugguaccaacaauuccccggcgcagcccccaaacuccucaucuacacaaacaaccaacgcccauccggcguccccgaccgcuucuccggcucaaaauccggcaccuccgccucccucgccaucuccggccuccaauccgaagacgaagccgacuacuacugcgccaccugggacgacucccucaacggacucuacgucuucggcaccggcacaaaaguaaccguacucggccaacccaaagccaaccccaccguaacccuauucccccccuccuccgaagaacuccaagccaacaaagccacccuagucugccuaaucucagacuucuaucccggcgccgucaccgucgccuggaaagccgacggcuccccagucaaagccggcguagaaaccaccaaacccuccaaacaauccaacaacaaauacgccgccuccuccuaccucucccucacccccgaacaauggaaaucccaccgcuccuacuccugccaaguaacccacgaaggcucaaccguagaaaaaacagucgcccccaccgaaugcuca

SEQ ID NO: 54371 - RNA, 1341 nt, Artificial Sequence
  derived and/or modified sequence opt11 from Tositumomab_HeavyChain
caggcuuaccuacaacaauccggcgccgaacucgucagacccggcgccuccgucaaaaugagcugcaaagcauccggauacaccuucaccucguacaauaugcacugggucaaacaaacaccccgacaaggccucgaauggauuggcgcaauauaccccggcaauggcgacaccuccuacaaccaaaaauucaaaggcaaagccacccucaccguggacaaguccucaagcaccgccuauaugcaacucuccucccucaccucagaagauagcgccguauacuucugcgcccgcgucgucuacuauuccaacucauacugguacuucgacgucuggggcaccggaaccaccguaacagucuccggccccuccgucuucccccucgcuccaagcagcaaauccaccucaggaggcaccgccgcgcuuggcugccuagucaaagacuacuucccagaaccaguaaccguuuccuggaacuccggcgcucucaccucaggaguccacaccuucccagccguacuccaaagcucaggccucuacucacucuccuccgucguaaccguacccucauccucccucggcacccaaaccuacaucugcaauguaaaccacaaaccauccaacacaaaagucgacaagaaggcagaaccaaaaagcugcgacaaaacccacacaugcccacccugccccgcccccgaacuccuaggcggcccauccgucuuccuauucccacccaaaccaaaagacacccucaugaucucccgcaccccggaaguuaccugcgucgucguagacgucucacacgaagaccccgaggucaaauucaacugguacguagacggcgucgaaguccacaacgccaaaacaaaaccccgcgaagaacaauacaacagcaccuaccgcgucguguccguacuaacuguacuccaccaagacuggcucaacggcaaagaguauaaaugcaaagucucuaacaaagcccuccccgcccccauagagaaaaccaucuccaaagccaaaggccaacccagagaaccccaggucuacacucuacccccaucccgcgacgaacucaccaaaaaccagguaucccuaaccugccucguuaaaggcuucuaccccuccgacaucgcaguagaaugggaaagcaacggccaacccgaaaacaauuacaaaaccacacccccaguucuagacuccgacggcuccuucuuccuauacuccaaacuaaccguggacaaaucccgcuggcaacaaggcaacgucuucucaugcuccgucaugcacgaagcccuccacaaccacuacacccaaaaaucccucucacuauccccaggaaag

SEQ ID NO: 54372 - RNA, 630 nt, Artificial Sequence
  derived and/or modified sequence opt11 from Tositumomab_LightChain
caaaucguccucucccaaucccccgccauacuauccgccucccccggcgaaaaaguaaccaugaccugccgcgccucauccuccgucucauacaugcacugguaccaacaaaaacccggaucuucccccaaacccuggaucuacgccccauccaaccucgcauccggcguccccgcccguuucuccggcuccggcuccggcacauccuacucccucaccaucucucgcgucgaagccgaagacgccgccaccuacuacugccaacaaugguccuucaacccacccaccuucggcgccggcaccaaacucgaacuaaaacgaaccgucgccgcccccuccgucuucaucuucccucccuccgacgaacaacucaaauccggcaccgccuccgucguaugccuccucaacaacuucuacccccgcgaagccaaaguccaauggaaagucgacaacgcacuacaaucaggcaacucccaagaauccguaaccgaacaagauuccaaagacuccacauacucccucuccuccacccuaacccucuccaaagccgacuacgaaaaacacaaagucuacgccugcgaagucacccaccaaggccucucaucccccgucaccaaauccuucaaccgc

SEQ ID NO: 54373 - RNA, 1338 nt, Artificial Sequence
  derived and/or modified sequence opt11 from Tovetumab_HeavyChain1
caaguacaacucguagaaucuggcggcggccuaguaaaacccggaggcucccuacgccucuccugcgcagccagcggauucacauucuccgacuacuacaugaacuggauucgccaagccccuggcaaaggccucgaauggguaucauacaucuccucuuccggcucaaucaucuacuacgcagacucuguaaaaggacgcuucaccauaucccgcgacaacgcgaaaaacucccuuuaccuacaaaugaacucccuccgcgccgaagacacagccguguacuacugcgcccgagaagggcgaaucgcugcacgcggcauggacgucuggggacaagguaccacagucaccgucuccuccgccagcaccaaaggacccuccguuuucccacuagcaccaugcucucguucaaccuccgagucaaccgcagcccuaggcugccucgucaaagacuacuuccccgaacccguaacaguauccuggaacucuggcgcacucaccuccggcguccacaccuucccagccguccuccaauccagcggccucuacuccuuaucauccgucgucaccguccccagcuccaacuucggcacccaaacguacacuugcaaugucgaccacaaaccauccaacaccaaagucgacaaaaccgucgaacgcaaaugcugcguagaauguccucccugccccgccccacccgucgcaggccccuccgucuuccucuucccacccaaacccaaagacacccucaugaucucccgcacccccgaagugaccugcgucgucgucgacgucucgcacgaagaccccgaaguucaauuuaacugguacgucgacggagucgaaguacauaaugccaaaaccaaaccccgcgaagaacaauucaacuccaccuuccgaguagucuccguucuaaccguaguccaccaagacuggcucaacggcaaagaauacaaaugcaaagucuccaacaagggccuacccgcccccauugagaaaaccaucuccaaaaccaaaggccaaccccgagaaccccaaguauacacccucccacccucccgagaagaaaugaccaaaaaccaagucucacuuaccugccucguaaaaggcuucuaccccuccgauauagccguagaaugggaaagcaacggccagcccgaaaacaacuacaaaacuacacccccaaugcucgacucggacggauccuucuuccuauacuccaaacuuaccgucgacaaaucccgcuggcaacaaggaaacguuuucuccugcuccguaaugcacgaagcacuccacaaccacuacacacaaaaaucacuaucccuaucccccggcaaa

SEQ ID NO: 54374 - RNA, 645 nt, Artificial Sequence
  derived and/or modified sequence opt11 from Tovetumab_LightChain1
gacauacaaaugacccaaagccccuccucacucuccgccuccgucggcgaccgcgucucaaucacaugccgccccucccaauccuucucccgcuacaucaacugguaccaacaaaaacccggcaaagcccccaaacuccuaauccacgccgccuccucacucgucggcggcguaccaucccgcuucucaggcucaggcuccggcaccgacuucacccucaccaucuccucccuccaacccgaagacuucgccaccuacuacugccaacaaaccuacuccaacccacccaucaccuucggccaaggcaccagacucgaaaugaaacguaccgucgccgcccccuccgucuucaucuucccacccuccgacgaacaacucaaaucaggaacagccuccgucgucugccuacucaacaacuucuacccccgcgaagccaaaguccaauggaaagucgacaacgcccuccaauccggaaacucacaagaauccgucaccgaacaagacuccaaagacucuaccuacucccucuccuccacccuuacccucuccaaagccgacuacgaaaaacacaaagucuacgccugcgaagucacccaccaaggccucuccucacccgucaccaaauccuucaaccgcggcgaaugc

SEQ ID NO: 54375 - RNA, 1347 nt, Artificial Sequence
  derived and/or modified sequence opt11 from Tralokinumab_HeavyChain1
caaguacaacucguccaauccggagccgaagucaagaaaccaggcgcaagcgucaaagucaguugcaaagcgagcggguacaccuucacaaacuacggccuaaguuggguccgccaagcgcccggacaaggccucgaauggaugggauggaucucagccaauaacggcgacacaaacuacggacaagaguuccaaggccgcgucacaaugaccacugacacaucaacaagcacggccuacauggaacuccgaagccucagauccgacgacaccgcugucuacuacugcgcacgcgacucauccucaagcugggccagaugguucuucgaccucuggggccggggaacccuaguaaccguaagcucagccucaaccaaaggacccagcguguucccccucgcccccugcagccgcagcacaagcgaguccaccgccgcucuaggcugccugguaaaagacuacuucccagaaccagucacagucucauggaacagcggcgcucucaccucagguguccacacauucccagccguacuccaaaguucgggccuauacucacucuccagcgugguaaccgucccaagcagcucauugggcacgaaaacauacacaugcaacgucgaccacaaacccagcaacacaaaaguagacaaacgcgucgaaucgaaauacggcccacccugccccucgugcccggccccggaguuccuaggcggcccaagcguauuccuguuucccccaaagccaaaagacacauuaaugaucucccgcacccccgaaguaaccugcguagucguggacguaucccaggaagaccccgaaguucaauucaauugguaugucgacggcguagaaguacacaacgccaagaccaaaccccgggaagaacaauucaacucaaccuaccgcgucgucucaguccuaaccguacuccaccaagacuggcucaacggaaaagaauacaagugcaaagucucaaacaaaggccuaccaucaagcaucgagaaaaccauaagcaaagccaagggccaaccccgagaaccacaagucuacacacuaccacccucacaagaagaaaugaccaagaaccaggucucgcuaaccugccuggucaaaggcuucuaccccagcgacauagcagucgaaugggaauccaacggccaacccgaaaacaacuacaaaaccacacccccaguccuagacucagacggcagcuucuuccucuacucccgccuaaccgucgacaaaucacgguggcaagaaggaaacgucuucuccugcagcgucaugcacgaggcacuacacaaccacuacacccaaaaaucacucucgcucucacugggaaaa

SEQ ID NO: 54376 - RNA, 642 nt, Artificial Sequence
  derived and/or modified sequence opt11 from Tralokinumab_LightChain1
uccuacguccucacucaaccacccucagucuccgucgcccccggcaaaaccgcccgcaucacaugcggaggcaacaucaucggcuccaaacucguccacugguaccaacaaaaacccggacaagcccccguccuagucaucuacgacgacggcgaccgacccuccggcauccccgaacgauucuccggcuccaacuccggcaacaccgccacccucaccaucucccgcgucgaagcaggcgacgaagccgacuacuacugccaagucugggacaccggcuccgacccaguagucuucggcggcggcaccaaacucaccguccuuggccaacccaaagccgcacccuccgucacccucuucccacccuccuccgaagaacuccaagccaacaaagccacccucgucugccuaaucagcgacuucuaccccggagcagucaccgucgccuggaaagccgacuccucccccgucaaagccggcgucgaaaccaccacccccuccaaacaauccaacaacaaauacgccgccucaucauaccucucucucacacccgaacaauggaaaucccaccgauccuacucaugccaagucacccacgaaggcuccaccgucgaaaagaccgucgcccccaccgaaugcucc

SEQ ID NO: 54377 - RNA, 1332 nt, Artificial Sequence
  derived and/or modified sequence opt11 from Trastuzuab_HeavyChain1
gaaguacaacuggucgaaagcggcggaggccucguacaacccggcggaucacuucgacucucaugcgccgcgagcggguucaacaucaaagacaccuacauccacuggguccgccaagccccaggaaaaggacucgaaugggucgcccgaaucuaccccacaaacggcuacacacgcuacgccgacagcgucaaaggcagauucaccauaucagcugacacguccaaaaacaccgccuaccuccaaaacucccuccgcgccgaagacacggccgucuacuacugcucccgauggggcggagacggauucuacgccgacuauuggggacaaggcacccuagucacagucucaagcgccuccaccaaaggccccucaguauucccgcucgcccccucaagcaagagcacaucaggagguacagccgcacucggcugccucgucaaggacuacuuccccgaacccgucaccgucuccuggaacuccggcgcccuuacaucaggaguccacacauucccugccguccuccaauccucuggccucuacucccuaucuucagucgucacuguacccagcucaucacuaggcacccaaaccuacaucugcaacgucaaccacaaacccuccaacacaaaagucgacaagaaagucgaacccaaauccugcgacaaaacacacaccuguccacccugccccgcacccgaacucuuagguggaccauccgucuuccuuuucccucccaaacccaaagacacccucaucucacgaacacccgaaguaaccugcgucgucgucgacgucucacacgaagaucccgaagucaaauucaacugguacgucgacggcgucgaaguccacaacgccaaaaccaaaccccgcgaagaacaauacaacagcaccuaccgcguagucuccguccucacaguccuacaccaagacuggcuaaacggcaaagaauacaaaugcaaagucucaaacaaagcccucccugcaccaauagaaaagacuaucuccaaagccaagggccaaccccgcgaaccucaagucuacacacucccucccucccgagaagaaaccaaaaaccaagucagccuaaccugccucgucaaaggguucuaccccucagacaucgccguagaaugggaaucgaacggccaaccugaaaacaacuacaaaaccacacccccaguccucgacuccgacggcucguucuuccucuacagcaaacucaccgucgacaaguccagauggcaacaaggaaacgucuucuccugcuccguccacgaagcacuccacaaccacuacacccaaaaaucgcuuucccucucuccuggc

SEQ ID NO: 54378 - RNA, 639 nt, Artificial Sequence
  derived and/or modified sequence opt11 from Trastuzuab_LightChain1
gacauccaaacccaaucccccuccucccucuccgccuccgucggcgaccgcgucaccaucacaugccgcgccucccaagacgucaacaccgccgucgccugguaccaacaaaaacccggcaaagcccccaaacuccucaucuacuccgccuccuuccuauacagcggcguccccucccgcuucucaggcucacgcuccggcaccgacuucacccuaaccaucuccucacuccaacccgaagacuucgccacauacuacugccaacaacacuacacgaccccacccaccuucggacaaggaaccaaagucgaaaucaaacgcacagucgccgcccccucagucuucaucuucccucccuccgacgaacaacucaaaucaggcaccgccuccgucgucugccuccucaacaacuucuacccccgcgaagccaaaguccaauggaaagucgacaacgcacuccaauccgguaacucccaagaauccgucaccgaacaagacuccaaagacuccaccuacucccucuccuccacccucacccucuccaaagccgacuacgaaaaacacaaagucuacgcaugcgaagucacccaccaaggccucucaucccccgucaccaaauccuucaaccgcggcgaaugc

SEQ ID NO: 54379 - RNA, 1347 nt, Artificial Sequence
  derived and/or modified sequence opt11 from Trastuzumab_emtansine_HeavyChain1
gaaguccaacucgucgaaucgggaggcggccucguccaacccggcggcucucuacgccuauccugcgccgccagcggcuuuaacaucaaagacacauacauacacuggguacgccaagcacccggcaaaggacuagaauggguagcccgcaucuauccaacaaacggcuacacacgcuacgccgacuccgucaaaggacgcuucaccauauccgccgauaccuccaaaaacaccgcauaccuccaaaugaacucacuccgcgcagaagacaccgcuguauacuacugcucccguuggggcggcgacggcuucuacgccauggacuacuggggccaaggcacccuagucaccgucucaagugccagcacaaaaggccccagcgucuucccccuagccccauccucuaaaagcacauccggcggcacagcugcacugggcugccucgugaaagacuacuucccagaacccgucaccguaagcuggaacuccggagcccucaccuccggcguacacacauuccccgccguacuccaaucaucgggccuauacucccucagcagcgucgucaccgucccaucaucaagccucggcacacaaaccuacauuugcaacgucaaccacaagccauccaacaccaaaguggacaagaaagucgaacccaaaucuugcgacaaaacacauacaugcccucccugucccgccccagaacuacuaggaggccccagcguauuccucuucccaccaaaaccuaaggacacccuaaugaucagccguaccccagaaguaacaugcguagucgucgacgucucccacgaagaucccgaagucaaauucaacugguacgucgacggcgucgagguacacaacgcaaaaaccaaaccacgagaagaacaguacaacuccacauaccgagucguaucuguccucacaguacuccaccaagacuggcucaacggcaaagaauacaaaugcaaaguuucaaacaaggcccuacccgcccccaucgagaaaaccaucagcaaagcaaaaggccaaccuagagaaccacaagucuacacccuacccccaagccgagaagaaaugaccaaaaaccaaguaucccuaaccugccuagucaaaggcuucuacccauccgacaucgccguagaaugggaauccaacggccaacccgaaaacaacuacaaaacaacaccgccaguacuagacucagacggcuccuucuuccuauacagcaaacuaacagucgacaaaucucgcuggcaacaaggcaacguauucuccugcuccgucaugcacgaagcccuacacaaccacuacacacagaaaucccucucacucuccccaggc

SEQ ID NO: 54380 - RNA, 642 nt, Artificial Sequence
  derived and/or modified sequence opt11 from Trastuzumab_emtansine_LightChain1
gacauccaaaugacacaaucccccucuucccucuccgccuccguaggcgaccgcgucaccaucacaugccgcgcaagccaagacgucaacaccgccgucgccugguaccaacaaaaacccggaaaagcccccaaacuccucaucuacuccgccuccuuccucuacuccggcguccccuccagauucuccggcucccgcuccggaaccgacuucacccuaaccaucuccucccuccagcccgaagacuucgccaccuacuacugccaacaacacuacaccacaccacccacauucggccaaggcaccaaagucgaaaucaaacgcaccgucgccgcccccuccgucuucaucuucccacccucggacgaacaacucaaaucaggcaccgccuccgucgucugccuccuaaacaacuucuacccccgcgaagccaaaguccaauggaaagucgacaacgcccuacaaucaggcaacucccaagaauccgucaccgaacaagacuccaaagacuccaccuacucccuaagcuccacccuaacccuauccaaagccgacuacgaaaaacacaaaguauacgcaugcgagguuacccaccaaggacuauccucccccguaaccaaauccuucaaccgcggcgaaugc

SEQ ID NO: 54381 - RNA, 1347 nt, Artificial Sequence
  derived and/or modified sequence opt11 from Trastuzumab_HeavyChain1
gaaguacaacuugucgaaucaggcggaggucuaguccagcccggcggcucccuccgccucuccugcgccgccuccggcuuuaacauaaaggacacauacauccacuggguacgacaagcucccggcaaaggccuagaauggguugcccgcaucuaccccacaaacggcuacacacgauacgccgacucagucaaaggccgauucacaaucuccgccgacaccuccaaaaacacagccuaccuacaaaugaacagccuucgcgccgaggacaccgccgucuacuacugcagccgcuggggcggcgacggcuucuacgccauggacuacuggggacaagggacccucgucaccguuagcuccgccuccaccaaaggucccucagucuucccccuagcccccucuuccaaaagcaccuccggcggcaccgccgcacucggaugccuaguaaaggacuacuuccccgaacccguaacagucucauggaacuccggagcacucaccucaggcguccacaccuucccugcaguucuucaauccuccggacucuacagccucucauccgucgucacaguacccuccuccucacucggcacccaaaccuacauaugcaacgucaaccacaaacccuccaacaccaaagucgacaagaaaguggaaccaaaauccugcgacaaaacccacacuugcccaccaugccccgcccccgaacugcucggaggucccucagucuuccucuucccacccaaaccaaaagacacccucaugaucucccgcacccccgaaguaaccugcgucgucgucgauguaucccacgaagaccccgaggucaaauucaacugguacgucgacggagucgaaguccacaacgccaaaaccaaaccccgagaagaacaguacaauagcaccuacagagucgucuccguccucaccguccuacaccaagacuggcucaacggaaaagaguacaaguguaaaguauccaacaaagcucuacccgcccccaucgagaaaaccauaucaaaagcaaaaggucaaccccgugaaccccaagucuacacacucccacccucacgcgaagaaaugaccaaaaaucaggucucccuaaccugccucgucaaaggcuucuaccccucagacauagcaguugaaugggaaagcaacggccaacccgaaaacaacuacaaaaccaccccacccguccucgacucagacggaucauucuuccucuacuccaaacucaccguagacaaaucccgcuggcaacaaggaaacguguucuccugcuccgucaugcacgaggcccuacacaaccacuacacacaaaagucccucucccucagccccggc

SEQ ID NO: 54382 - RNA, 1353 nt, Artificial Sequence
  derived and/or modified sequence opt11 from Trastuzumab_HeavyChain
gaaguccaacucgucgaauccggaggcggacucguccaaccuggaggcucccuccgacucuccugcgccgcaagcgguuucaacaucaaagacacauacauacacuggguccgacaagcacccggcaaaggacuugaaugggucgcccggauauaccccacgaacggcuacacccgauacgccgacagcguaaaaggacgcuucaccaucucagccgacaccuccaaaaacaccgccuaccuacaaaugaauagucuacgcgcagaagacaccgcagucuacuacugcucaagauggggaggcgauggauuuuacgcaauggacuacuggggccaagggacccucguaacaguaucaucagcuaguaccaaaggcccauccgucuucccacucgcccccucuuccaaaagcaccagcggcggcacagccgcgcucggcugccuagucaaagacuacuuccccgaaccaguaacagucucauggaacuccggagcccuaacuucaggcguacacacauucccagccguacuccaaagcuccggccucuacucccucuccuccguugucaccguccccuccuccucccuaggcacccaaacauacauaugcaacguaaaucacaaacccuccaacacaaaagucgacaagaaagucgaaccgcccaaauccugugacaaaacacauaccugcccgcccugccccgcacccgaacuccucggcggccccagcguauuccucuucccacccaaacccaaagacacacucaugaucucccgcacccccgaaguaacaugcguggucgucgacgucagccacgaagacccagaaguaaaauucaacugguacgucgacggcguggaaguacacaacgccaaaacaaaaccccgagaagaacaguacaacucaaccuacagggucgucuccguccucaccguacuacaccaagacuggcugaacggcaaagaauacaaaugcaaagucucaaacaaagcccuccccgcacccaucgagaaaacaauaagcaaagccaaaggccaaccacgcgaaccccaaguuuacacacuaccacccucccgcgacgaacucaccaaaaaccaagucucccuaaccugccucgucaaaggcuucuacccuagcgacauagcagucgaaugggaauccaacggacaacccgaaaacaauuacaagaccacacccccaguccucgacuccgacggcuccuucuuccucuacuccaaacucaccgucgacaaaucacgauggcagcaaggcaacgucuucuccugcucggucaugcacgaagcccuccacaaccacuacacccaaaaaucacucucgcucucccccggaaaa

SEQ ID NO: 54383 - RNA, 660 nt, Artificial Sequence
  derived and/or modified sequence opt11 from Trastuzumab_HeavyChain_variant_1n8z_B
gaagugcaacuggucgagagcggaggcggacucguacaaccgggcgggagccugagacuaagcugcgccgcgagcggauucaacaucaaggacacguacauacacugggucaggcaagcacccggaaaagggcuagaauggguggcaaggaucuaucccacgaacggauacacgcgauacgccgacagcgugaaagggcgauucaccauaagcgcugacacaagcaagaacaccgccuaccuccagaugaacagccugcgcgcggaagacaccgcagucuacuacugcagcagauggggaggcgacggauucuacgcgauggacuacuggggccagggcacgcucgugaccgugagcucggccucgaccaaaggcccgagcguguucccgcucgcacccucgagcaagagcaccagcggaggcacggccgcgcucgggugccuggucaaggacuacuucccggaaccagucacggucucguggaacagcggggcccugaccucgggcgugcacacguucccggccgugcuacagagcucgggccuauacucgcucucaagcguagucacggucccgagcucaagccuaggcacgcaaacguacauaugcaacgucaaccacaaacccucgaacacgaaaguggacaagaaaguggaaccg

SEQ ID NO: 54384 - RNA, 45 nt, Artificial Sequence
  derived and/or modified sequence opt11 from Trastuzumab_HeavyChain_variant_7637_H
gaacccaaauccugcgacaaaacccacaccugcccccccugcccc

SEQ ID NO: 54385 - RNA, 642 nt, Artificial Sequence
  derived and/or modified sequence opt11 from Trastuzumab_LightChain1
gacauccaaaugacccaaucccccuccucccucucagccuccgucggugaccgcgucaccaucaccugccgcgccucccaagacgucaacaccgccgucgccugguaccaacaaaaacccggaaaagcacccaaacuccucaucuacuccgccuccuuccuauacuccggcgucccaucccgcuucuccggcucacgcuccggcaccgacuucacacucaccaucuccucccuccaacccgaagacuucgccaccuacuacugccaacaacacuacaccaccccccccaccuucggacaaggcaccaaagucgaaaucaaacgcaccgucgccgcccccuccgucuucaucuucccccccuccgacgaacaacucaaauccggcacagccuccgucgucugccuccucaacaacuuuuacccccgcgaagccaaaguccaauggaaagucgacaacgcacuccaauccggcaacucccaagaauccgucaccgaacaagacuccaaagacuccaccuacucccucuccuccacacucacccuauccaaagccgacuacgaaaaacacaaagucuacgccugcgaagucacccaccaaggccuaucaucccccgucaccaaguccuucaaccgaggcgaaugc

SEQ ID NO: 54386 - RNA, 642 nt, Artificial Sequence
  derived and/or modified sequence opt11 from Trastuzumab_LightChain_variant_1n8z_A
gacauccaaaugacccaaucccccucaucccucucagcauccgucggcgaccgcgucaccaucacaugccgcgccucccaagacgucaacaccgccgucgccugguaccaacaaaaacccggcaaagcccccaaacuccucaucuacuccgccuccuuccucuacuccggcguccccucccgcuucuccggcucacgcuccggcaccgacuucacccucaccaucuccucacuccaacccgaagacuucgccaccuacuacugccaacaacacuacacaaccccaccaaccuucggacaaggcaccaaagucgaaaucaaacgcaccgucgcagccccguccgucuucaucuucccacccuccgacgaacaacucaaauccggcaccgccuccgucgucugccuccuaaacaacuucuacccccgcgaagccaaaguccaauggaaagucgacaacgcacuucaauccggaaacucccaagaauccgucaccgaacaagacuccaaagacucaaccuacucccucuccucaacccucacccucucaaaagccgacuacgaaaaacacaaagucuacgccugcgaagucacccaccaaggacucuccucacccgucaccaaauccuucaaccgcggcgagugc

SEQ ID NO: 54387 - RNA, 642 nt, Artificial Sequence
  derived and/or modified sequence opt11 from Trastuzumab_LightChain_variant_7637_L
gauauacaaaugacccaaucccccuccucacucuccgccucagucggcgaccgcguaacaauaaccugccgagcaucccaagacgucaacaccgccgucgccugguaccaacaaaaacccggcaaagcccccaaacuccuaauauacuccgccuccuuccucuacucaggcguccccucccgauucucuggcucccgcuccggcaccgacuucacccucaccaucuccucccuccaacccgaagacuucgccaccuacuacugccaacaacacuacaccaccccccccaccuucggccaaggcaccaaagucgaaaucaaacgcaccgucgccgcccccuccgucuucauauucccccccuccgacgaacaacucaaauccggcaccgccuccgucgucugccuccucaacaacuucuacccccgcgaagccaaaguccaauggaaagucgacaacgcccuccaauccggaaacucucaagaaucugucaccgaacaagacuccaaagacucaaccuacucccucuccucaacacucacccucuccaaagccgacuacgaaaaacacaaaguauacgccugcgaagucacccaccaaggccucuccucccccgucaccaaauccuucaaccgcggagaaugc

SEQ ID NO: 54388 - RNA, 1344 nt, Artificial Sequence
  derived and/or modified sequence opt11 from TRC-105_HeavyChain1
gaagucaagcucgaagaaucaggcggcggacucguccaaccaggcggcuccaugaaacucuccugcgccgccuccggauucaccuucagcgacgccuggauggacuggguacgccaaucccccgaaaaaggccucgaaugggucgcagaaauccgaagcaaagccucaaaccacgccaccuacuacgcagaauccgucaagggccgcuucacuaucucccgggacgacuccaaguccucaguguaccuccaaaugaacucccuacgagcagaagacaccggcaucuacuacugcacccgcuggcgccgcuucuucgacucauggggacaaggcaccacccucaccguaucguccgccucaacaaagggccccucugucuucccccucgcccccuccuccaaaucaaccucaggaggcacagccgcccuaggcugccuaguaaaagauuauuucccagaacccguaaccguauccuggaacucaggcgcccucaccuccggcguccacaccuuccccgcaguccuccaauccagcggccucuacucccuauccuccguagucaccguccccucgagcucccuagggacacaaaccuacaucugcaacgucaaccacaaacccucaaacaccaaagucgacaagaaaguagaaccaaaaucaugcgacaaaacacacacaugcccacccugccccgcacccgaacuacuaggcggcccauccgucuuccuauucccacccaaacccaaagacacacucaugaucucccgcacaccagaaguaaccugcgucguaguagacguaucccacgaagaccccgaaguaaaauuuaacugguacgucgacggaguagaaguacacaacgcaaaaaccaaaccccgugaagaacaauacaacagcaccuaucgagucgucucaguccuaaccguccuccaccaagacuggcucaacggaaaagaauacaaaugcaaagucuccaacaaagcacuccccgcccccaucgaaaagaccauauccaaagccaaagggcaaccccgagaaccccaagucuacacacucccuccuucccgcgacgaacucaccaaaaaccaggucucccuaaccugccucgucaaaggauucuacccauccgacaucgccgucgaaugggaauccaacggacaacccgaaaacaacuacaaaaccacaccacccguacucgacuccgacggauccuucuuccuauacucaaaacuuaccguagacaaaucaagauggcaacaaggcaacgucuucucgugcucagucaugcacgaagcacuacacaaccacuacacccaaaaaucccucucccuaucccccggcaaa

SEQ ID NO: 54389 - RNA, 639 nt, Artificial Sequence
  derived and/or modified sequence opt11 from TRC-105_LightChain1
caaaucguccucagccaaucccccgccauccucucagccucccccggcgaaaaagucaccaugaccugccgcgccuccuccuccgucuccuacaugcacugguaccaacaaaaaccaggcuccucacccaaacccuggaucuacgccacauccaaccucgccuccggcguccccguccgcuucucaggauccggcuccggcaccuccuacucccucaccaucucccgcgucgaagccgaagacgccgccacauacuacugccaacaaugguccucaaacccacuaaccuucggcgccggcaccaaacuagaacucaaacgcacagucgcagcccccuccgucuucaucuucccacccuccgacgaacaacucaaauccggcacagccucagucgucugccuccuaaacaacuucuacccacgcgaagccaaaguccaauggaaagucgacaacgcccuccaauccggcaacucccaagaauccgucaccgaacaagacucaaaagacuccaccuacucccucuccuccacacucacccucagcaaagccgacuacgaaaaacacaaagucuacgccugcgaagucacccaccaaggccucuccucccccgucaccaaauccuucaaccgcggcgaaugc

SEQ ID NO: 54390 - RNA, 1362 nt, Artificial Sequence
  derived and/or modified sequence opt11 from Tregalizumab_HeavyChain1
gaagaacaacucguagaaucaggcggaggacucgucaaacccggcggcagucuaagacucuccugcgcggcuagcggcuucuccuucagugacugccgcauguacuggcuccggcaagcccccggcaagggacuagaauggaucggcgucaucuccgucaaaagcgaaaacuacggcgcaaacuacgcggaguccguccgaggccgcuucaccaucucccgugaugacagcaaaaacacagucuaccuccagaugaacucacucaaaaccgaagacaccgccgucuacuacuguuccgcguccuacuaccgauacgacgucggagccugguucgcguacuggggccaaggaacgcuuguaaccgucuccuccgcaagcaccaaaggacccuccgucuuccccuuggcccccuccucaaaguccaccucaggaggcaccgccgcacuaggcugccucgucaaagacuacuuucccgagcccguaacagucuccuggaacuccggcgcccucaccucaggaguacacaccuuccccgcaguccuacaauccuccggccuauacucacucuccagcgucgucacggucccuuccuccucccuuggcacccaaaccuacaucugcaacgucaaccacaaacccucaaacaccaaagucgacaagaaagucgaacccaaauccugcgacaaaacacauaccugcccacccugccccgccccggaacuccucggcggcccauccguauuccucuucccucccaaacccaaagacacccuaaugauaucccgaaccccagaagucacaugcguaguagucgacgucucccacgaagaccccgaagucaaauucaacugguacgucgacggcgucgagguccacaacgccaaaacaaaaccccgcgaagaacaauacaacuccaccuacagagucgucucaguacucacgguccuccaccaggacuggcuaaacggcaaagaguacaaaugcaaggucucaaacaaagcccuacccgcaccaaucgagaaaaccaucuccaaggccaaaggacaaccccgcgaaccacaaguuuacacccucccacccucacgcgacgaacucaccaaaaaucaagucucacuaacaugccucgucaaaggcuucuaccccuccgacaucgccguggaaugggaauccaacggccaacccgaaaacaacuacaaaaccaccccucccguacucgacuccgacggcucauucuuccuauacucaaaacuaaccgucgacaaaucccgcuggcagcaaggaaaugucuucagcugcucugucaugcacgaagcccuccacaaccacuacacccagaaaucacuuucacucagccccggaaag

SEQ ID NO: 54391 - RNA, 654 nt, Artificial Sequence
  derived and/or modified sequence opt11 from Tregalizumab_LightChain1
gacaucgucaugacacaaagccccgacucccucgccguauccuugggcgaacgagcaaccauaaacugccgagcauccaaauccguauccaccagcggauacucauacaucuacugguaccaacaaaaacccggccaaccacccaaacuccuaaucuaccucgccuccauacucgaauccggaguccccgaccgauucucaggcucgggcuccggaacagacuucacccuaaccaucuccucccuccaagccgaagacguagccguauacuacugccaacacucacgagaacuccccuggacauucggccaaggcaccaaagucgaaaucaaacgcaccgucgccgcccccagcgucuucaucuucccacccucagacgaacaacucaaaucaggcaccgccuccgucgucugccuacucaacaacuucuacccccgcgaagccaaaguccaauggaaagucgauaacgcacuccaaagcggaaacucccaagaauccgucaccgaacaagacuccaaagacucaaccuacucccuauccucaacccuaacccucuccaaagccgacuacgaaaaacacaaagucuacgcaugcgaagucacccaccaaggccucagcucccccgucaccaaaucauucaacagaggcgaaugc

SEQ ID NO: 54392 - RNA, 1353 nt, Artificial Sequence
  derived and/or modified sequence opt11 from Tremelimumab_HeavyChain1
caaguccaacucgucgaaucaggaggcggcgucguccaacccggccgcucacuacgacucuccugcgcagcaucaggcuucaccuucuccucauacggcaugcacuggguccgucaagccccaggcaaaggccucgaauggguagccgucaucugguacgacggauccaacaaauacuacgccgacuccgucaaaggccgcuucaccauaagccgcgacaacagcaaaaacacccucuaccuccaaaugaacagccuccgcgccgaagacaccgccgucuacuacugcgcccgagacccccgcggcgccacucucuacuacuacuacuacgguauggacguauggggccaaggaaccaccgucacagucuccuccgccuccacaaaaggcccaucagucuucccacuugcacccugcucacgcuccacauccgaaucaacagccgcacuaggcugccucguaaaagacuacuuucccgaacccgucacagucaguuggaacucaggcgcccucaccuccggaguucacaccuuccccgcaguccuccaaucguccggacuauacucccuguccuccgucguaaccguccccuccuccaacuucggcacccaaaccuacacaugcaacgucgaccacaaaccauccaacacaaaagucgacaaaacagucgaacgcaaguguugcgucgaaugcccucccugccccgccccacccgucgcaggccccagcguauuccuauucccucccaaacccaaagacacccucaugaucucccgaacgcccgaaguuaccugcgucgucgucgacguaucacacgaagaucccgagguccaauucaacugguacgucgacggagucgaaguacacaacgccaaaacuaagcccagagaagaacaauucaacucaacguuccgagucguaucaguccuaaccguuguacaccaagauuggcugaacggaaaagaauacaaaugcaaagucuccaacaaaggauuacccgcacccauagagaaaacaauauccaaaacaaaaggccaaccccgugaaccccaagucuacacacucccgcccucccgcgaagaaaugaccaaaaaccaagucucccuaaccugccuagucaaaggcuucuaccccucugacaucgccgucgaaugggaaucuaacggccaaccagaaaacaacuacaaaacgacucccccaaugcuagacuccgacggcuccuucuuccucuacucgaaacucaccguugacaaauccagauggcaacagggaaacguauucuccugcuccguaaugcacgaagcccuacacaaccacuacacacagaaaucccugagccucucccccggcaaa

SEQ ID NO: 54393 - RNA, 642 nt, Artificial Sequence
  derived and/or modified sequence opt11 from Tremelimumab_LightChain1
gacauccaaaugacacaaucccccucaucccucuccgccuccgucggcgaccgcguaaccauaaccugccgcgccucccaaagcaucaacuccuaccuagacugguaccaacaaaaacccggcaaagcccccaaacuccucaucuacgccgccuccucacuccaauccggaguccccucccgcuucuccggcuccggcuccggcaccgacuucacccucaccauauccucccuccaaccagaagacuucgccacauacuacugccaacaauacuacuccacccccuucacauucggccccggcaccaaagucgaaaucaaacgcaccgucgccgcccccuccguauucaucuucccacccuccgacgaacaacucaaauccggcaccgccuccgucgucugccuccuuaacaacuucuacccccgcgaagccaaaguccaauggaaagucgauaacgcccuccaaucaggaaacucccaagaauccguaaccgaacaagacuccaaagacuccaccuacucccucuccucaacccucacccucagcaaagccgacuacgaaaaacacaaagucuacgccugcgaagucacccaccaaggccucuccucccccgucaccaaauccuucaaccgcggagaaugc

SEQ ID NO: 54394 - RNA, 1341 nt, Artificial Sequence
  derived and/or modified sequence opt11 from Trevogrumab_HeavyChain1
gaaguccaaguccucgaaagcggaggcgaccucguacaacccggcgguucauuaagacuaagcugcgcagccuccggauucacauucuccgccuacgccaugaccuggguuagacaagcccccggcaaagggcucgaaugggucucagccauauccggcuccggcgguucugcauacuacgccgacagcguaaaaggccgcuucaccaucuccagagacaacaguaaaaacaccgucuacuuacaaaugaacucccugcgugcagaagacacagcagucuacuacugcgccaaagacggcgccuggaaaaugucgggccucgaugucuggggccaaggaacaacuguaaucgucuccuccgccuccacaaaaggcccauccgucuucccccucgcgcccugcucacgcagcacaagcgaauccacugccgcacucggcugccuagucaaggacuacuuccccgaaccagucacaguaagcuggaacucaggggcacucaccuccggcguccacaccuuucccgccguacuccaguccuccggacucuacagccuauccuccguaguaaccguccccuccucuucccucggaaccaaaacauauaccugcaacgucgaccacaaacccucgaacacaaaaguagacaaacgcgucgaauccaaauacggacccccuugcccgcccugccccgcacccgaguuccucggaggacccagcguauuccucuucccucccaagcccaaagacacacucaugaucucccgaacaccagaagucacaugcgucgucguagacguaagccaagaagacccagaaguccaauucaacugguacgucgacggcguggaaguccacaacgccaaaaccaaaccccgcgaagaacaauucaacucaacauaccgggucgucuccguucugaccguacuccaccaagacuggcuuaacggaaaagaauacaagugcaaaguauccaacaaaggccucccauccuccaucgaaaagacgauuagcaaagccaaaggccaaccacgagaaccacaaguauacacccucccacccucccaagaagaaaugaccaaaaaccaagucucacucaccugucuugucaaaggcuucuaccccuccgacauagccgucgaaugggaauccaacggucaacccgaaaacaacuacaaaaccacacccccaguccuggacuccgacggcuccuucuuccuguacucacgccucaccguagacaaaaguagauggcaagaaggcaacguauucucaugcuccgucaugcacgaagcccuccacaaccacuacacccaaaaaucacuaucccucucguuaggaaaa

SEQ ID NO: 54395 - RNA, 642 nt, Artificial Sequence
  derived and/or modified sequence opt11 from Trevogrumab_LightChain1
gacauccaaaugacccaaucccccgccucacuauccgccuccgucggcgaccgcgucaccaucacaugccgcgccucccaagacaucucagacuaccucgccugguaccaacaaaaacccggcaaaauaccccgccuccucaucuacacaaccuccacccuccaauccggaguccccucccgcuuccgcggauccggcuccggcaccgacuucacccuaaccaucucuucccuccaacccgaagacgucgccacauacuacugccaaaaauacgacuccgccccccucaccuucggcggcggcaccaaagucgaaaucaaacgcaccgucgccgcccccuccguauucaucuucccacccuccgacgaacaacucaaauccggcaccgccuccgucgucugccuccucaacaacuucuacccccgcgaagccaaaguccaauggaaagucgacaacgcccuacaaagcggcaacucacaagaaucaguuaccgaacaagacagcaaagacuccaccuacucccucuccuccacccuaacccucucuaaagccgacuacgaaaaacacaaagucuacgccugcgaagucacccaccaaggccucuccucacccgucacaaaaucauucaaccgcggcgaaugc

SEQ ID NO: 54396 - RNA, 1737 nt, Artificial Sequence
  derived and/or modified sequence opt11 from Tucotuzumab_celmoleukin_HeavyChain1
caaauccaauuaguccaaucaggcgccgaaguaaagaaaccaggcgaaacugucaaaaucucaugcaaagccucaggguacaccuucaccaacuacggcaugaacuggguuaaacaaacacccggaaaaggccucaaauggaugggcuggauaaacaccuacaccggcgaaccaaccuacgccgacgacuuuaaaggacgauucgcuuucucccucgaaacauccacuuccaccgcguuucuccaaaucaacaaccuucgcucagaagacacagccaccuauuucugcguccguuucaucucaaaaggcgauuacuggggccaaggcacauccguaaccgucucauccgccucaacaaagggccccuccguauucccucuugcccccaguucgaaguccacaagcggcggcaccgcggcccuaggcugccucguaaaagauuacuuccccgaacccgucaccgucucauggaacuccggcgcucuaaccuccggaguccacaccuuccccgccguacuccaaucauccggucucuacucccucucauccguagucaccguccccuccagcucacucggcacucaaaccuacaucugcaacgucaaccacaaacccuccaacacaaaaguagacaaaagagucgaaccuaagucaugcgauaaaacccacaccugucccccaugccccgccccagaacuacucggcggccccuccguauuccuguucccuccaaaacccaaagacacgcucaugaucucacgcacccccgaaguuaccugcgucgucgucgacguuucucacgaagauccugaagucaaauucaacugguacgucgacggcgucgaaguacacaacgcaaaaaccaaaccucgagaagaacaauacaacagcaccuaucgcguaguauccguccucaccguccuacaccaagacuggcucaacggcaaagaauacaaaugcaaagucucaaacaaggcccuccccgcgccaaucgagaaaacaaucuccaaagcaaaaggucaaccccgcgaaccccaaguauacacccucccacccagccgagaagaaaugaccaaaaaccaagucucccuaacgugccucgucaaaggauuuuaccccuccgacauagccguagaaugggaauccaacggccaacccgaaaacaacuacaagaccacaccacccguccuagauucggacggcuccuucuuccucuacuccaaacucacuguagacaaaucacgcuggcaacaaggcaacgucuucagcugcuccguaaugcacgaggcccuacacaaccacuacacccaaaaaucacucucacucucccccggaaaagcacccacaagcuccuccaccaagaaaacccaacuccaacucgagcaucuccuccuugaccuccaaaugauccucaauggcaucaacaacuauaaaaaccccaaacuaacacgaaugcucacauucaaauucuacaugcccaaaaaggcaacagaacucaaacaccuacaaugccuugaagaagaacugaaaccccucgaagaaguccucaaccucgcccaauccaaaaacuuccaccuucgaccccgcgaccuuaucuccaacauaaacguaauaguucuagaacucaaaggauccgaaacuaccuuuaugugcgaauacgcugacgagaccgccaccauagucgaguuccucaaccgauggauaaccuucugccaauccaucaucagcacacuuacc

SEQ ID NO: 54397 - RNA, 639 nt, Artificial Sequence
  derived and/or modified sequence opt11 from Tucotuzumab_celmoleukin_LightChain1
gaaaucguccucacccaaucccccgccacccucucacucucccccggcgaacgcgucacccuaaccugcuccgccuccuccuccgucucauacaugcucugguaccaacaaaaacccggcagcucccccaaacccuggaucuucgacaccuccaaccucgccuccggcuuccccgcccgauucuccggcucaggcuccggaaccuccuacucccucaucaucuccuccauggaagccgaagacgcagccaccuauuacugccaccaacgcuccggcuaccccuacacauucggcggcggaaccaaacucgaaaucaaacgaaccgucgccgcccccucaguauucaucuucccgcccuccgacgaacaacucaaaucaggcaccgccucagucgucugccuccucaacaacuucuacccccgagaagccaaaguccaauggaaagucgacaacgcccuccaauccggcaacucccaagaauccgucaccgaacaagacuccaaagacuccaccuacucccucuccuccacccucacccucuccaaagccgacuacgaaaaacacaaagucuacgccugcgaagucacacaccaaggccucuccucccccguaaccaaauccuucaaccgcggcgaaugc

SEQ ID NO: 54398 - RNA, 1344 nt, Artificial Sequence
  derived and/or modified sequence opt11 from Ublituximab_HeavyChain1
caagccuaccuacaacaauccggagcugaacucguacgccccggcgccucgguaaaaauguccugcaaagccuccggauacaccuucaccucauacaacaugcacuggguaaagcaaaccccacgucaagggcucgaauggaucgggggaauuuaccccggaaacggcgacaccuccuacaaccaaaaauucaaaggcaaagcaacccucacuguaggcaaaucauccuccaccgccuacaugcaacuaucaucccucacuucugaagacucagccgucuacuucugcgcccgcuacgacuacaacuacgcaauggacuacuggggccaaggcaccucaguaaccguaucaagcgccuccaccaaaggacccuccguuuucccgcuagcccccucauccaaauccaccagcggaggcaccgccgcccucggcugccucguaaaagacuacuuccccgaacccgucaccguauccuggaacuccggcgcacuaaccuccggcguccacaccuuccccgccguccuccaauccuccggacucuacagccucucauccgucgucacaguccccucauccucccuaggcacccaaaccuacauaugcaacguaaaccacaaacccuccaacaccaaaguagauaagaaaguagaaccaaaaucaugcgacaaaacccacaccugucccccaugccccgcccccgaacuccucgguggcccaucagucuuccucuucccacccaaacccaaagacacccuaaugauaagccgcacccccgaaguaaccugcgucgucgucgacgucagccacgaagauccagaagucaaauucaacugguacgucgacggcgucgagguccauaacgcaaaaaccaaaccacgugaagaacaauacaacuccacauacagagucgucuccgucuuaaccguccuacaccaagacuggcuuaacggcaaagaauacaaaugcaaagucuccaacaaagcccuacccgcaccaaucgagaaaaccaucuccaaagccaaaggucaaccucgcgaaccacaaguuuacacccucccacccucucgcgacgaacucaccaaaaaccaagucucccuuaccugccucgucaaaggauucuaccccagcgacaucgccgucgaaugggaaucuaacggccagcccgaaaacaacuacaaaaccacaccacccguccucgacucagacggauccuucuuccucuacucaaaacuaacaguagacaaaucccgguggcaacaaggcaacguauucuccugcuccgucaugcacgaagcccuccacaaccacuacacccaaaaaucccucucccuuagccccggcaaa

SEQ ID NO: 54399 - RNA, 639 nt, Artificial Sequence
  derived and/or modified sequence opt11 from Ublituximab_LightChain1
caaaucguccuaucccaaucacccgccauccucuccgccucccccggcgaaaaagucaccaugaccugccgcgccuccuccuccgucuccuacaugcacugguaccaacaaaaacccggcucuucccccaaacccuggaucuacgccaccuccaaccucgccuccggcguccccgcccgcuucuccggcuccggcuccggcacuucauacucauucaccaucucccgcguagaggccgaagacgcagccaccuacuacugccaacaauggacauucaacccacccaccuucggcggcggcacccgccucgaaaucaaacgcaccgucgccgcccccuccgucuucaucuucccccccuccgacgaacaacuaaaaucaggcaccgccuccgucgucugccuccucaacaauuucuacccccgcgaagccaaaguccaauggaaaguugacaacgcccuacaauccggcaacucccaagaauccgucaccgaacaagacucaaaagacuccaccuacucacuaucuuccacccucacccucuccaaagccgacuacgaaaaacacaaagucuacgccugcgaagucacccaccaaggccucuccucacccguaaccaaauccuucaaccgcggcgaaugc

SEQ ID NO: 54400 - RNA, 1353 nt, Artificial Sequence
  derived and/or modified sequence opt11 from Ulocuplumab_HeavyChain1
gaaguccaacucgucgaauccggcggcggacucguccaacccggcggcucucuacgacuauccugcgcugcagccggcuuuaccuucucaucauauuccaugaacuggguccgccaagcccccgguaaaggccucgaaugggucuccuacaucuccucgcgcuccagaaccaucuacuacgccgacucaguaaaaggccgcuucaccauuucucgagacaacgccaaaaacucccuauaucuacaaaugaacucucuccgagacgaagacaccgcagucuacuacugcgcacgcgacuacggcggacaacccccauacuacuacuacuacggcauggacgucuggggucaaggaaccaccgucaccgucucauccgcauccaccaaaggcccaucaguuuucccacuagcccccugcuccagaaguaccuccgaaucuaccgcagcccuaggcugccuaguaaaagacuauuucccagaacccgucaccguuuccuggaacuccggcgcacucacuuccggaguccacacauucccagccguccuucaauccucaggccucuacucacucuccuccgucgucacaguccccucauccucucugggaaccaaaacauacaccuguaaugucgaccacaaacccuccaauaccaaaguagacaaacgcgucgaaucaaaauacggaccucccugcccacccugccccgccccagaguuccucggcggcccauccgucuuucucuucccacccaaacccaaagauacacucaugaucucacgcacacccgaaguaaccugcgucgucguugacgucucccaagaagacccugaaguccaauucaacugguacguagacggugucgaaguccacaacgcaaaaaccaaaccccgcgaagaacaauucaacuccaccuaccgcgucguuucaguccuaacaguccuccaccaagacuggcucaacggcaaagaauacaagugcaaagucucaaacaaaggccuccccuccagcaucgaaaagacaaucuccaaagccaaaggccaaccccgcgaaccccaaguauacacccuacccccuucacaagaagaaaugaccaaaaaccaagucucacuuacaugucucgucaaaggcuucuaccccuccgacaucgccguugaaugggaaucaaacggccaacccgaaaacaacuacaaaaccaccccucccguccucgacuccgacggcuccuucuuccuauacucccgccucaccguagacaaaucaagauggcaagaaggaaacgucuucuccugcuccguaaugcacgaagcccuccacaaccacuacacccaaaaaucccucucacucucacugggc

SEQ ID NO: 54401 - RNA, 642 nt, Artificial Sequence
  derived and/or modified sequence opt11 from Ulocuplumab_LightChain1
gacauccaaaugacccaaucccccucaucccuauccgccuccguaggagaccgcguaaccauaaccugccgcgccucccaaggaaucuccucauggcuagccugguaccaacaaaaacccgaaaaagcccccaaaucccucaucuacgccgccagcucccuccaauccggcguccccuccagguucucuggcucuggcuccggcaccgacuucacacugaccaucuccucacuccaacccgaagacuucguaaccuacuacugccaacaauacaacuccuacccccgcaccuucggacaaggcaccaaagucgaaaucaaacgcaccgucgccgcccccuccguauucaucuucccucccuccgacgaacaacucaaauccggaaccgccucagucgucugccuccucaacaacuucuacccccgcgaagccaaaguccaauggaaagucgacaacgcccuccaauccggcaacucccaagaauccgucaccgaacaagacuccaaagacucaaccuacucccucagcucaacccucacccuaagcaaggccgacuacgaaaaacacaaagucuacgccugcgaagucacacaccaaggccuaagcucacccgucaccaaauccuucaaccgcggcgaaugc

SEQ ID NO: 54402 - RNA, 1344 nt, Artificial Sequence
  derived and/or modified sequence opt11 from Urelumab_HeavyChain1
caaguccaacuucaacaauggggcgcaggacuccuaaaacccuccgaaacgcuaucccugaccugcgccgucuacggcggcuccuuuuccggauacuacugguccuggauacgccaauccccggaaaaaggccucgaauggaucggagaaaucaaccacggaggauacguaaccuacaacccaucccuagaaucccgcgucaccaucagcguagauacauccaaaaaccaauucucccucaaacucuccuccgucaccgcugccgacaccgcaguauacuacugcgcaagagacuacggccccggcaacuacgacugguacuucgaccucuggggccgcggcacacucgucaccgucagcucugccucaacaaagggcccgucugucuuuccccucgcacccuguuccagaucaacaagcgaauccacagccgcacucggcugccuaguaaaagacuacuuccccgaaccagucacugucucauggaacuccggcgcccucaccuccggcguccacaccuuccccgccguccuccaguccuccggccuuuacucccucuccuccgucgucacaguccccucauccagccucggaaccaaaaccuacacaugcaacgucgaccacaaaccaucaaacaccaaagucgacaagcgcgucgaauccaaauacggcccaccuuguccucccugccccgcccccgaguuccucgggggccccuccgucuuucuauuuccacccaaacccaaagacacccucaugaucagccgcacccccgaagucacgugcgucguaguagacguuucccaagaagaccccgaaguacaauucaacugguacguugacggcguagaaguccacaacgcaaaaaccaaaccccgagaggaacaauucaacuccaccuaccgcgucgucucaguccucaccguccuccaccaagacuggcucaacggcaaagaauacaaaugcaaagucuccaacaaaggacuaccauccagcaucgagaaaaccauauccaaagcaaaaggccagcccagagaaccccaggucuacacccucccacccucccaagaagaaaugaccaaaaaccaagucucccuaaccugccuugucaaaggcuucuaccccucugacaucgcagucgaaugggaaaguaacggccaacccgaaaacaauuacaaaaccaccccacccguccuagacuccgacggcuccuuuuuccuuuacucccgacuaaccgucgacaaaucccgauggcaagaaggcaacguauucaguugcuccgucaugcacgaagcccugcacaaccacuacacccaaaaaucgcucucacucucccucggcaaa

SEQ ID NO: 54403 - RNA, 648 nt, Artificial Sequence
  derived and/or modified sequence opt11 from Urelumab_LightChain1
gaaaucguccucacccaaucccccgccacccucucacucucccccggagaacgcgccacccucuccugccgcgcuucccaauccguauccuccuaccucgccugguaccagcaaaaacccggccaagcccccagacuccucaucuacgacgccuccaaccgcgcaaccggcaucccagcccgcuucuccggcuccggcuccggcacagacuucacccucaccauauccucacucgaacccgaagacuucgccgucuacuacugccaacaacgcuccaacuggccccccgcccucaccuucugcggcggcaccaaagucgaaaucaaacgcaccgucgccgcccccagcgucuucauauucccccccuccgacgaacaacuaaaaucaggcaccgccucagucgucugccuccucaacaacuucuacccccgcgaagcuaaaguccaauggaaagucgacaacgcccuccaauccggaaacucccaagaauccgucaccgaacaagacuccaaagacuccaccuacucccuauccuccacccuaacccucuccaaagccgacuacgaaaaacacaaagucuacgcaugcgaagucacccaccaaggccucuccucacccgucaccaaauccuucaaccgcggcgaaugc

SEQ ID NO: 54404 - RNA, 1347 nt, Artificial Sequence
  derived and/or modified sequence opt11 from Urtoxazumab_HeavyChain1
gaaguccaacucguugaaagcggcggcggccucguccaacccggcggaagccuacgacucagcugcgccgcaagcggcuucacauucucuuccuacggaaugucauggguccgccaagcaccuggcaaaggacuagaaugggucgccacuauuucaaccggcggcuccuacaccuacuaccccgacuccguaaaaggacgauucaccaucucccgcgacaacgccaaaaacacccuuuaccuccaaaugaacucccuccgagccgaagacaccgccgucuacuacugcgcacgccguggcgacgccuggggaaaccuagacuacuggggacaaggcacccuagucaccgucucaucggccucuacgaaaggccccucaguuuucccacuagcccccagcaguaaauccaccagcggcggaaccgccgcucucggcugcuuagucaaagacuacuucccagaaccagucaccguaagcuggaacuccggcgcacucacaucagguguccacaccuucccagccguccuacaauccucaggccucuacucacucuccuccgucgucaccguaccgagcagcucacucggcacccaaaccuacaucugcaacguaaaccacaaacccagcaacacaaaagucgacaagaaagucgaaccaaaaucaugcgacaaaacccacacaugcccacccugccccgccccagagcuacucggaggccccuccguauuccucuucccacccaaacccaaagacacccucaugaucucccgcacacccgaaguaacaugcgucgucguagacgucagccacgaagaccccgaagucaaauucaacugguacguagauggcgucgaaguccacaaugccaaaaccaaaccccgcgaagaacaauacaacucaaccuacagagucgucagcguucuaaccguccuacaccaagacuggcucaacggcaaagaguacaaaugcaaagucucgaacaaagcccuacccgcccccaucgagaaaaccaucucuaaagccaaaggccaaccccgcgaaccccaaguauacacacucccucccucccgcgacgaacucaccaaaaaccaaguaucacucaccugucuagucaaaggcuucuaccccuccgacauugcaguugaaugggaauccaacggacaacccgaaaacaacuacaaaaccaccccacccgucuuagauucggacggcaguuucuuccucuacuccaaacucaccgucgacaaaagccgauggcaacaaggcaacguauucagcugcagcgucaugcacgaagcacuacacaaccauuacacccagaaaagccuaagccuaagccccggcaaa

SEQ ID NO: 54405 - RNA, 642 nt, Artificial Sequence
  derived and/or modified sequence opt11 from Urtoxazumab_LightChain1
gaaauaguacucacccaaucacccgccacccucuccgucucccccggcgaacgagccacccuauccugccgagccucccaaaccaucuccaacaaccuccacugguaccaacaaaaacccggccaagccccccgacuacucaucaaaucagcaucccaauccauauccggaauccccgcccgcuucucaggcuccggcuccggcaccgacuucacccuaacaaucuccucccucgaauccgaagacuucgccgucuacuacugccaacaauccuacucauggccccucaccuucggccaaggcaccaaagucgaaaucaaacgcacaguagcagcacccuccgucuucaucuucccccccuccgacgaacaacucaaaucaggcacagccucagucgucugccuacuaaacaacuucuacccccgcgaagccaaaguccaauggaaagucgacaacgcccuccaauccgguaacucccaagaauccgucaccgaacaagacuccaaagacucaaccuacucccucuccuccacacuaacccucuccaaagccgacuacgaaaaacacaaagucuacgccugcgaagucacccaccaaggccucuccucccccgucaccaaauccuucaaccgcggcgaaugc

SEQ ID NO: 54406 - RNA, 1347 nt, Artificial Sequence
  derived and/or modified sequence opt11 from Ustekinumab_HeavyChain1
gaaguacaacuaguccaaagcggcgcugaaguaaaaaaacccggcgaaucgcucaaaaucucaugcaaaggcucaggcuacucuuucaccacauacuggcucggcuggguccgccaaaugcccggcaaaggccucgauuggaucggcaucaugucccccguggacucagacauacgcuacucccccuccuuccagggccaagucaccaugucugucgacaaauccaucacaaccgccuaccugcaauggaacucacucaaagccucggacaccgccauguacuacugcgcccgacggcgaccaggccaaggcuacuucgacuuuuggggccagggcacccuggucaccgucagcuccuccuccacaaaaggccccagcgucuucccacucgcccccuccagcaaaagcaccuccggaggcacagccgcccuaggcugccucgucaaagacuacuuccccgaaccaguaaccgucuccuggaacuccggagcccuaaccuccggaguacacaccuucccugccguucuccaguccucaggccuuuacucacucuccuccgucgucaccguacccuccuccucccucggcacccaaaccuacauaugcaacgucaaucacaaaccauccaacacuaaagucgacaaacgcguagaaccgaaaucaugcgacaaaacccacacaugcccacccugcccagccccagaacuacucggcggcccaucggucuuucucuuccccccuaaaccaaaagacacccugaugaucucccgaacccccgaagucaccugugucguagucgacguaucccacgaagacccggaaguaaaauucaacugguacgucgacggagucgaaguccacaacgccaaaacaaaaccccgcgaagaacaauacaacagcacauaccgaguagucuccguacucacaguccuacaccaggacuggcucaacggaaaagaauacaaaugcaaagucuccaauaaagcccuccccgccccgaucgaaaaaaccaucuccaaagcgaaaggccaacccagagaaccacaagucuacacccuuccccccucacgcgacgaacuaaccaaaaaucaaguaucccuaaccugccucgugaaaggcuucuaccccucagacauagccguggaaugggaauccaacggacaaccagaaaacaacuacaaaacaacaccacccguccuagauagcgacggcucauucuuccuauauuccaagcuaaccgucgacaaaucccgcuggcaacagggcaacgucuucuccugcagcguaaugcacgaagcccuccacaaucacuacacacaaaaaucccuuagccuuucccccggcaaa

SEQ ID NO: 54407 - RNA, 642 nt, Artificial Sequence
  derived and/or modified sequence opt11 from Ustekinumab_LightChain1
gacauccaaaugacccaauccccauccucccucuccgccuccgucggcgaccgcgucaccauaaccugccgcgccucccaaggcaucuccuccuggcucgccugguaccaacaaaaacccgaaaaagcccccaaaucccucaucuacgccgcauccucacuccaauccggcgucccaucccgcuucucaggcuccggcuccggcacugacuucacccucaccaucucaucacuccaacccgaagacuucgccaccuacuacugccaacaauacaacaucuaccccuacaccuucggacaaggcaccaaacucgaaaucaaacgcacagucgccgcccccuccgucuucaucuucccacccuccgacgaacaacucaaaucaggaacagcuuccgucgucugccuccucaacaacuucuacccccgugaagccaaaguccaauggaaagucgacaacgcccuccaaucaggcaacucccaagaauccgucaccgaacaagacagcaaagacuccaccuacucccucuccuccacccucacccuuuccaaagccgacuacgaaaaacacaaagucuacgccugcgaagucacccaccaaggccucuccuccccagucaccaaauccuucaaccgcggcgaaugc

SEQ ID NO: 54408 - RNA, 1341 nt, Artificial Sequence
  derived and/or modified sequence opt11 from Vadastuximab_talirine_HeavyChain1
caaguccagcuaguccaauccggcgccgaagucaagaaaccgggcgcauccguaaaagucucaugcaaagccucaggcuacaccuucaccaauuacgacauaaacuggguccgccaagcacccggccaaggacucgaauggaucggauggauauacccaggcgacggcucaaccaaauacaacgaaaaauucaaagcaaaagccacacucacagccgauacgucaacaagcacagccuacauggaacuccgcucacucagauccgacgacaccgccguauacuacugcgccuccggcuacgaagacgccauggacuacuggggccaaggaacaaccguaaccgucucaucagccagcacaaaaggccccuccguauucccccucgcccccuccuccaaauccaccuccggcggaacugccgcacucggcugccucgucaaagacuacuuccccgaaccagucaccguauccuggaacuccggagcacuaacauccggaguccacacauuccccgcuguccuccaauccuccggacucuacucacucuccuccguagucaccgucccuagcucaucccucggcacccaaacauacauuugcaacgucaaccacaaaccaucaaacaccaaagucgacaagaaaguagaacccaaaagcugcgacaaaacccacaccuguccacccugccccgcccccgaacucuuaggcggccccugcguauuccucuucccacccaaacccaaagacacucucaugaucucacgaacccccgaaguaaccugcgucgucguugacgucucacacgaagaccccgaagucaaauucaacugguacgucgacggcgucgaaguacacaacgccaaaaccaaaccccgcgaagaacaauacaacuccaccuaccgcguaguaucaguccuaaccguccuccaccaagacuggcuaaacggcaaagaauacaaauguaaagucuccaacaaagcccuucccgcacccauagagaaaaccaucucaaaagcaaaaggacaaccccgcgaaccucaggucuacacacuuccacccucacgcgacgaacuaacuaaaaaccaagucuccuuaaccugccuugucaaaggauucuaccccuccgacaucgccguagaaugggaaagcaauggacaacccgaaaauaacuacaaaaccacacccccgguccuagacuccgacggcuccuucuuccuauacuccaaacucaccgucgacaaaucucgcuggcaacaaggcaacgucuucuccugcagcgucaugcacgaagcacugcauaaccacuacacccaaaagucccuaucucucucaccaggcaag

SEQ ID NO: 54409 - RNA, 642 nt, Artificial Sequence
  derived and/or modified sequence opt11 from Vadastuximab_talirine_LightChain1
gacauccaaaugacccaaucccccuccucccucagcgcauccgucggcgaccgcgucaccaucaacugcaaagccucucaagacaucaacuccuaccucuccugguuccaacaaaaacccggcaaagcccccaaaacccucaucuaccgcgccaaccgccucgucgacggcguccccucacgcuucuccggcucaggcucuggccaagacuacacacuaaccaucuccucacuccaacccgaagacuucgccacauacuacugccuccaauacgacgaauucccccucaccuucggcggcggcaccaaagucgaaaucaaacgcacagucgccgcccccucagucuucaucuucccccccucagacgaacaacucaaauccggcaccgccuccgucgucugccuccucaacaacuucuacccccgcgaagccaaaguccaauggaaagucgacaacgcccuccaauccggcaacucccaagaauccgucaccgaacaagacuccaaagacucaacuuacucccucuccuccacccucacccucuccaaagccgacuacgaaaaacacaaagucuacgccugcgaagucacccaccaaggccuauccucccccgucaccaaaagcuucaacagaggcgaaugc

SEQ ID NO: 54410 - RNA, 1362 nt, Artificial Sequence
  derived and/or modified sequence opt11 from Vandortuzumab_vedotin_HeavyChain1
gaaguccaacucgucgagucuggaggcggccucguccaacccggaggcucccuccgacucagcugcgccgucucaggauacuccauaaccucagacuaugcguggaacuggguacgacaggcccccggcaaaggacuagaaugggucggcuacaucuccaacuccgguuccacauccuauaacccaucccucaaauccagauucacgaucucacgugacacaagcaaaaacacccucuacuuacaaaugaacucccuacgcgcagaagacaccgccgucuacuacugcgcacgagaacgcaacuacgacuacgacgauuacuacuacgccauggacuacuggggacaaggcacccucguaaccguauccucagcuucaaccaaaggacccuccguuuucccccuagcacccuccucaaaaucaacauccggaggaaccgccgcccucggcugccuaguaaaagacuacuuccccgaaccagucaccgucuccuggaacaguggcgcccucaccucgggcguacacaccuuccccgcaguccuacaaucaucaggccucuacucccuauccuccguggucacaguccccuccucaucacucggcacacaaaccuauaucugcaacgucaaccacaaaccaucaaacacaaaaguagacaagaaagucgagcccaaaagcugcgacaaaacccacaccuguccacccugccccgcccccgaacuccucggaggccccuccgucuuccucuucccucccaaacccaaagacacccucaugauuucccgcacccccgaaguaaccugcgucgucgucgacgucucccacgaagaccccgaagucaaauucaacugguacguagacggcgucgaaguccacaaugccaaaaccaaaccccgcgaggaacaauacaacagcaccuaccguguggucuccguacuaaccguccuccaccaagacuggcuaaacgguaaagaauauaaaugcaaagucuccaacaaagcccuccccgcccccaucgaaaagaccaucaguaaggccaaaggacaaccccgcgaaccccaagucuacacccucccucccagccgagaagaaaugaccaaaaaccaagucucacugaccugccucgucaaaggauucuacccguccgacauagcgguagaaugggaauccaacggucagcccgaaaacaacuacaaaacaacaccacccguccuagacuccgacggcuccuuuuuccucuacagcaaacuaaccgucgacaaaucccgcuggcaacaaggcaacgucuucuccugcuccgucaugcacgaagcccuccacaaccacuacacucaaaaaucacuaucccucuccccaggcaaa

SEQ ID NO: 54411 - RNA, 660 nt, Artificial Sequence
  derived and/or modified sequence opt11 from Vandortuzumab_vedotin_LightChain1
gacauccaaaugacccaaucaccaucaucccucuccgcauccgucggcgaccgcgucaccaucaccugcaaauccagccaaucccuacucuaccgcuccaaccaaaaaaacuaccucgccugguaccaacaaaaacccggcaaagcacccaaacuccuaaucuacugggcauccacacgcgaauccggcguccccucccgcuucuccggauccggcuccggcaccgacuucacccucaccaucuccucccuccaacccgaagacuucgccacauacuacugccaacaauacuacaacuauccccgcaccuucggccaaggcaccaaagucgaaaucaaacgcacagucgccgcccccuccguauucaucuucccccccucagacgaacaacuaaaaucaggaaccgccuccgucgucugccuccucaacaacuucuacccacgcgaagccaaaguccaauggaaagucgacaacgcacuccaauccggcaacucacaagaauccgucaccgaacaagacuccaaagacucaaccuacucccucuccucaacccuaacccucuccaaagccgacuacgaaaaacacaaagucuacgccugcgaagucacacaccaaggccuauccucccccgucaccaaaucauucaacagaggcgaaugc

SEQ ID NO: 54412 - RNA, 1329 nt, Artificial Sequence
  derived and/or modified sequence opt11 from Vantictumab_HeavyChain1
gaaguccaacucgucgaauccggcggcggacucguacagcccggcggaucacuccgccucucuugcgccgcaucgggcuuuaccuucagccacuacacucucucauggguccgccaagcaccaggcaaaggccucgaaugggucucagucaucagcggcgacggauccuacaccuacuacgccgacucagucaaaggccgauucaccaucuccuccgacaacuccaaaaacacccucuaccuccaaaugaacucgcuccgagccgaagacacagccgucuacuacugcgcacguaacuucauaaaauacgucuucgcaaacuggggccaaggaacccucgucacagucuccuccgccuccaccaaaggccccuccgucuucccucucgcccccugcucccgcucaacaucagaaucaacagccgcccucggcugccuuguaaaagacuacuuucccgaaccagucacaguaagcuggaacucaggagcccuaacauccggaguccacaccuuccccgccguccuccaauccuccggccucuacucccuuuccucagucgucacugucccauccucuaacuucggcacccaaacauacacaugcaaugucgaccacaaacccuccaacaccaaaguagacaaaaccgucgaacgaaaaugcugcguagaaugcccacccugccccgcaccacccgucgccgggcccuccguguuccuauuucccccaaaaccaaaagacacacucaugauaagccgcacaccggaagugaccugcgucgucgucgaugugagccacgaagaccccgaaguacaguucaacugguacgucgacggcguagaaguccacaacgcaaaaaccaaaccccgcgaagaacaauucaacagcacauuccgcgucgucuccguucucaccguaguccaucaagacuggcucaacggcaaagaauacaaaugcaaaguaucaaacaaaggacuccccgcacccaucgagaaaaccaucuccaaaacaaaaggucaaccacgugaaccacaaguuuacacccucccacccucccgagaagaaaugaccaaaaaccaaguaucucuaacaugccucgucaaaggcuucuaccccuccgacaucgccgucgaaugggaauccaacggccaacccgaaaacaacuauaaaaccacgccacccaugcuagacuccgacggauccuucuuccucuacucaaaacucaccgucgacaaaucccgauggcaacaagguaacgucuucucuugcuccguaaugcacgaagcacuccauaaccacuacacccaaaaaucccucucccucucacccggg

SEQ ID NO: 54413 - RNA, 639 nt, Artificial Sequence
  derived and/or modified sequence opt11 from Vantictumab_LightChain1
gacaucgaacucacccaaccccccuccgucuccgucgcccccggccaaacagcccgcauauccugcucaggcgacaacaucggcuccuucuacguccacugguaccaacaaaaaccaggccaagccccaguccucgucaucuacgacaaauccaaccgcccauccggcauacccgaacgcuucuccggcucaaacuccggcaacaccgcuacccucaccaucuccggcacacaagccgaagacgaagccgacuacuacugccaauccuacgccaacacccucucccuagucuucggcggaggcaccaaacucaccguccuaggacaaccaaaagccgcccccuccgucacccucuucccccccuccuccgaagaacuccaagccaacaaagcaacccucguaugccucaucucagacuucuaccccggcgccgucaccgucgccuggaaagcagacuccucccccguaaaagcaggcgucgaaaccaccacccccuccaaacaauccaacaacaaauacgccgccagcuccuaccucucccuaacccccgaacaauggaaaucccaccgcuccuacuccugccaagucacccacgaaggauccaccgucgaaaaaacagucgcccccaccgaaugcucc

SEQ ID NO: 54414 - RNA, 1389 nt, Artificial Sequence
  derived and/or modified sequence opt11 from Vanucizumab_HeavyChain1
caaguccaacucguccaauccggcgcagaagucaagaaacccggcgccucugucaaagucagcugcaaagccuccggcuacacauucacaggcuacuacaugcacugggucagacaagccccaggccagggccuugaauggaugggcuggaucaacccaaacuccggcgguacaaacuacgcacaaaaauuccaaggccgagugaccaugacacgcgacaccuccaucuccaccgcauacauggagcucucccgacuccgguccgacgacaccgcagucuacuacugcgcccguucacccaaccccuacuacuacgacuccuccggcuacuacuacccgggagccuucgacauuuggggacaaggaaccaugguaacagucucaucagccuccgucgccgccccaagcgucuucaucuucccacccuccgacgaacaacucaaguccggaacagcaagcguaguaugucuucugaacaacuucuacccccgcgaggcuaaaguccaauggaaagucgacaaugcccuccaaucgggcaacucacaagaauccgucaccgaacaagacuccaaagacagcaccuacucccucucguccacucuaacacuuuccaaggccgacuaugaaaaacacaaagucuacgccugcgaaguaacccaccaaggccuauccagccccgucaccaaaucauucaaccgcggcgaaugcgacaaaacacacacaugcccucccugccccgccccagaacuccucggcggccccuccguauuccuauucccacccaaacccaaagacacccuuaugauaucacgaaccccagaagucacaugcgucgucguugacgucagccacgaagaccccgaagucaaauucaacugguacgucgacggagucgaaguccacaacgccaaaacaaaaccacgcgaagaacaauacaacuccaccuaccgcgugguuuccguacucacaguccuccaccaagacuggcuaaacgguaaagaauacaaaugcaaaguaucaaacaaagcacuccccgcacccauagagaaaaccaucuccaaagcaaaaggacaaccccgagaaccucaagucugcacccucccacccucacgcgacgaacuaaccaaaaaccaagucucccuguccugcgccguaaaaggcuucuaccccuccgacaucgcaguggaaugggaaucaaacggccaacccgaaaacaacuacaaaaccaccccacccguccucgacuccgacgguuccuucuuccucguuucuaaacuaacagucgacaagucccgcuggcagcagggcaacgucuucuccugcucaguuaugcaugaagcccuccacaaccacuacacccaaaaaucacucucucucucccccggcaag

SEQ ID NO: 54415 - RNA, 1359 nt, Artificial Sequence
  derived and/or modified sequence opt11 from Vanucizumab_HeavyChain2
gaaguccagcucgucgaauccggcgguggacucguacaaccaggcggaagccuacgccucucuugcgccgccucuggauacaccuucaccaacuacggaaugaacuggguacgacaagcccccggcaagggccucgaaugggucggcuggauuaacacauacaccggugaacccacguaugccgccgacuucaagcgccgcuucaccuucucacucgacaccuccaaauccaccgccuaccuccaaaugaacagccuccgcgcagaggacacagccguuuacuacugcgccaaauacccccacuacuacggcuccucccacugguacuucgacgucuggggccagggaacacucguaaccguauccucagccuccaccaagggccccuccgucuucccacuagcgcccuccuccaaauccacauccggaggaaccgccgcccuuggcugccucgucaaagacuacuucccagaacccgucaccgucuccuggaacuccggcgcccucaccuccggcguacacaccuuccccgccguccuccaauccucaggccuuuacucccucuccuccguagucaccguccccuccucuucccuuggaacccagacauacaucugcaacgucaaccacaaacccucaaacaccaaaguagacaagaaagucgaacccaaauccugcgacaaaacccacacaugcccacccugccccgcccccgaacuacuaggcggccccucaguuuuccuauucccgcccaaaccaaaagacacacuuaugaucuccagaacacccgaaguaaccugcgucgucgucgacguaucccacgaagaccccgaaguuaaauucaacugguacgucgacggagucgaaguacacaaugccaaaaccaaaccacgcgaagaacaauacaacucaaccuaccgugucguauccguccucacagugcuccaccaagacuggcucaacggcaaagaauacaaaugcaaagucuccaacaaagcucucccagccccaaucgagaaaaccauauccaaagccaaaggacagccccgcgaaccccaaguauacacccuucccccaugccgcgacgaacucaccaaaaaccaaguaucacucuggugccuagucaaaggcuucuaucccuccgacaucgcagucgaaugggaauccaacggccaaccugaaaacaacuacaaaacuacacccccaguccucgacucagacggcuccuucuuccuauacagcaaacuaaccguagacaaaucccgauggcaacaaggaaacgucuucuccugcagcgucaugcacgaagcacuccacaaccacuacacccaaaaaucacucucucucucucccggcaaa

SEQ ID NO: 54416 - RNA, 639 nt, Artificial Sequence
  derived and/or modified sequence opt11 from Vanucizumab_LightChain1
caacccggacucacccaacccccaucugucuccguugcccccggccaaacagcccgcaucaccugcggcggcaacaacaucggcuccaaauccguccacugguaccaacaaaaacccggccaagcccccguccucgucgucuacgacgacuccgaccgcccauccggcauccccgaacgcuucucagguuccaacuccggcaacaccgccacccucaccauaucacgcgucgaagccggcgacgaagccgacuacuacugucaagucugggacuccuccuccgaccacuacguauucggaaccggaaccaaagucacaguccuauccuccgccuccaccaaaggccccuccgucuucccacucgcccccucuuccaaauccaccuccggcggcacagccgcccucggcugccucgucaaagacuacuuccccgaaccagucaccgucuccuggaacuccggcgcccucaccuccggcguacacaccuuccccgccguccuccaaucauccggccucuacucacuauccuccguaguuaccguccccuccucaucacuaggcacccaaaccuacaucugcaacgucaaccacaaacccuccaauaccaaagucgacaaaaaagucgaacccaaauccugc

SEQ ID NO: 54417 - RNA, 642 nt, Artificial Sequence
  derived and/or modified sequence opt11 from Vanucizumab_LightChain2
gacauccaaaugacccaaucccccucaucccuauccgccuccgucggcgaccgcguaaccauaaccugcuccgcuucccaagacaucucuaacuaccucaacugguaccaacaaaaacccggaaaagcccccaaaguccucaucuacuucaccuccucccuccacuccggcgucccaucccgcuucuccggcuccggcuccggcacagacuucacccucaccaucuccucccuccaacccgaagacuucgccaccuacuacugccaacaauacuccaccguccccuggaccuucggccaaggcaccaaagucgaaaucaaaagaacagucgccgcccccuccgucuucaucuucccacccuccgacgaacaacucaaauccggcaccgccuccgucgucugccuccucaauaacuucuacccccgcgaagccaaaguccaauggaaagucgacaacgcacuccaauccggcaacucccaagaauccgucaccgaacaagacuccaaagacuccaccuacucacuauccuccacccucacccucuccaaagccgacuacgaaaaacacaaagucuacgccugcgaagucacccaccaaggccucuccucucccgucaccaaauccuucaacagaggcgaaugc

SEQ ID NO: 54418 - RNA, 1356 nt, Artificial Sequence
  derived and/or modified sequence opt11 from Varlilumab_HeavyChain1
caaguccaacucguagaaucaggcggcggcgucguccaacccggccgaucacuacgacuuagcugcgcagccagcggauucaccuucucauccuacgacaugcacuggguccgccaagcccccggaaaaggccucgaaugggucgcagucaucugguacgacggauccaacaaauacuacgccgacuccgucaaaggccgcuucacuaucucccgcgacaacagcaaaaacacccuauaccuucaaaugaacucccuccgcgccgaagacaccgccgucuacuauugcgccagaggcucaggaaacuggggcuucuucgacuacuggggccaaggaacccucguaaccgucucguccgccuccaccaaaggccccucagucuucccccuggcaccauccucaaaguccacauccggaggaaccgccgcccuaggcugccuuguuaaagauuacuuccccgaaccggucaccguaaguuggaacucaggcgcucucaccuccggcguacauacauucccugcaguacuccaguccucaggccuuuacucccucuccuccgucguaacaguacccuccuccucccuaggcacacaaacauacauaugcaacgucaaccacaagccaucaaacaccaaaguugacaagaaagucgaaccaaaauccugcgacaaaacccacaccugucccccaugcccagcccccgaacuacucggcggcccauccgucuuccucuucccacccaaacccaaagacacccugaugaucucacgcacacccgaaguuaccugcgucgucgucgacguaucccacgaagaccccgaagucaaauucaacugguacgucgacggcgucgaaguacacaacgccaaaaccaaaccccgagaggaacaauacaacuccacauaccgugucgucuccguccucacuguacuccaccaagacuggcuuaacggaaaagaauacaaaugcaagguaucuaacaaagcccucccagcacccaucgagaaaaccaucuccaaagccaagggccaaccccgagaaccucaagucuacacacucccacccucccgugacgaacucaccaaaaaucaaguaucacuaaccugccucgucaaaggcuucuacccaucugacauagccgucgaaugggaaucaaacggccaacccgaaaacaacuacaaaaccacaccaccgguccucgacagcgacgguuccuucuuccucuacuccaaacucaccguagacaaaagccgcuggcaacaaggaaacgucuucagcugcagcgucaugcacgaggcccuacacaaccacuacacccagaaaucccuaucccuaagcccgggcaaagguucuuca

SEQ ID NO: 54419 - RNA, 642 nt, Artificial Sequence
  derived and/or modified sequence opt11 from Varlilumab_LightChain1
gacauccaaaugacccaaucccccuccucccucuccgcaagcgucggcgaccgcguaaccaucacgugccgcgccucccaaggcaucuccagauggcucgccugguaccagcaaaaacccgaaaaagcccccaaaucccucaucuaugccgccuccucccuccaauccggcguccccuccagauucucaggaucaggcuccggcaccgacuucacccucaccaucagcucccuccaacccgaagacuucgccaccuacuacugccaacaauacaacaccuacccccgcaccuucggccaaggaaccaaagucgaaaucaaacgaacagucgcagcccccuccgucuucaucuucccacccuccgacgaacaacucaaauccggcaccgccuccgucgucugccuccucaacaacuucuacccccgcgaagccaaaguacaauggaaagucgauaacgcacuccaauccggcaacucacaagaauccguuaccgaacaagacuccaaagacuccaccuacucccuaagcuccacccucacccucuccaaagccgacuacgaaaaacacaaagucuacgccugcgaaguaacccaccaaggccuuuccucccccgucaccaaauccuucaaccgcggcgaaugc

SEQ ID NO: 54420 - RNA, 1338 nt, Artificial Sequence
  derived and/or modified sequence opt11 from Vatelizumab_HeavyChain1
caaguccaacuccaagaaucuggccccggccucguaaaaccaagcgaaacacuaagccuaacaugcaccgucagcggauucagccuaaccaacuacggcauccacuggauacgccagccacccggaaaaggacucgaauggcuaggcguaauuugggcccgaggcuuuaccaacuacaacuccgcccucaugucccgccuaaccauuagcaaagacaacucuaagaaccaaguaucccucaaacucuccuccguaaccgccgccgacaccgccgucuacuacugcgcaagagccaacgacggaguauacuacgcaauggacuacuggggacaaggaaccuuagucaccgucuccuccgcuuccacaaaaggccccucugucuucccccuagcacccugcucccgauccacauccgaaucgaccgcggcccuaggcugccucguaaaagauuacuuccccgaacccgucacagucuccuggaacagcggcgcucucaccuccggaguccacaccuuccccgccguccuccaaucauccggacuauacagccuauccagcguagucacaguccccucauccucccucggcaccaaaacuuacacaugcaacguagaccacaaacccagcaacaccaaagucgauaaacgggucgaaagcaaauacggcccacccugccccucaugccccgcacccgaguuccuaggcggaccauccgucuuccucuucccgcccaaacccaaagacacacucaugaucucacgcacacccgaaguaaccugcgucgucgucgacgucucacaagaagacccagaaguacaauucaacugguacgucgacggcgucgaaguccacaacgccaaaaccaaaccaagggaagaacaauucaacuccaccuaccgcguagucucaguacuuaccguacuccaccaagacuggcucaacggcaaagaauacaaaugcaaaguaucaaacaagggccugcccucauccaucgaaaagacaauuuccaaagccaaaggucaaccccgugaaccccaagucuacacccucccucccucacaagaagaaaugaccaaaaaccaaguaucccuaacaugccucgucaaagguuucuaccccuccgacauagccgucgaaugggaaucaaacggccaacccgaaaacaauuacaaaaccacacccccuguccuagacucagacggcuccuuuuuccucuacucccgacuaaccgucgacaaaucccgauggcaagaaggcaacgucuucuccugcucggucaugcacgaagcccuccacaaccacuauacccaaaagucccuuucccucucccuaggcaaa

SEQ ID NO: 54421 - RNA, 639 nt, Artificial Sequence
  derived and/or modified sequence opt11 from Vatelizumab_LightChain1
gacuucgucaugacacaaucccccgccuuccuauccgucacccccggcgaaaaagucaccaucaccugcuccgcccaaagcuccgucaacuacauccacugguaccaacaaaaacccgaccaagcccccaaaaaacucaucuacgacacauccaaacucgccuccggaguccccucccgcuucuccggcucaggcuccggcacugacuacaccuucacaaucuccucccucgaagccgaagacgccgcaaccuacuacugccaacaauggaccaccaacccccucaccuucggacaaggcaccaaagucgaaaucaaacgcaccgucgccgccccauccgucuucaucuucccccccuccgacgaacaacuaaaauccggcaccgccuccgucgucugccuccucaacaacuucuacccccgcgaagccaaaguccaauggaaagucgacaacgcccuccaauccggcaacucccaagaauccgucaccgaacaagacucaaaagacucuaccuacucccucuccuccacccucacccucuccaaagccgacuacgaaaaacacaaaguauacgccugcgaagucacccaccaaggccuauccucacccgucaccaaauccuucaaccgcggcgaaugc

SEQ ID NO: 54422 - RNA, 1353 nt, Artificial Sequence
  derived and/or modified sequence opt11 from Vedolizumab_HeavyChain1
caagugcaacucguccaauccggagcagaagucaaaaaacccggugcauccguaaaaguaucaugcaaaggguccggguacacauucaccucuuacuggaugcacuggguacgccaagccccuggccaacggcuagaauggaucggcgagauagaccccagcgaauccaacacaaacuacaaccaaaaauucaaaggccgcguaacccuaaccgucgacauuuccgccuccacagcauacauggaacucucaucccuacgcuccgaagacacagccguauacuacugcgccagaggcggauacgacggcugggacuacgccaucgacuacuggggucaaggcacacucgucaccgucucaagcgcaucuaccaaaggacccuccgucuucccacucgcccccuccuccaaauccaccuccggcggcaccgccgcccucggaugccucguaaaagacuacuucccagaacccguaaccgucuccuggaacucgggcgcccucacaucaggcguccacacauuccccgccguccuucaauccucaggucucuacucccucuccucagucguaacuguccccucguccucacucggcacacaaaccuacauuugcaacgucaaccacaaacccucaaacaccaaagucgacaaaaaaguggaacccaaaucaugcgacaaaacgcacacaugccccccuugcccggcacccgagcuagcuggagcucccuccguauuccucuucccacccaaacccaaagacacccuaaugaucucacgcacccccgaaguaacaugcgucguagucgacguaucacacgaagaccccgaagucaaauucaacugguacguagacggaguagaaguccacaacgccaaaaccaaaccacgagaagaacaauacaacucgaccuaccgcgucgucuccguacucaccguccuacaccaagacuggcucaacggcaaagaguacaaaugcaaaguuuccaauaaagcacuccccgccccaaucgaaaaaaccaucuccaaagccaaaggccaaccucgcgaaccccaaguauacacccucccacccucccgcgacgaacucacaaaaaaccaagucagccucaccugccuagucaaaggcuucuacccauccgacaucgccgucgaaugggaaagcaacggccagcccgaaaacaacuacaaaaccaccccccccguccuggauuccgacggaagcuucuuccuauacucaaaacucacagucgacaaaucccgguggcagcaaggcaacgucuucucaugcuccgucaugcacgaagcccuccacaaccacuacacccagaagucccuaucccucucacccggcaaa

SEQ ID NO: 54423 - RNA, 657 nt, Artificial Sequence
  derived and/or modified sequence opt11 from Vedolizumab_LightChain1
gacgucgucaugacccaauccccccuaucccuccccguaacccccggcgaacccgcauccaucuccugccgcuccucccaaucccucgcaaaauccuacggcaacaccuaccucuccugguaccuccaaaaacccggccaaucaccccaacuccucauauacggcaucuccaaccgcuucuccggcguccccgaccgauucucaggcuccggcuccggcaccgacuucacccuuaaaaucucccgcgucgaagccgaagacgucggcguauacuacugccuccaaggcacccaccaacccuacaccuucggccaaggaaccaaagucgaaaucaaacgcacagucgccgcccccucagucuucaucuucccccccuccgacgaacaacuaaaaucuggcacagccuccgucgucugccuccucaacaacuucuacccccgcgaagccaaaguccaauggaaagucgacaacgcccuccaauccggcaacucccaagaauccgucaccgaacaagacuccaaagacuccacauacucccucucuuccacacucacccucuccaaagccgacuacgaaaaacacaaagucuacgccugcgaagucacccaccaaggccucucaucccccgucaccaaauccuucaaccgcggcgaaugc

SEQ ID NO: 54424 - RNA, 1353 nt, Artificial Sequence
  derived and/or modified sequence opt11 from Veltuzumab_HeavyChain1
caaguccaacuacaacaauccggagccgaagucaagaaaccuggaagcuccgucaaaguauccugcaaagccuccggcuacacauucaccucauacaacaugcacugggucaaacaagcacccggacaaggccucgaauggaucggcgccauauaccccggaaugggcgacaccuccuauaaucaaaaauucaaagguaaagccacccucaccgcagacgaaagcacaaacacagccuacauggaacucucaagccuccguucagaagacacagccuucuacuacugcgcccgaucaaccuauuacggcggcgacugguauuuugacguauggggacaaggaaccacuguaaccgucucuucggccucaaccaaaggacccuccgucuucccacuagcgccauccuccaaaagcacauccggcggcacagcagcccucggcugccucgucaaagacuacuuccccgaacccgucaccgucuccuggaacucaggcgcccucaccucuggaguccacaccuuucccgcaguccuacaauccuccggacucuacagccuauccuccgucguaacaguccccucauccucccucggaacccaaacauacaucugcaacguaaaccacaagccauccaacaccaaaguagacaagcgcguagagcccaaauccugcgacaaaacccacaccugucccccaugccccgccccagaacuacuaggaggccccuccguauuccuauucccaccuaagcccaaagacacccuaaugaucucccgcacaccugaagucacuugcgucgucguagacguaucccacgaagacccagaaguaaaauucaacugguauguagacggcgucgaaguccacaacgcaaaaaccaaaccccgcgaagaacaauacaacucgacauaccgaguagucagcguacuaacaguacuccaccaagacuggcucaacggcaaagaauacaaaugcaaaguauccaacaaagcccuacccgcaccaauagagaaaaccauauccaaagccaaaggccagccccgcgaaccccaaguuuacacccuacccccaucccgcgaagaaaugaccaaaaaccaagucucacucacaugccucguaaaaggcuucuaccccuccgacauugccgucgaaugggaaucaaauggacaacccgaaaacaacuacaaaacaacaccgcccguacucgacuccgacggcuccuucuuccuguacagcaaacuaaccgucgacaaaucccguuggcaacagggcaacgucuucucaugcuccgucaugcacgaagcccuucacaaccacuacacccagaaaagccuuucacucucgccgggaaaa

SEQ ID NO: 54425 - RNA, 639 nt, Artificial Sequence
  derived and/or modified sequence opt11 from Veltuzumab_LightChain1
gacauccaacucacccaaucccccuccucccuauccgccucagucggcgaccgcgucaccaugaccugccgcgccuccuccuccgucuccuacauccacugguuccaacaaaaacccggcaaagcccccaaaccauggaucuacgcaaccucaaaccucgcuuccggcguccccguacgcuucuccggcuccggcuccggcaccgacuacaccuucaccaucuccucccuccaacccgaagacaucgccaccuacuacugccaacaauggaccuccaacccacccaccuucggcggcggcaccaaacucgaaaucaaacgaaccgucgccgcccccuccguuuucaucuucccacccuccgacgaacaacuaaaauccggcaccgccuccgucgucugccuccucaacaacuucuacccccgcgaagccaaaguccaauggaaaguagacaacgcccuccaauccggaaacucccaagaauccguuaccgaacaagacuccaaagacuccaccuacucccucuccuccacccucacccuauccaaagccgacuaugaaaaacacaaaguauacgccugcgaagucacccaccaaggccucuccucccccgucaccaaauccuucaaccgcggcgaaugc

SEQ ID NO: 54426 - RNA, 1359 nt, Artificial Sequence
  derived and/or modified sequence opt11 from Vesencumab_HeavyChain1
gaaguacaacucgucgaauccggcggcggccuuguccaacccggcggcucccuccgacuauccugcgccgcaagcggcuucaccuucucaagcuacgcgaugagcuggguccgccaagccccaggaaaaggccucgaaugggucucacaaaucucccccgcgggcggauacacuaacuacgccgacuccgucaaaggccgcuucaccaucagcgcggacacauccaagaacaccgccuaccuucagaugaacucccuacgcgccgaagacaccgccgucuacuauugcgccagaggcgaacuccccuacuaccgaaugagcaaagucauggacguguggggccagggcacccucgucaccguauccuccgccuccacaaaaggucccucuguauucccccuagcaccauccucaaaaucuacuuccggcgguacagccgcccucggcugccucguaaaagacuacuuccccgaaccagucacagucucauggaacuccggcgcccucaccagcggcguccacaccuucccagccguccuccaauccuccggacucuacagccucuccucaguagucaccguacccuccucuucucuuggcacgcaaacauauaucugcaacgucaaccacaaaccuagcaacaccaaaguagacaagaaagucgaaccaaaauccugcgacaaaacccacaccugucccccaugcccagcccccgaacuccuaggaggacccuccgucuuccucuuucccccaaaaccaaaagacacccuaaugaucucccgcacccccgaaguaacaugcgucgucguagacgucucccacgaagaccccgaaguuaaauucaacugguacgucgacggcgucgaaguccacaacgccaaaaccaaaccccgcgaagaacaauacaacuccacauaccgagucgucuccguccuaacaguccuccaccaagacuggcucaacgguaaagaauacaaaugcaaagucucaaauaaagcccuacccgcaccaauagagaaaaccaucucaaaagcuaaaggccaaccacgcgaaccccaggucuacacccucccacccucccgcgaagaaaugaccaaaaaccaagucucccuaaccugccucgucaaaggcuucuaccccagcgauauagcagucgaaugggaaucaaauggccaaccagaaaacaacuacaaaaccacuccacccguccuagacuccgacggaucuuucuuccucuacuccaaacuaacagucgacaaaucacgauggcaacaaggcaacgucuucucuugcuccguaaugcacgaagcccuccacaaccacuacacccagaaaucccuaucgcuaucaccaggaaaa

SEQ ID NO: 54427 - RNA, 642 nt, Artificial Sequence
  derived and/or modified sequence opt11 from Vesencumab_LightChain1
gacauccaaaugacccaaucccccuccucccuauccgccuccgucggcgaccgcguaaccaucacuugccgagccucccaauacuucuccuccuaccucgccugguaccaacaaaaacccggcaaagccccaaaacuccucaucuacggcgccuccucccgcgccuccggcguccccucacgcuucuccggcucaggcuccggaaccgacuucacccuuaccaucuccucacuccaacccgaagacuucgccaccuacuacugccaacaauaccucggauccccacccaccuucggccaaggcaccaaagucgaaaucaaacgcaccgucgccgcacccucugucuucaucuucccacccuccgacgaacaacucaaaagcggcaccgccuccgucgucugccuccucaacaacuucuacccccgcgaagccaaaguccaauggaaagucgacaacgcccuccaaucaggcaacucccaagaauccgucaccgaacaagacuccaaagacucaaccuacucccucuccuccacccuaacccucuccaaagccgacuacgaaaaacacaaagucuacgccugcgaagucacccaccaaggccucuccucccccgucaccaaauccuucaacagaggcgaaugc

SEQ ID NO: 54428 - RNA, 1338 nt, Artificial Sequence
  derived and/or modified sequence opt11 from Visilizumab_HeavyChain1
caaguacaacuuguacaaagcggagccgaagucaagaaacccggcgccuccgucaaagucucuugcaaagcauccggcuauaccuucaucuccuacaccaugcacuggguccgccaagcccccggccaaggacuagaauggaugggauacaucaacccucguuccggcuacacccacuacaaccaaaaacuaaaagacaaagccacccucaccgccgacaaauccgcauccaccgccuacauggaacuauccucccuccgcagcgaagacaccgccguauacuacugcgcccgcuccgcauacuacgacuacgacggcuucgccuacuggggacaaggcacccucguaaccgucucuuccgcaucaaccaaaggacccuccgucuucccacucgcucccugcucccgcuccaccucagaaucgacagccgcccucggcugccuagucaaagacuacuuccccgaacccguaaccgucagcuggaacucuggcgcccucacuagcggcguccacacauuccccgccguccugcaauccucuggccucuacucgcucuccuccgucgucacuguacccuccucaaacuucggcacccaaaccuauaccugcaaugucgaccacaaacccuccaacaccaaaguugacaaaaccgucgaacgaaaaugcugcguagaaugcccucccugcccagccccacccgcagccgcccccuccgucuuccuuuucccacccaaacccaaagacacccuuaugaucucccgaacacccgaaguaaccugcgucgucgucgacgucucucacgaagacccugaaguccaauucaacugguacgucgacggcguggaaguacacaacgccaaaaccaaacccagagaagaacaauucaacucaaccuuccgagucgucucgguccucaccguuguccaccaagacugguuaaacggcaaagaauacaaaugcaaaguuuccaacaagggacuacccgcacccauagagaaaaccauaucaaaaaccaaaggccaaccacgcgaaccccaaguauacacccucccacccuccagagaagaaaugaccaaaaaccaagucucccuaaccugccucguaaagggcuucuaccccucagacaucgcagucgaaugggaauccaacggacaaccagaaaacaacuacaaaaccacgcccccaaugcucgauucggacggcuccuucuuccuuuacucaaaacucaccgucgacaaaucacgauggcaacaaggaaacgucuucucaugcuccgucaugcacgaagcccuccacaaccacuacacccaaaagucccucagccucucccccuccaaa

SEQ ID NO: 54429 - RNA, 639 nt, Artificial Sequence
  derived and/or modified sequence opt11 from Visilizumab_LightChain1
gacauccaaaugacccaaucacccuccucccuauccgccucagucggcgaccgcgucaccaucacuugcuccgccuccuccuccgucuccuacaugaauugguaccaacaaaaacccggcaaagcccccaaacgacucaucuacgacaccuccaaacucgccuccggcguccccucccgcuucucaggcuccgguucaggcaccgacuucacccucaccaucuccucccuccaacccgaagacuucgccaccuacuacugccaacaaugguccuccaacccacccaccuucggcggcggcaccaaagucgaaaucaaacgcaccgucgccgcccccuccgucuucaucuucccucccucagaugaacaacuaaaauccggcaccgccucagucgucugccuacucaacaacuucuacccccgcgaagccaaaguccaauggaaagucgacaacgcccuccaauccggcaauucacaagaauccgucaccgaacaagacuccaaagacuccaccuacucacucuccuccacccucacccuauccaaagccgacuacgaaaaacacaaagucuacgcaugcgaagucacccaccaaggccucuccucccccgucaccaaauccuucaaccgcggcgaaugc

SEQ ID NO: 54430 - RNA, 1353 nt, Artificial Sequence
  derived and/or modified sequence opt11 from Volociximab_HeavyChain
caaguccaacucaaagaguccggccccggccuaguagccccaagccagucccucagcauaaccugcaccaucuccggauucucccucacagacuacggcguccacugggucagacaacccccaggcaaaggccucgaauggcuaguagucaucuggucagacggcuccucaacauacaacucugcccucaaguccagaaugacaauccgaaaagacaacuccaaaucccaagucuuccuaaucaugaacucacuccaaaccgacgacucagccauguacuacugcgcucgccacggcacauacuacggcaugaccacuacaggcgacgcccucgacuacuggggccagggcacuagcguuaccgucuccuccgccuccaccaaaggcccauccgucuucccacuagcccccugcagccgcucaaccuccgaaagcacagccgcccucggaugccuagucaaggauuacuucccugaacccgugaccgucuccuggaacuccggagcccuaaccagcggcguacacaccuucccagcuguccuccaguccucgggccucuacucccuauccucaguagucaccgucccuucauccucccucggaaccaaaacauacacaugcaacgucgaccacaaaccauccaacacaaaaguagacaaacgcgucgaauccaaauacggcccacccugccccuccugccccgcccccgaguuccucggcggacccuccgucuuccuauuuccacccaaacccaaagacacacucaugaucucgcgcacccccgaagucacaugcgucgucguagacgugucccaagaagaccccgagguccaauucaacugguacgucgacggcgucgaaguccacaacgccaaaacaaaaccccgcgaagaacaauucaacucaacuuaccgcguagucucaguccucaccguacuccaucaagacuggcuaaacggcaaagaauacaaaugcaaaguuucaaacaaaggccugcccucgagcaucgagaaaacaaucuccaaggccaaaggccaaccccgcgaaccccaaguauacacccucccacccucucaagaagaaaugaccaaaaaucagguuucccuaaccugccucgucaagggcuucuaccccuccgacaucgcagucgaaugggaaagcaacggccaaccagaaaacaacuacaaaaccacacccccgguccuggacuccgacggcagcuucuuccuauacucccgccucacaguagacaagucccgcuggcaggaaggcaacgucuucucuugcucagucaugcacgaggcccuucacaaccacuacacccaaaagucccuaucccuaucccucggcaaa

SEQ ID NO: 54431 - RNA, 645 nt, Artificial Sequence
  derived and/or modified sequence opt11 from Volociximab_LightChain
caaaucguccucacacaaucccccgccauaauguccgccucccucggcgaacgagucaccaugaccugcaccgccuccagcuccguaucauccaacuaccuccacugguaccaacaaaaacccggcuccgcccccaaccucuggaucuacuccaccuccaaccucgccuccggcguacccgcccgcuucuccggcuccggcuccggcaccuccuacucccucaccaucuccuccauggaagccgaagacgccgccaccuacuacugccaccaauaccuccgcucaccccccaccuucggcggcggaaccaaacucgaaauaaaacgcaccgucgccgcccccuccgucuucaucuuccccccauccgacgaacaacucaaauccggcaccgccuccguaguaugccuccuaaacaacuucuacccccgcgaagccaaaguccaauggaaagucgacaacgcccuccaauccggcaacucacaagaauccgucaccgaacaagacucaaaagacuccaccuacucccucuccucaacccuaacccucuccaaagcagacuacgaaaaacacaaagucuacgccugcgaaguaacccaccaaggccucuccucccccguaaccaaaucauucaaccgcggcgaaugc

SEQ ID NO: 54432 - RNA, 1344 nt, Artificial Sequence
  derived and/or modified sequence opt11 from Vorsetuzumab_HeavyChain1
caaguccaacucguacaauccggagccgaagucaagaaacccggcgccuccguuaaagucagcugcaaagcuagcggcuacaccuucacaaacuacggcaugaacuggguccgccaagccccaggccaaggccuaaaauggaugggcuggauaaacacauacaccggcgaacccaccuacgcagacgcauucaaaggccgcgucacuaugacccgcgacaccucaauaucaacagccuacauggaacucucaagacuacgcuccgacgacaccgcggucuacuacugcgcccgagacuacggagacuacggcauggacuacuggggccaaggaaccacagucaccgucuccuccgcaucaaccaaaggacccucggucuucccccucgccccauccuccaaaagcaccuccggcggcaccgccgcccuuggcugccuaguaaaagacuacuuuccagaacccgucacugucuccuggaacuccggggcacucacauccggaguucauaccuuccccgccguccuacaauccuccggccucuacucucuuagcuccgucgucacugucccaagcucaucacucggcacccaaacuuacauaugcaacgucaaccauaaacccuccaauaccaaagucgacaagaaagucgaaccaaaaucaugcgacaaaacacauaccugcccacccugccccgcccccgaacuacuaggcggccccuccgucuuccuauucccaccuaaacccaaagacacccucaugaucagccgcaccccagaagucacaugcgucgucguagacgucucacacgaagacccagaaguaaaauucaacugguaugucgacggcguagaaguccacaacgcuaaaacaaaaccucgagaagaacaauacaacuccaccuaccgcgucguaucuguccucaccguccuacaccaagacuggcucaacggcaaagaauacaaaugcaaagucuccaacaaagcacugcccgcacccauugagaaaacuaucuccaaagcuaaaggccaaccccgcgaaccacaggucuacacccuaccucccucccgagacgaacuaaccaaaaaccaaguaucacugaccugccucgucaaaggcuucuacccaagcgacauagcggucgaaugggaaagcaacggccaaccagaaaacaacuacaaaacaaccccacccguccucgacuccgacggcucauucuuccucuacagcaaacucacagucgacaagucgcgauggcaacaaggcaacguauucucaugcagcgucaugcacgaagcgcuccacaaccacuacacacaaaaaucacucucacucagccccggaaaa

SEQ ID NO: 54433 - RNA, 654 nt, Artificial Sequence
  derived and/or modified sequence opt11 from Vorsetuzumab_LightChain1
gacaucgucaugacccaaucacccgacucccucgccguaagccuaggcgaacgcgccaccaucaacugccgcgccuccaaauccgucagcacauccggcuacuccuucaugcacugguaccaacaaaaacccggccaaccccccaagcuccucaucuaccuagccuccaaccucgaaagcggcguccccgaccgcuucucaggcuccggcuccggcaccgacuucacccuaaccaucuccucccuccaagccgaagacguagccgucuacuacugccaacacucacgcgaaguccccuggaccuucggccaaggcaccaaagucgaaaucaaacgcaccgucgccgcccccuccgucuucauauucccacccuccgacgaacaacuaaaauccggcaccgccuccgucguaugccuccucaacaacuucuacccccgcgaagccaaaguccaauggaaagucgacaacgcacuccaaagcggaaacucccaagaauccgucaccgaacaagacagcaaagacuccaccuacucccucuccuccacacuaacccucagcaaagccgacuacgaaaaacacaaagucuacgccugcgaagucacccaccaaggccucuccucccccgucacaaaauccuucaaccgcggcgaaugc

SEQ ID NO: 54434 - RNA, 1344 nt, Artificial Sequence
  derived and/or modified sequence opt11 from Vorsetuzumab_mafodotin_HeavyChain1
caaguacagcuaguccaauccggcgccgaagucaagaaacccggcgccucaguaaaagucuccugcaaagcaucaggcuacacauucacuaacuacggcaugaacugggucagacaagcacccggccaaggccuaaaauggaugggauggaucaacaccuacacuggcgaaccaacauacgccgacgcauucaaaggccgcguaaccaugacccgcgacacauccauuucaaccgcauacauggaacucucacgccuccggagcgacgacacagccgucuacuacugcgcccgcgacuacggagacuacggcauggacuacuggggccaaggcacgaccgucaccguauccuccgcgucaaccaagggcccauccguauucccccuagcccccucaucaaaaucuaccuccggaggcacagccgcacuaggcugccucguaaaggacuacuuccccgaacccgucaccguauccuggaacuccggagcccuaaccuccggcguccacacuuuccccgccguacuccaaucaagcggccuauacucacucuccucugucgucaccgucccuucauccucccuaggcacccaaacauacaucugcaacgucaaccacaaacccuccaacacaaaagucgacaagaaaguagaacccaaauccugcgacaaaacccacaccuguccucccugccccgcccccgaacuacucggcggccccucagucuucuuauucccacccaaacccaaagacacgcucaugauaagccgcaccccagaaguaaccugcgucgucgucgauguaucccacgaagacccugaggucaaauucaacugguacgucgacggagucgaaguccacaacgcaaaaaccaaaccccgcgaagaacaauacaacuccaccuaccgaguugucuccguccucaccguauuacaccaagacuggcucaacggcaaagaauacaaaugcaaagucuccaacaaagcucuccccgcacccaucgagaaaaccauauccaaagccaaaggacaaccccgagaaccccaaguauacacccuaccacccagccgcgacgaacucaccaaaaaucaaguaucccugaccugccucgucaaaggcuucuacccaucagacauagccguagaaugggaaucaaacggccagccagaaaacaacuacaaaaccaccccuccaguccuagacucagacgguucauucuuccucuacuccaaacuaaccgucgauaaaucccguuggcaacaaggcaacgucuucucgugcuccgucaugcacgaagcccugcacaaccacuauacacaaaaaucacucucacucucccccggaaaa

SEQ ID NO: 54435 - RNA, 654 nt, Artificial Sequence
  derived and/or modified sequence opt11 from Vorsetuzumab_mafodotin_LightChain1
gacaucguaaugacacaaucacccgacucccuagccgugagccuaggcgaacgcgcaaccauaaacugccgagcaagcaaaagcguauccacaagcggauacucguucaugcacugguaccaacaaaaacccggacaaccacccaaacuccugaucuaccuagcauccaaccucgaaagcggagucccagacagauucucaggcucaggcucgggcacagacuucacccuaaccauaagcucacuccaggccgaagacguagccgucuacuacugccaacacucacgcgaagucccauggacauucggacaagggaccaaagucgaaaucaaacgcacagucgcagccccaagcguauucauauucccacccucagacgaacaacuaaaaucaggcacagccucggucguaugccugcucaacaacuucuacccacgcgaagccaaaguccaauggaaagucgacaacgcacuccaauccggaaacucacaagaaagcguaaccgaacaagacagcaaagacucgaccuacagccugagcucaacccugacccuaagcaaagccgacuacgaaaaacacaaaguauacgcgugcgaagucacacaccaaggacuaagcucccccguaaccaagagcuucaacaggggcgaaugc

SEQ ID NO: 54436 - RNA, 1347 nt, Artificial Sequence
  derived and/or modified sequence opt11 from Yttrium_(90Y)_clivatuzumab_tetraxetan_HeavyChain1
caaguccaacuacaacaaucgggcgccgaaguaaagaaacccggcgccucagucaaagucuccugcgaagcauccggauacaccuuccccuccuacguccuccacuggguuaaacaagcccccggacaaggacuagaauggauaggauacaucaaccccuacaacgacggaacccaauacaacgaaaaauucaaaggaaaagccacccucacccgcgacaccuccaucaacacagcauacauggaacuaucccgacuccgcuccgacgacaccgccguuuacuacugcgcgagaggcuucggcggaucauacggauucgccuacuggggccaaggcacccuaguuacagucuccuccgccucaaccaaaggccccuccgucuuuccccucgcccccuccuccaaauccaccuccggcggcacagccgcgcucggcugccuaguaaaagacuacuuccccgagcccgucaccgucuccuggaacucaggcgcgcucacaagcggaguccacaccuuccccgcaguacuccaauccucaggccucuacucccuuuccucagucguaaccguccccuccuccucgcucggaacccaaaccuacaucugcaacgucaaccacaaacccuccaacacaaaaguugacaaacgaguagaaccaaaaagcugcgacaaaacccacacaugcccacccugccccgccccagaacuacucggcggaccuuccguauucuuauucccacccaaaccuaaagacacacuuaugaucucccgaacacccgaaguaaccugcgucguagucgacgucucacacgaagaccccgaagucaaauucaauugguacguagacggcgucgaagugcacaacgcaaaaaccaaaccacgcgaagaacaauacaacucaaccuaccgcgucgucuccguccucacaguccuccaccaagacuggcuaaacgguaaagaauacaaaugcaaaguaucaaacaaagcccuaccagcccccauagagaaaaccaucucaaaagccaaaggucaaccacgcgaaccccagguuuacacccucccgcccucccgagaggaaaugaccaaaaaccaagucucccucacaugccucgucaaaggauucuaccccuccgacaucgcaguggaaugggagucuaacggccaacccgaaaacaacuacaaaacaaccccacccguccucgacucagacggcagcuucuuccuauacuccaagcuaaccguagacaaaucacgauggcaacagggcaacgucuucuccugcucagucaugcacgaagcacuccacaaccacuacacacaaaaaucccucagccuaucacccggaaaa

SEQ ID NO: 54437 - RNA, 645 nt, Artificial Sequence
  derived and/or modified sequence opt11 from Yttrium_(90Y)_clivatuzumab_tetraxetan_LightChain1
gacauacaacucacccaaucccccucuucccuuuccgccuccgucggagaccgagucaccaugaccugcucagccuccuccuccguauccuccuccuaccucuauugguaccaacaaaaacccggcaaagcccccaaacucuggaucuacuccaccuccaaccuagccuccggcguacccgcccguuucucaggauccggcuccggcaccgacuucacccucaccaucuccucccuccaacccgaagacuccgccuccuacuucugccaccaauggaaccgcuaccccuacaccuucggcggcggcacccgccucgaaaucaaacgaaccguagccgcccccuccgucuucaucuucccacccucagacgaacaacucaaauccggcaccgccuccgucgucugccuccuaaacaacuucuaccccagagaagcaaaaguccaguggaaagucgacaacgcccuccaaucgggcaacucccaagaaucuguaaccgaacaagacuccaaagacuccacauacucccucuccuccacccucacccuauccaaagccgacuacgaaaaacacaaagucuacgccugcgaagucacacaccaaggccuaucaucacccgucaccaaaucauucaaccgaggcgaaugc

SEQ ID NO: 54438 - RNA, 1338 nt, Artificial Sequence
  derived and/or modified sequence opt11 from Yttrium_Y_90_epratuzumab_tetraxetan_HeavyChain1
caaguccaacuuguccaaucaggcgccgaagucaagaaacccgguuccuccgucaaaguaucaugcaaagccucuggcuacacauucacuuccuacuggcuacacuggguacgccaagcccccggccaaggccuagaauggauaggauacaucaacccccgcaacgacuacaccgaauacaaccaaaacuucaaagacaaagccacaaucaccgcagacgaauccacaaacacagcuuacauggaacucucaucacuucgcuccgaagacacggcauucuacuucugcgcccggagagacauaaccaccuucuacuggggccaaggaaccacagucaccgucagcucagccucaaccaaaggacccagcgucuucccccucgcaccaagcucaaaaucaaccucaggcggcaccgccgccuuaggcugccucguaaaagacuacuuccccgaacccgucaccgucuccuggaacuccggcgcacuaacauccggcguacacaccuuccccgcaguccuccaauccuccggccuguacucccucuccucagucgucaccguccccagcagcucacucggcacacaaacauacauaugcaacgucaaccacaaacccuccaacacuaaaguagacaaacggguagaaccaaaauccugcgacaaaacccacacaugcccacccugcccagccccagaacuccuaggcggaccaucaguauuccucuucccacccaaacccaaagacacgcugaugaucucccgcacccccgaaguaacaugugucgucgucgacguaucacacgaagacccugaaguuaaauucaacugguacgucgacggcguagaaguccacaacgcaaaaaccaaaccccgcgaggagcaauacaacucaacuuaccgcgucgucucaguacucacaguccuacaccaagacuggcuaaacggcaaagaauauaaaugcaaagucuccaacaaagcccucccagcuccaauagaaaagaccaucuccaaagccaaaggccaacccagagaaccacaaguauacacccuacccccaucaagagaagaaaugaccaaaaaccaagucagcuuaaccugccucguaaaaggcuucuaccccuccgacaucgcaguagaaugggaauccaacggacaaccugaaaacaacuacaaaacaaccccacccguacucgauuccgacgguucauucuuccucuacuccaaacucaccgucgacaaaucccgcuggcaacaaggcaacgucuucagcugcucagucaugcacgaagcacuacacaaccacuacacccaaaaaucccucucccuaucccccgggaaa

SEQ ID NO: 54439 - RNA, 657 nt, Artificial Sequence
  derived and/or modified sequence opt11 from Yttrium_Y_90_epratuzumab_tetraxetan_LightChain1
gacauccaacucacacaaucccccuccucacucuccgccuccgucggcgaccgagucacaauguccugcaaauccucccaauccguccuauacucagccaaccacaaaaacuaccucgcaugguaucaacaaaaacccggcaaagcccccaaacuucucaucuacugggccuccacccgcgaauccggcguccccucccgcuucucaggcucuggcuccggcaccgacuucacuuucaccaucuccucccuccaacccgaagacaucgccaccuacuauugccaccaauaccucuccucauggaccuucggcggcggcaccaaaguccaaaucaaacgcaccgucgccgcccccuccgucuucaucuucccccccucagacgaacaacucaaauccggcaccgccuccgucgucugccuacuaaacaacuucuacccccgcgaagccaaaguccaauggaaagucgacaacgcccuccaaucaggaaacucccaagaaucugucaccgaacaagacuccaaagacuccaccuacucccucuccucuacccucacccucucaaaagccgacuacgaaaaacacaaagucuacgccugcgaagucacccaccaaggccucuccucccccgucaccaaauccuucaaccgcggcgaaugc

SEQ ID NO: 54440 - RNA, 1326 nt, Artificial Sequence
  derived and/or modified sequence opt11 from Yttrium_Y_90_epratuzumab_HeavyChain1
caaguccaacucguccaauccggagcagaagucaaaaagcccggcuccuccguuaaagucuccugcaaagcaucaggcuacaccuucaccuccuacuggcuccacuggguccgccaagcccccggacagggccuagaauggaucggcuacaucaacccccgcaacgacuacaccgaauacaaccaaaacuucaaagacaaagccacaaucaccgccgacgaaucaaccaacacagccuacgaacuauccucccuacgaucagaagacaccgccuucuacuuuugcgcccgacgcgacaucaccaccuucuacuggggacaaggaacuaccguaaccgucagcucagcaucaacuaaaggacccagcgucuucccacucgccccauccuccaaaucaaccuccggcggcaccgccgcccuuggaugccucguaaaggacuacuucccggaacccgucaccgucuccuggaacuccggcgcacuaaccuccgguguacacacauuccccgccguccuacaaagcuccggccuguacucccucuccagcgucgucaccguccccuccuccucacucggaacccaaaccuauaucugcaauguaaaccacaaacccuccaacaccaaaguagacaaacgcgucgaaccaaaauccugcgacaaaacacauaccugcccacccugccccgcccccgaacuacucgguggucccuccguauuccucuuucccccuaaacccaaagacacucuaaucucacgcacccccgaaguaaccugcgucgucgucgacguaucccacgaagaucccgaagucaaauucaacugguacguagacggugucgaaguccacaacgccaaaaccaaaccccgcgaagaacaauacaacuccacauaccgcguugucuccguccuaacaguccuccaccaagacuggcuuaacgggaaagaauacaagugcaaagucagcaacaaagcacuacccgccccuauagagaaaacaauaucuaaggccaaaggccaaccccgcgaaccacaagucuacacccucccacccucccgggaagaaacgaaaaaccaagucucccuaaccugccuagucaaaggauucuaccccucagauaucgccguagaaugggaauccaacggccaacccgaaaacaacuacaaaaccaccccucccguccucgacuccgacggcuccuucuuccuauacuccaaacugacagucgacaaaucucgcuggcaacagggcaacgucuucuccugcucaguacacgaagcccuccacaaccacuacacccaaaaaucccucagccucucccccggcaaa

SEQ ID NO: 54441 - RNA, 654 nt, Artificial Sequence
  derived and/or modified sequence opt11 from Yttrium_Y_90_epratuzumab_LightChain1
gauauccaacucacacaaucccccuccucccuuuccgccuccgucggcgaccgcgucaccuccugcaaauccucccaauccguccuuuacucagccaaccacaaaaacuaccucgcaugguaccaacaaaaacccggcaaagccccaaaacuccuaaucuacugggccuccacccgcgaauccggcguccccucccgcuucuccggcuccggcuccggaaccgacuucaccuucacaaucuccucacuccaacccgaagacaucgccaccuacuacugccaccaauaccuauccucauggaccuucggcggcggcaccaaaguacaaauaaaacgcaccgucgcagccccauccguauucauauucccacccuccgacgaacaacucaaauccggcacugcauccgucgucugccuacuaaacaacuucuacccccgcgaagccaaaguccaauggaaagucgacaacgcccuccaauccggcaacucccaagaauccgucaccgaacaagacuccaaagacuccaccuacucccucuccuccacccucacccuuuccaaagccgacuacgaaaaacacaaagucuacgccugcgaagucacccaccaaggccuauccucccccgucacaaaauccuucaaccgcggcgaaugc

SEQ ID NO: 54442 - RNA, 1365 nt, Artificial Sequence
  derived and/or modified sequence opt11 from Zalutumumab_HeavyChain1
caaguccaacucgucgaaagcggcggaggcgucguccaacccggacgaagccuccgccuuucaugcgccgcauccggcuucaccuucuccaccuacggcaugcacuggguaagacaagcacccggcaaaggccuagaaugggucgccgucaucugggacgacggcucauacaaauacuauggcgacuccguuaaaggaagauucacaaucucccgagacaacagcaaaaacacacucuaccuccaaaugaacucccuccgugccgaggacaccgcuguauacuacugcgcacgggacggcaucaccaugguccgcggcgucaugaaagacuacuucgauuacuggggccaaggaacccuagucacaguuucauccgccucaacaaaaggcccauccgucuuuccccuagcccccucauccaaauccacauccggcggcacagccgcacucggcugccuaguaaaggacuacuucccugagcccgucaccgugucauggaacucaggagcacuaacauccggcguccauaccuucccagccguccuccaaagcagcggacucuacagccucuccucaguagucacaguacccuccuccucccuuggcacucaaaccuacaucugcaaugucaaccacaaaccaucaaacacaaaagucgacaaacgcgucgaaccaaaaucaugcgacaaaacucacacauguccaccauguccagccccagaacuucuuggcggaccauccgucuuccucuuuccacccaaacccaaagacacccucaugaucucccgcacaccugaaguaaccugcgucgucgucgacgucucccacgaagaccccgaagucaaauucaacugguaugucgauggaguugaaguccacaacgccaaaacaaaaccaagggaagaacaguauaacucuaccuaccgaguuguguccguccucaccguacuacaccaagacuggcuaaacggcaaagaauacaaaugcaaggucagcaacaaagcccuacccgcccccaucgaaaagaccaucagcaaagccaagggacaaccccgcgaaccccaagucuacacccuaccaccaucacgcgaagaaaugaccaaaaaucaagucucucucacaugccucgucaaaggcuucuacccaucagacaucgccgucgagugggaaagcaacggccaacccgaaaacaacuacaaaacaaccccacccguccucgacuccgacggauccuuuuuccucuacuccaaacucaccgucgacaaaagccgcuggcaacaaggcaacgucuucuccugcuccgucaugcacgaagcccuacacaaccacuauacccaaaaaucccucucccucagccccggcaaa

SEQ ID NO: 54443 - RNA, 642 nt, Artificial Sequence
  derived and/or modified sequence opt11 from Zalutumumab_LightChain1
gccauccaacucacccaaucccccuccucccuuuccgccuccgucggcgaccgcgucaccauaaccugccgcgccucccaagacaucuccuccgcccucguaugguaccaacaaaaacccggaaaagcccccaaacuccucaucuacgacgccuccucacucgaauccggcguccccucccgcuucucuggcucagaaucaggcaccgacuucacccucaccaucuccucccuccaacccgaagacuucgccaccuacuacugccaacaauucaacuccuacccccucaccuucggcggcggcaccaaagucgaaaucaaacgcaccgucgccgcccccuccgucuucaucuucccacccuccgacgaacaacucaaauccggcaccgccuccgucgucugccuccucaacaacuucuacccccgugaagccaaaguccaauggaaagucgacaacgcacuccaauccggcaacucccaagaauccguaaccgaacaagacuccaaggacuccaccuacucccuauccuccacccucacccuauccaaagccgacuacgaaaaacacaaaguauacgccugcgaagucacccaccaaggccucucaucccccgucaccaaauccuucaaccgcggcgaaugc

SEQ ID NO: 54444 - RNA, 1332 nt, Artificial Sequence
  derived and/or modified sequence opt11 from Zanolimumab_H0_HeavyChain
caaguccaacuacaacaauggggcgccggacuacucaagcccuccgaaacccucucacuaacaugcgcaguuuacggcggcuccuucucugguuacuacugguccuggauccgccaaccacccggaaaaggccucgaauggaucggcgaaaucaaccacuccggauccaccaacuacaaccccucacucaaaucccgcgucaccauauccgucgacaccuccaaaaaccaguucucccuaaaacucuccuccgucaccgcugccgacaccgcagucuacuacugcgcccgcgucaucaacugguucgaccccuggggacaaggcacacucgucaccgucucauccgccuccacuaaaggccccucagucuucccccucgcccccuccuccaaauccaccucaggaggcaccgccgcacuaggcugccuagucaaagacuacuuccccgaaccagucaccgucucuuggaacucaggggcccuaaccuccggaguccacaccuuccccgccguacuacaaucaucaggacuauacucucucucaucguggacagucccaucaucaucccucggcacccaaaccuacauaugcaacgucaacuucaucaaacccuccaacacaaaagucgacaagaaagucgaaccaaaaucaugcgacaaaacccacacaugcccaccaugcccagcaccagaacuccucggaggccccuccgucuuccucuucccacccaaacccaaagacacccucaugaucucucgcacaccagaggucacuugcgucugggacgucucccacgaggaucccgaagucaaauucaacugguacgucgacggaguagaaguccacaacgcaaaaaccaaaccccgagaagaacaauauaacucaaccuaccgcguagucuccguccucacaguccuccaccaggacuggcucaacggaaaagaauacaaaugcaaagucuccaacaaagccuuacccgccccaaucgagaaaacaaucuccaaagccaaaggacaaccccgcgaaccccaagucuacacccucccaccaucacgcgaagaaaugaccaaaaaccaagucucacucacaugccucguuaaaggcuucuacccauccgacaucgccguagaaugggaauccaacggccaacccgaaaacaacuacaaaaccacucccccaguucucgacuccgacggauccuucuuccucuacucgaaacucaccguggacaaaucccgauggcaacaaggcaacguauucuccugcagcgucaugcacgaagcccuccacaaccacuacacccaaaaaucucucucccuuucacccggcaaa

SEQ ID NO: 54445 - RNA, 642 nt, Artificial Sequence
  derived and/or modified sequence opt11 from Zanolimumab_L0_LightChain
gacauccaaaugacccaauccccauccuccgucucagccuccgucggcgaccgcgucaccaucacaugccgagccucacaggacaucuccagcuggcuagccgucgucuaccaacacaaacccggcaaagcccccaaacuccucaucuacgcagccucuucacuccaauccggcguccccucccgcuucuccggcucaggcuccggcaccgacuucacccucaccaucuccucccuccaacccgaagacuucgccaccuacuacugccaacaagccaacuccuucccauacaccuucggcggaggcaccaaacucgaaaucaaacgcacagucgccgcccccuccgucuucaucuucccacccuccgacgaacaacuaaaauccggcaccgccuccgucgucugccuccucaacaacuucuacccccgcgaagccaaaguacaauggaaagucgacaacgcccuccaauccggcaacucccaagaaucagucaccgaacaagacuccaaagacuccaccuacucacucuccuccacccucacccucuccaaagccgacuacgaaaaacacaaagucuacgccugcgaagucacccaccaaggccuuuccucacccgucaccaaauucaaccgcggcgaaugc

SEQ ID NO: 54446 - RNA, 1344 nt, Artificial Sequence
  derived and/or modified sequence opt11 from Zatuximab_HeavyChain1
caaguccaacuccaacaacccggcgccgagcuagucgaacccggcggcuccgucaaacucucaugcaaagccucaggcuacacguucacaucccacuggaugcacugggucaaacaacgccccggacagggccuggaauggaucggagaaaucaauccaagcucaggccgcaacaacuacaaugaaaaauucaaauccaaggccacccuaaccguugacaaaucguccuccacagccuacaugcaauucuccucacucaccuccgaagacuccgcagucuacuacugcguacgcuacuacggcuacgacgaagccauggacuacuggggccagggaaccuccgucacaguguccucagccucaaccaaaggccccuccgucuucccccucgcccccucauccaaauccaccagcggcggcaccgccgcccucggaugccucgugaaagacuacuuucccgaacccguaacagucuccuggaacagcggcgcccuaaccagcggaguacauacauuccccgcgguccuacaauccuccggccucuacucccuaucaagcguaguaaccguccccuccucaucccuuggaacccaaacuuacaucugcaacguaaaccacaaaccaucaaacaccaaagucgacaaacgcgucgaaccaaaaucgugcgauaaaacccacacaugcccacccugccccgcccccgaacuccucggcggccccagcgucuuccucuuucccccaaaacccaaagacaccuuaaugaucucccgaacccccgaagucacaugcgucgucguagacguaucccacgaagacccagaagucaaauucaacugguacgucgacggcgucgagguccacaacgccaaaaccaaaccacgcgaggaacaauacaacagcaccuaccgagucgucucaguacucaccgugcuacaccaagacuggcucaacggcaaagaauacaaauguaaagucuccaacaaagcccuccccgcccccaucgagaaaaccaucucaaaagccaaaggccaaccacgcgaaccucaaguauacacccuaccacccucccgcgaagaaaugaccaaaaaccaagucucucuaacuugccucgucaaaggauucuaccccagcgacauagcugucgaaugggaauccaacggccaacccgagaacaacuauaagaccacacccccaguacuagacuccgacggcuccuucuuccuguacuccaaacuaaccguagacaaaucccgcuggcagcaaggcaacguauucagcugcucagucaugcacgaagcccuacacaaccacuacacccaaaaaucccuaucucucucccccgga

SEQ ID NO: 54447 - RNA, 657 nt, Artificial Sequence
  derived and/or modified sequence opt11 from Zatuximab_LightChain1
gacaucgucaugacccaagccgccuucucaaaccccgucacccucggcaccucagccuccaucuccugccgcagcuccaaaucccuccuccacuccaacggcaucaccuaccucuacugguaccuccaaaaacccggacaauccccccaacuccuaaucuaccaaauguccaaccucgccuccggaguacccgaccgauucucaucaucuggcucgggcacagacuuuacccuacgcaucagccgagucgaagccgaagacgucggcgucuacuacugcgcccaaaaccucgaacuccccuacaccuucggcggcggcacaaaacucgaaaucaaacgcaccgucgccgcccccagcgucuucaucuucccccccuccgacgaacaacucaaauccggcacagccucagucgucugccugcucaacaacuucuacccccgcgaagccaaaguccaauggaaagucgacaacgcccuccaauccgguaacucccaagaauccguaaccgaacaagacuccaaagacucaaccuacucccucuccucaacccucacccucuccaaagccgacuacgagaaacauaaagucuacgccugcgaagucacacaccaaggccuauccucacccgucaccaaauccuuuaaccgcggcgaaugu

SEQ ID NO: 54448 - RNA, 1356 nt, Artificial Sequence
  derived and/or modified sequence opt11 from Actoxumab_HeavyChain
caaguccaacucgucgaaucagggggcggcguaguacaacccggccgcucacuucgccucucaugcgcggccuccggcuucagcuucuccaacuacggaaugcacuggguccgccaagcccccggaaaaggacuagaaugggucgcccucaucugguacgacggcuccaaugaagacuacaccgacuccgucaaaggccgguucaccauaucccgugacaacuccaaaaacacccuauaccuccaaaugaacucccuccgcgccgaagacaccgccgucuacuacugcgcacguuggggcauggucagaggaguaaucgacguuuucgacaucuggggacaaggaaccgucguaaccguauccagcgccucaaccaaaggacccuccguauucccacuagcacccagcuccaaauccaccuccggcggaaccgccgcccucggcugccucguaaaagacuacuucccagaacccguaaccguauccuggaacuccggagcccuaaccaguggcguccacacauuucccgcaguccuacagagcuccggacucuacucccuaucauccgucgucaccguucccuccucaucccucggcacccaaacauacaucugcaacguaaaccacaaaccaagcaacacgaaaguggacaaacgcgucgaacccaaaucaugcgacaaaacacauaccugcccacccugccccgcccccgaacuacucggcggccccucaguauuccucuucccacccaaacccaaagacacacucaugaucucacgaacacccgaagugaccugcgucgucgucgacgucucccacgaagaccccgaagucaaauucaacugguacguugacggagucgaaguccacaaugcaaaaacaaaaccccgcgaagaacaauacaacucgaccuaccgggucgucucaguccucacaguccuccaccaagacuggcucaacggaaaagaguacaaaugcaaaguauccaacaaagcccucccagcccccauagagaaaacaauaagcaaagccaaaggacaaccacgcgaaccccaagucuacacacucccacccucccgcgaagaaaugaccaaaaaccaagucucucuaaccugccucgugaaaggauucuaccccagcgacaucgcagucgagugggaauccaacggacagccagaaaacaauuacaaaaccaccccucccguacuagacuccgacggcuccuucuuccuauacuccaagcuaaccgucgacaaaucccgcuggcaacaaggcaacgucuucuccugcuccguaaugcacgaagcccuccacaaccacuacacccaaaagucccucagccucagccccggcaaa

SEQ ID NO: 54449 - RNA, 642 nt, Artificial Sequence
  derived and/or modified sequence opt11 from Actoxumab_LightChain
gacauccaaaugacccaaucccccuccucagucuccgccuccgucggcgaccgcgucaccauaaccugccgcgccucccaaggcaucuccucauggcucgccugguaccaacacaaacccggcaaagcccccaaacuccucaucuacgccgccuccucccuacaauccggcguccccucccgcuucuccggcuccggcuccggcaccgacuucacccuaaccaucuccucccuccaacccgaagacuucgccacauacuacugccagcaagccaacuccuuccccuggaccuucggacaaggcaccaaagucgaaaucaaacgcaccgucgcagcccccagcguauucaucuucccacccucagacgaacaacuaaaauccggaaccgccuccgucgucugccuacucaacaacuucuacccccgcgaagccaaaguacaauggaaagucgacaacgcccuccaauccggcaacucccaagaauccgucaccgaacaagacagcaaagacuccaccuacucucucucaucaacccuaacccucucaaaagccgacuacgaaaaacacaaaguuuacgccugcgaagucacccaccaaggccucuccucacccgucaccaaauccuucaaccgaggcgaaugc

SEQ ID NO: 54450 - RNA, 1326 nt, Artificial Sequence
  derived and/or modified sequence opt11 from Andecaliximab_HeavyChain
caaguccaacuacaagaauccggccccggccucguaaaacccuccgaaacccucucccuuaccugcaccgucucaggcuucagccuccuauccuacggcguacauuggguccgacaaccaccaggcaaaggccuagaauggcucggagucaucuggaccggcggcacaaccaauuacaacuccgcccucaugucacgcuucaccaucuccaaagaugacuccaaaaacaccgucuaccuuaaaaugaacucccucaagaccgaagauaccgcaauuuacuacugcgcucgauacuacuacggcauggacuacuggggccaaggcacacucgucaccguaagcagcgcaucaaccaagggacccucugucuucccacucgcaccuugcucacgauccaccuccgaaagcacagccgcccuuggcugccuugugaaagacuacuuccccgaaccagucaccgucucauggaacucaggagcccuaacaucaggcguccacaccuuccccgcuguccuccaauccagcggccucuacucacuauccagcgucgucaccguaccauccucuucccuaggaaccaaaaccuauaccugcaacgucgaccacaaacccuccaauacaaaagucgacaaacgagucgaauccaaauacggaccucccugcccacccugccccgcccccgaguuccucggcggccccucagucuuccucuucccaccuaaaccuaaagacacacuuaugauaucccguacccccgaaguaaccugcgucgucgucgacgucucccaagaagaccccgaaguccaauucaacugguacgucgacggcgucgaaguccacaacgcaaaaaccaaacccagagaagaacaauucaauuccacauaccgcgucgucucaguacucacaguccuccaccaagacuggcucaacggcaaagaauacaaaugcaaaguaucaaacaaaggccuaccauccuccaucgaaaagaccauaucaaaagcgaaaggccaaccacgcgaaccacaagucuauacccucccucccucccaagaagaaaugaccaaaaaccaaguaucacuaaccugccucgucaaaggcuucuaucccucagauaucgccgucgaaugggaaagcaacggccaacccgaaaacaacuacaaaaccacacccccgguccucgacagcgacggcagcuucuuccucuacucccgccucaccgucgacaaaucacgauggcaagaaggcaacguuuucucaugcagcgucaugcacgaagcccuccacaaccacuauacccaaaaaucccucucccuaucccucgggaaa

SEQ ID NO: 54451 - RNA, 642 nt, Artificial Sequence
  derived and/or modified sequence opt11 from Andecaliximab_LightChain
gacauccaaaugacccaaucccccuccucccucuccgcauccgucggcgaccgcguaaccaucacaugcaaagccagucaagacguccgcaacaccgucgccugguaccaacaaaaacccggcaaagcccccaaacuccucaucuacuccuccuccuaccgcaacaccggcgucccagaccgcuucucaggcuccggcuccggcaccgacuucacccucaccaucuccucccuccaagccgaagacgucgccgucuacuacugccaacaacacuacaucacccccuacacauucggcggcggcaccaaagucgaaaucaaacgcaccgucgccgcccccuccgucuucaucuucccacccuccgacgaacaacuaaaauccggcaccgccuccgucgucugccuacuaaacaacuucuacccccgcgaagccaaaguccaauggaaagucgacaacgcccuacaauccgguaacucccaagaauccgucaccgaacaagacuccaaagacuccaccuauuccuuauccucaacccuaacccucuccaaagccgacuacgaaaaacacaaaguauacgccugcgaaguaacccaccaaggccucuccucccccguaaccaaauccuucaaccgcggagaaugc

SEQ ID NO: 54452 - RNA, 1353 nt, Artificial Sequence
  derived and/or modified sequence opt11 from Aprutumab_HeavyChain
gaaguccaacuacuugaaagcggcggaggucucguucaacccggcggcucacuccgacucuccugcgccgccucaggcuucaccuucuccucuuacgccaugucauggguccgacaagccccaggcaagggacucgaaugggucuccgccaucuccggcucuggcacaagcaccuauuacgccgacuccguaaaaggccgcuucaccaucagccgcgacaacuccaaaaacacucuauaccuccaaaugaacucccuccgcgccgaagacaccgccgucuacuacugcgcccgcguccgcuacaacuggaaccauggcgacugguucgaccccuggggacaaggcacacucgucaccgucuccuccgccuccacuaaaggccccucugucuucccccuagcuccaucaucaaaauccaccuccggcggcaccgccgcccucggcugccuagucaaggacuacuucccagaacccgucaccgucucauggaacagcggcgcccuuaccucaggcguacacaccuuccccgccguccuucaaucaucgggccucuacucccucucaucagucgucacaguccccuccuccucacuaggcacccaaacauacaucugcaacgucaaccacaaacccuccaacacuaaaguagauaagaaagucgaacccaaaaguugcgacaaaacccacacaugcccucccugccccgcccccgaacuccucggaggcccuuccgucuuucucuucccgcccaaacccaaagacacacugaugaucucccggacccccgaaguaacuugcgucgucgucgacguaucccacgaagaccccgaagucaaauucaacugguacguagacggaguagaaguccacaacgccaaaacuaaaccacgcgaagaacaauacaacuccacauaccgagucguaucaguccucaccguucuacaccaagacuggcucaacggcaaagaauacaaaugcaaaguaucaaacaaagcccuaccugcaccaaucgagaaaaccauaagcaaagccaaaggccaaccccgcgaaccccaagucuacacucuucccccuucccgagacgaacucaccaaaaaccaaguaucccuaaccugccucgucaaaggauucuacccauccgacaucgccgucgaaugggaaagcaacggccaacccgaaaacaacuacaaaacaacaccacccguccuugacucagacggaucauucuuucuauacuccaaacuaacagucgauaaaucaagauggcaacaaggcaacgucuucucaugcucuguaaugcacgaagcccuccacaaccacuacacccaaaaaucccucucccucucccccggc

SEQ ID NO: 54453 - RNA, 648 nt, Artificial Sequence
  derived and/or modified sequence opt11 from Aprutumab_LightChain
caauccguccucacccaaccccccucagccuccggcacccccggccaacgagucacaaucucaugcuccggcuccuccuccaacaucggaaacaacuacguauccugguaccaacaacuccccggcaccgccccaaaacuccucaucuacgaaaacuacaaccgccccgcaggcguacccgaccgauucuccggcuccaaauccggcaccuccgccucccuagcaaucuccggacuacgcuccgaagacgaagccgacuacuacugcuccuccugggacgacucccucaacuacuggguauucggcggcggaaccaaacucaccguacucggccaacccaaagcagcccccuccgucacccuauucccgccaucauccgaagaacuacaagccaacaaagccacccucguaugccucauauccgacuucuaccccggcgccgucaccgucgccuggaaagccgacuccucccccgucaaagccggcgucgaaaccaccacccccuccaaacaauccaacaacaaauacgccgccuccucauaccucucccucacccccgaacaauggaaaucccaccgcuccuacucaugccaagucacccacgaaggcagcaccgucgaaaaaaccgucgcacccaccgaaugcucc

SEQ ID NO: 54454 - RNA, 1341 nt, Artificial Sequence
  derived and/or modified sequence opt11 from Azintuxizumab_HeavyChain
gaaguccaacucguagaauccggaggcggacucguccaaccaggcggcucccuucgucuaagcugcgcagccuccggauucaccuucucagacuacuacauggccuggguucgucaagcccccggcaagggccucgaauggguagcauccaucaauuacgacggcucauccaccuacuacguagacuccgucaaaggacgcuucaccaucuccagagacaacgccaaaaacucccuauaccuccaaaugaacucccuccgcgcagaagacaccgcaguauauuacugugcccgcgaccgcggcuacuacuucgacuacuggggccaagguacaacagucaccgucuccucagccucaaccaaaggccccucugucuucccccucgcaccauccuccaaauccaccucagguggaaccgccgcacuaggcugccucguaaaagacuacuucccugaacccgucaccgucuccuggaacuccggagcccucaccuccggaguacacaccuucccagcaguccuccaaucauccggacucuacucccucuccucugucgugacagucccaagcagcucacucggcacccaaaccuacaucugcaacgucaaccacaaacccuccaacaccaaaguagacaagaaagucgaacccaaauccugcgacaaaacccacacaugcccacccugccccgcccccgaacuccucggcggccccucugucuuucuauucccucccaaacccaaagacacccucaugaucucccgaacccccgaaguaaccugcgucguaguagacgucucccacgaagaccccgaaguaaaauuuaacugguacguagacggcguugaaguccacaacgccaaaacuaaaccccgagaagaacaauacaacuccaccuaccgggucguauccguacuaacaguccuacaccaagacugguuaaacggaaaagaauacaaaugcaaagucuccaacaaagcacuccccgcccccaucgaaaagaccauauccaaagccaaaggccaaccccgcgaaccccaaguauacacccuaccacccucacgcgaagaaaugaccaaaaaccaaguaucccugaccugccucguaaaaggcuucuaccccuccgacaucgccgucgaaugggaauccaacggccaaccagaaaacaacuacaaaaccacaccgccuguccuagacuccgauggauccuuuuuccuauacucuaagcucaccguugacaaaucccgcuggcaacaaggcaacgucuucuccugcuccgucaugcacgaagcacuccacaaccacuacacucaaaaauccuuaucccucucccccggcaaa

SEQ ID NO: 54455 - RNA, 660 nt, Artificial Sequence
  derived and/or modified sequence opt11 from Azintuxizumab_LightChain
gacgucgucaugacacaaaccccccucucccucuccguaacacccggccaacccgccuccaucagcugccgcuccucccaaucccucguccacuccaacggcaacaccuaccuucacugguaccuccaaaaacccggccaauccccccaacuacucaucuacaaagucucaaaccgcuucuccggcguccccgaccgcuucuccggcuccggcuccggcaccgacuucacccuaaaaaucucccgcgucgaagccgaagacgucggcguauacuucugcagccaauccacccacgucccccccuucaccuucggaggcggcaccaaagucgaaauaaaacgaaccgucgccgcccccuccgucuucaucuucccacccuccgacgaacaacucaaauccggcaccgccuccgucgucugccuccucaacaacuucuacccccgagaagccaaaguccaauggaaagucgacaacgcccuccaaucaggaaacucacaagaaucagucaccgaacaagacuccaaagacuccaccuacucccucuccuccacccucacccucuccaaagccgacuacgaaaaacacaaggucuacgcaugcgaagucacccaccaaggccuauccucccccgucaccaaauccuucaaccgcggagaaugc

SEQ ID NO: 54456 - RNA, 366 nt, Artificial Sequence
  derived and/or modified sequence opt11 from Blinatumomab_HeavyChain1
caagugcaauugcaacagagcggggccgagcuagugcgcccgggcucgagcgugaaaauaagcuguaaagcgagcggguacgcguucucgagcuauuggaugaacugggucaagcaaaggccagggcaagggcucgaguggauaggccagaucuggcccggggacggggacacgaacuauaacgggaaauuuaaagggaaagcgaccuugaccgcggacgagagcucgagcacggccuauaugcagcucucgagcuuggccucggaagacagcgcggucuauuucugugccaggcgcgagaccacgaccgugggcagguacuauuacgcgauggauuacuggggccagggcacgaccgugaccgug

SEQ ID NO: 54457 - RNA, 363 nt, Artificial Sequence
  derived and/or modified sequence opt11 from Blinatumomab_HeavyChain2
gacaucaaacuccaacaauccggcgccgaacucgcccgccccggcgccuccgucaaaauguccugcaaaaccuccggcuacaccuucacccgcuacaccaugcacugggucaaacaacgccccggccaaggccucgaauggaucggcuacaucaaccccucccgcggcuacaccaacuacaaccaaaaauucaaagacaaagccacccucaccaccgacaaauccuccuccaccgccuacaugcaacucuccucccucaccuccgaagacuccgccgucuacuacugcgcccgauacuacgacgaccacuacugccucgacuacuggggccaaggcaccacccucaccgucuccuccgucgaa

SEQ ID NO: 54458 - RNA, 1494 nt, Artificial Sequence
  derived and/or modified sequence opt11 from Blinatumomab_LightChain_HeavyChain_HeavyChain_LightChain
gacauacagcuaacccaaucacccgcaagccuagcagucagccugggccagcgcgccacuauaagcugcaaagcaagccaaagcguagauuacgacggcgacucguaccugaacugguaccaacaaaucccaggccaaccacccaagcuacucaucuacgacgcaagcaaccucguauccggcaucccaccccgauucucgggcagcggcucagguacagacuucacacucaacauacacccagucgaaaaagucgacgcagccacauaccacugccaacagucaacagaggacccguggacauucgggggagggaccaagcucgaaaucaaaggaggaggcgggagcgggggcgggggcucaggcgggggcgggagccagguccaguuacaacaaucaggcgcggaacucgugcgacccggaagcucgguuaaaaucucauguaaggcaucaggcuacgccuucuccuccuacuggaugaacuggguaaaacaacgacccggccaaggccuagaauggauaggacaaauauggccaggcgacggcgacaccaacuacaacggcaaguucaaaggaaaagccacacuaaccgccgacgaaagcagcucgaccgcauacaugcaauuguccucacuagcaagcgaggauucagccguauacuucugcgcccgcagggaaacaaccaccguaggacgauacuacuacgccauggacuacuggggccaagggaccacagucacagucucaagcggcggcggaggcucggacauaaaacuacaacagagcggagcagaauuagcgcgcccgggagcgagcguaaaaaugagcugcaaaacuagcggguauacauucacccgcuacacaaugcacugggucaagcaaaggcccggacaaggacucgaauggauaggcuauaucaaccccucacgaggauacacaaacuacaaccaaaaauucaaagacaaagccacacuaaccacagacaagagcucgagcacggcauacaugcaacucucaucacucaccucggaagacagcgcggucuacuacugcgcccgauacuaugacgaucacuacugccuggacuacuggggacaaggaacaacacucacagucucgagcguagaaggaggcucgggcggaagcggaggcucaggcggaagcggaggcguggacgacauacaacuaacgcaaucaccagcgaucaugagcgcaagcccaggcgaaaaaguaacgaugaccugucgagcaagcucauccguaaguuacaugaacugguaccagcaaaaaucaggcacaagccccaaaagauggauauacgacaccucgaaaguugccucgggcgucccauaccgcuucuccgguagcggaagcggaaccucauacucacuuacgaucucaucgauggaagcagaagacgccgcgaccuacuauugccaacaauggagcagcaauccccuaacauucggagcggguacaaaacuggaacugaaa

SEQ ID NO: 54459 - RNA, 333 nt, Artificial Sequence
  derived and/or modified sequence opt11 from Blinatumomab_LightChain1
gacauccaacucacccaaucccccgccucccucgccgucucccucggccaacgcgccaccaucuccugcaaagccucccaauccgucgacuacgacggcgacuccuaccucaacugguaccaacaaauccccggccaaccccccaaacuccuaaucuacgacgccuccaaccucgucuccggcauccccccccgcuucucaggcuccggcuccggcaccgacuucacccucaacauccaccccgucgaaaaagucgacgccgccaccuaccacugccaacaauccaccgaagaccccuggaccuucggcggcggcaccaaacucgaaaucaaa

SEQ ID NO: 54460 - RNA, 324 nt, Artificial Sequence
  derived and/or modified sequence opt11 from Blinatumomab_LightChain2
gucgacgacauccaacucacccaaucccccgccaucauguccgccucccccggcgaaaaagucaccaugaccugccgcgccuccuccuccgucuccuacaugaacugguaccaacaaaaauccggcaccucccccaaacgcuggaucuacgacaccuccaaagucgccuccggcguccccuaccgcuucuccggcuccggcuccggcaccuccuacucccucaccaucucauccauggaagccgaagacgccgccaccuacuacugccaacaaugguccuccaacccccucaccuucggcgccggcacaaaacucgaacucaaa

SEQ ID NO: 54461 - RNA, 1350 nt, Artificial Sequence
  derived and/or modified sequence opt11 from Brazikumab_HeavyChain
cagguccaacucgucgaauccggcggcggagucguccaaccaggccgcucacuacgcuuaucaugcgccgccuccggcuuuaccuucucaucauacgggaugcacuggguccgacaagcaccaggcaaaggacucgaaugggucgccgucauaugguacgacggauccaacgaauacuacgccgacucagucaaaggccgguuuacuaucuccagagauaauuccaaaaacacccuauaccuacaaaugaacucucucagagccgaagacacagccgucuacuacugcgcccgugaccgcggauacaccuccucuugguacccagacgcauucgacaucuggggccagggcacaauggucaccguaucauccgcaagcaccaaaggccccuccgucuucccacucgcccccugcucccgaagcaccucagaauccaccgccgcccuaggaugccucgucaaagacuacuuccccgaacccguaaccgucuccuggaacuccggcgcccuaacaagcggcguccacaccuuccccgccguacuccaaucuucuggacucuacucccucagcucgguagucacaguccccucaucaaacuucggcacccaaaccuacacaugcaacgucgaccacaaaccaagcaacaccaaagucgacaaaaccgucgaacgcaaaugcugcgucgaaugcccacccugccccgccccacccgucgcaggacccuccgucuuccucuucccacccaaacccaaagacacccucaugaucucccgcacccccgaaguaaccugcgucgucgucgaugucagccacgaagaccccgaaguccaauucaacugguacgucgacggcgucgaaguccacaaugccaagacaaaaccccgugaagaacaauucaacucaacauuccgagucgucuccguccuuacugucguccaccaagacuggcuaaacggcaaagaauacaaaugcaaaguaucaaacaaaggccuaccugcgcccaucgagaaaaccaucuccaaaacaaagggacagccacgagaaccucaaguauacacccucccacccucacgugaagaaaugaccaaaaaccaagucucacuaaccugccucgucaaaggauucuaccccuccgacaucgcugucgaaugggaaucaaacggccaacccgaaaacaacuacaaaacaaccccacccaugcuggacucugauggcagcuucuuccuauacuccaaacuaaccgucgacaaaagccgcuggcaacaaggcaacguuuucuccugcuccgucaugcacgaagccuuacacaaccacuacacccaaaaaucccucucccuaucacccggcaaa

SEQ ID NO: 54462 - RNA, 651 nt, Artificial Sequence
  derived and/or modified sequence opt11 from Brazikumab_LightChain
caauccguccucacccaaccccccuccguaucaggcgcccccggccaacgcgucaccaucuccugcacaggcuccucauccaacacuggcgccggcuacgacguccacugguaccaacaaguacccggcaccgcccccaaacuacuuaucuacggcuccggaaaccgacccuccggcguccccgaccgcuucuccggcuccaaaucuggcacauccgccucccucgccaucaccggccuccaagccgaagacgaagccgacuacuacugccaauccuacgacuccucccucucaggcugggucuucggaggcggcacccgccucaccguccuaggacaaccaaaagccgcccccucagucacccucuucccacccuccuccgaagaacuccaagccaacaaagccacccuagucugccucaucuccgacuucuaccccggcgccgucaccgucgccuggaaagccgacuccuccccagucaaagccggcgucgaaaccaccacccccuccaaacaauccaacaauaaauacgccgccuccucauaccucucccucaccccugaacaauggaaaucccaccgcuccuacuccugccaaguaacccacgaaggcuccaccguagaaaaaaccgucgcccccaccgaaugcucc

SEQ ID NO: 54463 - RNA, 363 nt, Artificial Sequence
  derived and/or modified sequence opt11 from Brolucizumab_HeavyChain
uccgaaguccaacucgucgaaucaggaggcggccucguccaacccggcggcucccuccgccucuccugcaccgccuccggcuucucccucaccgacuacuacuacaugaccuggguccgacaagcccccggcaaaggccucgaaugggucggcuucaucgaccccgacgacgaccccuacuacgccaccugggccaaaggccgcuucaccaucucacgcgacaacuccaaaaacacccucuaccuccaaaugaacucacuccgcgccgaagacaccgccgucuacuacugcgccggcggagaccacaacuccggcuggggccucgacaucuggggccaaggcacccucgucaccgucuccucc

SEQ ID NO: 54464 - RNA, 333 nt, Artificial Sequence
  derived and/or modified sequence opt11 from Brolucizumab_LightChain
auggaaaucgucaugacccaaucccccuccacccucuccgccuccgucggagaccgcgucaucaucaccugccaagccuccgaaaucauccacuccuggcucgccugguaccaacaaaaacccggcaaagcacccaaacuccucaucuaccucgccuccacccucgccuccggcguccccucccgcuucuccggcuccggcuccggcgccgaauucacccucaccaucuccucccuccaacccgacgacuucgccaccuacuacugccaaaacgucuaccucgccuccaccaacggcgccaacuucggccaaggcaccaaacuaaccguccuc

SEQ ID NO: 54465 - RNA, 1347 nt, Artificial Sequence
  derived and/or modified sequence opt11 from Cabiralizumab_HeavyChain
caaguccagcuaguccaauccggagccgaagucaagaaacccggcuccuccgucaaagucucuugcaaagccuccggcuacacuuucaccgacaacuacaugaucuggguaagacaagcccccggacaaggacucgaauggaugggcgacaucaacccauacaacggcggcaccaccuuuaaccaaaaauucaaaggccgcgucaccauaacagccgacaaaagcaccuccaccgccuacauggaacucucaucccuacgcuccgaagacacagcugucuacuacugugcccgcgaaucccccuacuucuccaaccuauacgucauggacuacuggggccaaggcacccucgucacagucucauccgccuccaccaaaggcccaucugucuucccccucgcacccugcagcagaucaaccagcgaauccacagcagcccucggcugccucgucaaagacuacuucccagaacccguaaccgucucauggaacuccggggcacucacuuccggcguccacaccuuccccgcuguccuacaaucauccggccucuacucccucucuucugucguuacaguccccucuuccucucuaggcaccaaaaccuacacaugcaacguagaccacaaaccuuccaacaccaaagucgacaaacgcguagaauccaaauacggcccucccugcccacccugccccgcccccgaguuccucggcggccccagcgucuuccucuucccacccaaacccaaagacacacucaugaucucccgcacccccgaaguuaccugcgucgucguggacgucagccaagaagaccccgaaguccaauuuaacugguacguagacggugucgaaguccacaacgccaagaccaaaccccgcgaagaacaauucaauagcacauaccgcguaguguccguccuaaccguccugcaccaagauuggcuaaacggcaaagaauacaaauguaaagucaguaacaaaggacuucccagcuccaucgaaaagaccaucuccaaagcuaaaggccaaccccgcgaaccccaaguauacacccuaccaccaucccaagaagaaaugacuaaaaaucaagucucgcucacaugccucgucaaaggcuuuuaccccuccgacaucgccgucgaaugggaauccaacggccaacccgaaaauaauuacaaaacaacaccucccguccucgacucggacggcucauucuuccuauacucccgccuaaccgucgacaaaagccgcuggcaagaaggaaacgucuucuccugcuccgucaugcaugaagcccuccacaaccacuacacccaaaaaucacucucacucucacucggcaaa

SEQ ID NO: 54466 - RNA, 654 nt, Artificial Sequence
  derived and/or modified sequence opt11 from Cabiralizumab_LightChain
gaaaucguccucacccaaucccccgccacccuaagccucucacccggcgaacgcgccacacucuccugcaaagccucacaaucaguagacuacgacggcgacaacuacaugaacugguaccaacaaaaacccggccaagcccccagacuccucaucuacgccgccuccaaccucgaauccggcaucccagcccgcuucucaggcuccggcucaggcaccgacuucacccuaaccaucuccucccucgaacccgaagacuucgcagucuacuacugccaccucucaaacgaagaccucuccaccuucggcggcggcaccaaagucgaaaucaaacgcaccgucgccgcccccuccgucuucauauucccgcccuccgacgaacaacucaaauccggcaccgccuccgucgucugccuccucaacaacuucuacccccgcgaagccaaaguccaauggaaagucgacaacgcacuccaauccggaaacucccaagaauccgucaccgaacaagacuccaaagacuccaccuacucccucuccuccacccuaacccucuccaaagccgacuacgaaaaacacaaagucuacgccugcgaagucacacaccaaggccuaucaucgcccgucacaaaaucauucaaccgcggcgaaugc

SEQ ID NO: 54467 - RNA, 1329 nt, Artificial Sequence
  derived and/or modified sequence opt11 from Camrelizumab_HeavyChain
gaaguccaacucgucgagucaggcggcggacucguacaacccggcggcucccuccgccuaagcugcgcagccuccgguuucaccuucuccuccuacaugauguccuggguccgccaagccccaggcaaaggccucgaaugggucgcaaccaucucuggcggaggugccaacaccuacuacccagacuccgucaaaggacgcuucaccaucucccgcgacaacgccaaaaacucgcucuaccuacaaaugaacucccuacgcgccgaagacaccgccgucuacuacugcgcccgccaacucuacuacuucgacuacuggggccagggcacuaccgucacugucuccuccgccuccaccaaaggccccuccguuuucccccucgcccccugcagccgauccacaucagaauccaccgccgcccuaggcugccuagucaaagacuacuuccccgaaccagucaccgucuccuggaacucuggcgcccucaccuccgguguacacaccuucccugccguacuccaauccucaggacucuacucucucucaucagucguaaccguacccuccucaucacucggaacuaaaaccuauaccugcaacgucgaccacaaacccucuaacacaaaaguagacaaacgagucgaaucgaaauacggcccacccugcccacccugccccgcaccagaguuccugggaggacccuccguuuuccuauucccgcccaaacccaaggacacacucaugauaucccgcacccccgaaguaacaugcgucguagucgacgucucacaagaagaucccgagguacaauucaauugguacguagacggcguagaaguccacaacgcaaaaaccaaaccccgagaagaacaauucaacucaaccuaccgcgucgucuccguacucaccguccuucaccaggacuggcucaacggcaaagaauacaaaugcaaaguaucaaacaaaggacugcccucauccaucgagaagaccauaagcaaagccaaaggccaaccccgcgaaccccaagucuacacccucccaccaucucaagaagaaaugaccaaaaaccaaguaucucuaacgugccucgucaaagguuucuaccccuccgacauagcggucgaaugggaguccaacggccaacccgagaacaacuacaaaaccacacccccaguccucgacucagacggcucauucuuccuuuacucccgccucacaguagacaagucccguuggcaagaaggcaacgucuucagcugcuccguaaugcacgaagcucuccacaaccacuacacccagaaaucacucucccucucgcucggaaaa

SEQ ID NO: 54468 - RNA, 642 nt, Artificial Sequence
  derived and/or modified sequence opt11 from Camrelizumab_LightChain
gacauccaaaugacccaaucccccuccucacucuccgccuccguaggcgaccgcgucaccauaaccugccucgcaucccaaaccaucggcacauggcucaccugguaccaacaaaaacccggcaaagcacccaaacuccucaucuacacugccaccucccuagcagacggaguccccucccgauucuccggauccggcuccggcaccgacuucacccuaaccaucuccucacuccaacccgaagacuucgccaccuacuacugccaacaagucuacuccauccccuggaccuucgguggcggcaccaaagucgaaaucaaacgcacagucgcagcccccuccgucuucaucuucccacccuccgacgaacaacucaaauccggcaccgccuccgucgucugccuccuaaacaacuucuacccccgcgaagccaaaguccaauggaaagucgacaacgcccuccaauccggcaacucccaagaauccgucaccgaacaagacucaaaagacuccaccuacagccucagcuccacccugacccucagcaaagccgacuacgaaaaacacaaagucuacgccugcgaagucacacaccaaggccugagcucacccguaaccaaauccuucaaccgcggcgagugc

SEQ ID NO: 54469 - RNA, 777 nt, Artificial Sequence
  derived and/or modified sequence opt11 from Caplacizumab_HeavyChain
gaggugcagcugguagagagcgggggaggacuggugcaaccggggggaagccugagguuaaguugcgcagcaucggggagaacguuuagcuauaacccgauggggugguuuaggcaggcgccggggaagggaagggaguugguagcggcaauaaguaggaccggggggagcaccuauuacccggauaguguagagggaagguucacgauaaguagagacaacgcgaagaggaugguguaccugcagaugaauagucugagggcggaggacacggcgguguacuauugcgcagcggcgggggugagggcggaggaugggagggugaggacgcuaccgagugaguacacguucugggggcaggggacacagguaacggugagcagcgcagcggcggagguacagcugguggagagcgggggggggcugguacagccgggggggagccugaggcugagcugugcagcgagcgggaggacguucagcuacaauccaauggggugguucagacaagcaccggggaaagggagagaguugguagcagcgauaagcaggacgggggggagcacguauuauccggauagcguggaggggagguuuacgauaagcagggacaacgcgaagaggaugguauaucugcagaugaauagccuaagagcggaggauacggcgguguacuacugugcggcggcaggggugagggcggaggacgggagggugaggacgcuaccgagugaguacacguucugggggcaggggacgcaggugacaguaaguagu

SEQ ID NO: 54470 - RNA, 657 nt, Artificial Sequence
  derived and/or modified sequence opt11 from Citatuzumab_bogatox_HeavyChain
gaaguccaacuaguccaauccggccccggacucguccaacccggcggcuccguacgcaucucaugcgccgccuccggauacaccuucaccaacuacggcaugaacugggucaaacaagcccccggcaaaggccuagaauggaugggauggaucaacaccuacaccggcgaauccaccuacgccgacuccuucaaaggccgcuucaccuucucccuagacaccucagccuccgccgccuaccuccaaauuaacucccuccgcgccgaagauaccgccgucuacuacugcgcccgcuucgccaucaaaggagacuacuggggccaaggaacccuccucaccgucuccuccgccucaaccaaaggacccuccgucuucccacucgcccccuccuccaaauccaccucaggcggcaccgccgcccucggaugccucgucaaagacuacuuccccgaacccgucacagucuccuggaacuccggcgcccuaaccuccggcguccacaccuuccccgccguccuccaaucaucaggccucuacucccucucauccgucgucaccguccccuccuccucccucggcacacaaaccuacauaugcaacgucaaccacaaacccuccaacaccaaagucgacaaaaaagucgaacccaaauccugc

SEQ ID NO: 54471 - RNA, 1356 nt, Artificial Sequence
  derived and/or modified sequence opt11 from Cosfroviximab_HeavyChain
gacgucaaacuccucgaaucaggcggcggauuaguccaaccaggcggcucccuaaagcucagcugcgccgcauccggcuucagccuauccaccuccgguguuggcguaggcugguuccgccaaccuuccggcaaaggccucgaauggcucgcccuuaucuggugggacgacgacaaauacuacaaccccucucuaaaaucccaacuuucuauauccaaagacuucucccggaaucaagucuuccucaaaaucuccaacgucgacaucgccgacaccgccacauacuacugcgcacgcagagaucccuucggauacgacaacgccaugggcuacuggggccaaggaaccucggucacaguauccuccgccuccaccaaaggcccaucagucuucccacuugccccauccuccaaaucaaccuccggcggcacagccgcccuagguugccucguaaaagacuacuuccccgaaccagugaccguaucauggaacuccggcgcccucacuucaggcguccacacauuccccgccguccuccaaagcagcggucucuauucccucagcuccgucgucaccguaccaucaagcucccucggcacccaaaccuacauaugcaacguaaaccacaaacccagcaacaccaaagucgacaaacgagucgaaccaaaaucaugcgacaaaacccacacaugcccacccugcccagccccagaacuccucggcggccccucgguauuccucuucccucccaaacccaaagauacccucaugaucucccgcacccccgaaguuaccugcgucgucgucgacgugucccacgaagacccggaagugaaauucaacugguacgucgacggagucgaaguccacaacgccaaaaccaaaccccgagaagaacaauacaacuccaccuaccgcgucgucuccguccugaccguccugcaccaagacuggcucaacggcaaagaauacaaaugcaaagucuccaacaaagcccuccccgccccaaucgaaaagacaaucucaaaagccaaaggccaaccucgcgaaccccaagucuacacacuacccccaucccgagacgaacuuaccaaaaaccaagucucacuaaccugccucgugaaaggauucuacccaucagacauagcaguagaaugggaauccaacggccagcccgaaaacaacuacaaaacgaccccucccguccucgacuccgacggcucauucuuccucuacuccaaacucaccgucgacaaauccagauggcaacaaggcaacgucuuuuccugcuccgucaugcacgaagcccuccacaaccacuacacacaaaaaucacucucccugagucccggaaaa

SEQ ID NO: 54472 - RNA, 639 nt, Artificial Sequence
  derived and/or modified sequence opt11 from Cosfroviximab_LightChain
gacaucgucaugacccaaucaccccucucccucuccacauccgucggcgaccgcgucucccuaacaugcaaagccucccaaaacgucggcacagcagucgccugguaccaacaaaaacccggacaaucccccaaacuccucauauacucagccuccaaccgauacaccggcguccccgaccgcuucaccggaucaggcucuggcaccgacuucacacucaccaucuccaacaugcaauccgaagaccuagcagacuacuucugccaacaauacagcuccuacccccucaccuucggagccggcaccaaacucgaacuccgcaccgucgccgcacccuccguauucaucuucccacccucagacgaacaacuaaaauccggcaccgccuccgucguuugccuccucaacaacuucuacccccgcgaagccaaaguccaauggaaagucgacaacgcccuacaauccggcaacucccaagaaucagucaccgaacaagacuccaaagacuccaccuacucucucuccuccacccucacccucuccaaagccgacuacgaaaaacacaaagucuacgccugcgaagucacccaccaaggccucuccucacccgucaccaaauccuucaaccgcggcgaaugc

SEQ ID NO: 54473 - RNA, 1344 nt, Artificial Sequence
  derived and/or modified sequence opt11 from Crizanlizumab_HeavyChain
caaguucaacucguacaauccggcgccgaagucaagaaacccggcgccuccguaaaagucucaugcaaagucucaggcuacaccuucacauccuacgacauaaacuggguacgccaagccccaggcaaaggacucgaauggaugggauggaucuacccaggagacgguuccaucaaauacaacgaaaaauucaaaggacggguaacaaugacggucgacaaauccaccgacacagcauacauggaacuaagcucacuccgcagcgaagacacagccguauacuacugcgcacgccgcggcgaauacggaaacuacgaaggcgcaauggacuacuggggccaaggcacccuaguaaccgucagcagcgccucaacgaaagggcccucaguauucccacucgcccccugcucacgcucaaccucagaaagcacugccgcccucggcugccucgucaaagacuacuucccagaaccuguaacagucuccuggaacucaggcgcacuaaccucaggaguacacacauuccccgcaguccuacaaagcagcggccuguauucccucuccucggucgucaccguaaccagcagcaacuucggcacccaaacauacacaugcaacguggaccacaaacccuccaacaccaaagucgacaaaaccguagaacgaaaauguugcgucgaaugcccacccugucccgccccuccagucgccggccccuccguauuccucuuucccccaaaaccaaaagacacccucaugaucucccgcacccccgagguaaccugcgucgucgucgacgucucccacgaagaccccgaaguacaauucaacugguacgucgacggcauggaaguacacaacgccaaaaccaaaccgagagaagaacaguucaacucaacauuccgugucguaucaguccuaaccguaguccaccaagacuggcucaacggaaaagaauacaaaugcgcagucucaaacaaaggucuacccgccccaaucgaaaagaccauaagcaaaacaaaaggccaaccacgagaaccccaggucuacacgcucccacccucacgcgaagaaaugaccaaaaaccaagucucacucacaugccucgucaaaggcuucuaccccagcgacaucgccgucgaaugggaaucuaacggccaacccgaaaacaacuacaaaaccacaccacccaugcuugacucggacggaucauucuuccucuacucaaaacuaaccgucgacaagucccgcuggcaacaaggaaacgucuucuccugcucaguaaugcacgaagcacuucacaaccacuacacccaaaaaucacucucacucucacccgggaag

SEQ ID NO: 54474 - RNA, 654 nt, Artificial Sequence
  derived and/or modified sequence opt11 from Crizanlizumab_LightChain
gacauccaaaugacacaaucccccucaucccucagcgccucagucggcgaccgcgucacaaucacaugcaaagcaucccaauccgucgacuacgacggccacuccuacaugaacugguaccaacaaaaacccggcaaagcacccaaacuccucaucuacgccgccuccaaccucgaauccggcguccccucccgauucuccggauccggauccggcaccgacuucacccucaccaucuccucacuccaacccgaagacuuugccaccuacuacugccaacaauccgacgaaaacccccucacauucggcggcggcacaaaagucgaaaucaaacguacaguagccgcccccuccgucuucaucuucccaccauccgacgaacaacuaaaauccggcaccgccucaguagucugccuccuaaacaacuucuacccccgcgaagccaaaguccaauggaaagucgacaacgcccuccaguccggaaacucacaagaaagcgucaccgaacaagacuccaaagacuccaccuacucccucuccucaacccucacccucuccaaagccgacuacgaaaaacacaaagucuacgccugcgaaguaacccaccaaggccucuccucccccgucacaaaauccuucaaccgcggcgaaugc

SEQ ID NO: 54475 - RNA, 1365 nt, Artificial Sequence
  derived and/or modified sequence opt11 from Crotedumab_HeavyChain
gaaguccagcuagucgaauccggcggcggccuuguccaacccggcggcucgcuacgccuaagcugcgcagcaucuggcuucaccuucagcaacuaccuaaugaacuggguccgccaagcccccggaaaaggccucgaauggcucgcuaacauccaagaagacggcauagaaaaauacuacguagacucaguaaaaggccgcuucaccaucagccgcgauaacgccaaaaacucacuauaccuccaaaugaacucacuacgagccgaagacaccgcagucuacuacugcgcccgcgaacccucccauuacgacauccucaccggauacgacuacuacuacggcauggacgucuggggccaaggcaccaccguaaccgucagcagcgccuccacuaaaggccccagcgucuucccccuugcaccaugcagccgcuccacaucagaaucaaccgcagcccucggcugccucgucaaagauuauuuccccgaacccgucaccgucucauggaacuccggcgcccucaccuccgguguacacaccuuccccgccguccuacaauccucaggacucuauucacucagcagcgucgucaccguaccaagcuccucccucggcaccaagaccuacacaugcaacgucgaccacaaacccagcaauacaaaaguagacaaacgagucgaaucaaaauacggaccgcccugcccacccugccccgcccccgaguuccucggaggccccucaguauuccuauucccacccaaacccaaagacacacuaaugaucagccgcacccccgaagucacuugcgucgucguagacgucucccaagaagacccggaaguccaguucaacugguacguagacggcgucgaaguacauaacgccaaaacaaaaccacgagaagaacaauucaacucaaccuaccgcguagucagcguccuaaccguccuucaccaagacuggcugaacggcaaagaauacaaaugcaaagucuccaacaaaggccuacccuccuccaucgagaaaacuaucuccaaggcaaaaggucaaccccgcgaaccccaggucuacacacucccuccuucccaagaagaaaugaccaaaaaccaagucucccuaaccugccuuguaaaaggcuucuaucccucggacaucgcugucgaaugggaauccaacggacaacccgaaaacaacuacaagaccacuccacccguacucgacuccgacggcuccuucuuccuauacuccagacucaccguagacaaaucccgauggcaggaagggaacgucuucucaugcuccguaaugcaugaagcccuccacaaccacuauacacaaaaaucacucucccucucccucggcaaa

SEQ ID NO: 54476 - RNA, 642 nt, Artificial Sequence
  derived and/or modified sequence opt11 from Crotedumab_LightChain
gacauccaaaugacccaauccccauccucacucuccgccuccgucggcgaccgcgucaccaucacaugccgugccucccaaggcauccgcaacgaccucggcugguaccaacaaaaacccggcaaagcccccaaacgccuaaucuacgccgccuccucccuccaaucaggcgucccaucccgauucuccggcuccggcuccggcaccgaauucauccucaccgucucuucccuccaacccgaagacuucgccaccuacuacugccuccaauacaacucaaacccauucaccuucggccccggcaccaaagucgacauaaaacgcaccgucgcagcccccuccgucuucaucuucccccccuccgacgaacaacucaaauccggcaccgccucaguagucugccuccucaacaacuucuacccccgcgaagcaaaaguccaauggaaagucgacaacgcccuccaauccggcaacucccaagaauccgucaccgaacaagacuccaaagacuccaccuacucccuuuccuccacccucacccucuccaaagccgacuacgaaaaacacaaagucuacgccugcgaagucacacaccaaggucucuccucacccgucaccaaauccuucaaccgcggcgaaugc

SEQ ID NO: 54477 - RNA, 1356 nt, Artificial Sequence
  derived and/or modified sequence opt11 from Dezamizumab_HeavyChain
caaguccagcuaguccaauccggugcagaagucaagaaacccggcuccucaguuaaagucuccugcaaggcauccggcuucaccuucgcuacauauaauaugcacuggguccgccaagcccccggccaaggccucgaauggaugggcuacaucuauccaggcgacggcaacgcuaacuacaaccaacaauucaaaggccgcgucaccauaacugccgacaaaagcaccucuaccgcauacauggaacuauccucccuucgauccgaagauacagccgucuauuacugcgcccgcggcgacuucgacuacgacggcggcuacuacuucgauagcuggggacaaggcacccuugucacaguauccuccgccuccaccaaaggcccuagcguguucccucuagcccccuccuccaaauccaccuccggcggcaccgccgcccucggcugccuaguaaaagacuacuucccggaacccgucaccguauccuggaacuccggugcacucaccuccggaguacacaccuuccccgccguccuccaauccucuggccucuacucccucucauccguggucacuguucccuccucaucccucggcacacaaaccuacaucugcaacgucaaccacaaacccuccaacacaaaaguagacaagaaagucgaacccaaauccugcgacaaaacccacaccuguccacccugccccgcccccgaacuccucggcggcccaucagucuuucucuuucccccuaaacccaaagacacccucaugauaucccgcacacccgaaguaaccugcgucgucguagauguaagccacgaagaccccgaagucaaauucaacugguacguugacggcguagaaguccacaacgcaaaaaccaaaccaagagaagaacaauacaacucaaccuaccgcgucguaucaguccucacaguccuucaccaagacuggcuaaacggcaaagaauacaaaugcaaaguauccaauaaagcccucccugccccaaucgagaaaaccaucuccaaagccaaaggacagccccgagaaccccaagucuacacuuuaccacccucccgcgacgaacuaaccaaaaaccaagucucccuuacaugccucgucaaaggcuucuaucccuccgacaucgcaguugaaugggaaucaaacggccaaccugaaaacaacuauaaaaccaccccgcccguccucgacagugacggcuccuucuuccuuuacagcaagcucaccgucgacaaaucucgauggcaacaaggaaacgucuucagcugcucugucaugcacgaagcccuccacaaccacuacacccaaaaaucccucucacucucccccggcaag

SEQ ID NO: 54478 - RNA, 642 nt, Artificial Sequence
  derived and/or modified sequence opt11 from Dezamizumab_LightChain
gacauccaaaugacccaaucccccuccagccucuccgccagcguaggcgaccgcguaacaaucaccugccgcgcuagcgaaaacaucuacucauaccuagccugguaccaacaaaaacccggcaaagcccccaaacuacuaauccacaacgccaaaacccucgccgaaggcguccccucccguuucuccggcuccggcucaggcaccgacuucacccucaccaucuccucacuccaacccgaagacuucgccaccuacuacugccaacaccacuacggcgccccccucaccuucggacaaggaaccaaacucgaaaucaaacgcaccgucgcagcccccagcgucuucauauucccccccuccgacgaacaacuaaaauccggcaccgccucagucgucugccuacucaacaacuucuacccccgcgaagccaaaguccaauggaaagucgacaacgcccuccaauccggcaacucccaagaauccgucaccgaacaagacuccaaagacuccaccuacucccuaucaucaacccucacccugagcaaagccgacuacgaaaaacacaaagucuacgccugcgaagucacccaccaaggccucucaucacccgucaccaaaagcuucaaccgaggcgagugc

SEQ ID NO: 54479 - RNA, 1506 nt, Artificial Sequence
  derived and/or modified sequence opt11 from Duvortuxizumab_Chain1_scFv
gaaaacguacucacgcaauccccagcaacccugagcgucacccccggcgaaaaagcaaccauaaccugccgcgcaucccaauccguauccuacaugcacugguaccaacaaaaaccaggccaagcaccucgccuucuaaucuacgacgccucgaaucgugcauccggcguacccucaagauucuccggaagcggaagcggcaccgaccacacacuaaccaucuccagccucgaagccgaagacgccgcaaccuacuacugcuuccaaggcucagucuacccauucaccuucggccaaggaacaaaacucgaaauaaaaggugguggcagcggcggcggcggcgagguacaacucgucgaauccggcggcggccuagugcaacccggaggcucacuccgccuaucaugcgccgccagcggauucaccuucagcacauacgcaaugaacuggguccgccaagccccaggcaaaggacuagaauggguagggcgcauccgaagcaaauacaacaacuacgccaccuacuacgcagacuccgucaaaggaagauucacaauaucccgcgacgacucuaaaaauucacuauaccuacaaaugaacucacuuaaaaccgaagacaccgcaguauacuacugcguccgccacggaaacuucggcaauuccuacgucagcugguucgccuacuggggacaaggaacccuaguaacagucuccagcgcaucgacaaaaggagaagucgcagcaugcgaaaaggaaguagcugcacucgaaaaagaagucgccgcccuggaaaaagaagucgccgcccucgaaaaaggaggcggagacaagacgcauaccugcccacccugcccagcccccgaagcggccggcggaccaagcguauuccuguucccacccaaacccaaagacacccuaaugauaucacgcaccccagaaguaaccugcgucguaguagacgugagccacgaagaccccgaaguaaaguucaacugguacgucgauggcguagaaguccacaacgccaaaacaaaacccagagaagaacaauacaacucaaccuaucgagucgucagcguacugaccgugcuacaccaagacuggcuuaacggaaaagaauauaaaugcaaagucucaaacaaagcacuccccgcccccaucgagaaaaccaucagcaaagcaaaaggacagcccagggaaccccaagucuacacacucccaccaucccgagaagaaaugaccaagaaccaagucucacucuggugccuagucaagggcuucuacccuuccgacaucgccgucgaaugggaaagcaacggccaacccgaaaacaacuacaagaccaccccaccgguccucgacucagacggcucauucuuccuauacucaaaacuaaccgucgacaaaucccgcuggcaacaaggaaacguauucucaugcuccguuaugcacgaagcccugcacaaccacuacacccaaaaaucacucucccugucacccggaaaa

SEQ ID NO: 54480 - RNA, 813 nt, Artificial Sequence
  derived and/or modified sequence opt11 from Duvortuxizumab_Chain2_scFv
caagcaguaguaacccaagaacccagccucaccguaagccccggcggaaccguaacccuaaccugccgcucaagcacaggcgcagucaccaccucaaacuacgccaacuggguacaacaaaaaccaggccaagcgcccagaggccucaucggcggaaccaacaaacgagcccccuggacccccgcacgcuucuccggaagccuacucggaggcaaagcagcccucaccaucaccggcgcccaagccgaagacgaagcagacuacuacugcgcccugugguacagcaaccucugggucuucggcggcggaacaaaacuaaccguccucggcggcggcggcagcggaggcggcggacaaguaacccuccgcgaaagcggccccgcacucgucaaacccacccaaacacuaacccuaaccugcaccuucuccggauucucacucuccaccuccggcaugggcguaggcuggaucagacaaccacccggcaaagcccucgaauggcuagcccacaucuggugggacgacgacaaacgauacaaccccgcccuaaaaucacgacucacaaucuccaaagacaccuccaaaaaccaaguauuccuaacaaugaccaacauggaccccguggacacagcaacauacuacugcgcacgcauggaacuauggucauacuacuucgacuacuggggacaaggaaccacaguaacagucucaucagccucaaccaaaggcaaagucgccgccugcaaagaaaaaguagcagcacucaaagaaaaagucgccgcccucaaagaaaaagucgccgcacucaaagaa

SEQ ID NO: 54481 - RNA, 681 nt, Artificial Sequence
  derived and/or modified sequence opt11 from Duvortuxizumab_Chain3_h-CH2-CH3
gacaaaacccacaccugcccccccugcccagcccccgaagcagccggcggcccauccgucuuccucuucccccccaaacccaaagacacucucaugaucagccgcacccccgaagucaccugcgucgucgucgacgucucccacgaagaccccgaagucaaauucaacugguacgucgacggcgucgaaguccauaacgcuaaaaccaaaccacgcgaagaacaauacaacuccacuuaccgagucgucuccguccucaccguccuccaccaagacuggcucaacggcaaagaauacaaaugcaaagucuccaacaaagcccucccagcacccaucgaaaaaaccaucuccaaagcaaaaggccaaccacgcgaaccccaagucuacacccucccccccucccgcgaagaaaugacaaaaaaccaagucucccucuccugcgccgucaaaggcuucuaccccuccgacaucgccgucgaaugggaauccaacggacaacccgaaaacaacuacaaaaccaccccccccguccucgacuccgacggcucauucuuccucgucuccaaacucaccgucgacaaaagccgauggcaacaaggcaacgucuucucaugcuccgucaugcacgaagcccuccacaaccgcuacacacaaaaaucccucucccuaucccccggcaaa

SEQ ID NO: 54482 - RNA, 360 nt, Artificial Sequence
  derived and/or modified sequence opt11 from Efungumab_HeavyChain
auggcggaagugcaauuggucgagagcggggccgaggucaagaaaccgggcgagagcuugcgcauaagcuguaaagggagcgggugcauaaucucgagcuauuggauaagcugggucaggcaaaugcccgggaaagggcucgaguggaugggcaagaucgaucccggggacucguacauaaacuauagcccgagcuuucaagggcacgugaccauaagcgcggacaagagcauaaacacggccuaucuccaguggaauagcuugaaagcgagcgauaccgcgauguauuacugugccaggggcggacgcgauuucggggacucguucgauuacuggggccagggcacgcuagugaccgug

SEQ ID NO: 54483 - RNA, 750 nt, Artificial Sequence
  derived and/or modified sequence opt11 from Efungumab_HeavyChain_LightChain
auggcggaaguccaauuaguagagaguggggcagaggucaagaaaccgggcgagagcuugcgcauaagcuguaaagggagcggaugcauaaucucgagcuauuggauaagcuggguaagacagaugcccgggaaagggcucgaguggaugggcaagauagaccccggggacucguacauaaacuauagcccgagcuuccaaggacacgugaccauaagcgcggacaagagcauaaacacggccuaucuacaguggaauagcuugaaagcgagcgauacagcgauguacuacugugcaagaggcgggcgcgacuucggggacucguucgacuacuggggccagggcacgcucgugaccgugagcucaggcgggggcgggagcgggggcggaggcucgggagggggcgggagcgaugucgugaugacgcaaucgcccucguucuugagcgcguucgugggcgaucgaauaaccauaaccugucgcgcgagcucgggcauaagcagguacuuggccugguaccagcaagcacccgggaaagcacccaagcuccuaaucuaugccgcgagcacacuacaaaccggggucccgagcagauucucaggaucgggcucgggaacggaauuuaccuugaccauaaacucgcuccaacccgaggacuucgccacguacuacugccagcacuugaacucguacccacuaacguucggaggcggaaccaaggucgauaucaagcgcgcggccgcgcucgag

SEQ ID NO: 54484 - RNA, 339 nt, Artificial Sequence
  derived and/or modified sequence opt11 from Efungumab_LightChain
gacgucgucaugacccaaucccccuccuuccucuccgccuucgucggcgaccgcaucaccaucaccugccgcgccuccuccggcaucucccgcuaccucgccugguaccaacaagcccccggcaaagcccccaaacuccucaucuacgccgccuccacccuccaaaccggcguccccucccgcuucuccggcuccggcuccggcaccgaauucacccucaccaucaacucccuccaacccgaagacuucgccaccuacuacugccaacaccucaacuccuacccccucaccuucggcggcggcaccaaagucgacaucaaacgcgccgccgcccucgaa

SEQ ID NO: 54485 - RNA, 1350 nt, Artificial Sequence
  derived and/or modified sequence opt11 from Elezanumab_HeavyChain
gaaguccaacuuguccaauccggugccgaaguuaagaaacccggagcauccguaaaagucuccugcaaagcauccggcuacacauucaccucucacggcaucuccuggguccgccaagccccaggccagggccucgacuggauggguuggauuucccccuacuccggcaauaccaacuacgcccaaaaacuacaaggccgugucaccaugaccaccgacaccuccaccuccacagcauacauggaacucucaucucuccgauccgaagacacagccguauacuacugcgcccgcgucgguucaggccccuacuacuacauggacguauggggacaaggcacacuggucaccguauccucagccaguaccaaaggccccuccgucuucccacucgcccccuccucaaaauccaccuccggcggaaccgcugcccucggcugccucgucaaagacuacuuucccgaacccgucaccgugucauggaacucaggcgccuuaaccuccggcguccacaccuuccccgccguccuccaaucauccggccucuacucccuaucuucugucguaacaguccccucauccucccucggaacacaaaccuacauaugcaaugucaaucacaaacccucaaacacaaaagucgacaagaaaguagaacccaaauccugcgacaaaacacauaccugcccacccugccccgcccccgaagcagccggaggccccucagucuuccuauucccacccaaacccaaagaccaacucaugauaucacgcacccccgaaguaaccugcgucgucguagacguaagccacgaagaccccgaagucaaauucaacugguacgucgacggagucgagguucacaaugcaaaaaccaaaccccgagaggaacaauacaacucuacauaccgagucgucucuguccucaccguccuccaccaagacuggcuuaacggcaaagaauacaaaugcaaagucucuaacaaagcccuccccgcacccaucgagaaaaccauauccaaagccaaaggccaaccccgcgaaccccaagucuacacgcuacccccaucacgagaagaaaugacaaagaaccaagucucccuuaccugccucgucaaaggcuucuaccccagcgacaucgccgucgaaugggaauccaacggccaacccgaaaacaacuacaaaaccaccccucccguucucgacuccgacggcuccuucuuccuauacuccaaacuuacugucgacaaaucccgauggcaacaaggaaacgucuucuccugcagcguauuacacgaagcacuucacaaccacuacacucaaaaaucccucagccucucccccgguaaa

SEQ ID NO: 54486 - RNA, 645 nt, Artificial Sequence
  derived and/or modified sequence opt11 from Elezanumab_LightChain
caauccgcccucacccaaccccgcuccgucuccggcucacccggccaaucaguaaccaucuccugcaccggcaccuccuccuccgucggcgacuccaucuacgucucuugguaccaacaacaccccggcaaagcccccaaacuuaugcucuacgacgucacaaaacgccccucuggcguacccgaccgcuucuccggcuccaaaucaggcaacaccgccucacuuaccaucuccggacuccaagccgaagacgaagccgacuacuacugcuacucauacgccggcaccgacacccuauucggcggcggcaccaaagucaccguccucggccaacccaaagcagcaccuuccgucacccuauucccccccucauccgaagaacuacaagccaauaaagccacccucguaugccucaucuccgacuucuaccccggcgccgucaccguagccuggaaagccgacuccucccccgucaaagccggcgucgaaaccacuacccccuccaaacaaucaaacaacaaauacgcagccuccucauaccucucccucacccccgaacaauggaaaucccaccgcucauacuccugccaagucacacacgaaggcucaacagucgaaaaaacagucgcccccaccgaaugcucc

SEQ ID NO: 54487 - RNA, 1359 nt, Artificial Sequence
  derived and/or modified sequence opt11 from Emapalumab_HeavyChain
gaaguccaacuucucgaauccggaggcggccugguccaaccaggcggcucacuccgacuguccugcgccgccuccggcuucaccuucuccuccuacgccauguccugggucagacaagcccccggcaaaggacucgaaugggucuccgccaucagcggauccggcggaagcaccuacuacgccgacagcguaaagggccguuucaccaucucacgcgacaacuccaaaaauacccucuaccuacaaaugaacucauuacgcgccgaagacacugccguauacuauugcgcaaaagacggcuccucaggcugguacgucccccacugguucgaccccuggggccaaggcacccucgucaccgucucuucagcaucaaccaaaggccccucgguguucccccuagcacccagcagcaaauccaccucuggcggaaccgccgcccuaggcugccucgucaaagacuacuucccagaaccggucacaguauccuggaacucgggagcccuaaccuccggcguccacaccuuccccgcuguacuacagucguccggacuauacucauuauccucugucgucaccguccccucaagcucccucggcacgcaaacauacaucugcaauguaaaucauaaacccuccaacacaaaagucgacaaacgcgucgaacccaaaucaugcgacaaaacccauaccugcccaccaugccccgccccagaacuccuaggcggccccagcgucuuccuauucccacccaaacccaaggauacccuaaugauaucacgcacacccgaaguaaccugcgucgucgucgacgucucucacgaagaccccgaagucaaauucaacugguacgucgacggcgucgaaguccacaacgcaaaaacaaaaccacgcgaagaacaauacaacuccaccuaccgcgucgucuccguccucaccguccuucaccaagacuggcucaacggcaaggaauacaaaugcaaaguauccaacaaagcccuccccgccccaaucgaaaagaccauauccaaagcaaaaggacaaccccgagaaccccaaguauacacccucccucccucacgcgaagaaaugaccaaaaaccaggucucccuaaccugccucgucaaaggcuucuaccccucagacauagccgucgaaugggaauccaacggccaacccgaaaacaacuacaaaaccaccccacccguccucgacucagacggcagcuucuuccucuacucaaaacugaccguagacaaaucucgcuggcaacaaggcaacgucuucuccugcuccguaaugcacgaggcccuacacaaccacuauacccaaaaguccuuaucgcuaucccccggaaaa

SEQ ID NO: 54488 - RNA, 651 nt, Artificial Sequence
  derived and/or modified sequence opt11 from Emapalumab_LightChain
aacuucaugcucacacaaccacacuccgucuccgaaucccccggcaaaaccgucaccaucuccugcacccgcuccuccggcuccaucgcauccaacuacguccaaugguaccaacagcgacccggauccucccccaccaccgucaucuacgaagacaaccaacgccccuccggcgucccagacagauucuccggcuccaucgacuccuccuccaacuccgccucccuaaccauauccggccucaaaaccgaagacgaagccgacuauuacugccaauccuacgacggcuccaaccgcuggauguucggcggcggcaccaaacuaaccguccucggacaaccaaaagccgcacccuccgucacccucuucccccccuccucagaagaacuccaagccaacaaagccacccucgucugccucaucucagacuucuaccccggcgcugucaccgucgccuggaaagccgacuccucccccgucaaagccggcgucgaaaccaccacccccucaaaacaauccaacaacaaauacgccgccuccuccuaccucucccuaacccccgaacaauggaaaucccaccgcuccuacuccugccaaguaacccacgaaggauccaccgucgaaaaaaccguagcacccacagaaugcucc

SEQ ID NO: 54489 - RNA, 1341 nt, Artificial Sequence
  derived and/or modified sequence opt11 from Enoblituzumab_HeavyChain
caagucgaauuagucgaauccggcggcggucuaguacaacccggcggcucacuccgccucagcugcgccgccagcggcuuuaccuucacuuccuacuggaugagcuggguacgccaagcccccggcaaaggucucgaacucguuuccuccaucaccuccuacggauccuucaccuacuacgccgacucugucaagggucguuucaccaucucucgagacaacagcaaaaacacacuauaccuccaaaugaacucacuccgcgccgaagacacagccgucuacuauugcgcacgcaacauguacacccacuucgacucauggggccaaggaacccuaguaaccgucucuuccgccucaacaaaaggccccuccguauucccccucgcccccuccucaaaauccacaucaggcggcaccgccgcacucggaugucuugucaaagacuacuuccccgaacccguaaccgucuccuggaacucuggcgcccucacaucaggcguccacaccuuccccgccguccugcaauccuccggccuauacucccuguccuccguagucaccguccccuccuccucccucggaacccaaacauacaucugcaacgucaaccacaaacccaguaacaccaaaguugacaagaaagucgaacccaaauccugcgacaaaacccacacaugcccaccaugccccgcccccgaacuacucggaggucccucaguguuccucuuucccccaaaaccaaaagacacccuuaugaucucccgaacacccgaaguaaccugcgucgucgucgacgucucccacgaagacccugaagucaaauucaacugguacgucgacggcgucgaaguccacaacgccaaaaccaaaccaagagaagaacaauacaacucaaccuaccgaguagucuccguccuaaccguucuccaccaagacuggcucaacgguaaagaauacaaaugcaaagucagcaacaaagcccuccccgcacccaucgaaaagaccaucuccaaagccaaaggccaaccccgcgaaccccaaguauacacccucccaccaucucgcgacgaacucaccaaaaaccaagucucccuaacaugccuagucaaaggcuucuaccccagcgacaucgccgucgaaugggaaagcaacggccaacccgaaaacaacuacaaaaccacaccacccguccucgacucugacggcagcuucuuccuauacuccaaacucacagucgacaaaucccgauggcaacaaggaaacguauucuccuguucagucaugcacgaagcccuccacaaccacuacacccaaaaaucccucucccuaucccccggcaaa

SEQ ID NO: 54490 - RNA, 648 nt, Artificial Sequence
  derived and/or modified sequence opt11 from Enoblituzumab_LightChain
gacaucguacuaacccaaccacccuccgucuccggagcccccggccaacgcgucaccauauccugcuccggauccuccuccaacaucggcuccaacucagucuccugguaccaacaacucccaggaaccgcccccaaacuccucaucuacgacaacuccaaacgcccauccggcguccccgaccgcuucuccggcucaaaaucuggcaccucagccucccuagcaaucaccggccuacaauccgaagacgaagccgacuacuacugccaaucccgagacaccuacggcuacuacugggucuucggcggcggcaccaaacucaccguccuaggacaaccaaaagccgcccccuccguaacccuauucccccccucauccgaagaacuacaagccaacaaagccacccucgucugccucaucuccgacuucuacccaggcgccgucaccgucgccuggaaaggcgacuccucccccgucaaagccggugucgaaaccaccacccccuccaaacaaucaaacaacaaauacgccgcauccuccuaccucucucucacccccgaacaauggaaaucacaccgcuccuacuccugccaagucacccacgaaggcuccaccgucgaaaaaaccguagcccccaccgaaugcucc

SEQ ID NO: 54491 - RNA, 1323 nt, Artificial Sequence
  derived and/or modified sequence opt11 from Eptinezumab_HeavyChain
gaaguccaacuugucgaauccggcggcgggcucguccaacccggcggcucccuccgccucuccugcgccgucagcggaaucgaccuaucaggauacuacaugaacuggguccgccaagcccccggcaaaggccucgagugggucggcgucaucggaaucaacggcgcaaccuauuacgccuccugggcaaaaggccgauucaccaucucccgcgacaacucaaaaacaacugucuaccuacaaaugaacucacuacgcgcugaagacaccgcagucuacuucugcgcgcgcggagacaucuggggccaaggcacccucguaacagucuccucagccucaaccaaaggaccaucaguauucccauuagccccuuccucaaaauccacauccggcggcaccgccgcacuaggaugccucguuaaagacuacuucccagagcccguaacggucucauggaacagcggcgcccucaccagcggaguccacaccuuccccgccguccuccaauccucaggacucuacucccuauccuccguaguaaccguacccuccagcagccucggcacccaaaccuauaucugcaacgucaaccacaaaccauccaacacuaaaguggacgcccgcguagaacccaaaucuugcgacaaaacccacacaugcccgcccugcccugcaccagaacuccuaggagguccauccguaacccuauucccacccaagcccaaagacacccuaaugaucagccguacccccgaagucacaugcguuguagucgacgucucccacgaggaccccgaaguaaaauucaacugguacguagacggaguagaaguccacaacgccaaaaccaaaccaagagaagaacaauaugccuccaccuaccgcgucgucuccguccucaccguccugcaccaagacuggcugaacggcaaagaauacaaaugcaaagucuccaacaaagcucuccccgcacccauagagaaaacaaucucaaaagccaaaggccagccacgugaaccccaagucuacacccuucccccaucccgcgaagaaaugaccaaaaaccaagucucucuuaccugccucguaaaaggcuucuaccccuccgacaucgccguggaaugggaauccaacggccaaccggaaaacaacuacaaaaccaccccacccguacuagacuccgacggcuccuucuuccucuacuccaaguuaaccguagacaaaagccgauggcagcagggcaacguauucucaugcuccguaaugcacgaagcccuccacaaccacuacacucaaaaaucacuaucccuaucacccggaaaa

SEQ ID NO: 54492 - RNA, 657 nt, Artificial Sequence
  derived and/or modified sequence opt11 from Eptinezumab_LightChain
caaguccucacccaaucccccuccucccucucugccuccgucggcgaccgcgucaccaucaacugccaagccucccaauccgucuaccacaacaccuaccucgccugguaccaacaaaaacccggcaaaguccccaaacaacuaaucuacgacgccuccacccucgccuccggcguccccucccgcuucuccggauccggcucaggcaccgacuucacacuaaccaucuccucacuccaacccgaagacgucgccaccuacuacugccucggcucauacgacugcaccaacggcgacugcuucgucuucggcggcggcaccaaaguagaaaucaaacgaaccgucgccgcccccuccgucuucaucuucccccccuccgacgaacaacuaaaguccggcacagccuccgucgucugccuacucaacaacuucuacccccgcgaagccaaaguccaauggaaagucgacaacgcccuccaaucaggcaacucccaagaaucugucaccgaacaagacuccaaagacucaaccuacucccucuccucaacccucacccucuccaaagccgacuacgaaaaacacaaagucuacgccugcgaaguaacccaccaaggccucucuucccccguuacaaaauccuucaaccgaggcgaaugc

SEQ ID NO: 54493 - RNA, 1368 nt, Artificial Sequence
  derived and/or modified sequence opt11 from Erenumab_HeavyChain
caaguccaacucgucgaauccggcggaggcgucguccaacccggccgcucacuccgucucuccugcgcagccuccggcuucacauucucaucauucggcaugcacuggguccgccaagcccccggcaagggacuagaaugggucgcagucaucuccuuugacggcucaaucaaauacagcguagauuccgucaaaggccgauucaccaucucacgcgacaacuccaaaaauacacuuuuccugcaaaugaacucacuccgcgccgaagacaccgccguauacuacugcgcccgagaccgccucaacuacuacgacuccucaggauauuaccacuacaaauacuacggcauggccgucuggggccaaggaaccaccguaacugucuccuccgccuccaccaaaggacccuccgucuuuccccucgcucccugcucccgcucaaccucggaauccacagccgcccuaggcugccucgucaaagauuacuuucccgaaccagucaccgucagcuggaacucuggcgcacuaaccuccgggguccauacuuuccccgcaguccuccaaucauccggccucuauucccucuccuccgucguaaccguccccucuuccaacuucggcacccaaaccuacacgugcaacguugaccacaaacccuccaacaccaaagucgacaagaccgucgaacgcaaaugcugcgucgaaugcccacccugccccgccccacccgucgccggaccuagcguauuccucuucccgcccaaacccaaagacacucucaugaucucacgcacccccgaagugaccugcgucgucguagacguuagccaugaagaccccgaaguccaguucaacugguacgucgacggcgucgaaguacacaacgcaaaaaccaaaccccgcgaagaacaauucaauucaacauuccgcgucgucucuguccucaccgucguccaccaagacuggcucaacggcaaagaauacaagugcaaagucagcaacaaaggacuacccgcuccaaucgaaaagaccauaagcaaaaccaaaggccaacccagagaaccgcaaguauacacccuaccacccucacgcgaggaaaugaccaaaaaccaaguaucccuaaccugccucguaaaaggcuucuaucccuccgacauagcagucgaaugggaauccaacggccaacccgaaaacaacuauaaaaccacuccucccaugcucgacucagacggauccuucuuccucuacucaaaacucacaguagacaagucccgauggcaacaaggcaacgucuucuccugcucaguaaugcacgaggcccuccacaaccacuacacacaaaaaucccucucccuaucccccggcaaa

SEQ ID NO: 54494 - RNA, 648 nt, Artificial Sequence
  derived and/or modified sequence opt11 from Erenumab_LightChain
caguccguccucacccaaccccccuccgucuccgccgcccccggccaaaaagucacaaucuccugcuccggcuccuccuccaacaucggcaacaacuacgucuccugguaccaacaacucccuggcaccgcccccaaacuacucaucuacgacaacaacaaacgccccuccggcauccccgaccgcuucuccggcucaaaauccggcaccuccaccacccuaggcaucaccggccuccaaaccggcgacgaagccgacuacuacugcggcaccugggacucccgccucuccgccguagucuucggcggcggcaccaaacucacaguccucggccaaccaaaagccaaccccaccgucacacuauucccccccuccuccgaagaacuccaagccaacaaagccacccucgucugccucaucucagacuucuaccccggcgcagucacagucgcauggaaagcagacggcucacccgucaaagccggcgucgaaaccaccaaacccuccaaacaauccaacaacaaauacgccgccuccagcuaccucucucucacccccgaacaauggaaaucccaccgcuccuacuccugccaagucacccacgaaggcuccaccgucgaaaaaaccgucgcccccaccgaaugcucc

SEQ ID NO: 54495 - RNA, 1344 nt, Artificial Sequence
  derived and/or modified sequence opt11 from Fremanezumab_HeavyChain
gaaguccaacucguagaauccggcggaggccucguccaacccggcgguucacuccgucucucgugcgccgccucaggcuucaccuucuccaacuacuggaucucuuggguacgacaagcccccggcaaaggccuggaaugggucgcagaaauccgaucagaauccgacgccuccgcaacccacuacgccgaagccgucaagggccgcuuuaccaucucacgcgacaacgcgaaaaacucacuauaccuccaaaugaacucgcuucgagcugaagacaccgcaguguacuacugccucgccuacuucgacuacggacucgcaauacaaaacuacuggggccaagguacccuagucacagucuccuccgccuccacaaaaggacccuccgucuucccccuagcuccaugcucacgcuccacauccgaauccacagcagcacuuggcugccucgucaaagacuacuuccccgaaccagucaccgucagcuggaacuccggagcccuaaccuccggaguccacaccuuccccgcaguacuacaaucauccggacucuauagccucuccucaguagucacaguccccuccagcaacuucgguacucaaaccuauacaugcaacgucgaccacaaaccaagcaacaccaaagucgacaaaaccgucgaacgaaaaugcugcgucgaaugcccucccugccccgccccacccguagcuggacccagcgucuuccuauucccucccaaacccaaagacacgcuaaugaucucacgaacccccgaaguaaccugcgucguagucgacguaucccacgaagacccugaaguccaauucaacugguacguagacggcgucgaaguacacaacgcaaagaccaaaccaagagaagaacaguucaacuccaccuuccgcgucgucuccguccucacagucguccaccaagacuggcucaacggcaaagaauacaagugcaaagucuccaacaaaggccucccuuccuccaucgagaaaacaauaagcaaaaccaaaggccaaccccgcgaaccacaaguguacacccuaccaccaucccgcgaagaaaugaccaaaaaccaagucucccucacaugcuuagucaaaggauucuaccccuccgacaucgcagucgaaugggaauccaacggccaacccgaaaacaacuacaaaacaacaccacccaugcuugacucagacgguagcuuuuuccuuuacucaaaacucaccgucgacaagucccguuggcaacaaggaaacgucuucuccugcuccgucaugcaugaagcacuacacaaccacuacacacagaaaagccucucccucagccccgguaaa

SEQ ID NO: 54496 - RNA, 642 nt, Artificial Sequence
  derived and/or modified sequence opt11 from Fremanezumab_LightChain
gaaaucguccucacccaaucccccgccacccucucccucucccccggcgaacgagcaacccucuccugcaaagccucaaaacgagucaccaccuacguauccugguaccaacaaaaacccgggcaagcuccccgccuccuaaucuacggcgccuccaaccgcuaccucggaauccccgcccgcuucuccggcuccggcuccggcaccgacuucacccucaccaucuccucccucgaacccgaagacuucgccgucuacuacugcucccaauccuacaacuaccccuacaccuucggccaaggcaccaagcucgaaaucaaacgcaccgucgccgccccauccgucuucaucuucccacccucagacgaacaacucaaauccggcaccgccuccgucguaugccuacucaacaacuucuacccccgcgaagccaaaguccaauggaaagucgacaacgcccuccaaagcggcaacucccaagaauccgucaccgaacaagacuccaaagacucaaccuacucccucuccucaacccucacccucuccaaagcagacuacgaaaaacacaaagucuacgccugcgaagucacccaccaaggccuaucaucccccgucaccaaauccuucaaccgcggagaaugc

SEQ ID NO: 54497 - RNA, 1371 nt, Artificial Sequence
  derived and/or modified sequence opt11 from Frunevetmab_HeavyChain
caaguccagcuaguagaguccggagccgagcuaguccaacccggcgaaucccucagacucacaugcgccgcauccggauucucccuaacuaacaacaacguaaacuggguacgccaagcccccggaaaaggccucgaauggaugggaggcgucugggcaggcggcgccaccgacuacaacucagcacucaaaucacgucucaccaucacacgcgacacauccaaaaacaccgucuuccuacaaaugcacucacuccaauccgaagacacagccaccuacuacugcgcccgagacggcggauacuccuccuccacccucuacgccauggacgccuggggacaaggcacuaccgucacagucagcgccgccucuaccacagcacccuccgucuucccccucgcccccuccugcggaaccacaucuggcgccaccgucgcgcucgccugccucguccucggcuacuucccagaaccagucaccgucuccuggaacuccggcgcccuaacauccggcguacacaccuuccccgcaguacuccaagcaucaggccucuacucccucuccuccauggucaccgucccgucaucacgcuggcuauccgacaccuucacgugcaacguagcucacccacccuccaauaccaaagucgauaaaacgguccgcaaaacagaccaucccccaggacccaaacccugcgacugccccaaaugcccuccgcccgaaaugcucgggggccccucaaucuucaucuucccgcccaaacccaaagacacccucucaaucucacgaaccccagaagucacaugccucgucgucgaccugggccccgaugacucagauguccaaaucaccugguucgucgacaacacgcaagucuacaccgccaaaaccucgccccgugaagaacaauucaacuccaccuaccgagucgucuccguccugcccauccuccaccaagacuggcucaaaggaaaagaguucaagugcaaagucaacuccaaaucacuaccaucccccauagaacgcacaaucuccaaagccaaaggccaaccacacgaaccacaaguuuacgugcuaccacccgcccaagaagaacuaucccggaacaaagucucaguaaccugccucauaaagagcuuccacccacccgauaucgccguagaaugggaaaucacaggucaacccgaacccgaaaacaacuaccggaccacaccaccccaacuagacucagacggcaccuacuucguauacucaaaacucuccguagaccgcucacacuggcaacgaggcaacacauacacaugcagcgucucccacgaagcccuacacucccaccacacacaaaaaucccucacccaaucccccggcaag

SEQ ID NO: 54498 - RNA, 651 nt, Artificial Sequence
  derived and/or modified sequence opt11 from Frunevetmab_LightChain
gacaucgaaaugacccaauccccacucucccuauccgucaccccaggcgaauccgucuccauauccugccgagccuccgaagacaucuacaacgcccucgccugguaccuccaaaaacccggccgcucaccccgccuccucaucuacaacaccgacacccuccacacaggcguacccgaccgauucuccggcuccggcuccggcaccgacuucacccucaaaaucucccgcguccaaaccgaagacgucggcgucuacuucugccaacauuacuuccacuacccccgcaccuucggccaaggcaccaaacucgaacucaaacgauccgacgcccaacccuccgucuuccuauuccaacccucccuagacgaacuccacaccggcuccgccuccaucgucugcauacucaacgacuucuaccccaaagaagucaacgucaaauggaaagucgacggcgucguacaaaacaaaggcauccaagaauccaccaccgaacaaaacuccaaagacuccaccuacucccucuccuccacccuaaccauguccuccaccgaauaccaaucccacgaaaaauucuccugcgaagucacccacaaaucccucgccuccacccucgucaaauccuucaaccgcuccgaaugccagcgcgaa

SEQ ID NO: 54499 - RNA, 1341 nt, Artificial Sequence
  derived and/or modified sequence opt11 from Gatipotuzumab_HeavyChain
gaaguccaacucgucgagucaggaggcggacucguccaacccggcggcuccaugcgccucagcugcguagccucugguuuccccuuuuccaacuacuggaugaacuggguacgccaagcccccggcaaaggacucgaaugggucggcgaaauacgccuaaagagcaacaacuacaccacccacuacgccgaauccguuaaaggccgcuucaccaucucccgagacgacagcaagaacucacucuaccugcaaaugaacucacuuaaaacagaagacaccgccgucuacuacugcacccgacacuacuacuucgacuacuggggucaaggcacccucguaacagucucauccgccuccacaaaaggacccuccguauucccccucgcccccuccuccaaaucaacauccggcggaacagcugcccuaggcugccuugucaaagauuacuuccccgaacccgucacgguauccuggaacuccggcgcacucacauccggcguccacaccuuccccgcaguccuacaguccagcggucucuacucccuaagcuccguagucacaguccccucauccucacugggcacacaaacauacaucugcaacgucaaccacaaacccuccaacaccaaggucgacaaaaaggucgaacccaagucaugcgacaaaacccauaccugcccacccugccccgcccccgaacuccuaggcggacccucagucuuccuauucccacccaaacccaaagacacccucaugaucucccgaaccccagaaguaaccugcguaguggucgacguaagccacgaagacccagaagucaaauucaacugguacgucgacggcgucgaaguacacaacgccaagacaaaaccccgcgaggaacaauacaacagcaccuaccgaguagucuccguccucacaguacuacaccaagacuggcuuaacggcaaggaauacaaaugcaaggucuccaacaaagcccuccccgcccccaucgagaaaaccauauccaaagcaaaaggacaacccagagaaccccaagucuacacccugccacccagccgugaugaacucaccaagaaccaaguaucacuaaccugccucgucaagggauuuuaccccuccgacaucgccgucgaaugggaaucaaacggacaacccgaaaacaacuacaaaacaaccccucccguccucgacucggacggcagcuucuuucucuacagcaaacucaccguugacaaaucacguuggcagcaaggcaacgucuucucaugcuccgucaugcacgagggccuccacaaccauuacacccaaaagucccucucccucucacccgguaaa

SEQ ID NO: 54500 - RNA, 657 nt, Artificial Sequence
  derived and/or modified sequence opt11 from Gatipotuzumab_LightChain
gacaucgucaugacccagucaccccucuccaaccccgucacccccggcgaacccgccuccaucuccugccgauccuccaaaucccuccuccacucaaacggcaucaccuacuucuucugguaccuccaaaaacccggccaaucaccccaacuccuaaucuaccaaauguccaaccuagccucaggcguccccgaccgcuucuccggcuccggcuccggcaccgacuucacccuucgcaucuccagagucgaagccgaagacgucggcgucuacuacugcgcccaaaaccucgagcuaccacccaccuucggccaagguaccaaagucgaaaucaaacgcaccgucgcagcccccuccgucuucauauucccacccucagacgaacaacucaaauccggcaccgccuccgucgucugccuccucaacaacuucuacccccgagaagccaaaguccaauggaaagucgacaacgcccuccaauccggcaacucccaagaauccgucaccgaacaagacuccaaagacuccaccuacucccuauccuccacacucacccucuccaaagccgacuacgaaaaacacaaaguauacgccugcgaaguaacccaccaaggccuuuccucccccgucaccaaguccuucaaccguggcgagugc

SEQ ID NO: 54501 - RNA, 1365 nt, Artificial Sequence
  derived and/or modified sequence opt11 from Gedivumab_HeavyChain
gaaguccaacucguagaauccggaggaggcgucguccaaccaggcaaaucccuccgccucucaugcgccgcauccggccucaccuucuccuccuacgcaguccacuggguccgccaagcaccgggcaaaggccucgaauggguaacucuaaucuccuacgacggcgcaaaccaauacuacgcagacucagucaagggacgcuucacaaucucccgugacaacuccaaaaacacugucuaccuccaaaugaacucccuacgcccagaagacacugccgucuacuacugcgccguccccggccccguauucggcaucuucccacccugguccuacuucgacaauuggggucaaggcauccucgucacagucuccuccgcaucaacuaaaggccccuccguauucccccucgcccccuccucgaaaagcaccuccggaggcacagccgcacuaggaugccucgucaaagacuacuuccccgaacccgucaccguauccuggaacuccggagcccucaccucaggcguccauaccuucccagcaguccuccaaucauccggucucuacucccuaagcucugucguaacaguacccuccuccucccuagguacacaaaccuacauaugcaacgucaaccacaaaccauccaacaccaaaguagacaagaaagucgaacccaaauccugugacaaaacccacaccuguccacccugccccgcccccgaacuccucggaggccccuccguauuccucuucccacccaaaccuaaagacacacuaaugaucucccgaaccccagaaguaaccugcgucgucgucgacgucucccacgaagaccccgaagucaaauucaacugguaugucgacggcgucgaaguacauaacgcaaaaaccaaaccgcgcgaagaacaauacaacuccacauaucgcgucgucuccguccuaaccguccuucaccaagacuggcugaacggcaaagaguacaaaugcaaagucagcaacaaagccuuaccagcccccaucgagaaaaccaucuccaaagcuaagggccaaccccgcgaaccccaagucuacacucuaccgcccucgcgagaagaaaugaccaaaaaccaaguaucccuaaccugccucgucaaaggcuucuaccccuccgauaucgcagucgaaugggaauccaacggacagccugaaaacaacuacaaaaccaccccaccaguccucgauuccgacggcagcuucuuccucuacuccaaauuaaccguagacaaaucccgauggcaacaaggcaacguauucuccugcuccgucaugcacgaagcacuccacaaccacuacacccaaaaaucacucucccucucccccggaaag

SEQ ID NO: 54502 - RNA, 648 nt, Artificial Sequence
  derived and/or modified sequence opt11 from Gedivumab_LightChain
gaaaucguccucacccaaucucccgccacccucuccgucucacccggcgaacgcgccacccuauccugccgcgccucccaagucaucucccacaaccucgccugguaccaacaaaaacccggccaagcaccccgccuccuaaucuacggcgccuccacccgcgccuccggaauccccgcccgcuucuccggaucaggcuccggcacagacuacacccucaccaucaccucacuccaauccgaagacuucgccgucuacuacugccaacacuacuccaacuggcccccccgccucaccuucggcggcggcaccaaagucgaaaucaaacguaccgucgcagcccccuccgucuucaucuucccccccuccgacgaacaacucaaauccggaaccgcuuccgucgucugccuccucaacaacuucuacccccgagaagccaaaguccaauggaaagucgacaacgcccuccaauccggaaacucacaagaauccguaaccgaacaagacuccaaagacuccaccuacucccuauccuccacccucacccucuccaaagccgacuacgaaaaacacaaagucuacgccugcgaagucacacaccaaggacuauccucccccgucaccaaaucauucaaccgcggcgaaugc

SEQ ID NO: 54503 - RNA, 1329 nt, Artificial Sequence
  derived and/or modified sequence opt11 from Gemetuzumab_HeavyChain
gagguccaacucgugcaauccggagccgaagucaagaaacccggcuccagcgucaaagucuccugcaaagccucaggauacaccauaaccgacuccaacauccacuggguccgacaagcccccggucaaucccucgaauggaucggauacaucuaccccuacaacggaggaacugauuacaaccaaaaauucaaaaaucgcgccacccuaacaguugacaaccccaccaacaccgccuacauggaacuaucaucccuucgcuccgaagacaccgccuucuacuacugugucaacggcaaccccugguuagccuacuggggccaaggaacccucgucaccgucuccucagcaucaaccaaaggccccuccgucuucccacuagcucccugcucacgaagcaccuccgaauccacagccgcccuuggaugccucgucaaagacuacuuccccgaacccguuaccguaucauggaacuccggcgcauuaaccuccggcguccacaccuucccagcaguccuccaauccucaggccuuuauucccuuucaagcguaguuaccguccccuccagcucacucggaaccaaaaccuacacaugcaacguagaccacaaaccuucaaauacaaaagucgauaaacgagucgaauccaaauacgggcccccaugucccccaugcccggcccccgaguuccucggcggccccuccgucuuccuauucccgcccaaacccaaagacacacuuaugaucucacgcacccccgaaguaacaugcgucgucgucgacgucucccaagaagaccccgaaguccaguucaacugguacgucgacggcgucgaaguucacaacgccaaaacaaaaccccgcgaagaacaauucaacuccaccuaccgcgucguuuccguccucacaguacuccaccaagacuggcucaacggcaaagaauacaaaugcaaagucucaaacaaaggccuccccucauccaucgaaaagaccaucagcaaagccaaaggacaaccccgagaaccacaaguauacacucuuccacccucccaagaagaaaugaccaaaaaccaagucucacucacgugccuugucaaaggcuucuaccccucagauauugccgucgagugggaauccaacggucaacccgaaaacaacuacaaaacaaccccacccguccucgacuccgacggcagcuucuuccucuacucacgacucaccguagacaaaucccgcuggcaagaaggcaacgucuucuccugcucaguaaugcacgaagcccuccacaaccacuacacccaaaaaucccuaucacucucccuuggcaaa

SEQ ID NO: 54504 - RNA, 654 nt, Artificial Sequence
  derived and/or modified sequence opt11 from Gemetuzumab_LightChain
gacauccaacuaacccaaucccccuccacccuauccgccuccgucggcgaccgcguaaccaucaccugccgcgcauccgaaucccuugacaacuacggcauccgcuuccuaacaugguuccaacaaaaacccggcaaagccccaaaacuccuaauguacgcagccucaaaccaaggcuccggaguacccucccgcuucuccggcuccggcucaggcacagaauucacccuaaccaucuccucccuccaacccgacgacuucgccaccuacuacugccaacaaacaaaagaagucccaugguccuucggccaaggcaccaaagucgaagucaaacgcacaguagcagcccccuccgucuucaucuucccucccuccgacgaacaacucaaauccggcaccgccucagucgucugccuacucaacaacuucuacccacgcgaagccaaaguccaauggaaagucgacaacgcccuccaauccggcaacucccaagaauccgucaccgaacaagacuccaaagacuccaccuacucccucuccuccacccucacccucucaaaagccgacuacgaaaaacacaaaguauacgccugcgaagucacccaccaaggccuguccucccccgucaccaaauccuucaaccgaggcgaaugc

SEQ ID NO: 54505 - RNA, 1365 nt, Artificial Sequence
  derived and/or modified sequence opt11 from Gilvetmab_HeavyChain
gaaguccaacucguucaauccggcggagaccuagucaaacccggcggcagcguacgccucuccugcguagcgucaggcuucaacaucaagaacacauacaugcacuggguucggcaagcccccggcaaaggccuccaauggaucggccgcaucgcccccgcaaacgucgauacuaaauaugcccccaaguuccaaggcaaagccaccaucuccgccgacacagccaaaaacacagccuacaugcaacuaaauagccuacgcgcagaagacaccgccgucuacuacugcguccuaaucuacuacgacuacgacggagacaucgacgucuggggccagggcacacucgucacagucucaucagcauccacuaccgcacccuccgucuucccccucgcccccucaugcggcuccaccuccggaucaacagucgcgcucgccugucuuguauccggcuauuuccccgaacccgucaccgucuccuggaacucaggcucguuaaccuccggcguucacaccuucccauccguacuccaauccucaggacucuacucacuaucaucuauggucacagucccaagcucacgcuggcccagcgaaaccuuuaccugcaacgucgcccacccggccucuaaaacaaaagucgauaaacccguccccaagcgcgaaaacggccgcguacccagaccacccgacugccccaaaugccccgccccagaaaugcucggcggccccagcguauucaucuucccacccaaacccaaagacacccuacucaucgcccgcacccccgaagucacaugcgugguagucgcccucgacccagaagacccugaaguccaaaucuccugguucguagacggcaaacaaaugcaaaccgccaaaacacaaccccgcgaagaacaauucgccggaaccuaccgaguaguauccguccuccccauaggccaucaagauuggcuaaaaggcaaacaguucacaugcaaaguaaacaacaaagcccuccccucacccaucgaacgcacaauauccaaggcccguggacaagcccaccaaccauccgucuacguccuaccuccaucacgcgaagaacuauccaaaaacacaguuucacucacaugccuuaucaaggacuucuucccacccgacaucgaugucgaauggcagagcaacggccaacaagaacccgaauccaaauaccgcaccacuccaccccaacuagacgaggacggcucauauuuccuauacuccaagcucucugucgacaagucucgauggcaacgcggcgauaccuucaucugcgccgucaugcacgaagcccuccacaaccacuacacccaagaaucucuaucccacucccccggcaaa

SEQ ID NO: 54506 - RNA, 654 nt, Artificial Sequence
  derived and/or modified sequence opt11 from Gilvetmab_LightChain
gacaucguaaugacccaaacaccccucucccucuccgucucacucggcgaacccgccuccaucuccugccacgccucccaaaacauaaacgucuggcucuccugguaccgccaaaaacccggccaaaucccacaacuccucauauacaaagccucacaccuacacaccggcguccccgaccgcuucuccggcuccggcuccggcaccgacuucacccuccgcaucucccgcguagaagccgacgacgccggcguauacuacugccaacaaggccaauccuggccacucaccuucggccaaggaaccaaagucgaaaucaaacgcaacgacgcccaacccgccgucuaccucuuccaacccucccccgaccaacuccacacaggcuccgccuccgucgucugccuccucaacuccuucuacccaaaagacaucaacgucaaauggaaagucgacggcgucauccaagacaccggcauacaagaauccgucaccgaacaagacuccaaagacucaaccuacucccucuccuccacccuaacaauguccuccaccgaauaccucucacacgaacuauacuccugcgaaaucacccacaaaucccuccccuccacccucaucaaauccuuccaacgcuccgagugccaacgcgucgac

SEQ ID NO: 54507 - RNA, 1344 nt, Artificial Sequence
  derived and/or modified sequence opt11 from Ifabotuzumab_HeavyChain
caaguacaacucguccaaagcggagccgaagucaagaaacccggcgccuccguaaaagucuccugcaaagccuccggcuacacauucaccggcuacuggaugaauuggguccgccaggcccccggacaagggcucgaauggaugggcgacaucuaccccggcucaggcaacaccaacuacgacgaaaaauuccaaggcagagucaccaugacccgagauacgucaaucucaacggccuacauggaacuaagccggcucagaucugacgacaccgccguauacuacugcgcccgaggcggcuacuacgaagacuucgacuccuggggacaaggaaccaccgucaccguuucauccgcaagcaccaaaggccccuccguauucccccucgcccccucgucaaaaagcaccuccggcggcaccgccgcacucggaugccucgucaaagacuacuuccccgaacccguaaccgucuccuggaacuccggcgcccuaaccagcggcguacacaccuuccccgccguccuccaaucuucaggacuguacucccuuuccagcguugucaccguaccaagcagcucccuaggaacucaaaccuacauaugcaacgucaaccacaaaccaagcaacacaaaagucgacaaacgaguagaaccaaaaucaugcgacaaaacacacacaugcccacccugccccgcacccgaacuacucggcggacccucagucuuccucuucccacccaaacccaaagacacccucaugaucagccgaacacccgaagucacaugcgucgucgucgacgugucacacgaagaccccgaaguaaaauucaacugguacgucgacggcgucgaaguccacaacgcaaagaccaagccccgcgaagaacaauacaacagcaccuaccgcgucgucagcguccuuaccgucuuacaccaggacuggcucaacggcaaagaauacaaaugcaaaguguccaacaaagcacuccccgcccccaucgaaaagaccaucuccaaagccaaaggacaaccccgagaaccacaagucuacacccuacccccaagucgagaagaaaugaccaaaaaccaagucucccucacaugccucgucaaaggcuucuaccccucagacaucgcagucgaaugggaauccaacggccagcccgaaaacaacuacaaaaccaccccacccguacucgacagcgacggcuccuucuuccucuacagcaaacucacaguagacaaaagccgcuggcaacagggcaacgucuucuccugcucagucaugcacgaagcacuccacaaucacuacacccaaaaaucccugucucucucccccggcaaa

SEQ ID NO: 54508 - RNA, 642 nt, Artificial Sequence
  derived and/or modified sequence opt11 from Ifabotuzumab_LightChain
gacauccaaaugacccaaucacccuccuuccuaucagccuccguaggcgaccgcgucaccaucaccugccgcgcaucccaaggcaucaucucauaccucgccugguaccaacaaaaacccgaaaaagcccccaaacgccuaaucuacgccgccagcucccuccaauccggcguccccagccgcuucuccggcuccggcucaggcaccgaauucacccucaccaucuccucgcuccaacccgaagacuucgccaccuacuacugcggccaauacgccaacuaccccuacaccuucggccaaggcaccaaacucgaaaucaaacgcaccgucgccgcccccagcguuuucaucuuccccccaucagacgaacaacucaaauccggcaccgccuccgucgucugccuccucaacaacuucuacccccgcgaagccaaaguccaauggaaagucgacaacgcccuccaaagcggcaacucacaagaauccguaaccgaacaagacagcaaagacuccaccuacucacucuccuccacccucacccucuccaaagccgacuacgaaaaacacaaagucuacgccugcgaagucacucaccaaggccuauccucccccgucaccaaauccuucaaccgaggcgaaugc

SEQ ID NO: 54509 - RNA, 1323 nt, Artificial Sequence
  derived and/or modified sequence opt11 from Iratumumab_HeavyChain
caaguacaacuccaacaauggggcgccgguuuacucaaacccagcgaaacccuaucccuaaccugcgccguauacggcggcucauucuccgccuacuacugguccuggauccgccaaccgcccggcaaaggccucgaauggauaggcgacaucaaucacggcggaggcaccaacuacaaccccucccuaaaaucccgaguaacaaucuccguagacaccuccaaaaaccaauucucccuaaaacuaaacuccguaaccgccgccgacacagccgucuauuacugcgccucacucaccgccuauuggggccaaggcucccuagucaccgucucauccgccucaaccaagggccccucagucuucccccucgcccccuccaguaaauccaccucaggcggaacagcagcccuaggcugccucguaaaagacuacuuccccgaacccgucacagucuccuggaacucaggcgcccucacuucaggcguccacaccuuccccgccguacuucaaagcuccggccucuacucacucuccuccgucguaacagucccuuccucuucacuaggcacccagaccuacauaugcaacgucaaccacaaaccuuccaacaccaaagucgacaagaaagucgaacccaaaagcugcgacaaaacccacaccuguccacccugccccgcccccgagcuccuaggcggccccuccgucuuccucuucccacccaaacccaaagacacccucaugaucucacggacccccgaagucacaugcgucguugucgacgucucacacgaagacccagaagucaaauucaacugguacguggauggagucgaaguccacaacgcaaaaaccaagccacgcgaggaacaguacaacucaaccuaccgcgucguuagcguccucacaguacuacaccaagacuggcucaacggcaaagaauacaaaugcaaagucagcaacaaagcacuccccgcccccauagagaaaaccaucucaaaagcaaaaggucaaccccgugaaccccaaguauacacccucccacccucccgcgacgaacuaaccaaaaaucaaguaucccuaaccugccucgucaaaggcuucuaccccucagacaucgccgucgaaugggaauccaacggucaacccgaaaacaauuacaaaacaaccccucccguccuagacuccgacggcucauucuuccucuacuccaaacugacgguagacaaaucccgauggcaacaaggcaacgucuuuagcuguuccguuaugcacgaagcccuucacaaccacacccaaaagucacucucacucucccccggcaaa

SEQ ID NO: 54510 - RNA, 642 nt, Artificial Sequence
  derived and/or modified sequence opt11 from Iratumumab_LightChain
gacauccaaaugacccaaucccccaccucacucuccgccagcgucggcgaccgcgucaccaucaccugccgcgccucccaaggcaucuccuccuggcuaaccugguaccaacaaaaacccgaaaaagcccccaaaucccuaaucuacgccgccagcucccuccaauccggaguccccucacguuucuccggcucaggcuccggcaccgacuucacccucacaaucuccucccuccaacccgaagacuucgcaaccuacuacugccaacaauacgacuccuaccccaucaccuucggccaaggcacccgccucgaaaucaaacgcacagucgccgcccccuccgucuucaucuucccccccucugacgaacaacuaaaauccggcacagccuccgucgucugccuccucaacaacuucuacccccgcgaagcuaaaguccaauggaaagucgacaacgcacuccaauccggcaacucccaagaauccgucaccgaacaagacagcaaagacuccaccuacucacucuccucaacccuaacccucucaaaagccgacuacgaaaaacacaaaguauacgccugcgaagucacccaccaaggccucuccucccccguaaccaaaucuuucaaccgaggcgaaugc

SEQ ID NO: 54511 - RNA, 1344 nt, Artificial Sequence
  derived and/or modified sequence opt11 from Lacnotuzumab_HeavyChain
caaguccaacuacaagaaagcggccccggccucgucaaacccucccagacacuuucccugaccugcacagucuccgacuacuccaucacauccgacuacgccuggaacuggauccgccaauuucccggcaagggccuagaauggaugggauacauaucuuacucugguuccaccuccuacaacccaucgcucaaaucacgcaucacaaucucgcgcgacaccuccaaaaaccaauucucacuccaacucaauucugucaccgcagccgacacugcagucuacuacugcgcaucauucgacuacgcacacgccauggauuacuggggccaaggaacaaccgucaccgucuccucagccuccaccaaaggacccuccguauucccgcuagcccccuccuccaaauccacauccggcggcacagccgcccucggcugccuagucaaagacuauuucccagaacccguaaccgucucauggaacucaggagcccucacuucaggaguccacaccuuccccgcaguucuacaauccuccggacuauauucccucucuuccgucgucacuguccccuccuccucccucggcacccaaacauacaucuguaacgucaaccacaaacccuccaacaccaaagucgacaaacgcguugaaccaaaauccugcgacaaaacccacacaugcccacccugccccgcacccgaacuccucggcggacccuccgucuuucucuucccacccaaacccaaagacacacuaaugauaucaagaacccccgaagucaccugugucgucgucgacguaucacacgaagaccccgaaguaaaauucaacugguacguggacggcgucgaaguacacaacgccaagaccaaaccccgugaagaacaauacaacucuaccuaccgcgucguauccguccucaccguccuccaccaagacuggcuaaacggcaaagaauacaaaugcaaagucucaaacaaggcccucccagcccccaucgaaaagaccaucucaaaagcaaaaggacaaccccgagaaccacaagucuacacacucccacccucccgagaagaaaugacuaaaaaccaagucucccuuaccugccucgucaaaggauucuaccccuccgacauugcugucgaaugggaauccaacggacaacccgaaaacaacuacaaaaccaccccacccguccucgacucugacggauccuucuuccucuacuccaaacucacaguagacaaaucccgcuggcaacaaggcaacgucuucucaugcuccguaaugcacgaagcacuccacaaccacuacacccagaaaucccucucacuaucacccggcaaa

SEQ ID NO: 54512 - RNA, 642 nt, Artificial Sequence
  derived and/or modified sequence opt11 from Lacnotuzumab_LightChain
gacaucguccucacccaaagccccgccuuccuguccgucacccccggcgaaaaagucaccuucacgugccaagcaucccaaagcauaggcaccuccauacacugguaccaacagaaaaccgaccaagcccccaaacuccucaucaaauacgcauccgaauccauauccggcauccccuccagauucucaggcuccggcucaggcaccgacuucacccuaaccaucuccuccgucgaagccgaagacgcagccgauuacuacugccaacaaaucaacucauggcccaccaccuucggaggcggcaccaaacucgaaaucaaacgcaccgucgccgcccccuccgucuucauauucccacccuccgacgaacaacucaaaucaggcaccgccuccgucguaugccuccucaacaacuucuacccacgcgaagccaaaguccaauggaaagucgacaacgcacuccaauccggcaacucccaagaguccguaaccgaacaagacuccaaagacucaaccuacucccucuccuccacccucacccucuccaaagccgacuacgaaaaacacaaaguauacgcaugcgaggucacccaccaaggccucagcucccccgucaccaaauccuucaaccgcggcgaaugc

SEQ ID NO: 54513 - RNA, 1347 nt, Artificial Sequence
  derived and/or modified sequence opt11 from Larcaviximab_HeavyChain
gaaguccaacuccaggaauccggccccgaacuagaaaugccuggagcauccgucaaaauaucaugcaaagcuagcggcuccucauucaccggcuucucaaugaacugggucaaacaauccaacggaaaaucucucgaauggaucggcaacaucgacaccuacuauggcggcacaaccuacaaccaaaaauuuaaaggaaaagcaacccucacagucgacaaaucaucuuccaccgccuacaugcaacuuaaaucccucaccucugaagacuccgccgucuacuacugcgccagaagcgccuacuacggcuccaccuucgccuacuggggccaagguacccucguuaccgucuccgcagccucaaccaaaggcccauccguuuucccccuagcacccuccucuaaaucaaccucuggcggcacagcggcccuuggcugucucgucaaagacuacuuccccgaacccgucacgguauccuggaacucuggagcccucacauccggaguccacaccuuccccgccguacuacaauccuccggccucuacagucuauccuccgucguuaccguccccuccagcucucuaggcacccaaaccuacauaugcaacgucaaccacaaaccuuccaacaccaaaguagacaaacgcgucgaacccaaauccugugacaaaacacacacaugcccacccugcccugcccccgaacuccucggcggccccagcgucuuccucuuucccccaaaacccaaggacacccucaugaucucccgaaccccagaaguaaccugcgucgucgucgacgucucccacgaagacccggaagucaaauucaacugguacgucgacggaguugaagugcacaacgccaaaaccaagccccgugaagaacaauacaacucuaccuaccgaguagucuccguccucaccguccuacaccaagacuggcucaacggcaaagaauacaaaugcaaaguuuccaacaaagcccucccagccccaaucgaaaagaccaucucaaaagccaaaggacagccccgugaaccccaaguauacacucucccucccucccgcgacgaacucaccaaaaaccaagucucccugaccugccucgucaaaggauucuaccccuccgacaucgcaguagaaugggaaucaaacggacaacccgaaaacaacuacaaaaccacaccacccguacucgacucggacggcucguucuuccuauacucaaaacucaccgucgacaaaucacgauggcaacaaggcaacgucuucucuugcagcgucaugcacgaagcccuccacaaccacuacacacaaaaaucacucucccucucccccggcaaa

SEQ ID NO: 54514 - RNA, 642 nt, Artificial Sequence
  derived and/or modified sequence opt11 from Larcaviximab_LightChain
gacauccaaaugacccaaucccccgccucacucucugcaucagucggcgaaaccgucaccaucaccugccgcgccuccgaaaacaucuacucauaccuagccugguaccaacaaaaacaaggaaaaucaccccaacuccucgucuacaacgcaaaaacccucaucgaaggcguccccucccgauucucaggcucaggcuccggcacccaauucucccuaaaaaucaacucccuacaacccgaagacuucggcuccuacuucugccaacaccacuucggcacccccuucaccuucggcuccggaaccgaacucgaaaucaaacgcaccgucgccgcccccuccguauucaucuucccccccuccgacgaacaacucaaauccggcaccgccuccgucgucugccuccucaacaacuucuacccccgcgaagccaaaguccaauggaaagucgacaacgcccuccaauccggcaacucacaagaauccgucaccgaacaagacuccaaagacuccaccuacucccuauccuccacacuaacccuauccaaagccgacuacgaaaaacacaaagucuacgcaugcgaagucacccaccaaggccucuccucccccgucaccaaauccuucaaccgcggcgaaugc

SEQ ID NO: 54515 - RNA, 1338 nt, Artificial Sequence
  derived and/or modified sequence opt11 from Lendalizumab_HeavyChain
caaguacaacucguccaaucaggcgcggaagucaagaaacccggcgccuccgucaaagucucaugcaaagccuccggcuacaccuucaccgauuacuccauggacuggguacgccaagcccccggacaaggccucgaauggaugggagccauacaccucaacacaggauacacaaacuacaaccaaaaauucaaaggccgcgucaccaugacccgagacaccuccaccucaaccgucuauauggaacuaagcucacuacgcucagaagacacagccgucuacuacugcgcccgcggcuucuacgacgguuauucccccauggacuacuggggccaaggcaccaccguaacggucuccuccgccuccaccaaaggucccuccgucuucccacuagcaccaugcucccgcuccaccuccgaaagcaccgccgcccuaggaugccuagucaaagacuacuuccccgagccagucaccgucuccuggaacuccggcgcacucaccuccggcguacacaccuucccagccguacuccaguccucaggacucuacucccucuccuccgucguaaccguacccucauccaacuucggcacccaaaccuauacaugcaacgucgaccacaaaccgucuaacacaaaagucgacaagaccguagaacgaaaaugcugcguagagugcccucccugcccagccccaccagucgccggccccagcgucuuccucuucccacccaagcccaaagacacacucaugaucucucgcacacccgaaguaaccugcgucgucgucgacgucucccaagaagacccugagguacaauucaacugguacgucgacggcguagaaguccacaacgccaaaacuaaacccagagaagaacaauucaacuccaccuacagagucgucuccguacucacaguccuacaccaagauuggcucaacggcaaagaauacaaaugcaaggucuccaacaaaggccucccauccaguauagagaaaacaaucagcaaagccaaaggacaaccacgcgaaccccaagucuacacccuacccccaucacaagaagaaaugaccaaaaaccaaguuucccuaacuugccucgucaaaggauucuacccauccgacaucgccgucgaaugggaauccaacggccaacccgaaaacaacuacaagaccaccccuccuguauuagacuccgacggaucauucuuccucuacucacgccuaacagucgacaaaucacguuggcaggaaggcaaugucuucucuugcuccgucaugcacgaagcccuccacaaccacuacacccaaaaaucccucucccucucgcuaggcaaa

SEQ ID NO: 54516 - RNA, 654 nt, Artificial Sequence
  derived and/or modified sequence opt11 from Lendalizumab_LightChain
gauauccagaugacgcaaucgcccagcucauugagcgcgagugugggcgaccguguaaccauaaccugucgagcgagcgagagcguggacucguacgggaacucguucaugcacugguaccagcaaaagccugguaaagcgcccaagcuauugaucuaucgcgcgagcaaucucgagagcggggucccgagcagauucucgggaucgggcucgggcacagacuucacccugaccauuagcucacuccagcccgaagacuuugccacguacuacugccagcaaucgaacgaggacccguacacauucggaggcgggaccaaggucgagauaaagcgcacggucgcggccccaagcguguucauauucccgcccucggacgagcaacugaaaucaggcacggccucggucguaugccugcucaacaacuuuuacccgcgcgaggccaagguccaguggaaggucgauaacgcgcuccagagcgggaacucgcaagagagcgugaccgagcaagauagcaaggacucgaccuacagccugagcucgacccugaccuugagcaaggccgacuacgagaaacauaaaguguacgcaugcgaggucacgcaccaaggauugagcucacccgugaccaagagcuuuaacaggggagaaugc

SEQ ID NO: 54517 - RNA, 1359 nt, Artificial Sequence
  derived and/or modified sequence opt11 from Lesofavumab_HeavyChain
gaaguccaacucguccaauccggcgccgaagucaagaaacccggcgaaucccuaaaaaucagcugcaaagucucaggcuacuccuucaccagccaauggaucggauggguccgacaaaugccaggcaaaggccucgaauggaucgguaugauguacccaggcgaauccgaaaccauauacucccccuccuuccaaggccaaguaacaaucuccgcagacaacuccaucuccaccgccuaccuccaaugguccucgcuaaaagcauccgacacggccauauacuacugcgccuccggccccggauacuccggcuaucacuacggcugguucgacaccuggggccaaggaacccucgucacagucaguuccgcauccaccaaagggccuuccguauucccccucgcccccuccuccaaauccacauccgguggcacagcugcacuagguugccucguuaaagacuacuuccccgaacccguaacagucuccuggaacuccggcgcccucaccucaggaguccauacuuuccccgcaguacuccaauccuccggacucuacucacucucaagcgucgucaccguccccuccucaucccucggcacccaaaccuacaucugcaacgucaaccacaaaccauccaacacuaaagucgacaagaaagucgaaccaaaaucgugcgacaaaacccacacaugcccucccugccccgcccccgagcuccucggcggacccucugucuuccucuuuccacccaaaccaaaagacacacucaugaucucccggacacccgaaguaaccugcgucguagucgacguaucacacgaagaccccgaagucaaauucaacugguacguagacggcgucgaaguacacaacgccaaaacaaaaccccgcgaagaacaauauaacucaaccuaccgaguagucagcguccuaaccguacuccaccaagacuggcucaacggcaaagaauacaaaugcaaagucuccaacaaagcacucccagccccuauugagaaaacaaucuccaaagccaaaggccaacccagggaaccccaagucuacacccucccaccaagcagagaagaaaugaccaaaaaccaaguaucccuaaccugccuagucaaaggcuuuuaccccucugacaucgcagucgaaugggaaucaaacggucaacccgaaaacaacuacaaaaccaccccacccguacucgacucagacggcuccuucuuccuauacuccaaacucacuguagacaaaucccgcuggcaacaaggaaacgucuucuccugcagcguaaugcaugaagcccuacacaaccacuacacucagaaaucccucagccucucccccggcaaa

SEQ ID NO: 54518 - RNA, 657 nt, Artificial Sequence
  derived and/or modified sequence opt11 from Lesofavumab_LightChain
gacaucgucaugacccaaagcccccucucacuccccguaacccccggcgaacccgccucaaucucaugccgcuccucccaaucacuccuccgcuccaacggcuacaacuaccucgacugguaccuccaaaaacccggccaaucaccccaacuccucaucuaccucggcuccaaccgcgccuccggagucccagaccgauucuccggcuccggcuccggcaccgacuucacccucaaaauaucccgcgucgaagccgaagacgucggcgucuacuacugcaugcaagcccuacaaaccccauacaccuucggccaaggcaccaaacucgaaaucaaacgaaccgucgccgcccccuccgucuucaucuucccucccuccgacgaacaacucaaauccggcaccgccuccguagucugccuccucaacaacuucuacccccgcgaggccaaaguacaauggaaagucgacaacgcccuccaauccggaaacucacaagaaucagucaccgaacaagacuccaaggacucaaccuacucccucuccuccacccuaacccucucaaaagccgacuacgaaaaacacaaagucuacgccugugaagucacacaccaaggccucuccucccccgucacuaaauccuucaaccgcggcgaaugc

SEQ ID NO: 54519 - RNA, 1059 nt, Artificial Sequence
  derived and/or modified sequence opt11 from Letolizumab_HeavyChain
gaaguucaacuacucgaauccggcggcggccuaguacaacccggcggcucccugcgccucuccugcgccgccuccggcuucacauucaacugggaacucaugggcugggcccgccaagcccccggaaaaggacucgaaugggucagcggaaucgaaggccccggugacgucaccuacuacgccgacuccgucaaaggucgauucaccaucucccgcgacaacuccaaaaacacccuauaccuccaaaugaacucacuccgugcagaagacaccgccgucuacuacugcgucaaagucggaaaagacgccaaauccgacuaccgcggccaaggcacccucgucaccguuuccuccgccucaaccgaacccaaaagcuccgauaaaacacacacauccccacccucccccgcccccgaacugcuuggcggcucauccgucuuccuauucccacccaaacccaaagacacccucaugauaagccgcacccccgaggucacaugcguagucguagacgucucccacgaagaccccgaagucaaauucaacugguacgucgacggcguagaaguccacaaugcuaaaaccaagccccgcgaagaacaauacaacucaacauaccgcguaguauccguccuaaccguccuccaccaagacuggcucaacggaaaagaauacaaguguaaagucuccaauaaagcccuccccgcacccauagagaaaacuaucuccaaagcaaagggccaaccccgagaaccccaagucuacacccucccacccucccgcgacgaacucaccaaaaaccaagucucacucacaugccucguaaaaggauucuacccauccgacaucgccgucgaaugggaguccaacggacaacccgaaaacaacuacaaaacaaccccacccguccucgacuccgacggcagcuucuuccuauacucaaaacucaccguggacaaaagccgauggcaacaaggcaacgucuucuccugcucagucaugcacgaagcccuacauaaccacuacacacaaaaaucccuaucacucucacccggcaaa

SEQ ID NO: 54520 - RNA, 1338 nt, Artificial Sequence
  derived and/or modified sequence opt11 from Losatuxizumab_HeavyChain
gaaguccaacuacaagaauccggacccgggcucgucaaacccagccaaacccucucccucaccuguaccguauccggauacagcauaucccgagacuucgccuggaacuggaucagacaaccacccggcaaaggccucgaauggaugggcuacaucagcuacaacggcaacacccgauaccaacccucccucaaaucccgcaucaccaucucgcgcgacaccuccaaaaaccaauucuuccucaaacuaaacuccguaacagccgccgacaccgccaccuacuacugcguuaccgccucccgcggcuuccccuacuggggccaaggcacccuaguaaccguaucaucagcaucuaccaaaggcccauccgucuucccccucgcacccuccuccaaauccaccucaggcggcaccgccgcccuaggcugccucguaaaagacuacuuccccgaacccgucaccgucuccuggaacucaggcgcccucacauccggcguccacaccuuccccgccguacuccaaucaagcggacucuauucccuuuccucaguaguaacaguccccuccucuucacucggaacccaaaccuacaucugcaacgucaaccacaaaccauccaacacaaaaguagacaagaaagucgaacccaaauccugcgacaaaacccauaccugcccaccgugccccgcccccgaacuacugggcggcccauccgucuuccuauucccacccaaacccaaagacacccucaugauaucucgcacaccugaagucacuugcgucgucguagacgucucccacgaagaccccgaaguaaaauucaacugguacgucgacggcgucgaaguccacaacgccaaaacaaaaccccgcgaagaacaauacaacucaaccuacagagucguaucaguccuaaccguucuccaccaagacuggcuuaacgggaaagaauacaaauguaaggucucuaacaaagcccuaccagcaccaaucgagaaaaccaucuccaaagccaaaggccaaccccgagaaccccaagucuacacccuaccacccucacgcgaagaaaugaccaaaaaccaagucucccuaaccugccuagucaaaggcuucuacccauccgacauugccguagaaugggaaucaaacggacaacccgaaaacaacuacaaaacaaccccaccaguccuagacucagacggcuccuucuuccuauacuccaaacucaccguggacaagucccgcuggcaacaaggcaacgucuucucgugcagcgucaugcaugaagcucuccacaaccacuacacccaaaaaucccuaucacucucccccggcaaa

SEQ ID NO: 54521 - RNA, 642 nt, Artificial Sequence
  derived and/or modified sequence opt11 from Losatuxizumab_LightChain
gacauccaaaugacucaaucacccuccuccauguccgucuccgucggcgaccgaguaaccaucacuugccacuccucccaagacaucaacucaaacaucggcuggcuccaacaaaaacccggcaaauccuucaaaggccucaucuaccacggcaccaaccucgacgacggcguccccucccgauucucaggauccggcuccggcaccgacuacacccucaccaucuccucacuccaacccgaagacuucgccaccuacuacugcguccaauacgcccaauucccauggaccuucggaggcggcaccaaacuagaaaucaaacgcaccgucgccgcacccuccguauucaucuucccacccuccgacgaacaacuaaaauccggcacagccuccgucgucugccuccucaacaacuucuacccccgcgaggccaaaguccaauggaaagucgacaacgcccuccaaucuggcaacucccaagaauccgucaccgaacaagacagcaaagacuccaccuacucccucucuuccacccucacccucuccaaagccgacuacgaaaaacacaaagucuacgcaugcgaagucacccaccaaggccucuccucccccgucaccaaauccuucaaccgcggcgaaugc

SEQ ID NO: 54522 - RNA, 1338 nt, Artificial Sequence
  derived and/or modified sequence opt11 from Lupartumab_HeavyChain
gaaguccagcuccucgaauccggcggcggacucguccaaccaggcggcucccuccgccuuuccugcgccgccucagguuucaccuucuccaacgcuuggauguccuggguccgacaagcgcccggcaaaggccucgaaugggucucauacaucucauccucaggcuccaccauauacuacgcagacucagucaaaggccgcuucacaaucucucgugacaacuccaaaaacacacucuaccuacaaaugaacucacuacgcgccgaggacacagccgucuacuacugcgcccgcgaaggccuaugggccuucgauuacuggggacaaggcacccucgucaccgucagcuccgcauccaccaaaggcccaucagucuucccccucgcucccucauccaaauccaccaguggaggaaccgccgcccucggaugccuagucaaagacuacuuuccagaacccgucaccgucagcuggaauagcggcgcccucacuuccggaguccacaccuuccccgccguccuccaauccucaggucucuacucccucuccuccgucgucaccguccccuccagcucacuuggaacccaaaccuacaucugcaacgucaaccacaagccauccaacacaaaagucgacaagaaggucgaacccaaauccugcgacaaaacccacacuugcccacccugccccgcccccgaacuacucggaggacccuccguauuccucuucccacccaaacccaaagacacucucaugaucucccguaccccagaaguuacaugcguagucgucgacgucucccacgaagaucccgaagucaaauucaacugguacgucgacggcgucgaaguccacaacgccaagaccaagccccgcgaagaacaauacaacagcaccuaccgugucgucucaguacuaaccguccuacaccaagacuggcuuaacggcaaagaauacaaaugcaaagucuccaacaaagcccucccagcccccaucgagaaaaccaucucaaaagccaaaggccagccccgcgaaccccaagucuacacccuaccuccaucccgugacgaacuuaccaaaaaccaagucucacuaaccugccucgucaaaggcuucuacccgucagacaucgcagucgaaugggaauccaacggucaaccagaaaacaacuacaaaaccaccccuccaguccucgacuccgacggcucuuucuuucucuacuccaaacucacagucgauaaaucccgcuggcagcaagguaacgucuucuccugcuccgucaugcacgaagcccuucacaaccacuacacccaaaaaucccuaucccucucucccgga

SEQ ID NO: 54523 - RNA, 651 nt, Artificial Sequence
  derived and/or modified sequence opt11 from Lupartumab_LightChain
gaaucaguccucacccaaccccccuccgucuccggcgcccccggccaacgcgucaccaucuccugcaccggcuccuccucaaacaucggcgccggcuacgucguccacugguaccaacaacuccccggcaccgcccccaaacuccucaucuacgacaacaacaaacgacccuccggcguccccgaccgcuucuccggcucaaaauccggcaccuccgccuccuuagccaucucaggccuccgcuccgaagacgaagccgacuacuacugcgccgccugggacgaccgccucaacggcccuguauucggcggcggcaccaaacucaccguccucggccaacccaaagccgcccccuccguaacccucuucccccccuccuccgaagaacuccaagccaacaaagccacccucgucugccucaucuccgacuuuuaccccggagccgucaccgucgccuggaaagcagacucaucccccgucaaagcaggcgucgaaaccaccacacccuccaaacaauccaacaacaaauacgccgccuccuccuaccuaucccucacccccgaacaauggaaaucccaccgauccuacuccugccaagucacccacgaaggcuccacagucgaaaaaacagucgcccccaccgaaugcucc

SEQ ID NO: 54524 - RNA, 1731 nt, Artificial Sequence
  derived and/or modified sequence opt11 from Lutikizumab_HeavyChain
gaaguacaacucguugaguccgguggaggcgucguccaaccaggccgcucucuaagacuguccugcagcgccuccggcuucaucuucucacgauacgacaugagcuggguacgacaagccccaggcaaaggccuagagugggucgccuacaucagccacggaggcgccgggaccuacuacccagacucagucaaaggucguuucacaauaucccgcgacaacuccaaaaacacacuauuccuucaaauggacucccuccgcccagaagacaccggagucuauuucugcgcacgcgggggcgucaccaaaggcuauuucgacguguggggccagggcacaccugucacaguaagcuccgccuccacaaaaggaccgcagguacaacucgucgaauccgguggcggcgucguccaaccaggcagaucacuacgccucuccugcacagccagcggcuucaccuucucaauguucggcguacacuggguccgacaggccccaggcaaaggccuagaaugggucgccgcagucuccuacgacggcucaaacaaauacuacgcagaguccgucaaaggccgcuucacgauauccagagauaacagcaaaaacauccuauuccuccaaauggacuccuuacgacuagaggacacagcagucuacuacugcgcccgaggccgccccaaaguagucauaccugcaccccuagcccacuggggccagggcacccuagucaccuucuccuccgccucaaccaaaggaccauccgucuucccucuagcccccuccucaaaauccaccucaggcggcacugccgcacuaggcugccuagucaaagacuacuuccccgaacccguaaccguauccuggaacagcggcgcccuaacaucgggcguccacaccuuccccgcaguucuccaauccuccggacucuacagccuguccagcguggucaccguccccuccuccagccuuggcacccagacauauaucugcaacguaaaucacaaaccuuccaacaccaaaguagacaagaaagucgaaccaaaaucaugcgacaaaacccauacgugcccacccugcccagcccccgaggcugcaggaggaccgucagucuuccucuucccacccaaacccaaggacacacuaaugauuucacgcacacccgaagucacaugcgucgucgucgacgucucccaugaagaccccgaagucaaauucaacugguacgucgacggaguagaaguccacaacgccaaaaccaaaccccgcgaggaacaauacaacucgaccuaccgcgucgugucaguacugacaguccuacaccaagacuggcuuaacggcaaagaguacaaaugcaaggucagcaacaaagcccuccccgcucccaucgagaaaaccaucuccaaagccaagggccaaccacgcgaaccccagguauacacccucccacccucccgcgaagaaaugaccaaaaaccaaguaucccucacaugccucgucaaaggauucuaccccucggacauagcaguagaaugggaauccaacggccaacccgaaaauaacuacaaaacgacgccacccguccuagacuccgacggcagcuucuuucuuuacuccaaacuaaccguagacaaaucacgcuggcaacaaggcaacguauucagcugcucagucaugcacgaggcucugcacaaccacuacacccaaaaaucccuaucccucucccccggcaaa

SEQ ID NO: 54525 - RNA, 981 nt, Artificial Sequence
  derived and/or modified sequence opt11 from Lutikizumab_LightChain
gacauccaaaugacccaaucccccuccucccuauccgccucagucggugaccgaguaaccaucacaugccgcgcaucuggcaacauccacaacuaccucaccugguaccaacaaacccccggcaaagcccccaaacuccucaucuacaacgccaaaacccuagccgacggcguccccucacgcuucucaggcucaggcucaggcaccgacuacaccuucacaauauccucgcuccaacccgaagacaucgccaccuacuacugccaacacuucuggagcaucccuuacacauucggccaaggcacaaaacuccaaaucacucgcaccguugcagcccccgacauccaaaugacccaauccccauccuccgucucagccuccgucggagaccgcgucaccauaaccugccgcgccucccaaggcaucucaucauggcucgccugguaccaacaaaaacccggcaaagcccccaaacuuuuaaucuacgaagccuccaaccucgaaacaggcguccccucccgcuucuccggcuccggcuccggcuccgacuucacccucaccauauccucacuccaacccgaagacuucgccaccuacuacugccaacaaaccuccuccuuccuccucuccuucggcggcggcacuaaagucgaacacaaacgcaccgucgccgcccccuccgucuucaucuuucccccaucggacgaacaacucaaauccggcaccgccagcgucgucugccuccuaaacaacuucuacccucgcgaagccaagguccaguggaaagucgacaacgcccuccaauccggcaacagccaagaauccgucacugaacaagacuccaaagacucuaccuacucacucuccucaacccucacacuauccaaagccgacuacgaaaaacacaaagucuacgcuugcgaagucacacaccaaggccucucaucaccagucaccaaaucauucaaccguggcgaaugc

SEQ ID NO: 54526 - RNA, 1341 nt, Artificial Sequence
  derived and/or modified sequence opt11 from Oleclumab_HeavyChain
gaaguacaacuccucgagucaggaggcggucuaguccaacccggaggcucccuccgccucuccugcgccgccuccggauucaccuucuccuccuacgccuacuccuggguacgacaagccccaggcaaaggccucgaaugggucucagccaucucaggcucagggggccgcaccuacuacgcagacucaguuaaaggccgcuucacaaucuccagagacaacuccaaaaacacccuguaccuucaaaugaacucacuccgcgccgaagacaccgccgucuacuacugcgcacgucuaggcuacggccgaguagacgaauggggccgcggcacccuugucacagucuccucagcaucaaccaaaggacccuccgucuucccccucgcccccucaagcaaauccaccuccggcggcaccgccgcccucggaugccucgucaaagacuacuuccccgaaccagucacaguaucauggaacuccggcgcacucacauccggcguccacacauuccccgcuguacuacaauccucuggccucuacucccucucaucagucgucaccguccccuccuccucacucggaacccaaaccuacauaugcaacguaaaccacaaaccuucaaacaccaaagucgacaaaagagucgagcccaaaucuugcgacaaaacacacacaugcccaccaugcccggcccccgaguucgaaggaggccccuccguauuccucuucccacccaaaccuaaagacacccuaaugaucucccgcaccccagaaguaaccugcgucgucgucgacgucagccacgaagacccagaaguaaaauucaauugguacguagacggcgucgaaguccacaacgccaaaaccaaaccacgagaagaacaauacaacucaacauaccgcguagucuccguccuaacuguguuacaucaagacuggcucaacggcaaagaauacaaaugcaaaguaucaaacaaagcgcuccccgccuccaucgagaaaaccaucuccaaagccaaaggccaaccccgagaaccccaagucuauacccuaccacccucccgcgaagaaaugaccaaaaaccaagucucccucacaugccucgucaaaggcuucuaccccucugacauagcuguugaaugggaaagcaacggacaacccgaaaacaacuauaaaaccacacccccaguccucgacucggacggauccuucuuccuauacucaaaacucaccgucgacaaaucacgcuggcaacaaggcaacguauucuccugcuccgucaugcaugaagcccuccacaaccacuacacccaaaagagccucucacucuccccaggcaaa

SEQ ID NO: 54527 - RNA, 648 nt, Artificial Sequence
  derived and/or modified sequence opt11 from Oleclumab_LightChain
caauccguccucacacaaccacccuccgccuccggcacacccggccaacgcgucacaaucuccuguuccggcucccucuccaacaucggccgcaacccagucaacugguaccaacaacuccccggcaccgcccccaaacuccuaaucuaccucgacaaccuccgccucuccggcguccccgaccgcuucucaggcuccaaauccggcaccucagccucccucgccaucuccggccuccaauccgaagacgaagccgacuacuacugcgccacaugggacgacucccaccccggcuggaccuucggcggcggcaccaaacucaccguccuaggacaacccaaagccgcccccagcguaacccuauucccacccuccucagaagaacuccaagccaacaaagccacacucgucugccucaucuccgacuucuaccccggcgccgucacagucgccuggaaagccgacucaucacccgucaaagccggcgucgaaaccaccacccccuccaaacaauccaacaacaaauacgccgccuccucauaccucucacucacccccgaacaauggaaaucccaccgcuccuacuccugccaagucacccacgaaggcucaaccgucgaaaaaaccgucgcccccaccgaaugcuca

SEQ ID NO: 54528 - RNA, 1449 nt, Artificial Sequence
  derived and/or modified sequence opt11 from Otlertuzumab_HeavyChain
gaaguacaacucguccaaagcggcgccgaggucaagaaaccgggcgaaagccuaaaaauaucaugcaaagguuccggauacucauucacaggcuacaacaugaacuggguccgacaaaugccagggaaaggccucgaauggaugggaaacauagaccccuacuacggaggcacaaccuacaacagaaaauucaaaggacaaguaaccauaagugcagacaaauccaucucaaccgccuaccuacaauggucaucucucaaagcgagcgacaccgccauguacuacugcgccagauccguaggccccuucgacagcuggggucaaggcacacucgucaccgugucauccggcggcggaggcagcggaggcggaggcucaggcggcggaggaagcggcggcggcggcuccggcggaggcggcucagaaauaguacucacgcaaucacccgcaaccuugucccuaagcccaggcgaacgcgcgacccucagcugcagagccagcgaaaacgucuacuccuaccucgccugguaccaacaaaaaccuggacaagcgccccgacuacugauauacuucgccaaaacccucgcggaaggcaucccagcccgcuucucuggcucaggaucaggcaccgacuucacccuaaccauauccucccucgaaccagaagacuucgcagucuacuacugccaacaccacagcgacaaccccuggacauucggacaagggacaaaagucgaaaucaagggagaccaggagccaaagucgucagacaagacccauaccucaccaccaugcccagccccugaacugcucggcggaccaagcguauuccucuucccacccaagcccaaggacacacucaugaucucccgaacccccgaggucacaugcguagucguagacgucucccaugaagaucccgaagucaaauucaacugguacgucgauggugucgaaguccacaacgccaaaaccaaaccccgugaagaacaauacaacuccaccuaccgaguagucucagucuuaacaguccuccaccaagacuggcucaacggcaaagaauacaaaugcaaaguaucaaacaaagcccuacccgcacccauagagaaaaccauauccaaagccaaaggccagccccgcgaaccccaaguauacacucucccacccucacgagacgaacucacuaaaaaccaagucucucucacaugccuugucaaaggguucuacccaagcgauaucgccgucgaaugggaauccaacggccaacccgagaacaacuacaaaacaaccccacccguccuggacucggacggcagcuucuuccuauauucaaaacugacggucgacaaaagccgguggcaacaaggaaacguauucuccugcucagucaugcacgaagcccuacacaaccacuacacccaaaaaucacuuucccucagccccggaaaa

SEQ ID NO: 54529 - RNA, 339 nt, Artificial Sequence
  derived and/or modified sequence opt11 from Ozoralizumab_HeavyChain
gaagugcaauuggucgagagcgggggcgggcucgugcaaccgggcgggagcuugcgcuugagcugugccgcgagcggguucacguucucagacuauuggauguacugggucaggcaagcgcccgggaaagggcucgagugggugagcgagaucaauaccaauggcuugaucacgaaauaucccgauagcgugaaagggcgcuuuaccauaagcagggacaaugccaagaacacgcucuaucuccagaugaauagcuugcgcccggaagauaccgcggucuauuacugugccaggagcccgagcggguucaaucgagggcaagggaccuuggucacgguc

SEQ ID NO: 54530 - RNA, 1089 nt, Artificial Sequence
  derived and/or modified sequence opt11 from Ozoralizumab_HeavyChain_HeavyChain_HeavyChain
gagguacagcucguagaaucgggagggggccugguccaacccgggggcucgcucaggcuaucgugcgcggcaucgggauuuaccuuuagcgauuacuggauguauugggugagacaggcaccgggcaagggacuagaauggguaucggaaauaaacacaaacggacucauaaccaaguacccagacucgguaaagggccgguucacaauuucgagagauaacgcgaaaaauacauuguaccuacagaugaacucgcucaggcccgaggacacggccguguacuacugcgcacgcucgccaucugguuucaacaggggacagggcacgcucguaacagugagcucgggcgggggcggaaguggaggcgggagcgagguccagcucguggaaucgggcgggggcuugguacagccagggaacucgcucaggcucucgugcgcggcaucgggauucacauuuagcucguucgggaugucuugggugcgccaggccccgggcaagggccuggaaugggucucgagcauaagcggguccgggagcgacacacuauacgcagauucggucaagggcagguucacgaucucgcgcgauaaugcgaaaacaacccuguaccugcaaaugaacucgcuaaggccagaggacacggcaguauacuauugcacgaucgggggaucgcucucgcgcucgagucagggcacgcucgugacaguaagcucgggcggaggcgggagugggggcgggagcgagguccagcucguggaaucgggcggcggauugguccagccugggggcucgcuacggcucucgugcgcggcaucaggauucaccuuuagcgauuacuggauguacugggugagacaggccccgggcaagggauuagaauggguaucagaaauaaacacgaacggacuaauaaccaaguacccggacagugucaagggcagguucacaauaucacgcgauaacgcgaaaaauacacuauacuuacaaaugaacucacucagacccgaggacacggcaguguacuauugugcgcgcucgcccucaggcuuuaacaggggccaggguacgcucguaaccguaagcucg

SEQ ID NO: 54531 - RNA, 1494 nt, Artificial Sequence
  derived and/or modified sequence opt11 from Pasotuxizumab_HeavyChain_LightChain_HeavyChain_LightChain
caagugcaacucguagaaaguggaggagggcuggucaagcccggagaaagccuacgccugagcugcgcagcaucgggauucacauucagcgauuacuacauguacuggguaagacaagcaccaggaaaaggacuagaauggguagcaauaaucagcgacgggggauacuacaccuacuacagcgacaucaucaaaggaagauucaccaucagcagagacaacgcgaaaaacagccuguaccuacaaaugaacucccugaaagcagaagacacggcaguauacuacugcgcccgcggguucccccuccuaagacacggagcuauggacuacuggggacaaggcacccuaguaacaguaucauccggaggaggcggcucaggcggcggaggaagcggaggcggcggaagcgacauacaaaugacccaaagcccaucgucccuaagugccuccguaggagaccgaguaacaauaacaugcaaagccagccaaaacguagacacaaacgucgccugguaccaacaaaaacccggacaagcaccaaaaagccucaucuacagcgcaagcuacagauacagcgacguaccaucacgauucagcggguccgcauccggcaccgacuucacacuaacaaucuccagcguccaaagugaagacuuugcaaccuacuacugccaacaauacgacucauacccauacaccuucggcggcggaaccaaacuagaaauaaaaagcggcggcggaggguccgagguccaacucguagaaagcggcggcggucucguacaaccagggggaucacucaaacuauccugcgcagcaucaggauucacauucaacaaauacgccaugaacuggguccgacaagcccccggcaaagggcuggaaugggucgccaggauacgcagcaaauacaacaacuacgccaccuacuacgccgacagcgucaaagaccgcuucacaaucagcagagacgacagcaaaaacacagcauaccuccaaaugaacaaccucaaaacagaagacacagccguauacuacugcguaagacauggcaacuucggcaacucauacauaucauacugggcauacuggggccaaggaacgcuagucacaguaucaagcggaggaggaggaagcggcggaggcggcucaggcggcgguggcagccaaaccguaguaacacaagaacccucgcuaaccguaagcccaggcggcaccguaacgcuaacaugcggcucauccacgggcgccgucaccagcggcaacuaccccaacuggguacaacaaaaaccagggcaagcaccccgcggccucauaggcggaacgaaguuccuagccccagggacaccagcaagauucagcggaagccuccucggcggcaaagcagcacugacccuguccggcguacaaccagaagacgaggccgaauacuacugcguacuaugguacagcaaccgcugggucuucggaggcgggacaaaacucaccguccua

SEQ ID NO: 54532 - RNA, 357 nt, Artificial Sequence
  derived and/or modified sequence opt11 from Pasotuxizumab_HeavyChain1
caaguccaacucgucgaauccggcggcggccucgucaaacccggcgaaucccuccgccucuccugcgccgccuccggcuucaccuucuccgacuacuacauguacuggguccgccaagcccccggcaaaggccucgaaugggucgccaucaucuccgacggcggauacuacaccuacuacuccgacaucaucaaaggccgcuucaccaucucccgcgacaacgccaaaaacucccucuaccuccaaaugaacucccucaaagccgaagacaccgccgucuacuacugcgcccgcggcuucccccuccuccgccacggcgccauggacuacuggggccaaggcacacucgucaccguc

SEQ ID NO: 54533 - RNA, 369 nt, Artificial Sequence
  derived and/or modified sequence opt11 from Pasotuxizumab_HeavyChain2
gagguccagcucguggaaucgggcgggggcuugguccagcccgggggcucacucaagcucucgugcgcggccucgggcuuuaccuuuaacaaguacgcgaugaauugggugcgccaggccccgggcaagggcuuggaaugggucgcgcgcauacgcucgaaauauaacaauuacgcgaccuauuacgcggacucggucaaggacagguucacgaucucgcgcgaugacucgaaaaauaccgcguaccugcaaaugaacaaucucaagaccgaggacacggccguguacuauugcgugcgccauggcaauuucgggaacucguacauaagcuauugggcguacuggggccagggcacgcucgugaccgug

SEQ ID NO: 54534 - RNA, 321 nt, Artificial Sequence
  derived and/or modified sequence opt11 from Pasotuxizumab_LightChain1
gacauccaaaugacccaaucccccuccucccucuccgccuccgucggcgaccgcgucaccaucaccugcaaagccucccaaaacguagacaccaacgucgccugguaccaacaaaaacccggccaagcccccaaaucccucaucuacucagccuccuaccgcuacuccgacguccccucccgcuucucaggcuccgccuccggcaccgacuucacccucaccaucuccuccguccaauccgaagacuucgccaccuacuacugccaacaauacgacuccuaccccuacaccuucggcggcggcaccaaacucgaaaucaaa

SEQ ID NO: 54535 - RNA, 327 nt, Artificial Sequence
  derived and/or modified sequence opt11 from Pasotuxizumab_LightChain2
caaaccgucgucacccaagaacccucccucaccgucucccccggcggcaccgucacccucaccugcggcuccuccaccggcgccgucaccuccggcaacuaccccaacuggguccaacaaaaacccggccaagccccccgcggccucaucggcggcaccaaauuccucgcccccggcacccccgcccgcuucuccggcucacuccucggcggcaaagccgcccucacccucuccggcguccaacccgaagacgaagccgaauacuacugcguccucugguacuccaaccgcugggucuucggcggcggcaccaaacucaccguccuc

SEQ ID NO: 54536 - RNA, 1023 nt, Artificial Sequence
  derived and/or modified sequence opt11 from Placulumab_HeavyChain
gacauacaaaugacccaaucacccagcucacucuccgccagcguaggggaccgugucaccaucacaugccgagccucccaagccaucgacuccuaccuccacugguaccaacaaaaacccggaaaagcacccaaacuccuaaucuacuccgccuccaaccucgaaaccggaguccccuccagauucucuggauccggcuccggaaccgacuucacccuuaccaucucaucacuacuccccgaagacuucgccaccuacuacugccaacaagucgucuggcgccccuucaccuucggccaaggaaccaaagucgaaaucaaacgagucgaacccaaauccucagacaaaacccacaccuguccgcccugccccgcccccgaacuccuaggcggccccuccgucuuccucuucccacccaaacccaaagacacccucaugaucucccgaacccccgaaguaaccugcgucgucgucgacguaucacacgaagaccccgaagucaaauucaacugguacgucgacggaguagaaguacacaacgccaaaaccaaacccagagaagaacaauacaacuccaccuaccgagucguaucaguccuaaccgugcuacaccaagacuggcucaacggaaaagaauacaaaugcaaagucuccaauaaagcccuccccgcccccaucgagaaaaccaucuccaaagcaaaaggccaaccccgagaaccccaagucuacacacucccuccaucacgcgacgaacuaaccaaaaaccaaguaucccuaaccugccucgucaaaggcuucuaccccucagacaucgccgucgaaugggaauccaacggccaacccgaaaacaacuacaaaaccaccccacccguccucgacuccgacggcuccuucuuccucuacucgaaacucaccgucgauaaaucccgcuggcaacaaggaaacgucuucuccugcuccgucaugcacgaagcccuccacaaccacuacacucaaaaaucacucucacuaucucccggaaaa

SEQ ID NO: 54537 - RNA, 1353 nt, Artificial Sequence
  derived and/or modified sequence opt11 from Porgaviximab_HeavyChain
gaaguccaacuccaagaaucagguggcggacucaugcaacccggcggcuccaugaaacuaucgugugucgccuccggcuucacauucuccaacuacuggaugaacuggguacgccaauccccagaaaaaggacucgaaugggucgcagaaauccgacucaaaagcaacaacuacgccacccacuacgccgaauccguaaaaggaagauuuacaauaucacgcgacgauucaaaaagaucagucuacuuacaaaugaacacccuccgcgccgaagacaccggaaucuacuacugcaccagaggcaacggcaacuacagagccauggacuacuggggccagggcaccagcgucaccgucagcuccgccuccaccaaagggcccuccgucuucccccucgcccccuccuccaaaucgacuuccggaggaacagccgcccugggcugccuagucaaagacuacuuccccgaaccagucacggucucauggaacuccggcgcccuaaccuccggcguccacacguuccccgccguacuccaauccuccggacuauacucccucagcagcguagucacagucccaagcuccagccucggcacccaaaccuacaucugcaaugucaaccacaaaccuagcaacacaaaagucgacaaacgcgucgaacccaaauccugcgacaaaacccacacuugcccgcccugccccgcccccgaacuccuuggaggcccauccgucuuccucuucccacccaaacccaaagacacccucaugaucucccgcaccccagaagucaccugugucguagucgacgucucacacgaagaucccgaagucaaauucaacugguaugucgacggcgucgaaguccacaacgcaaaaaccaagcccagagaagaacaauacaacuccaccuaccgcgucguuuccguacucaccguccuccaccaagauuggcuaaacggcaaagaauacaaaugcaaggucagcaacaaagcccuccccgcccccaucgaaaagacaaucucaaaagccaaaggccaaccacgcgaaccccaaguauacacccuacccccaucccgugacgaacucaccaaaaaccaaguaucacuaaccugccucguaaaaggcuucuaccccuccgacauagccgucgaaugggaaagcaacggccaacccgaaaacaauuacaaaaccacaccaccaguccucgacucagacggcuccuucuuccucuacuccaaacuaaccguagacaaaucccgauggcaacaaggaaacgucuucuccugcuccgucaugcacgaagcccuccacaaccacuacacgcagaaaagccuuucacuaucacccggcaaa

SEQ ID NO: 54538 - RNA, 642 nt, Artificial Sequence
  derived and/or modified sequence opt11 from Porgaviximab_LightChain
gacauccaaaugacacaaagccccgcaagccugagcguaagcguaggcgaaaccguaagcauaaccugccgcgcaagcgaaaacauauacucaagccuagccugguaccaacaaaaacaaggaaaaucaccccaacuccuagucuacagcgccaccauacucgcagacggagucccguccagauucucaggcucaggcucaggcacacaauacucccuaaaaaucaacucacuccaaagcgaagacuucggcacauacuacugccaacacuucugggggaccccauacacauucgggggcggaaccaaacucgaaaucaaacgcacggucgcagccccaagcguauucaucuucccgcccucagacgaacaacugaaaucaggcacagccucagucguaugccuacucaacaacuucuacccacgcgaggccaaaguccaauggaaagucgacaacgcgcuccagagcggaaacucacaagaaagcguaaccgaacaagacagcaaagacucgaccuacagccucagcucaacucuaacccuaagcaaagccgacuacgaaaaacacaaaguauacgcaugcgaagucacacaccaaggccuaagcucccccguaaccaaaucguucaacagaggcgaaugc

SEQ ID NO: 54539 - RNA, 1341 nt, Artificial Sequence
  derived and/or modified sequence opt11 from Prezalumab_HeavyChain
gaaguacaacucgucgaauccggaggcggccuaguccaaccaggaggaucccuccgccuguccugcgccgcuagcggauucacuuucuccuccuacuggauguccugggucagacaagcccccggaaaaggccucgaauggguagccuacaucaaacaagacggcaacgaaaaauacuaugucgacucaguaaaaggucgcuucacaaucagccgcgacaacgccaaaaacucccuauaccuccaaaugaacucacuacgagcagaagacaccgccgucuacuacugcgcccgcgaaggaaucuuaugguucggagaccuccccacauucuggggacaaggcacccuagucaccgucuccuccgcauccacaaaagggcccuccgucuucccccuagcccccugcucccgauccacuuccgaauccaccgcagcacucggcugccuagucaaagacuacuuccccgaacccguaaccgucucauggaacucaggagcccucaccagcggaguacacaccuucccagccguucuccaaucuagcggccucuacucacucucuucagucgucacaguaccuuccucaaacuucggaacucaaaccuacacaugcaauguggaccacaaacccuccaacacaaaagucgacaaaacagucgaacgcaaaugcugcgucgaaugcccaccaugccccgccccacccguagccggcccauccguauuccuguucccacccaagcccaaagacacccucaugaucucacgcacccccgaaguaaccugcgucgucgucgacguaucacacgaagaccccgaaguucaauucaacugguacgucgacggcguagagguacacaacgccaaaaccaaacccagagaggaacaauucaacuccaccuuccgaguagucagcguccugacagucguccaccaggacuggcucaacggcaaagaguacaaaugcaaagucuccaacaaaggccuccccgcccccaucgagaaaaccaucuccaaaaccaaaggccaaccccgcgaaccccaagucuacacccuacccccaucgcgcgaagaaaugaccaaaaaccaagucucccuaacaugccucgucaaaggcuucuaccccucagacauagcagucgaaugggaauccaacggacaaccagaaaacaacuacaaaaccaccccaccaaugcucgacucagacggaucauucuuccuuuacuccaaacuaacuguugacaaaucaagauggcaacaaggcaacgucuucuccugcuccgucaugcacgaagcacuccacaaccacuacacccagaagucgcuaucccuaucucccggcaaa

SEQ ID NO: 54540 - RNA, 642 nt, Artificial Sequence
  derived and/or modified sequence opt11 from Prezalumab_LightChain
gacauccaaaugacccaaagccccuccucccucuccgccucagucggcgaccgcgucaccaucacaugccgcgccagccaaggcaucuccaacuggcucgccugguaccagcaaaaacccgaaaaagcccccaaaucacucaucuacgccgccagcucacuucaaagcggagucccuucccgcuucuccggcucaggcucaggcaccgacuuuacccucaccaucucaucacuccaacccgaagacuucgccaccuacuacugccaacaauacgacuccuacccccgcaccuucggccaaggcaccaaagucgaaaucaaacgcaccgucgccgcccccagcgucuucaucuucccucccuccgacgaacaacuaaaauccggcaccgccucagucgucugccuacucaacaacuucuacccccgcgaagccaaaguccaauggaaagucgacaacgcccuccaauccggaaacucccaagaaagcguaaccgaacaagacagcaaagacuccaccuacucccucuccuccacccuaacccuaucaaaagccgacuacgaaaaacacaaagucuacgccugcgaagucacccaccaaggccuaagcucccccgucaccaaauccuucaaccgcggcgaaugc

SEQ ID NO: 54541 - RNA, 342 nt, Artificial Sequence
  derived and/or modified sequence opt11 from Radretumab_HeavyChain
gaaguccaacuccucgaauccggcggcggccucguccaacccggcggcucccuccgccucuccugcgccgccuccggcuucaccuucuccuccuucuccaugucuuggguccgccaagcccccggcaaaggccucgaaugggucuccuccaucuccggcuccuccggcaccaccuacuacgccgacuccgucaaaggccgcuucaccaucucccgcgacaacuccaaaaacacccucuaccuccaaaugaacucccuccgcgccgaagacaccgccgucuacuacugcgccaaacccuuccccuacuucgacuacuggggccaaggcacccucgucaccguc

SEQ ID NO: 54542 - RNA, 1071 nt, Artificial Sequence
  derived and/or modified sequence opt11 from Radretumab_HeavyChain_LightChain
gaaguccaacuacucgaauccggcggcggccucguccaaccaggcggcagccuccgauuaucaugcgccgccagcggauucacauucucuuccuucagcauguccuggguccggcaagccccaggcaaaggccucgaauggguaucaagcauauccggcuccucaggcaccaccuacuacgccgacucagucaaaggccgcuucaccaucucccgcgacaacuccaaaaacacucucuaccuccaaaugaacucacuucgcgccgaagacaccgcaguauacuacugcgccaaaccauucccauacuucgacuacuggggacaaggcacccucgucacagucuccuccggcgacggcucauccggcggcuccggcggcgcaucagaaaucguccucacccagagcccaggcacacucucacucuccccaggcgaacgagcaacacucuccugccgugcaucccaauccgucuccucaagcuuccucgccugguaccaacaaaaacccggacaagccccccgccuccucaucuacuacgcauccucccgcgcaacaggaauccccgaccgcuucucaggauccggcuccggcaccgacuucacacucaccaucucaagacucgaacccgaagacuucgcagucuacuacugccaacaaaccggccguauaccucccacauucggccaaggcacaaaagucgaaauuaaaucaggcggcuccggcggaccccgugccgcacccgaagucuacgcauucgcaaccccagaauggcccggcucccgugauaaacgaacccucgccugccucauccaaaacuucaugccugaagacauauccguacaauggcuccacaacgaaguacaacuacccgacgccagacacucaaccacccaaccccgcaaaaccaaaggcucaggauucuucgucuucucccgccucgaagucacccgcgccgaaugggaacaaaaagacgaauucauuugccgcgcaguccacgaagccgccucccccucacaaaccguacaacgagccgucuccguaaaccccgaauccucacgacgcgguggcugc

SEQ ID NO: 54543 - RNA, 693 nt, Artificial Sequence
  derived and/or modified sequence opt11 from Radretumab_LightChain
gcauccgaaauaguacucacacaaucacccggcacccucagccucucccccggcgaacgcgccacccucucuugccgcgccucccaauccgucuccucaucauuccucgccugguaccaacaaaaacccggacaagcaccacgccuccucauauacuacgccuccucccgcgccaccggcauacccgaccgcuucuccggcucaggcuccgguaccgacuucacccucacaaucucacgccuugaacccgaagacuucgccgucuacuacugccaacaaaccggccgcaucccacccaccuucggccaaggcacaaaagucgaaauaaaauccggcggcuccggcggcccccgcgcagcccccgaagucuacgccuucgccacccccgaauggcccggcucccgcgacaaacgcacccucgccugccuaauccaaaacuucaugcccgaagacaucuccguccaauggcuccacaacgaaguccaacuacccgacgcccgucacucaacaacgcaaccccgaaaaaccaaaggcucaggcuucuucgucuucucccgccucgaagucacccgcgccgaaugggaacaaaaagacgaauuuaucugccgcgccguccacgaagccgcaucccccucccaaaccguccaacgagccgucuccgucaaccccgaauccucccgacgcggcggcugc

SEQ ID NO: 54544 - RNA, 1359 nt, Artificial Sequence
  derived and/or modified sequence opt11 from Ranevetmab_HeavyChain1
gaaguacaacucgucgaaagcggcggcggccucguccaacccggcggcucccuccgcuuaucuugcguagccagcggauucucacucaccaacaacaaugucaacuggguccgacaagccccaggaaaaggacucgaaugggucggcggcgucugggccggcggagccaccgacuacaauagcgcccuaaagucccgauucaccaucucacgcgacaacgcgaagaacaccguauuccuccaaaugcacucacuccguuccgaagacaccgccgucuacuacugcgcacgagacggcggauacucgagcuccacccucuacgccauggacgccuggggccaaggcaccaguguaaccguaagcucagccucaacuacggcccccuccgucuucccacucgcccccucaugcgguuccaccuccgggagcaccgucgcccuugcuugccuaguuuccggcuacuucccagaaccggucaccgucuccuggaacuccggaucccugacaucgggcgugcacaccuucccaucaguacuccaguccuccggccuacacucacuuucauccauggucaccguccccuccucgcguuggcccuccgaaaccuucacuugcaacgucguacaccccgccuccaacaccaaaguagacaaacccguuuucaacgaaugccgguguaccgauaccccacccugccccguacccgaaccccucggcggccccuccguccucaucuucccacccaaacccaaagacauacuacgcaucacccgaacccccgaaguaaccugcguaguccuagaccucggccgcgaagaccccgaaguccaaauaagcugguucguggacggcaaagaaguaaucaccgcaaaaacccaaucccgcgaacaacaguucaacggcacauaccaggucgucucaguacuccccaucgaacaccaagacuggcucaccggcaaagaguucaaaugccgcguaaaccacaucgaccucccaucccccauagaacgaaccaucuccaaagcucgcgguagagcgcacaaacccucagucuacguccucccaccauccccaaaagaacuauccuccuccgacacaguaucgauaacaugccuuaucaaggacuucuacccacccgacaucgaugucgaauggcagucaguaggccagcaagaacccgaacgaaaacaccgcaugaccccuccccaacucgacgaagacggcagcuacuuccucuacucaaaauuaagcguagacaaaucccgauggcaacaaggcgaccccuucacuugcgccgucaugcacgaaacccuccaaaaccacuacaccgaccuaucucuaucacacucacccggaaaa

SEQ ID NO: 54545 - RNA, 1359 nt, Artificial Sequence
  derived and/or modified sequence opt11 from Ranevetmab_HeavyChain2
gaaguacaacucgucgaaagcggcggcggccucguacaacccggcggaucccugcgccucagcugcgucgccuccggauucucccucaccaacaacaacguuaacuggguccgccaagcucccggcaaaggccucgaaugggugggcggcguaugggccggcggagccacagauuacaacagcgcacucaaauccagauucaccaucucccgcgacaacgccaaaaacacaguauucuugcaaaugcacucccuccgauccgaagacaccgcagucuacuacugcgcccgagacggcggauacuccuccuccacccuauacgccauggaugcuuggggccagggcacauccgucacugucuccuccgccuccaccacagcacccuccguauucccccucgcacccucaugcggcucuacguccggguccaccgucgcccucgccugccuagucucaggcuauuuccccgaacccgucacuguaucguggaacagcggcucucuuaccucaggcguccacaccuuccccuccguccuccaauccucgggccuccacucccucuccuccaugguaacgguacccucaucccgcuggcccucagaaacguuuaccugcaaugucguccacccagccuccaacacaaaaguagacaaacccgucuuuaacgaaugccgcugcaccgacacaccacccugccccguccccgagccccucggcggcccuucaguccucaucuuucccccaaaaccaaaagacauccuacgcauaacccggacaccagaaguaaccugcgucguacucgaccucggccgcgaagacccugaaguacaaauauccugguucgucgacggaaaagaaguccuaaccgcaaaaacccaaucccgagaacaacaguucaacggcaccuaccaagucgucuccguacuccccaucgagcaccaagacuggcucaccggcaaagaguucaaaugccgcguuaaccacaucgacuuaccaucuccaaucgaacgcacaauauccaaggcccgaggccgagcccacaaaccuucgguauacguccuaccaccaucaccaaaagaacucuccagcuccgacaccgucuccauuaccugccucaucaaagacuuuuacccacccgacaucgacgucgaguggcaauccgucggucaacaagaacccgaacgcaaacaccgcaugacgccaccccaacucgacgaggacggcagcuacuuccucuacucaaagcuaagcgucgacaaaucccgcuggcaacaaggagaccccuucacaugcgcagucaugcacgagacccuacaaaaccacuacaccgaucucucucucucacacucgcccggaaaa

SEQ ID NO: 54546 - RNA, 651 nt, Artificial Sequence
  derived and/or modified sequence opt11 from Ranevetmab_LightChain
gacaucgucaugacccaaucccccgccucucucucccuuucccaaggagaaaccgucaccauaaccugccgugccuccgaagacaucuacaacgcccuagccugguaccaacaaaaacccggccaagcccccaaacuccucaucuacaacaccgacacccuccacaccggcguccccucccgauucucaggauccggcuccggcaccgacuucucccucacaauauccucccucgaaccagaagacgucgccgucuacuacugccaacacuacuuccacuacccccgcaccuucggccaaggcaccaaagucgaacucaaacgcaacgacgcccaacccgccguauaccucuuccaacccuccccagaccaacuccacaccggcuccgccuccgucguaugccuccucaacuccuucuaccccaaagacaucaacgucaaauggaaagucgacggcgucauccaagacacaggcauccaagaauccgucaccgaacaagacaaagacucaaccuacucccucuccuccacccuaaccauguccuccaccgaauaccucucccacgaacucuacuccugcgaaaucacccacaaaucccuccccuccacacucaucaaauccuuccaacgcucagaaugccaacgcgucgac

SEQ ID NO: 54547 - RNA, 1761 nt, Artificial Sequence
  derived and/or modified sequence opt11 from Remtolumab_HeavyChain
gaaguccaacucgucgaaagcggcggcgggcucguccagcccggccgcucccucagacuaucaugcgccgcaucaggauucaccuucgacgacuacgcaaugcauuggguacgacaagcaccaggcaagggccucgaauggguaagcgccaucaccuggaacucaggccacauagacuacgcugacuccguagaaggccgcuucacaauaucccgcgacaacgccaaaaacagccucuaccuccaaaugaacucacuacgugcagaagacaccgccguauacuacugcgcaaaagucucauaccucuccaccgcauccucccucgacuacuggggacaagggacccuagucacagucucuuccggaggcggcggcucaggcggcggaggcucagagguccaacucguccaaucuggcgccgaagucaaaaagcccggaagcucagucaaaguguccugcaaagccuccggaggcuccuucggcggcuacggaaucggauggguccgacaagccccaggccaaggacucgaauggaugggaggaaucacccccuucuucggcuucgccgacuacgcccaaaaauuccaaggacgcguaacgaucacagcagacgaauccacgacgacagccuauauggaacuaucaggacuaaccuccgacgacacagcgguauacuacugugcacgagaccccaaugaguucuggaaugguuacuacucuacucacgauuucgacuccuggggacaaggcaccaccgucacaguaucauccgccuccaccaaaggcccaucaguauucccccucgcccccucgucuaaaucaaccucaggcggcaccgcggcccucggcugccucguaaaagacuauuuccccgaaccaguaaccgucuccuggaacuccggagcccucacauccggaguccacacauucccagccguccuccaguccuccggccuauacucccuaucaagcgucgucaccguacccuccuccucccucggaacccagaccuacauuugcaacguaaaccacaaacccuccaacacuaaagucgacaagaaaguugaacccaaauccugcgacaaaacacacacaugucccccaugccccgcuccggaacuucuaggcggcccaucugucuuccuauuuccacccaaacccaaagacacccuaaugaucucacgcacaccugaaguaaccugcguaguagucgacguaucccacgaagaccccgaagucaaauucaauugguacgucgacggcguggaaguccacaacgcaaaaaccaaaccccgcgaagaacaauacaacagcacauauaggguagucucaguacucaccguacuccaccaagacuggcucaacggcaaagaauacaaaugcaaggucucgaacaaagcauugcccgcacccaucgaaaagaccaucuccaaagccaaaggccaacccagagagccccagguguacacacuacccccaucacgagacgagcucaccaaaaaccaaguaucacugaccugccucgucaaaggcuucuaccccagcgacauagccguagagugggaauccaacggacaacccgaaaacaacuacaaaacaaccccgcccguccucgacucagacggcagcuucuuccucuacuccaaacugaccguagacaaaagccgcuggcaacaaggcaacguauucagcugcucagucaugcacgaagcacuccacaaccacuacacccaaaaaucccucucauuaucaccaggcaag

SEQ ID NO: 54548 - RNA, 993 nt, Artificial Sequence
  derived and/or modified sequence opt11 from Remtolumab_LightChain
gacauacaaaugacccaauccccauccagccuauccgcaucagucggcgaccgcgucaccauaacaugucgagcaucacaaggcauccgcaacuaccuagcuugguaccagcagaaacccggaaaagccccaaaacuccucaucuacgccgccucuacacuacaauccggaguccccuccagauucucaggauccggcuccggcacagacuucacccucaccauaucaucccuccaaccugaagacgucgccaccuacuacugccaacgauacaaccgcgcccccuacaccuucggccaaggcacaaaagucgaaaucaaacgaggcgguucaggcggcggcggcuccggcgaaaucguucucacccaaucccccgacuuccaaagcgucaccccuaaagaaaaagucaccauuaccugccgagcaucccaagacaucggcuccgaacuccacugguaccaacaaaaacccgaccaaccacccaagcuacucaucaaauaugccucccacuccaccuccggcguccccucccgcuucagcggcuccggcuccggcacagacuucacccuaaccauaaacggccucgaagccgaagacgccggaacauacuacugccaccaaaccgacucccuucccuacaccuucggccccggcaccaaagucgacauaaaacgcacaguagccgcccccucugucuucauauucccacccuccgacgaacaacucaaauccggaaccgccuccgucgucugccuccugaacaacuucuacccaagagaagccaaaguccaauggaaaguagacaacgcccuccaaucaggaaacucccaagaaucagucaccgaacaagacucaaaagacuccaccuacagccuaucaucaacucucacacucuccaaagccgacuacgaaaaacacaaagucuacgccugcgaagucacccaccaaggacucucaucccccguaaccaaauccuucaaccgaggcgaaugc

SEQ ID NO: 54549 - RNA, 1341 nt, Artificial Sequence
  derived and/or modified sequence opt11 from Rosmantuzumab_HeavyChain
caaguccaacuaguccaaucaggcgcagaagucaaaaaacccggagcuucaguuaaaguaagcuguaaagccuccgguuacacauucaccgauuacuccauccacuggguccgccaagcaccaggacaaggccucgaauggaucggcuacaucuaccccucaaacggcgacucuggcuauaaccaaaaauucaaaaaccgagucaccaugacccgagacacauccaccuccaccgcauacauggaacuaucacgcuuacgauccgaagacaccgccgucuauuacugcgccaccuacuucgccaacaauuucgacuacuggggucaagguacaacacucaccgucuccuccgcaagcaccaaaggcccaucgguauucccccucgcccccagcucuaaauccaccuccggcggcaccgccgcccuaggcugccuagucaaagacuacuuccccgaacccguaacagucuccuggaacuccggcgcccucacaagcggaguccauaccuuccccgcaguccuacaaucaucaggccucuacucacucucauccgucgucaccguccccuccuccucccucggcacccaaaccuacaucugcaacgucaaccacaaacccucaaacaccaaagucgacaaacgcgucgaaccaaaaucaugcgacaaaacccacaccugcccccccugccccgccccugaacuacuuggcggccccuccguauuccuauucccucccaaacccaaagauacccucaugaucucccgcacacccgaagucaccugcgucgucgucgacgucucccacgaagacccugaaguaaaauucaacugguacgucgacggcguugaaguccacaacgccaaaaccaaaccacgcgaagaacaauacaacucaaccuaccgcgucgucuccguccuaaccguccuccaccaggacuggcucaacggcaaagaauacaagugcaaagucuccaacaaagcccuucccgcucccaucgaaaaaaccauauccaaagccaaaggccaaccccgcgaaccacaagucuacacccugccccccucacgcgaagaaaugaccaaaaaccaaguaucccucaccugccuuguaaaagguuucuaccccagcgacaucgccguagaaugggaaucuaacggccaaccagaaaacaacuacaaaaccaccccaccaguccuugacuccgacggcuccuucuuccuauacuccaaacucaccgucgacaaaucccgcuggcaacaaggcaacgucuucucaugcagcguaaugcacgaagcacuccacaaccauuacacccaaaaaucgcucucccuauccccgggcaaa

SEQ ID NO: 54550 - RNA, 654 nt, Artificial Sequence
  derived and/or modified sequence opt11 from Rosmantuzumab_LightChain
gacauccaaaugacacaaucacccucaucucucuccgccuccgucggcgaccgcguaaccaucacaugcaaagccucccaauccgucgacuacgacggagacucauacaugaacugguaccaacaaaaacccggcaaagcacccaaacuccucaucuacgccgccuccaaccucgaauccggcguccccucccgcuucuccggcuccggauccggcaccgacuucacccucacaaucucccccguccaagccgaagacuucgccaccuacuacugccaacaauccaacgaagacccccucacauucggagccggcaccaaacucgaacucaaacgcaccgucgccgccccauccgucuucaucuuucccccaucugacgaacaacuuaaauccggcacagccuccgucgucugccuccucaacaacuucuacccacgcgaagccaaaguccaauggaaagucgacaacgcccuccagucuggcaacucacaagaaucagucaccgaacaagacuccaaagacuccaccuacucccuauccuccacccucacccuauccaaagccgacuacgaaaaacacaaagucuacgcaugcgaagucacccaccaaggccucagcucacccgucaccaaauccuucaaccgaggcgaaugc

SEQ ID NO: 54551 - RNA, 1332 nt, Artificial Sequence
  derived and/or modified sequence opt11 from Rozanolixizumab_HeavyChain
gaaguaccccucgucgaaucaggcggcggccucguccaaccaggaggcucccucagacuauccugcgcagucucuggauucaccuucuccaacuacggaauggucuggguccgucaggccccaggcaaaggccucgaaugggucgcauacaucgacucagacggagacaacacuuacuaccgcgacagcgucaaaggccgcuucacaaucucacgcgacaacgccaaaucaucacuauaccuccaaaugaacucacuccgcgccgaagacaccgccguauacuacugcaccaccggcauaguccgcccauuccuauacuggggccaaggaacccuagucacaguauccuccgcauccacaaaaggccccuccgucuucccacucgcaccaugcucucgcuccaccuccgaauccaccgccgcucuuggaugccuuguaaaagacuacuuccccgaaccggucaccgucuccuggaacucaggcgcccucaccuccggcguccacacguuccccgccguacuccaaagcuccggacucuacucccucucauccgucgugacaguacccagcuccagccucggcaccaaaaccuauaccugcaacgucgaccacaaaccuuccaacacaaaaguagacaaacgcgucgaauccaaauacggaccuccaugcccacccugccccgcccccgaguuccucggcggacccuccgucuuccucuucccacccaaacccaaagacacccucaugaucucacgcacccccgaagucacgugcguaguggucgacgucagccaagaagaccccgaaguccaauucaacugguacgucgacggcgucgaaguacacaacgccaaaaccaaaccccgggaagaacaauucaacucaaccuaccguguaguuuccguccucacaguacuucaccaagacuggcucaacggcaaagaauauaaaugcaaagucucaaacaaaggccuccccuccagcauagaaaagaccaucucuaaagcaaaaggccaaccccgagaaccccaagucuacacacuaccacccucccaagaagaaaugaccaaaaaccaagucucccucacaugccuagucaaaggauucuaccccuccgacaucgccgucgaaugggaaucaaacggccaacccgaaaacaacuacaaaaccaccccacccguccucgacuccgacggauccuucuuccucuacagccgccucaccguagacaaaagcagauggcaagaaggaaacgucuucucaugcuccguuaugcacgaagcccuacacaaccacuacacccaaaaaucccucucacuauccuuaggcaaa

SEQ ID NO: 54552 - RNA, 657 nt, Artificial Sequence
  derived and/or modified sequence opt11 from Rozanolixizumab_LightChain
gacauccaaaugacccaaucccccagcucacucuccgccuccgucggcgaccgcgucacaaucaccugcaaauccucccaaucacucgucggcgccuccggcaaaaccuaccucuacuggcucuuccaaaaacccggcaaagcccccaaacgccucaucuaucucgucuccacacucgacuccggcauccccucccguuucuccggcuccggcucaggcaccgaauucacccucaccaucuccucacuccaacccgaagacuucgccaccuacuacugccuccaaggcacucacuucccccacaccuucggccaaggaaccaaacuagaaaucaaacgaaccgucgcagcccccuccgucuucauauucccccccuccgacgaacaacucaaauccggcaccgccuccgucgucugccuccucaacaacuucuacccccgcgaagcaaaaguccaauggaaagucgacaacgcccuccaauccggcaacucacaagaauccgucaccgaacaagacucuaaggacuccaccuacucccucucauccacccuaacacucucuaaagccgacuacgaaaaacacaaagucuacgccugcgaagucacccaccaaggccucuccucccccgucaccaaauccuucaaccgcggcgaaugc

SEQ ID NO: 54553 - RNA, 1329 nt, Artificial Sequence
  derived and/or modified sequence opt11 from Sapelizumab_HeavyChain
caaguccaacuacaagaaagcggcccuggccucgucaaaccauccgaaacacucagccuaaccugcgcagucucgggccacuccaucucccacgaccacgccugguccuggguccgacagcccccaggcgaaggccuggaauggauaggcuuuaucuccuacuccggaauaacuaacuacaaccccucacuccaaggccgcgucaccaucucacgugacaacuccaagaacacccucuaccuacaaaugaacucucuacgcgcugaagacacagccguauacuacugcgcacgcucauuagccagaacaaccgccauggacuacuggggagaaggaacccuagucaccguuuccagcgccucuaccaaaggccccucagucuuuccccuagcccccucuucaaaaucaaccuccggaggcacagccgcacucggcugccuaguaaaagacuacuucccggaaccagucaccgucagcuggaacuccggcgcccuaacaucuggcguccauaccuuccccgcuguccuacaauccucuggacuuuacucccuaucauccguagucacuguacccuccuccaauuucgguacccaaacauauaccugcaaugucgaccacaaacccuccaacacaaaaguagauaaaaccgucgaacgcaaaagcugcgucgaaugcccucccugucccgccccacccgucgcaggacccuccgucuuccucuucccaccaaaacccaaagacacccucaugaucucacgcacaccugaaguaaccugcgucgucgucgacgucucccaagaagaccccgaaguccaguuuaacugguacgucgacggcgucgaaguacacaacgccaaaaccaaaccccgcgaagaacaauuuaacuccaccuuucgcgucgucuccguccucaccgucguacaccaagacuggcucaacgggaaagaauacaaaugcaaaguuuccaacaaaggcuugcccgcccccauagagaaaaccauauccaagaccaaaggacaaccccgcgaaccccaagucuacacucucccaccaucccaagaagaaaugaccaaaaaccaagucucccuaaccugccucgucaaaggcuucuaccccuccgacauagcggucgaaugggaaucaaacggccaacccgaaaacaacuacaaaaccacacccccgaugcucgacucugacggcuccuucuuccucuacuccaaacucaccgucgacaaaucccgcuggcaagaaggcaaugucuucuccugcuccgucaugcacgaagcccugcacgcccacuacacgcaaaaaucccucucccucuccccc

SEQ ID NO: 54554 - RNA, 642 nt, Artificial Sequence
  derived and/or modified sequence opt11 from Sapelizumab_LightChain
gacauccaaaugacacaaucacccucaagccuaagcgcaagcgugggcgacagcguaaccauaaccugccaagcaagcacggacauuagcucacaccuaaacugguaccaacaaaagcccggaaaagcacccgagcuccuaaucuacuacggaagccaccuccuaagcggagucccaagcagauucucaggcuccggcucaggcacagacuucaccuucaccauaagcucacuagaggccgaagacgcggccacauacuacugcgggcaaggcaacagacucccguacacguucgggcaagggaccaaagucgagaucgagcgcacagucgcggccccgagcguguucauauucccgcccucggacgaacaacucaaaucgggcacggccucagucguaugccugcucaacaacuucuacccacgcgaggcaaaaguccaguggaagguagacaacgcacuccagagcggaaacucacaagaaagcguaaccgagcaagacagcaaagacucaaccuacagccugagcucaacccuaacccuaagcaaggccgacuacgaaaaacacaaaguguacgcgugcgaagucacacaccagggccuaagcucacccguaaccaagagcuucaacagaggcgaaugc

SEQ ID NO: 54555 - RNA, 1356 nt, Artificial Sequence
  derived and/or modified sequence opt11 from Selicrelumab_HeavyChain
caaguccagcuaguccaaucaggcgcggaagucaagaaaccaggcgccuccgucaaaguuuccugcaaagccuccggcuacacauuuaccggauacuacaugcacuggguacgucaagcccccggccaaggccucgaauggaugggcuggaucaaccccgacuccggcggcaccaacuacgcccaaaaauuccaaggccgcgucaccaugacccgcgacacauccaucucaaccgcuuacauggaacuaaaccgccuacgauccgacgacaccgccgucuacuacugcgcccgagaccaaccccucggauacugcaccaacggcguaugcuccuacuucgacuacuggggacaaggcacccuagucaccguauccuccgccucaaccaaaggaccaucagucuucccccucgccccaugcucccgaucuaccuccgaauccaccgcagcccugggaugccuagucaaagacuacuuccccgaaccaguaaccgucucauggaacuccggagcccuuacauccggcguccacaccuuuccugcaguccuccaaucaucaggccucuacucccuaagcucagucgucaccgucccaucauccaauuucggaacccaaaccuacacuugcaacgucgaccacaaacccagcaacacuaaagucgacaaaacagucgagcgcaaaugcugcgucgaaugcccacccugucccgcaccacccgucgcaggccccuccgucuuccuauucccacccaagcccaaggacacccucaugaucucccgcacccccgaaguaaccugcgucgucguagacgugucucacgaagaccccgaaguacaguucaacugguacgucgacggcgucgaaguccacaaugcaaaaaccaaaccccgcgaagaacaguucaacucuaccuucagagucguaucaguccuaacaguaguacaccaggacuggcucaacggcaaagaauacaaaugcaaagucagcaacaaaggccuucccgcaccuauagagaaaacaaucuccaaaaccaaaggccagccccgagaaccucaagucuacacacuaccacccucccgcgaagaaaugaccaagaaccaagucucccucacaugccuagucaaaggcuucuaccccuccgacaucgccguugaaugggaaucaaacggccaaccagaaaacaacuacaaaaccacacccccaaugcucgacuccgacggauccuucuuucuauacuccaaacucaccgucgacaaaucacgauggcaacaaggcaacgucuucuccugcucaguaaugcacgaagcccuucacaaccacuacacacaaaaaucccucucccuaucacccggcaaa

SEQ ID NO: 54556 - RNA, 642 nt, Artificial Sequence
  derived and/or modified sequence opt11 from Selicrelumab_LightChain
gacauccaaaugacccaaucccccuccuccgucuccgccuccguaggcgaccgcgucacaauaaccugccgcgccucacaaggcaucuacuccuggcucgccugguaccaacaaaagcccggcaaagcacccaaccuccucaucuacaccgcauccacccuccaaucuggcguccccucccgauucucaggcuccggcucuggcaccgacuucacccucacaaucuccucccuccaacccgaagacuucgccacauacuacugccaacaagccaacaucuucccccucaccuucggaggcggcaccaaagucgaaauaaaacgcaccgucgccgcccccuccguauucaucuucccucccuccgacgaacaacucaaauccggcaccgccuccgucgucugccuccucaacaacuucuacccccgcgaagccaaaguccaauggaaagucgacaacgcacuccaauccggcaacucccaagaauccgucaccgaacaagacuccaaggacuccaccuacucccucuccuccacccucacacucuccaaagccgacuacgaaaaacacaaaguauacgccugcgaaguaacccaccaaggccuauccucccccguaaccaaauccuucaaccgcggagagugc

SEQ ID NO: 54557 - RNA, 354 nt, Artificial Sequence
  derived and/or modified sequence opt11 from Solitomab_HeavyChain1
gagguccagcucuuggaacagagcggggccgagcucgugcgaccgggcacgagcgugaaaauaagcuguaaagcgagcggguacgcguucacgaacuauugguugggcugggucaagcaaaggcccgggcacgggcucgaguggauaggcgauaucuuucccgggagcgggaacauacacuauaacgagaaauuuaaagggaaagcgaccuugaccgcggacaagagcucgagcacggccuauaugcagcucagcucauugaccuuugaagauagcgcggucuauuucugugccaggcuaaggaacugggacgagcccauggacuauugggggcaagggaccacggucacgguc

SEQ ID NO: 54558 - RNA, 375 nt, Artificial Sequence
  derived and/or modified sequence opt11 from Solitomab_HeavyChain2
gacguccaacucguccaauccggcgccgaagucaaaaaacccggcgcauccgucaaagucuccugcaaagccuccggcuacacauucaccagauacaccaugcacuggguccgccaagcccccggccaaggccucgaauggaucggcuacaucaaccccucccgcggcuacaccaacuacgccgacuccgucaaaggccgcuucaccaucaccaccgacaaauccaccuccaccgccuacauggaacucuccucccuccgcuccgaagacaccgccaccuacuacugcgcccgcuacuacgacgaccacuacugccucgacuacuggggccaaggcaccaccgucaccgucuccucaggcgaaggcaccuccacc

SEQ ID NO: 54559 - RNA, 1488 nt, Artificial Sequence
  derived and/or modified sequence opt11 from Solitomab_LightChain_HeavyChain_HeavyChain_LightChain
gaauuggugaugacgcaaucacccucaucccugaccguaacagccggcgaaaaaguaaccaugaguugcaaaagcagccaaucacugcucaacuccgggaaccagaaaaacuaucucaccugguaccaacaaaaacccggacaaccgcccaagcucuugaucuacugggcaagcacacgcgaaagcggagucccagacagauucacaggauccggcucaggcaccgacuucacccuaaccaucagcucaguacaagccgaagaccuagccgucuacuacugccagaacgacuacucguacccacucacauucggagccggcaccaaacucgaaauaaagggaggcggcggaagugggggagggggcucuggcgggggaggcagcgaaguccaacuacucgaacaaagcggggccgaacucgugcgcccaggcaccuccguaaaaauauccuguaaagcaagcggauacgcauucacgaacuauuggcuaggaugggucaagcaaagacccgggcacggccuagaguggauaggagacaucuuccccggaagcggaaacauucacuacaacgagaaauucaaagggaaagccacgcuaacagcagacaaaagcucaagcacggcauacaugcaacucucaucgcuaaccuucgaagacuccgcggucuacuuuugcgcaagacucaggaacugggacgaaccgauggacuacuggggacaagggaccacggucacggucuccagcggaggaggcggcuccgacguacaacugguccaaagcggcgcagaagucaagaaacccggagcgaguguaaaaguaagcuguaaagccagcggauacaccuucacacgauacaccaugcacugggucagacaagcgcccgggcaaggacucgaguggaucggcuacauaaacccgucacgaggauacacaaacuacgccgacagcguaaaaggacgauucaccauaaccacagacaaaagcacaagcacggccuacauggagcucucaagccuacgcagcgaagacaccgccaccuacuauugcgcaagguacuaugacgaucacuacugccuggacuacuggggacaaggaaccaccguaacagucucgagcggagaaggaaccucaacaggaagcggaggaucaggcggaagcggaggcgcggacgauaucguacucacacaaagcccagcaacccuaagccuaagcccaggagaaagagcaacccuaagcugccgcgcaagccaaagcguaaguuacaugaacugguaccaacagaaaccaggcaaggccccaaaacgauggaucuacgacaccucaaaaguggccucaggcgucccagcacgcuucuccgggagcgggagugggacagauuacucgcuuacgaucaacagccuagaagcagaagacgcagcgaccuacuacugccaacaguggucgagcaacccacuaaccuucggcggcggcacgaaaguggaaaucaaa

SEQ ID NO: 54560 - RNA, 339 nt, Artificial Sequence
  derived and/or modified sequence opt11 from Solitomab_LightChain1
gaacucgucaugacccaaucccccuccucccucaccgucaccgccggcgaaaaagucaccauguccugcaaauccucccaaucccuccucaacuccggaaaccaaaaaaacuaccucaccugguaccaacaaaaacccggccaaccccccaaacuacucaucuacugggccuccacccgcgaauccggcguccccgaccgcuucaccggcuccggcuccggcaccgacuucacccucaccaucuccuccguccaagccgaagaccucgccgucuacuacugccaaaacgacuacuccuacccccucaccuucggcgccggcaccaaacucgaaaucaaa

SEQ ID NO: 54561 - RNA, 324 nt, Artificial Sequence
  derived and/or modified sequence opt11 from Solitomab_LightChain2
gccgacgacaucguccucacccaaucccccgccacccucucccucucccccggcgaacgcgccacccucuccugccgcgccucccaauccgucuccuacaugaacugguaccaacaaaaacccggcaaagcccccaaacgcuggaucuacgacaccuccaaagucgccuccggcguccccgcccgcuucuccggcuccggcuccggcaccgacuacucccucaccaucaacucccucgaagccgaagacgccgccaccuacuacugccaacaaugguccuccaacccccucaccuucggcggcggcaccaaagucgaaaucaaa

SEQ ID NO: 54562 - RNA, 1359 nt, Artificial Sequence
  derived and/or modified sequence opt11 from Suptavumab_HeavyChain2
gaaguccaacucguagaaaguggaggagaccucguacagcccggaagaagccuacgccucucuugcgucgccuccggauucaccuucgacgacuacgccaugcacuggguccgacaagcccccggcaaaggacucgaauggguauccggcgucagcuggucaggcagcacagucggcuacgccgacuccgucaaaggccgauucaccgucucccgagacaacgcucaaaaaucucuuuaucuccagaugaacagucuccgcgcagaagacaccgcccuauacuacugcguaaaagaugccuacaaauucaauuacuacuacuacggucucgacgucuggggccagggaaccaccguaaccguauccucagccagcaccaagggacccagcguauucccccucgcccccuccuccaaguccaccuccggaggcacagcugcacucggcugccucguaaaagacuacuuccccgaacccgucaccgucuccuggaacuccggagcacuaaccucaggaguccacaccuuccccgcaguccuccaauccucaggacuauacagccucagcuccgucgucacuguccccuccuccagucucggcacucaaacauacaucuguaacgucaaccacaaacccucaaacaccaaagucgacaagaaagucgaacccaaauccugcgauaaaacccacacaugcccacccugccccgcacccgaacuccucggcggccccuccgucuuccuauucccacccaaacccaaagacacucucaugaucucccgcacccccgaaguaaccugcgucgucgucgacgucucccacgaagaccccgaagucaaauucaauugguacgucgacggcgucgaaguccacaacgcuaaaaccaaaccccgcgaagaacaguacaauucaacuuaccgcgucgucucaguccuaacaguacuccaccaggacuggcuaaacggaaaagaauacaaaugcaaagucucaaacaaagcacuccccgccccaaucgagaaaaccaucuccaaagccaaaggccaaccacgcgaaccccaaguauacacccucccaccaagccgugacgaacucacuaaaaaccaaguaucccuaaccugccucgugaaaggauucuacccgagcgacaucgcagucgaaugggaauccaacggccaaccagaaaacaauuacaaaaccacuccacccguacuagacagcgacggcagcuucuuccucuauagcaaacugacggucgacaaaucccgcuggcaacagggaaacguauucuccugcucaguaaugcacgaagcacuccacaaccacuacacccaaaagucacuaucccucucccccggcaaa

SEQ ID NO: 54563 - RNA, 1356 nt, Artificial Sequence
  derived and/or modified sequence opt11 from Suvratoxumab_HeavyChain
gaaguccaacucgucgaauccggaggcggacuaguucagcccggcgggucccuacgccuauccugugcagcaucaggauucaccuucucaucccacgacaugcacugggucagacaagccaccgguaaaggccuagaauggguaucaggcauaggaacugcaggcgacaccuauuaccccgacuccguaaaaggccgcuucacaaucucccgagaaaacgccaaaaacucacucuaccuacaaaugaacucacuucgagcaggggacacugcagucuacuacugcgcccgagacagguacucccccacgggacacuauuacggcauggacguauggggccaaggaaccaccguaaccgucuccucagcuucaaccaaaggcccaucagucuucccccuagcccccagcuccaaaagcacaucaggaggcaccgcagcccuaggcugccucgucaaagacuacuuccccgaaccagucaccgucucauggaacagcggagcccuaacaucaggcguccacacauuucccgcuguucuccaaucauccggacuauauucacucucaucagucguuaccguccccagcuccucacucggcacccaaaccuauaucugcaacgugaaccacaaacccuccaacaccaaagucgacaaaagagucgaacccaaauccugcgacaaaacacacaccugcccucccugcccagcaccugaacuccucggaggccccucuguauuccuauucccaccaaaaccaaaagacacccuauacauaacccgggaacccgaagucaccugcgucguagucgacguaucccacgaagaccccgaaguaaaauucaacugguacguagacggcguggaaguccacaacgccaaaacaaaaccccgugaagaacaauacaacuccaccuaccgagucgucagcguccucaccguccuccaccaagauuggcuaaacgguaaagaauacaaaugcaaagucuccaacaaagcccucccagccccaaucgaaaaaaccaucucaaaagcaaaaggccaaccccgcgaaccucaagucuacacccuaccccccucccgugaagaaaugaccaaaaaccaagucagucucaccugccucguaaaaggcuucuacccaucggacaucgcagucgaaugggaaucaaacggacaacccgaaaacaacuacaaaacgaccccccccguacucgacucagauggguccuucuuccuuuacuccaaacuaaccguagacaaaucaagauggcaacaaggcaacgucuucuccugcucugucaugcacgaagcacuccacaaccacuacacgcaaaaaucccucucacucucacccggcaaa

SEQ ID NO: 54564 - RNA, 639 nt, Artificial Sequence
  derived and/or modified sequence opt11 from Suvratoxumab_LightChain
gacauacaaaugacccaaucccccuccacccucucagcauccgucggcgaccgcgucaccaucacaugccgagccucccaaucaaucucauccuggcucgccugguaccaacaaaaacccggcaaagcccccaaacuccuaaucuacaaagccuccucccucgaauccggcguccccucacgcuucucaggcuccggcuccggaacagaauucacccucaccaucuccucccuacaacccgacgacuucgccaccuacuacugcaaacaauacgccgacuacuggaccuucggccaaggcaccaaagucgaaaucaaacgcacaguagccgcccccagcgucuucaucuucccccccucagacgaacaacuaaaauccggcaccgccuccgucgucugccuacucaacaacuucuacccccgcgaagccaaaguccaauggaaagucgacaacgcccuacaauccggcaacucccaagaauccgucaccgaacaagacuccaaagacuccaccuacucccucuccuccacccucacccucuccaaagccgacuacgaaaaacacaaagucuacgcaugcgaagucacccaccaaggccucuccuccccagucaccaaauccuucaaccgcggcgaaugc

SEQ ID NO: 54565 - RNA, 642 nt, Artificial Sequence
  derived and/or modified sequence opt11 from Tadocizumab_LightChain
gacauacaaaugacacaaaccccauccacccucuccgccuccguaggcgaccgcgucaccauauccugccgcgcaucacaagacaucaacaacuaccucaacugguaccaacaaaaacccggcaaagcccccaaacuccuaaucuacuacaccuccacacuucacuccggcguccccucccgcuucuccggcuccggauccggcaccgacuacacccucaccaucuccucccuacaacccgacgacuucgcaaccuacuucugccaacaaggcaacacacuaccauggaccuucggccaaggcaccaaagucgaagucaaacgcacaguagccgcccccuccgucuucaucuucccacccuccgacgaacaacucaaauccggcaccgccuccgucgucugccuucucaacaacuucuacccccgcgaagccaaaguccaauggaaagucgacaacgcccuccaauccggcaacucccaagaauccgucaccgaacaagacuccaaagacucaaccuauucccucuccuccacccucacacuauccaaagccgacuacgaaaaacacaaagucuacgccugcgaagucacccaccaaggccucuccucccccgucaccaaauccuucaaccguggcgaaugc

SEQ ID NO: 54566 - RNA, 1341 nt, Artificial Sequence
  derived and/or modified sequence opt11 from Tanezumab_HeavyChain
caaguccaacuccaagaauccggccccgguuuagucaaacccucagaaacccucagccuaaccugcaccgucucuggcuuuucccucauaggcuacgaccucaacuggauccgacaacccccgggcaaaggacuagaauggauaggcaucaucuggggagacggcaccaccgacuacaacuccgccgucaaaagccgcguaacaauauccaaagacaccucuaaaaaccaauucucccuuaaacuauccuccgucaccgcagcagacacagcuguauacuacugcgcccgaggaggauacugguacgccaccuccuauuacuucgacuacuggggccagggaacacucguaaccguauccuccgccucaaccaaaggccccuccgucuucccccuagcacccugcucacgcuccaccuccgaauccaccgccgcccucggcugccuuguaaaagacuacuucccagaaccggucaccgucagcuggaacuccggcgcucucaccucaggcguccacaccuuucccgccguucuccaaagcucaggccucuauucccucucauccguaguaaccguaccaucaucaaacuucggaacccaaaccuauaccugcaacgucgaccacaaacccuccaauaccaaaguagacaagaccgucgaacgaaaaugcugcgucgaaugcccucccugccccgcaccacccgucgccggccccucuguauuccuauucccacccaaacccaaagacacccucaugauaucgcgaacccccgaagucacaugcgucgucgucgacguaucccacgaagaccccgaaguacaauucaacugguacgucgacggcgucgagguccacaacgccaaaaccaaaccccgcgaggaacaauucaacucaaccuucagagucgucucaguccucaccgucguacaccaggacuggcucaacggcaaagaauacaaaugcaaagucuccaacaaagggcuacccuccucaauugagaaaacuauauccaagacgaaaggccaaccacgcgaaccacaagucuacacucucccucccucccgcgaagaaaugaccaaaaaccaagucucccuaaccugccucgucaaaggcuucuaccccucagacaucgccguggaaugggaauccaacggacaacccgaaaacaacuacaaaaccaccccacccaugcucgacuccgacggcucuuucuuccucuacuccaaacucaccgucgacaaaucacgcuggcaacaaggcaacgucuucuccugcagcgucaugcacgaagcccuccacaaccacuacacccaaaaaucacuaucucucagccccggcaaa

SEQ ID NO: 54567 - RNA, 642 nt, Artificial Sequence
  derived and/or modified sequence opt11 from Tanezumab_LightChain
gacauccaaaugacacaaucucccuccucccucuccgccuccgucggcgaccgagucaccaucacaugccgcgccucucaauccaucuccaacaaccucaacugguaccaacaaaaacccggcaaagccccaaaacuccucaucuacuacaccucccgcuuccacuccggugucccaucccgcuucuccggcuccggauccggcaccgacuucaccuucaccaucucaucccuccaacccgaagacaucgccaccuacuacugccaacaagaacacacccuccccuacaccuucggccaaggcaccaaacucgaaaucaaacgcaccgucgccgcccccucugucuucaucuucccacccuccgacgaacaacuaaaauccggcaccgccuccguagucugccuacucaacaacuucuacccccgcgaagccaaaguccaauggaaagucgacaacgcccuccaauccggcaacucccaagaauccgucaccgaacaagacucuaaggacuccaccuauucccucuccuccacccucacccucuccaaagccgacuacgaaaaacacaaagucuacgccugcgaagucacucaccaaggccucuccucccccgucaccaaauccuucaaccgcggcgaaugc

SEQ ID NO: 54568 - RNA, 1353 nt, Artificial Sequence
  derived and/or modified sequence opt11 from Tavolixizumab_HeavyChain
caaguccaacuacaagaaucaggaccgggccucgucaaaccaucgcaaacccucucccuaaccugcgccgucuacggcggaucauucucaucaggauacuggaacuggauaagaaaacaccccggcaaaggccuggaauacaucggguacaucucauacaacggaaucacauaccacaacccaucacuaaaauccagaaucaccaucaaccgcgauaccuccaaaaaccaauacucacuccaacucaacuccgucacccccgaagacaccgccgucuacuacugcgccagauacaaauacgauuacgauggcggacacgccauggacuacuggggacaaggcacacucgucaccguauccucugccuccaccaaaggacccuccgucuucccacucgcgcccucauccaaaagcaccucaggcggaaccgcugcccucggcugccuagucaaagacuacuuccccgaaccagucaccguauccuggaacucuggagcacucaccuccggcguccacaccuucccagcaguccuccaaucaucaggccuguacucacucuccagcguugucaccguucccagcuccucccucggcacccaaacauacaucugcaacgucaaccacaagcccucaaacaccaaagucgacaagagagucgaaccaaaaucaugcgacaaaacacacaccugucccccaugccccgcacccgaacuccuaggcggccccucugucuuccucuuuccacccaaaccuaaagacacccucaugaucucccgcacccccgaaguaaccugcgucgucgucgacgucucccacgaagaccccgaaguaaaauucaacugguacgucgacggcgucgaagugcacaacgcaaaaaccaaaccccaagaggaacaguacaacuccaccuaccgcgucgucucaguccucaccguccuccaccaggacuggcucaauggcaaagaauacaaaugcaaagucuccaacaaggcacuacccgcccccauugagaaaaccaucuccaaagccaaaggccaaccccgcgaaccccaagucuacacccuucccccuucccgcgaagaaaugaccaaaaaccaagucucacuaaccugccucguaaaaggcuucuaccccucugacaucgcagucgaaugggaauccaacggccaacccgaaaauaacuacaaaaccaccccaccaguccucgacucugacggcucauucuuccucuacucaaaacucacugucgacaaaucccgcuggcaacaaggaaacguauucuccugcucugucaugcacgaagcccuucacaaccacuacacccaaaaaucccuuucacuauccccuggcaaa

SEQ ID NO: 54569 - RNA, 642 nt, Artificial Sequence
  derived and/or modified sequence opt11 from Tavolixizumab_LightChain
gacauccaaaugacacaaucccccuccucccucucagcaucagucggcgaccgcguaaccaucacaugccgcgccucacaagacaucuccaacuaccucaacugguaccaacaaaaacccggcaaagcccccaaacuccuaaucuacuacaccuccaaacuccacucaggagucccauccagauucuccggcuccggcuccggcaccgacuacacccucaccaucuccucccuccaacccgaagacuucgccaccuacuacugccaacaaggcuccgcccuccccuggaccuucggccaaggcaccaaagucgaaaucaaacgcaccgucgccgcccccuccgucuucaucuucccacccucagacgaacaacugaaauccggcaccgccucagucgucugccuacucaacaacuucuacccccgcgaagccaaaguccaauggaaagucgacaacgcacuccaaucaggcaacucacaagaauccgucaccgaacaagacuccaaagacuccaccuacucccucucauccacccuaacccucuccaaagccgacuacgaaaaacacaaagucuacgccugcgaagucacccaccaaggacucuccucccccgucaccaaauccuucaaccgcggcgaaugc

SEQ ID NO: 54570 - RNA, 1335 nt, Artificial Sequence
  derived and/or modified sequence opt11 from Telisotuzumab_HeavyChain
caaguccaacucguccaauccggagcagaaguuaaaaaaccuggagcaucaguaaaagucuccugcaaagccuccggauacauauucaccgccuacaccaugcacugggucagacaagcccccggccaaggccucgaauggaugggauggauaaaacccaacaacggccucgccaacuacgcacagaaauuccaaggcagagucacaaugacccgcgacacuuccauaucaaccgccuacauggaacucucccgccuaagaucagacgauaccgcggucuacuacugugcccgcuccgaaauaaccaccgaauucgacuacuggggccaagguacccucgucacuguauccucagccagcacaaaaggccccuccgucuucccccucgcaccauccucaaaauccaccuccggaggaacagccgcacucggcugccucguaaaggacuacuucccugaaccagucaccgucucguggaauagcggcgcccucaccagcggaguacacaccuuccccgccguccuccaaucauccggacucuacucccugagcuccgucgucaccguccccuccucaucccucggcacccaaacauacaucugcaacgucaaccacaaaccuagcaacaccaaagucgacaaacgcgucgaacccaaauccugcgacugccauugcccccccugccccgcccccgaacuccucggaggcccaucagucuuccuauucccgccuaagcccaaggacacccucaugauaucccgcacccccgaagucaccugcguagucguugacgucucccacgaagacccagaagucaaguucaauugguacgucgacggcgucgaaguccacaacgccaaaacuaaacccagagaagaacaauauaacucaacauaccggguggucuccguacuuaccguacuccaccaggacuggcucaacgguaaagaauauaaaugcaaagucuccaacaaagcccuacccgcaccaaucgaaaaaacuaucuccaaggccaaaggccaaccccgagaaccccaagucuacacucugccccccucccgagaagaaaugacuaaaaaccaagucucccuuaccugccucgucaaaggcuucuaccccuccgacaucgccguagaaugggaauccaacggccaacccgaaaacaacuacaaaaccacaccccccguccucgacucugacggaucauucuuccuguacuccaaacucaccgucgacaaaagccgcuggcaacaaggcaacgucuucuccugcuccguaaugcacgaagcccuccacaaccacuacacccaaaaaucucucucccucuccccaggc

SEQ ID NO: 54571 - RNA, 654 nt, Artificial Sequence
  derived and/or modified sequence opt11 from Telisotuzumab_LightChain
gacaucguaaugacgcaaucgcccgacagccuggccgugagcuuaggcgagcgcgcgaccauaaacugcaaaucgagcgagagcguagacucguacgcgaacucauuccugcacugguaccagcaaaagcccgggcaaccgcccaaacuccugaucuaccgcgcaagcacacgcgagagcggagucccagaccgguucucgggcucgggcucgggcacggacuucaccuuaaccauauccucgcuccaggccgaggacguagccguguacuacugccagcaaucgaaagaggacccgcucacguucgggggagggaccaaggucgagaucaagcgcacaguagcggccccgagcguguucauauucccgcccuccgacgagcaacugaaaucgggcacggccucagucguaugccugcucaacaacuucuacccgcgcgaggccaaaguccaguggaaaguagacaacgcgcuccagagcggaaacucacaagaaagcgugaccgagcaagacagcaaggacucaaccuacagccugagcucaacccuaacccugagcaaagccgacuacgaaaaacacaaaguauacgcaugcgaggucacgcaccagggccugagcucgcccguaaccaagagcuucaacaggggcgagugc

SEQ ID NO: 54572 - RNA, 1335 nt, Artificial Sequence
  derived and/or modified sequence opt11 from Telisotuzumab_vedotin_HeavyChain
caaguccagcuaguccaaucgggugccgaaguaaagaaacccggcgccuccgugaaagucucauguaaagccuccgguuacaucuucacagcauacaccaugcacuggguccgccaagcacccggccaaggccuagaauggaugggcuggauaaaacccaacaacggccuagccaacuacgcccaaaaauuccaagggcgcgucacaaugacccgcgacacauccauauccaccgccuacauggaacucucccgccuccgcucagaugacacugccgucuacuacugcgccagauccgaaauaaccaccgaguucgacuacuggggccaaggcacccucgucaccgucucaagcgccuccaccaaaggacccuccgucuucccccucgcccccuccuccaaauccaccuccggcggcaccgccgcccuuggcugccucguaaaagacuauuuccccgaacccgucacagucuccuggaacuccggcgcccucacauccggcguacacaccuucccagccguccuucaauccagcggccucuauucccucuccuccgucgucacagucccaagcuccucucucggcacccaaacauacaucuguaacguuaaccacaaaccaucaaacaccaaagucgacaaacgcgucgaaccaaaaucaugcgacugccacuguccacccugucccgcccccgaacugcuaggcggccccuccgucuuucuauuucccccuaaacccaaagacacccuaaugaucagccgaacccccgaagucacaugcgucguaguagacgucucccacgaagaccccgaagucaaauucaacugguacgucgacggcgucgaaguacacaacgccaaaaccaaaccaagagaagaacaguacaacuccaccuaccgaguagucagcguacucacaguccuacaccaagacuggcucaacggcaaagaauacaaaugcaaagucuccaauaaagcccuacccgcacccaucgaaaagaccauaucaaaagccaaaggccaaccccgcgaaccacaaguauacacccucccacccagccgagaagaaaugaccaaaaaccaaguaucccuaacaugccuaguuaaaggcuucuaccccuccgacauagccgucgaaugggaauccaacggccaacccgaaaacaacuacaaaacaaccccgcccguccuagacucagacggaucauucuuccuauauuccaaacuaaccgucgacaaaucuagauggcaacaaggaaacgucuucuccugcuccguaaugcacgaagccuuacacaaccacuacacacagaaaagccuuucccucucccccgga

SEQ ID NO: 54573 - RNA, 654 nt, Artificial Sequence
  derived and/or modified sequence opt11 from Telisotuzumab_vedotin_LightChain
gacaucguaaugacgcaaucgcccgacagccuggccgugagccugggcgaacgcgcgaccauaaacugcaaaucaagcgaaagcguggacucauacgcaaacucguuccugcacugguaccagcaaaagcccgggcaaccacccaagcuccugaucuaccgcgcaagcacacgcgaaagcggggucccagacagauucucaggcucgggcucaggcacagacuucacccuaaccaucagcucgcuccaggcagaagacguagccguauacuacugccagcaaucgaaagaggacccacucacguucgggggcggaaccaaggucgaaaucaagcgcacagucgcggccccgagcguauucauauucccgcccucggacgaacaacugaaaucaggcacagccucagucguaugccuacuuaacaacuucuacccgcgcgaggccaaaguccaguggaaagucgacaacgcgcuccaaagcgggaacucacaagaaagcgugaccgaacaagacagcaaagacucaacauacagccuaagcucaacccuaacccuaagcaaggccgacuacgagaaacacaaaguguacgcgugcgaagucacacaccagggccuaagcucgcccgugaccaagagcuucaacagaggagaaugc

SEQ ID NO: 54574 - RNA, 1350 nt, Artificial Sequence
  derived and/or modified sequence opt11 from Timigutuzumab_HeavyChain
gaaguccaacucgucgaaucagggggcggccucguccagccaggaggcucacuccgccucuccugcgccgcauccggcuucaacaucaaagacaccuacauccacuggguccgccaagcccccggcaaaggccucgagugggucgcacgcauauaccccacgaacggcuacacaagguacgccgacucagucaaaggccgauucacaauuucagcagacaccuccaaaaacacagccuaccuccaaaugaacucccuucgcgcagaagacaccgcagucuacuacugcucucgcuggggcggcgacggcuucuacgcaauggacuacuggggccaaggcacccucguaaccgucucaucagccuccaccaaaggccccuccgucuuuccccucgcccccucaucuaaaagcaccuccggcggcacugccgcccucggcugccucgucaaagacuacuuccccgaacccguaacagucuccuggaacucaggcgccuuaaccagcggcguccacaccuuccccgccguccuccaauccuccggccucuacucccucuccucggucguaaccgucccauccucaucucucggaacacaaacauacauaugcaacgucaaccacaaacccuccaacacaaaaguagacaagaaagucgaaccaaaauccugcgacaaaacccauaccugcccacccugccccgcccccgaacuccucggcggacccagcguauuccuauucccgcccaaacccaaagacacccucaugaucucucguacccccgaaguuacuugcgucgucgucgacgucucccacgaggaccccgaagucaaauuuaacugguacguagacggcgucgagguccacaacgccaaaaccaaaccacgcgaagaacaauacaauuccacauaccgagucgucagcguccugacaguacuccaccaagacuggcuaaacggcaaagaauacaaaugcaaaguaagcaacaaagcacuccccgcacccaucgagaaaaccaucucaaaagccaaaggccaaccccgcgaaccacaaguauacacacuacccccaucacgcgacgaacucaccaaaaaccaaguuucccuaaccugccucgucaaagguuucuaccccuccgauaucgccguagaaugggaauccaacggccaacccgaaaacaacuacaaaacgaccccacccguacucgacucugacggauccuucuuucucuacuccaaacucaccguagacaaaucccgcuggcaacaaggcaacgucuucuccugcucaguaaugcacgaaggacuccacaaccacuacacccaaaaaucacucucccucucaccaggcaaa

SEQ ID NO: 54575 - RNA, 642 nt, Artificial Sequence
  derived and/or modified sequence opt11 from Timigutuzumab_LightChain
gacauccaaaugacccaaucacccuccucccuauccgccuccguaggcgaccgcguaaccaucaccugccgcgccucccaagacguaaacaccgcagucgccugguaccaacaaaaacccggcaaagcccccaaacuccuaaucuacuccgccucauuccucuacuccggcguccccucccgcuucuccggcucccgcuccggcaccgacuucacccucaccauauccucacuccaacccgaagacuucgccaccuacuacugccagcaacacuacacaaccccccccaccuucggccaaggcaccaaagucgagaucaaacgcaccgucgccgcccccagcguauucauauucccccccuccgacgaacaauuaaaauccggcaccgccuccgucgucugccuacucaacaacuucuacccccgcgaagccaaaguccaauggaaagucgacaacgcacuccaauccggaaacucccaagaauccgucaccgaacaagacuccaaagacuccaccuacucccucuccuccacccucacccucuccaaagccgacuacgaaaaacacaaaguauacgcaugcgaagucacccaccaaggccucuccucccccgucacuaaauccuucaaccgcggcgaaugc

SEQ ID NO: 54576 - RNA, 1332 nt, Artificial Sequence
  derived and/or modified sequence opt11 from Timolumab_HeavyChain
caaguccaacucgucgaaaguggcggaggcgucguccaacccggccgcucccuacgccucuccugcgcagccuccggauucacauucuucuccuacgccaugcacuggguacgucaaacacccggaaaaggccucgaaugggucgccguaauaugguucgacgggucaaacgaaaacuacguugacuccguaaaaggccgcuucaccauaucccgcgacaacuccaaaaacacccucuaccuacaaaugaacacuuuacgagccgaagacacagcagucuacuacugcgcacgagacgccugguccuacuucgacuacuggggccaaggcacacucgugacagucuccuccgccuccaccaaaggccccuccgucuucccacucgccccaugcucccgaucaaccagcgaaucaacagccgcucuagguugccugguaaaagacuacuuccccgaaccaguaaccgucucauggaacucaggagcccucacaagcggcguccacaccuuccccgccguacuacaauccuccggccucuacagccucucauccgucguaacagucccaaguuccagccuaggcaccaaaacauacacaugcaacguugaccauaaacccucaaauaccaaagucgacaaaagagucgaauccaaauacggaccgcccugcccacccugccccgcacccgaguucgccggcggacccuccguauuccuauucccucccaaacccaaagacacccucaugaucagcagaacacccgaaguaaccugcgucguagucgacgucucccaagaagaccccgaaguccaauucaacugguacgucgacggcgucgaaguccacaacgccaaaaccaaaccccgcgaagaacaauucaacuccaccuacagagucguaucaguccuaaccguacuacaccaagacuggcuaaacggcaaagaauacaaaugcaaagucucaaacaaaggccuacccuccuccaucgagaaaaccaucagcaaggcaaagggccaaccccgcgaaccacaaguauacacccucccaccgucacaagaagaaaugaccaagaaccaagucucccuaaccugccucgucaaaggcuucuacccuagcgacaucgcagucgaaugggaauccaacggccaaccagaaaacaacuacaagaccacaccacccguccuagacuccgauggcagcuucuuccuguacucacgccuaaccguagacaaaucacgauggcaggaaggaaacguguucagcugcucaguaaugcacgaagcacuccacaaccauuacacccaaaaaucccucucccuaucccuaggaaaa

SEQ ID NO: 54577 - RNA, 642 nt, Artificial Sequence
  derived and/or modified sequence opt11 from Timolumab_LightChain
gucauccaacucacccaaucccccuccucccucuccgccuccgucggcgaccgcgucaccaucacaugccgcgccucccaaggcaucuccagagcccucgcaugguaccaacaaaaacccggcaaaggccccaaacuccucaucuacgacgccucaucacucgaauccggaguccccucccgcuucuccggcuccggcuccggcaccgacuucacccucaccaucuccucacuccaacccgaagacuucgccaccuacuacugccaacaauucaacuccuacccacucacauucggaggcggcaccaaagucgaaaucaaacgaacagucgccgcccccagcgucuucaucuucccacccuccgacgaacaacucaaauccggcaccgccucagucgucugccuccucaacaacuucuacccccgcgaagccaaaguccaauggaaagucgacaacgcccuccaauccggcaacucccaagaauccgucaccgaacaagacuccaaagacuccaccuacucccucuccucaacccucacccucuccaaagccgacuacgaaaaacacaaaguauacgccugcgaagucacccaccaaggccucuccucccccgucaccaaauccuucaaccgcggcgaaugc

SEQ ID NO: 54578 - RNA, 1347 nt, Artificial Sequence
  derived and/or modified sequence opt11 from Tomuzotuximab_HeavyChain
cagguccaacucaaacaauccggcccaggccucguacaacccucccaaagccucagcaucacgugcaccgucucgggcuucucccuaaccaacuacggcguccacuggguccgccaauccccaggaaaaggccucgaauggcucggagucaucuggucaggcggcaacaccgauuacaacacccccuucacaagccgucucucaaucaacaaagacaacuccaaaucccaagucuucuucaaaaugaacucccuccaaucaaacgacaccgccaucuacuacugcgcacgugcccucaccuacuacgacuacgaauuugcuuacuggggccaaggcacacucgucacagucucaaccgccuccaccaaaggccccucagucuucccacuagccccuuccuccaaaucuaccagcggcggcaccgccgccuuaggcugccucgugaaagacuauuucccagaacccguaacgguuucuuggaacuccggcgcacucacauccgguguccacaccuuccccgccguccuucaaucauccggccucuacucucuuuccucagucgucaccguucccuccuccucccucggcacacaaaccuacaucugcaacgucaaccacaaacccucgaacaccaaagucgacaagaaaguagaaccuaaauccugcgacaaaacccauaccugcccucccugccccgcacccgaacuccucggcggcccauccguauuccuauucccacccaaacccaaagacacccuaaugaucucaaggacacccgaaguaaccuguguaguaguugacgucucccacgaagaccccgaaguuaaauucaacugguacguagacggcgucgaaguccacaacgccaaaaccaaaccccgcgaggaacaauacaacucaaccuaccgcguugucucaguccuaaccguccuccaccaggacuggcuaaacggcaaagaauacaaaugcaaagucuccaacaaagcacucccugcaccuaucgaaaagacaaucuccaaagcaaaaggccaaccccgcgaaccccaggucuacacccuaccacccucccgcgacgaacucaccaaaaaccaagucucccucaccugucucgucaaaggcuucuaccccucagacaucgcaguagaaugggaaucaaacggccagcccgaaaacaacuauaaaacuaccccgcccguccucgacagcgacggcuccuucuuccuuuacuccaaacuaaccguagacaaaucccgcuggcaacaaggcaacguuuucuccugcucugucaugcacgaaggacuccacaaccacuacacccaaaaaucacuaucacucucccccggcaaa

SEQ ID NO: 54579 - RNA, 642 nt, Artificial Sequence
  derived and/or modified sequence opt11 from Tomuzotuximab_LightChain
gacauccuccucacccaaagccccgucauccucuccgucucccccggcgaacgcguauccuucuccugcagagccucccaaucaaucggcaccaacauccacugguaccaacaaagaaccaacggcucaccccgccuccucaucaaauacgccuccgaauccaucuccggcauccccagccgauucuccggcuccggcuccggcaccgacuucacccucuccaucaacuccgucgaaagcgaagacaucgccgacuacuacugccaacaaaacaacaauuggccaaccacauucggcgccggaaccaaacucgaacucaaacgcaccgucgccgccccauccgucuucaucuucccacccuccgacgaacaacuaaaauccggcaccgccucagucgucugccuccucaacaacuucuacccccgcgaagccaaaguacaauggaaagucgacaacgcccuccaauccggcaacucucaagaauccgucaccgaacaagacuccaaagacuccaccuacucacuaagcuccacccuaacccucuccaaagccgacuacgaaaaacacaaagucuacgccugcgaagucacccaccaaggccucuccucucccgucacaaaauccuucaaccgaggcgaaugc

SEQ ID NO: 54580 - RNA, 1347 nt, Artificial Sequence
  derived and/or modified sequence opt11 from Trastuzumab_duocarmazine_HeavyChain
gaaguccaacuggucgaauccggcggcggccucguacaaccagggggaucccugagacuaucaugcgccgcauccggcuucaacaucaaagacacauacauccacuggguccgucaagcccccggcaaaggacucgaaugggucgccagaauauaccccaccaauggcuauacccgcuacgcagacagcgucaaaggccgcuucacuaucuccgccgacaccuccaaaaacacagccuaccuccagaugaacucauuacgcgccgaagacaccgccgucuacuacugcucccgcuggggcggugacggcuucuacgccauggacuacuggggccaggguacccuaguaaccguaagcuccgccuccacuaaaggcccauccguauucccccucgcccccucauccaaguccaccagcggcggcaccgcagcccuaggcugccucgucaaagacuacuuccccgaaccagucaccgugucuuggaacucgggcgcccuuaccagcggcguccacacauuccccgcaguccuccaaucuuccggacucuacucacuauccucuguagucaccguucccucauccucacucgggacacaaacauacaucugcaacgucaaccacaaaccaagcaacacaaaagucgacaagaaagucgaaccaaaauccugcgacaaaacucauacauguccacccugccccgcacccgaacuccuuggcggccccuccguauuccucuucccacccaaaccaaaagacacccucaugaucuccagaacacccgaagugacaugcgucgucgucgacgucucacacgaagaccccgaagucaaauucaacugguacgucgacggcgucgagguacacaacgcaaaaacuaaaccccgcgaagaacaguacaacuccaccuaccgagucguauccguccuaaccguccuccaccaagacuggcucaacggaaaagaauacaaaugcaaaguaagcaauaaagcccuccccgccccaauagagaaaacaauaucaaaagcaaaaggccaaccccgggaaccccaagucuacacccucccacccagccgagaagaaaugaccaaaaaccaagucuccuuaaccugccucgucaaaggcuucuacccauccgacaucgccgucgaaugggaauccaacggccaacccgaaaauaacuacaaaaccaccccacccgugcucgacagugacggcucauucuuccuuuacuccaaacuaaccgucgacaaauccagauggcaacaagguaacguauucuccugcucugucaugcacgaagcccuacacaaccacuacacacaaaaaucccucucccucagucccggc

SEQ ID NO: 54581 - RNA, 642 nt, Artificial Sequence
  derived and/or modified sequence opt11 from Trastuzumab_duocarmazine_LightChain
gacauccaaaugacccaaucccccuccucccuaagcgcauccgucggcgaccgcgucaccauaacaugccgcgccucccaagacgucaacaccgccgucgccugguaccaacaaaaaccaggcaaagcccccaaacuccucaucuacuccgcauccuuccucuacagcggcguacccucacgauucuccggcucccguucaggcaccgacuucacccucaccauauccucacuccaacccgaagacuucgccaccuacuacugccaacaacacuacaccaccccccccaccuucggacaaggcaccaaagucgaaaucaaacgcaccgucgcagcccccuccgucuucaucuucccccccucagacgaacaacucaaauccggcacagccuccgucguaugccuucucaacaacuucuacccccgagaagccaaaguccaauggaaaguagacaacgcccuccaaucaggcaacucccaagaauccgucaccgaacaagacuccaaagacuccaccuacagccucagcuccaccuuaacccucuccaaagccgacuacgaaaaacacaaagucuacgccugcgaagucacacaccaaggccucuccucacccgucacaaaauccuucaaccgcggcgaaugc

SEQ ID NO: 54582 - RNA, 1368 nt, Artificial Sequence
  derived and/or modified sequence opt11 from Varisacumab_HeavyChain
caaguccaacucguccaauccggcgccgaagucaagaaaccaggcgccuccgucaaagucucaugcaaagccuccggaggcacauucucuuccuacgccaucuccuggguccgccaagcccccggccagggccucgaauggauggguggcuucgaccccgaagacggcgaaacgauauacgcgcaaaaauuccaaggccgcgucaccaugaccgaagauacgucaacagacaccgccuacauggaacuauccucccuacgcuccgaagacaccgcagucuacuacugcgcaaccggccggagcauggucagaggcgucaucauccccuucaacggaauggacguauggggccaaggcacaacaguaacagucuccuccgccagcacaaaaggaccaucaguauucccccuagcacccuccuccaaaucaaccuccggcggaaccgccgcacucggcugccucguaaaagacuacuuccccgaaccagucaccguaucauggaacucaggagcacucaccuccgggguacacaccuuccccgcaguccuccaauccagcggccuuuacucacucuccagcgucguaaccgucccaagcuccagccucggcacacagaccuacaucugcaacgucaaccacaaacccuccaacaccaaaguagacaagaaagucgaacccaaauccugcgacaaaacacacaccugucccccaugcccagcacccgaacuacugggaggccccucagucuuccucuucccacccaaacccaaagacacccucaugaucucucgcacccccgaagugaccugcgucgucguagacgucucccacgaggacccugaagucaaauucaacugguacguagacggcgucgaaguccacaacgccaaaaccaaaccacgcgaagaacaauacaacucaaccuaccgcguaguauccguacuaaccgucuuacaccaagacuggcucaacggcaaagaauacaagugcaaagucuccaacaaagcccuuccugcccccauagagaaaacaaucucaaaagcaaaaggccagccccgcgaaccccaaguuuacacccuaccgcccucucgagacgaacuaaccaaaaaccaagugucccucacaugccuagucaaggguuucuaccccuccgacauagccgucgaaugggaaucaaacggacaacccgaaaauaacuacaaaacaacaccacccguccucgacucagacggcuccuucuuccucuauuccaaacuaaccguagacaaauccagauggcaacaaggcaacgucuucuccuguucagucaugcacgaagcacuccacaaccacuauacccaaaagucacucucacucucacccggcaaa

SEQ ID NO: 54583 - RNA, 642 nt, Artificial Sequence
  derived and/or modified sequence opt11 from Varisacumab_LightChain
gacauccgaaugacccaaucccccucaucccucuccgccuccgucggcgaccgcgucaccauaaccugccgcgccucacaauccaucuccucauaccucaacugguaccaacaaaaacccggcaaagcccccaaacuccucaucuacgccgccuccucacuccaaucaggcguacccucucgcuucuccggcuccggcuccggcaccgacuucacccucaccaucuccucccuccaacccgaagacuucgccaccuacuacugccaacaauccuacuccacaccccucaccuucgguggcggaaccaaaguagaaaucaaacgcaccgucgccgcccccucagucuucauauucccacccuccgacgaacaacucaaauccggaaccgccuccgucgucugccuccucaacaacuucuacccccgcgaagccaaaguccaauggaaagucgacaacgcccuccaauccggaaacucccaagaauccgucaccgaacaagacuccaaagacuccaccuacucccuauccuccacccucacccucucaaaagccgacuacgaaaaacacaaaguauacgccugcgaagucacccaccaaggccucuccucccccgucaccaaauccuucaaccgaggcgaaugc

SEQ ID NO: 54584 - RNA, 1359 nt, Artificial Sequence
  derived and/or modified sequence opt11 from Vunakizumab_HeavyChain
gaaguccagcuaguccaauccggcgccgaagucaagaaacccggcgcaagcgucaaagucuccugcaaagccuccggcuacaccuucaccgacuacgaaguccacuggguccgccaagcccccggacaaggacuagaauggaugggagucaucgaccccggaacagguggcgucgcauacaaccaaaaauucgaaggaagagucacaaugacugccgacaccucgaccucuaccgccuacauggagcuacgcucacuccgcuccgacgacacugccgucuacuacugcacccgcuacucccucuucuacggcuccuccccuuacgccauggacuacuggggccaaggcacauuaguuaccgucagcuccgccuccaccaaaggccccuccguauucccccuagcacccuccagcaaauccaccagcggaggcacagcagcucucggaugccuagucaaagacuacuucccagaaccugucaccgucucauggaacucaggcgcccucaccucaggcguccacacguuccccgccguacuccaaucaucaggacucuacucccucuccucaguagucaccguccccagcucaagccucggcacccaaaccuacaucugcaacguaaaccacaaaccauccaacaccaaagucgacaagaaaguagaacccaaauccugcgauaaaacccauaccugcccaccaugccccgcucccgaacuacucggcggaccaucagucuuccuauucccacccaaacccaaagacacccucaugauaagcagaacccccgaagugaccugcgucguagucgacgucagccacgaagaccccgaaguaaaauucaacugguacguagacggcguagaaguccacaacgcaaaaaccaaaccccgcgaggaacaauacaacagcaccuaccgcguaguauccguacucacaguccuucaccaagacuggcucaacggcaaggaguacaaaugcaaagucagcaacaaagcacuccccgcacccauagagaaaaccauaagcaaagcgaaaggacaaccacgcgaaccccaagucuacacccucccacccucccgcgaagaaaugacuaaaaaccaaguaucacugaccugcuuggucaaaggcuucuacccaucagacaucgcagucgaaugggaauccaacggacaacccgaaaacaacuacaaaacaacacccccaguccucgacuccgauggcuccuucuuccucuacuccaaacuaaccgucgacaaaucacgcuggcaacaaggcaacgucuucuccugcucagugaugcacgaagcccuacacaaccacuacacccaaaagucccucucccucagcccuggcaaa

SEQ ID NO: 54585 - RNA, 639 nt, Artificial Sequence
  derived and/or modified sequence opt11 from Vunakizumab_LightChain
gaaaucguccucacccaaucacccgacuuccaauccgucacccccaaagaaaaagucaccaucacaugcucagccuccuccucagucaacuacaugcacugguuccaacaaaaacccgaccaaucccccaaacucuggaucuaccgcaccuccaaccucgccuccggcguacccucccgcuucuccggcuccggcucaggcaccgacuacacccuaaccaucaacucccucgaagccgaagacgccgccaccuacuacugccaacaacgcuccucauacccuuggaccuucggccaaggcaccaaacucgaaaucaaacgcaccgucgccgcccccuccgucuucaucuucccacccuccgacgaacaacucaaauccggcaccgccuccgucgucugccuacucaacaacuucuacccccgcgaagccaaaguacaauggaaagucgacaacgcccuccaauccggcaacucccaagaaucagucaccgaacaagacuccaaagacuccaccuacucccucuccuccacccucacccuauccaaagcagacuacgaaaaacacaaaguauacgccugcgaagucacacaccaaggccucuccucacccgucaccaaauccuucaaccgcggcgaaugc

SEQ ID NO: 54586 - RNA, 1341 nt, Artificial Sequence
  derived and/or modified sequence opt11 from Xentuzumab_HeavyChain
cagguagaacucgucgaauccggcggcggccuaguucaacccggaggaucacucaggcuaagcugcgcagcauccggauuuaccuucaccuccuacuggauguccuggguccgccaagcccccggcaaaggacucgaacucgucuccuccauaaccaguuacggcuccuucaccuacuacgcagauuccgucaaaggccgauucaccaucucccgcgacaacucuaaaaacacccucuaccuccaaaugaacucacuccgcgcggaagacaccgccguauacuauugcgcacgcaacauguacacccacuucgauuccuggggacaagguacccucgucacagucuccucggccucaaccaaaggccccagcguauucccccucgcacccuccuccaaauccaccucagguggcaccgccgcacucggaugccuggucaaagacuacuuccccgaacccgucaccgucuccuggaacucuggcgcccuaacuuccggaguccauaccuuccccgcuguccuacaaucauccggacucuacucccucucuucagucguaaccguccccuccuccucacucggcacucaaacauacaucugcaacgucaaccacaaaccauccaacacaaaaguugacaagaaagucgaacccaaauccugcgacaaaacccauaccugcccacccugccccgcccccgaacuccuuggcggaccauccgucuuccucuucccucccaaacccaaagacacccuaaugaucucacgcacccccgaaguaaccugcgucgucgucgacguuucccacgaagaccccgaaguaaaauucaacugguacgucgacggcguugaaguacacaacgcaaaaacuaaaccccgcgaggaacaauacaacuccaccuaucgcgucguauccguccucaccguccuccaccaagacuggcucaacggcaaagaauacaaaugcaaagucuccaauaaagcacuccccgcucccauagagaaaaccauauccaaagccaaaggacaaccccgcgaaccacaaguauacacacucccucccucccgagacgaacuaaccaaaaaccaagucucacuaacaugccucgucaaaggcuucuaccccucugacaucgccguggaaugggaaucaaacggccagcccgaaaacaacuacaaaaccacaccacccguccuagacuccgacggcagcuuuuuccuauauuccaaacucaccguagacaaaucccgauggcaacaaggcaacgucuucuccugcuccguuaugcacgaagcccuccacaaccacuacacccaaaaaucacucucccucucccccggcaaa

SEQ ID NO: 54587 - RNA, 648 nt, Artificial Sequence
  derived and/or modified sequence opt11 from Xentuzumab_LightChain
gacaucguacucacccaaccccccuccgucucaggcgcccccggccaacgcgucacaaucuccugcuccggcuccuccucaaacaucggcuccaacuccgucuccugguaccaacaacucccaggaaccgcacccaaacuacucaucuacgacaacuccaaacgccccuccggcguccccgaccgcuucucuggcuccaaauccggcaccucugccucccucgccaucaccggccuccaauccgaagacgaagccgacuacuacugccaaucccgcgacaccuacggcuacuacugggucuucggcggcggcaccaaacucaccguacucggccaaccaaaagccgcacccuccgucacccucuucccccccuccuccgaagaacuccaagccaacaaagccacccucgucugccucaucuccgacuucuaccccggcgccgucaccgucgccuggaaaggagacucaucccccguaaaagcaggcgucgaaaccaccacacccucaaaacaaucaaacaacaaauacgcagccuccuccuaccucucacucacacccgaacaauggaaaucccaccgcuccuacucaugccaagucacccacgaaggcucaaccgucgaaaaaaccgucgcccccaccgaaugcucc

SEQ ID NO: 54588 - RNA, 726 nt, Artificial Sequence
  derived and/or modified sequence opt11 from anti-rabies_SO57_LightChain
auguccguccccaccauggccugggcacuccuacuacucucccuccucacacaaggcaccggcuccugggcccaaucagcccucacacaaccccgcuccgucuccggcucccccggccaauccgucaccaucuccugcaccggaaccuccuccgacaucggaggcuacaauuucgucucuugguaccaacaacaccccggcaaagcccccaaacucaugaucuacgacgccacaaaacgccccucuggcguacccgaccgcuucuccggcuccaaauccggcaacaccgccucccuaaccaucuccggacuccaagccgaagacgaagccgacuacuacugcugcuccuacgccggcgacuacacccccggugucgucuucggcggcggcaccaaacuaaccguccucggacaacccaaagccgccccuucaguaacccucuuccccccuucauccgaagaacuacaagccaacaaagccacacuagucugccuaaucuccgauuucuaccccggagccgucaccguagccuggaaagccgacuccucacccgucaaagccggcguagaaaccaccacccccuccaaacaauccaacaacaaauacgccgccuccuccuaccucucccucaccccagaacaauggaaaucccacagauccuacuccugccaagucacccacgaaggcuccaccgucgaaaaaacagucgcccccacagaaugcucc

SEQ ID NO: 54589 - RNA, 1428 nt, Artificial Sequence
  derived and/or modified sequence opt11 from anti-rabies_SO57_HeavyChain
auggacuggaccuggcgcuuccucuucguggucgccgcugccaccggaguccaaucacaaguccaacucguccaaucuggagccgaaguuaagaaacccggauccuccguaaaagucuccugcaaagccuccggcgguaccuucaaccgcuacaccgucaacuggguccggcaagcccccggccaaggucucgaauggaugggaggcaucauacccaucuucggcaccgccaacuacgcccaacgcuuccaaggacgucuaaccauaacagcugacgagucuaccagcaccgcuuacauggaacucuccucacucagauccgacgacaccgccguuuacuucugcgcacgcgaaaaccuugacaacucaggaaccuauuacuacuucucgggcugguucgaccccuggggacaagggacccuagucacagucuccuccgccucuacaaaaggccccucgguauucccccucgcacccuccucgaaaucaaccagcggaggaacagcagcacugggcugccucgucaaagacuacuuccccgaacccguaaccgucuccuggaacuccggagcccuuaccuccggcguccacacauuccccgccguccuccaaagcagcggacuauacagccucucauccgucguaaccgucccaucuucgucacucggcacccaaacauacaucuguaacguaaaccacaaaccaagcaacaccaaagucgacaaacgagucgaaccaaaauccugugacaaaacacacacaugcccaccuugccccgccccagaacuccucggcggcccguccgucuuccucuucccacccaaacccaaggacacccugaugauaucacgcacacccgaaguaaccugcgucguagucgaugucucccacgaagaccccgaagucaaauucaacugguacguugacggcguagaaguccacaacgccaagaccaaaccccgcgaagaacaauacaacuccacauaccgagucgucuccguacuaaccguccuacaccaggacuggcucaacggcaaagaguacaaaugcaaagucuccaacaaagcacuccccgcacccaucgagaaaaccaucuccaaagcaaaaggacaaccccgagaaccacagguauacacccucccacccucacgugaagaaaugacgaaaaaccaagucucacucacaugccucguaaaagguuucuacccaagcgacaucgccgucgaaugggaaucaaacggccaacccgaaaacaacuacaaaaccacaccucccguccuagacuccgacggcagcuucuuccuguacagcaaacucaccguugacaaaucuagauggcaacaaggcaacgucuucuccugcucugucaugcacgaagcccuccacaaccacuacacccagaaaagccucucacucucccccggaaaa

SEQ ID NO: 54590 - RNA, 696 nt, Artificial Sequence
  derived and/or modified sequence opt11 from anti-rabies_SOJB_LightChain
auggccuggacaguacuccuccucggccuccucucccacugcaccggcuccgucacauccuacguccucacccaaccccccucagucuccguagcccccggcaaaacagcccgaauaaacugcggcggcaacaacaucgaauaccgcuccguccacugguaccaacaaaaauccggccaagcccccgucgccgucaucuacgacaacuccgaccgccccuccggcauacccgaacgcuucuccggauccaaauccggcaacaccgccacccucacaaucucccgaguagaagccggcgacgaagccgacuacuacugucaagucugggacaucuccuccgacgucgucuucggcggcggcaccaaacucaccguccuaggccaacccaaagcagcccccuccgucacacucuuccccccaucauccgaagaacuccaagccaacaaagccacacucguaugccuaaucagcgacuucuaccccggagccgucaccgucgccuggaaagccgacuccucccccgucaaagcaggcgucgaaaccacuacccccuccaaacaauccaacaacaaauacgcagccucuuccuaccucucccucacccccgaacaauggaaaucccaccgauccuacuccugccaagucacccacgaaggcuccaccgucgaaaaaacagucgcccccaccgaaugcucc

SEQ ID NO: 54591 - RNA, 1554 nt, Artificial Sequence
  derived and/or modified sequence opt11 from anti-rabies_SOJB_HeavyChain
auggauacccuguguucuacccugcuccuccuaacaaucccaucuuggguauuaucacaaaucacccucaaagaaaccggcccaacacucgucaaacccacucaaacccucacccuaaccugcacauucuccggauucucacucuccaccucaggcgucggcgucggcuggauccgccaaccacccggcaaagcacucgaaugggucacacucauauacugggacgacgauaaacgcuacucccccucacuagaaaaccguguaacaauccgcaaagacaccucaaagaaucaagucgcacucaccaugaccaacauggacccccuagacaccgguaccuacuacugcgcccaccgccaacacaucuccagcuuccccugguucgacucauggggccaagguacucuagucaccgucucauccgccuccacaaaaggccccucagucuucccccucgcccccugcucacgcuccaccucaggaggcacugcagcacuuggcugccuugucaaagacuauuuccccgaacccgucacugucucauggaacuccggcgcccucaccucaggcguccacacauucccagccguccuccaaucuucgggccucuacucccucuccagcgucguaacagucccauccucaucucucggcacacaaaccuacacgugcaauguaaaccacaaacccucaaacaccaaagucgacaagcgcgucgaacucaaaacuccccuuggcgacaccacccacacuugcccccgcugccccgaacccaaauccugcgacacucccccacccugcccccggugcccugagccuaaauccugcgacaccccaccacccugcccacgcuguccagaacccaaauccugcgacaccccaccacccugcccccguugccccgcccccgaacuccuuggaggccccuccguguuccuauucccacccaaaccaaaagacacccuaaugaucucacgcacccccgaagucaccugugucguaguugacgucucccacgaagacccagaaguccaauucaaaugguacgucgacggcgucgaaguccacaaugcaaaaacaaagccccgugaagaacaauuuaacuccaccuuucguguaguuuccguccucacagugcuccaccaagacuggcuuaacggcaaagaauauaaaugcaaagucuccaacaaagcccucccagcccccauugagaaaacaaucuccaaaaccaaaggccaaccccgagaaccccaaguauacacccucccacccucccgcgaagaaaugaccaaaaaucaagucucccuaaccugccucgucaaaggauucuaucccuccgauaucgccgucgaaugggaauccuccggccaaccagaaaacaacuacaacaccacucccccuaugcucgacucagacggcuccuucuuccucuacucuaaacucaccgucgacaaaucccgcuggcaacagggcaacauauucuccugcuccguaaugcacgaagcccuccacaaccgcuucacccaaaaaucccucucacuaucccccggcaaa

SEQ ID NO: 54592 - RNA, 702 nt, Artificial Sequence
  derived and/or modified sequence opt11 from anti-rabies_SOJA_LightChain
auggaagcccccgcccaacuccucuuccuacuccuccucugguuacccgacaccaccggcgaaaucguccucacucaaucacccgccacccucucucuaucccccggagaacgcgccacccuagcuugccgcgccucccaaaccgcuucccgcuaccuagccugguaccaacaaaaacccggccaagccccacgccuccucaucuacgacacauccaaccgcgccaccggcauccccgccagauucucaggcucaggcuccggcaccgacuucacccucuccaucuccucccucgaacccgaagacuucgccgucuacuacugccaacaacgcuucaacuggccauggaccuucggucaaggcaccaaagucgaauuuaaacgcaccgucgccgcccccuccgucuucaucuucccacccucagacgaacaacucaaauccggcaccgccucagucgucugccuccuaaacaacuucuacccccgcgaagccaaaguccaauggaaaguagacaacgcccuccaauccggcaacucccaagaauccgucaccgaacaagacuccaaagacuccaccuacucccuuuccuccacccucacccucucuaaagccgacuacgaaaaacacaaaguauacgcaugcgaagucacccaccaaggccucuccucccccgucacaaaauccuucaaccgcggcgaaugc

SEQ ID NO: 54593 - RNA, 1422 nt, Artificial Sequence
  derived and/or modified sequence opt11 from anti-rabies_SOJA_HeavyChain
auggaauuuggccucuccuggcuauuccucguagcaauccucaaaggcguccagugcgaaguccagcugcucgaaagcggcggaggccuaguucagcccggaggaagccuccgacucucaugcgccgcaucugguuucacauucuccaacuacgcaaugucguggguccgccaagcccccggaaaaggacuugaauggguauccgccaucuccgccucaggccacucgaccuaccuugcagacuccgucaaaggccgauucacaaucucacgagacaacuccaaaaauacacucuaccuacaaaugaacucccuccgggccgaagacacagcagucuacuacugcgcaaaagaccgagaagucaccaugaucgucguccucaacggcggcuucgacuacuggggacaaggcacacgcguaaccguauccuccgccucaaccaaaggacccuccgucuucccccucgcccccucauccaaauccaccucaggcggcacagcagcccucggcugccuaguaaaagacuacuuccccgaaccagucacaguaucauggaacuccggcgcacuaaccagcggcguacacaccuuuccagccguccuccaaucaagcggacuauacucacuuagcuccgucguaaccgucccauccucaucccucggcacccaaaccuacaucugcaacgucaaccacaagcccuccaacaccaaaguggacaaacgcguagaacccaaauccugcgacaaaacacacaccugucccccaugccccgccccagaacuccuuggaggccccuccgucuuccuauucccgcccaaacccaaagacacccuuaugaucucacgaaccccagaagucacaugcgucgucgucgacgucucccacgaagaccccgaaguaaaauucaacugguacgucgauggcguggaaguccacaacgccaaaacuaaaccccgcgaagaacaauacaacagcaccuaccgaguagucagcguccuaaccguccuacaccaagacugguuaaacggcaaggaauacaaaugcaaagucuccaacaaagcccucccagcucccaucgaaaagaccauaucaaaagccaaaggccaaccacgcgaaccccaggucuacacccugccaccauccagagaagaaaugaccaaaaaccaagucucccucacaugccucgucaaaggcuucuaccccagcgacaucgcaguggaaugggaauccaacggccaacccgaaaacaacuacaaaacaacaccucccguacucgacagcgacggaucauucuuccucuacucuaaacucaccguagacaaaucccgauggcaacaaggcaacgucuucuccugcuccgucaugcacgaagcccuccacaaccacuacacccaaaaaucccugucccugucccccggcaaa

SEQ ID NO: 54594 - RNA, 321 nt, Artificial Sequence
  derived and/or modified sequence opt11 from anti-rabies_LightChain
gucaugacccaaucccccgccacccucucccucucccccggcgaacgcgccacccucuccugccgcgccucccaauccguccgcaacuaccucgccugguaccaacaaaaacccggccaagccccccgccuccucaucuacggcgccuccaaccgcgccaccggcauccccgcccgcuucuccggcuccggcuccggcaccgacuucacccucaccaucuccucccucgaacccgaagacuucgccgucuacuacugccaacaacgcuccgacuggccccucuccuucggccaaggcaccaaacucgaaaucaaacgcacc

SEQ ID NO: 54595 - RNA, 333 nt, Artificial Sequence
  derived and/or modified sequence opt11 from anti-rabies_HeavyChain
gggcccgcgugggaggucccggaaacgcucccgguccagcccuuggacucgcccucggucgcgauggcgugcacgggcgugcgccaggccccgggcaagggccuggaaugggucgcggucauaagcuaugacgggagcaauaaauauuacgcggacucggucaagggcagguucacgaucucgcgcgauaacucgaaaaauaccuuguacuugcaaaugaacucgcuaagggccgaggacacggccguguacuauugcgcgaaagauagcaauagcgggagcuauuacgcgcacgaucucggguacuggggccagggcacgcucgugaccgug

SEQ ID NO: 54596 - RNA, 342 nt, Artificial Sequence
  derived and/or modified sequence opt11 from anti-rabies_LightChain
gaacucgucaugacccaauccccccucucccuccccgucacacucggccaacccgccuccaucuccugccgcuccucccaaucccucauccacuccaacggcaacaccuaccucaacugguuccaacaacgccccggccaauccccccgccgccucaucuacaaagucuccgaccgcgacuccggcguccccgaccgcuucucaggcuccggcuccggcaccgacuucacccucaaaaucucccgcgucgaagccgaagacgucggcgucuacuacugccuccaaggcacccacuggccccgcaccuucggccaaggcaccaaacucgaaaucaaacgcacc

SEQ ID NO: 54597 - RNA, 351 nt, Artificial Sequence
  derived and/or modified sequence opt11 from anti-rabies_HeavyChain
gucguccaacccggccgcucccuacgccucuccugcgccgccuccggauucaccuucuccucauacgccaugcacuggguccgccaagcccccggcaaaggccucgaaugggucgccgucaucuccuacgacggcuccaacaaauacuacgccgacuccgucaaaggccgcuucaccaucucccgcgacaacuccaaaaacacccucuaccuccaaaugaacucccuccgcgccgaagacaccgccgucuacuacugcgcccgcgacaaagcccucgccgcccgccgcggcuacuacuacuacuacggcaccgacgucuggggacaaggcacccucgucaccgucucaucc

SEQ ID NO: 54598 - RNA, 648 nt, Artificial Sequence
  derived and/or modified sequence opt11 from anti-RSV_5ITB_LightChain
uccgacauccaaaugacccaaucccccuccacccuauccgcauccgucggcgaccgcgucaccaucacaugccgcgccucccaauccaucuccuccuggcuagccugguaccaacaaaaacccggaaaagcccccaaacuccucaucuacgacgccucaucacucgaauccggcguucccucccgcuucucaggcuccggcuccggcaccgaauuuacccucaccaucuccagccuccaacccgacgacuucgccaccuacuacugccaacaauacaacaccuacucaugguggaccuucggccaaggcaccaaagucgacaucaaacgcaccgucgccgcaccauccgucuucaucuucccacccuccgacgaacaacucaaauccggcaccgccuccgucgucugccuccuuaacaacuucuacccccgcgaagccaaaguccaauggaaagucgacaacgcacuccaauccggcaacucccaagaauccgucaccgaacaagacuccaaagacucuaccuacucccucuccucaacccucacccuuuccaaagccgacuacgaaaaacacaaaguauacgcaugcgaagucacucaccaaggccuauccucccccguaaccaaauccuuuaaccgcggcgaaugc

SEQ ID NO: 54599 - RNA, 660 nt, Artificial Sequence
  derived and/or modified sequence opt11 from anti-RSV_5ITB_HeavyChain
gucgaaucaggcggcggccuaauccaacccggcggcucccuccgccucuccugcgccgucuccggcuucaccgucuccucaaaauacaugaccuggguccgccaagcccccggcaaaggacucgaaugggucucugucaucuacggcggcggcuccacauacuacgccgacuccgucgucggccgcuucaccaucuccagagacaacuccaaaaacacccuauaccuccaaaugaacucccuccgcgccgaagacaccgccgucuacuacugcgccucccgccucggcguccgcgcaacaaccggcgaccucgacuacuggggccaaggcacccuaguaaccgucuccuccgcaucaaccaaaggccccuccguauucccacucgcacccuccucaaaauccacauccggcggcacagccgcccucggcugccucgucaaagacuacuuccccgaacccgucaccgucuccuggaacuccggcgcacucaccuccggcguccacaccuuccccgccguccuccaaucauccggccuauacucacuauccagcgucgucacaguccccuccuccucccucggcacccaaaccuacaucugcaacgucaaccacaaaccauccaacaccaaagucgacaaacgcgucgaaccaaaauccugc

SEQ ID NO: 54600 - RNA, 639 nt, Artificial Sequence
  derived and/or modified sequence opt11 from anti-alpha-toxin_4U6V_LightChain
gacauccaaaugacccaaucccccuccacccucuccgccuccguaggcgaccgcgucacaaucacaugccgcgccucccaauccaucucauccuggcuagccugguaccaacaaaaaccaggcaaagcccccaaacuccucaucuacaaagccuccucacuugaauccggcguccccucccgcuucuccggcuccggcuccggcaccgaauuuacccucaccaucucuucacuccaacccgacgacuucgccaccuacuacugcaaacaauacgccgacuacuggaccuucggccaaggcaccaaagucgaaaucaaacgcaccgucgccgcccccuccgucuucaucuucccacccuccgacgaacaacucaaaucaggcaccgcauccgucgucugccuccucaacaacuucuacccccgcgaagccaaaguccaauggaaagucgacaacgcccuccaauccggcaacucccaagaauccgucaccgaacaagacuccaaagacuccaccuacagccuauccuccacccuuacacuauccaaagccgacuacgaaaaacacaaagucuacgccugcgaagucacccaccaaggccucuccucacccgucaccaaauccuucaaccgcggcgaaugc

SEQ ID NO: 54601 - RNA, 675 nt, Artificial Sequence
  derived and/or modified sequence opt11 from anti-alpha-toxin_4U6V_HeavyChain
gaaguacaacucgucgaaagcggcggcggacucguacaacccggcggcagccuacgccuaagcugcgcagccagcggauucaccuucucaucccacgacaugcacuggguccgacaagcaaccggcaaaggacucgaaugggucagcggaaucggcaccgccggcgacaccuacuacccagacuccguaaaaggccgauucacaaucucacgcgaaaacgccaaaaacagccucuaccuacaaaugaacucacucagagcaggagacacagcaguauacuacugcgcacgcgaccgcuacuccccaaccggacacuacuacggaauggacgucuggggccaaggcacaaccguaaccgucagcucagccucaaccaaaggacccuccguauucccacucgcacccucaagcaaauccacaagcggcggcacagccgcccucggaugccuagucaaggacuacuucccagaacccguaaccgucuccuggaacagcggcgcccuaaccuccggcguacacacauuccccgccguccuccaaucaucaggccuauacucacuaucgagcguagucacaguaccgagcucaagccuaggcacacaaacauacauaugcaacgucaaccacaagcccuccaacacaaaagucgacaaacgcgucgaaccaaaaucaugc

SEQ ID NO: 54602 - RNA, 879 nt, Artificial Sequence
  derived and/or modified sequence opt11 from anti-alpha-toxin_4U6V_Chain-A
gcagacuccgacaucaacauaaaaaccggcaccaccgacaucggcuccaacaccaccguaaaaaccggcgaccuaguaaccuacgacaaagaaaacggcaugcacaaaaaagucuucuacuccuucaucgacgacaaaaaccacaacaaaaaacuccucgucauccgaaccaaaggcaccaucgccggacaauaccgcguauacuccgaagaaggcgccaacaaaucaggccucgccuggcccucagccuucaaaguccaacuccaacucccagacaacgaagucgcccaaaucuccgacuacuacccaagaaacuccaucgacacaaaagaauacauguccacccucaccuacggcuucaacggcaacgucacaggcgacgacacaggcaaaaucggcggacucaucggcgccaacguuuccaucggccacacccucaaauacguccaacccgacuucaaaaccauccucgaaagccccaccgacaaaaaaguaggcuggaaaguaaucuucaacaacaugguaaaccagaacuggggccccuacgacagagacuccuggaacccaguauacggcaaccaacucuucaugaaaacccgcaacggcagcaugaaagccgccgacaacuuccuggaccccaacaaggcaucaagccuacucucauccggcuucucccccgacuucgccaccgucaucacaauggaccgcaaagccagcaaacaacaaaccaacaucgacgucaucuacgaacgcguacgagacgacuaccaacuccacuggaccuccacgaacuggaagggcacaaacaccaaagacaaauggaucgaccgaucaucagaacgcuacaaaaucgacugggaaaaagaggaaaugaccaac

SEQ ID NO: 54603 - RNA, 879 nt, Artificial Sequence
  derived and/or modified sequence opt11 from anti-alpha-toxin_4U6V_Chain-B
gccgacuccgacauaaacauaaaaaccggcaccaccgacaucggcucaaacacaacagucaagaccggcgaccucguaaccuacgacaaagaaaacggaaugcacaaaaaagucuucuacucauucaucgacgacaaaaaccacaacaaaaaacuacucgucauacgaaccaaaggcacaaucgccggccaauaccgcgucuacuccgaagaaggcgccaacaaauccggccucgccuggcccagcgccuucaaaguccaacuccaacuccccgacaacgaagucgcccaaaucucagacuacuacccccgaaacagcaucgacacaaaagaguacauguccacacucaccuacggcuucaacggcaacgucaccggcgacgacaccggaaaaaucggcggccucaucggagccaacgucagcaucggccacacccucaaauacguccaacccgacuucaaaaccauccuagaaucccccacagacaaaaaagucggauggaaagucaucuucaacaacaugguaaaccaaaacuggggccccuacgaccgagacucauggaaccccgucuacggaaaccaacuauucaugaaaacccgaaacggaucaaugaaagccgccgacaacuuccucgacccaaacaaagcauccagccuccuauccuccggcuucucccccgacuucgccaccgucauaaccauggaccguaaagcauccaaacaacaaaccaacaucgacgucaucuacgaacgcguacgcgacgacuaccaacuacauuggacaagcaccaacuggaaaggcaccaacacaaaggacaaauggaucgaccgauccuccgaacgcuauaaaaucgacugggaaaaagaagaaaugacaaac

SEQ ID NO: 54604 - RNA, 642 nt, Artificial Sequence
  derived and/or modified sequence opt11 from anti-IsdB_5D1Q_Chain-A
gacauccaacucacacaaucacccucaucaguauccgccuccgucggcgaccgcaucacaaucacaugccgcgccucccaagacaucuccaacugggucgccugguaccaacaaaaacccggcaaagcccccaaacuccucaucuacagcgcauccucacuccaauccggcgucccaagccgcuucuccggcuccggcucaggcaccgacuucacccucaccaucuccucccuccaacccgaagacuucgccaccuacuacugccaacaagccaacaccuuccccuggaccuucggccaaggaaccaaagucgaaaucaaacgcaccgucgcagcccccuccguauucaucuucccacccucagacgaacaacucaaauccggcaccgccucugucgucugucuucucaacaacuucuacccccgcgaagcaaaaguccaauggaaagucgacaacgcccuccaaagcggcaacucccaagaauccgucaccgaacaagacuccaaagacuccaccuacucccucuccucaacccucacccuaagcaaagccgacuacgaaaaacacaaagucuacgccugcgaagucacccaccaaggccuauccucccccgucaccaaauccuucaaccgaggcgaaugc

SEQ ID NO: 54605 - RNA, 783 nt, Artificial Sequence
  derived and/or modified sequence opt11 from anti-IsdB_5D1Q_Chain-B
caaguacaacucguccaauccggcgccgaaguaaaaaaacccgccuccuccgucaaagucuccugccaggccuccggcggcuccuucuccacacgcacaaucucauggcuacgacaagcaccaggccaaggccucgaauggaugggcggcauaucccccaucuucggagccgccaacuacgcccaacgauuccaaggccgcgucacaaucaccgccgacaaauccaccucaaccgccuacauggaacucaccucacucacuuccgaagacaccgccguauacuacugcgcccgcgaccgcccacccggcgcccaauucgacacauggggccaaggcacccucgucacagucuccucagccuccaccaaaggccccuccgucuucccccucgccccaucaucaaaauccacaagcggcggcacagccgcccucggcugccucgucaaagacuacuuccccgaaccagucaccgucuccuggaacuccggcgcacuaacauccggcguccacaccuuccccgccguccuccaaagcucaggccucuacuccuuauccucagucgucaccgucccaucauccucccuaggcacccaaacauacaucugcaacgucaaccacaaaccauccaacacaaaaguagacaaaaaagucgaaccaaaauccugcggaggaggcucuggccaccaccaccaccaccaccaccaccaccacggaggcgacuacaaagaccacgacggagacuacaaagaccacgacaucgacuacaaagacgacgacgacaaa

SEQ ID NO: 54606 - RNA, 822 nt, Artificial Sequence
  derived and/or modified sequence opt11 from anti-IsdB_5D1Q_Chain-C
gaaguccaacucgucgaauccggcgguggccucguccaaccaggcggcucacuaacacucuccugcgccgccucuggccucaucuucuccgacucaaccaugcacuggguccgccaagccuccggccgcggccuagaaugggucgcccgaauccgcuccaaagccaacaacuacgcaaccucauccgacaaauccgcaaccgccuaccucgccuccgucaaaggccgcuucaccaucucacgcgacgacuccaaagacaccaccuuccuugaaauguccucccucaaaaucgaagacaccgccgucuacuacugcaucgccucauccaccaccggcugguacguacgcgaagacuucgauuacuggggccacggaacacucguaaccguauccuccgcaucaaccaaaggaccauccgucuucccccucgcccccuccucaaaauccaccuccggaggcaccgcagcccucggaugccuuguuaaagacuacuuccccgaacccgucaccgucuccuggaacuccggagcacuaaccuccggcguccacaccuuccccgcaguacuccaauccuccggccucuacucccuguccuccguagucacaguccccuccucaucccucggaacacaaaccuacaucugcaacguaaaccacaaacccuccaacacaaaagucgacaaaaaagucgaacccaaaucaugcggaggcggcuccggccaccaccaccaccaccaccaccaccaccacggaggcgacuacaaagaccacgacggugacuacaaagaccacgacaucgacuacaaagacgacgacgacaaa

SEQ ID NO: 54607 - RNA, 648 nt, Artificial Sequence
  derived and/or modified sequence opt11 from anti-IsdB_5D1Q_Chain-D
gaaaucguccuaacccaaucccccggcacccucucccucucucccggcgaacgcgccacccuauccugccgcgccucccaaucagucuccuccuccuaccucgccugguaccaacagaaaccuggccaagcaccccgccuccucaucuacggcgccucaucccgcgccacaggcauccccgaccgauucuccggcuccggcuccggcaccgacuucacccucucaaucucccgccuagaacccgaagacuucgccgucuauuacugccuacacuacggcaccuccccaauguacaccuucggacaaggaacaaaacuagaaaucaaacgaaccgucgccgccccauccgucuucaucuucccacccuccgacgaacaacucaaaucaggcaccgccagcgucgucugccuacucaacaacuucuacccccgcgaagccaaaguccaauggaaagucgacaacgcccuccaauccggcaacucccaagaauccgucaccgaacaagacuccaaagacuccaccuacucccuaucuucaacccucacccucucaaaagccgacuacgaaaaacacaaagucuacgccugcgaagucacucaccaaggccuuuccucccccgucaccaaauccuucaaccgcggcgaaugc

SEQ ID NO: 54608 - RNA, 360 nt, Artificial Sequence
  derived and/or modified sequence opt11 from anti-IsdB_5D1Q_Chain-E
cccggcaaaaugaccgaccuccaagacaccaaauacgucgucuacgaauccgucgaaaacaacgaauccaugauggacaccuucgucaaacaccccaucaaaaccggcaugcucaacggcaaaaaauacauggucauggaaaccacaaacgacgacuacuggaaagacuucauggucgaaggccaacgcguccgcaccaucuccaaagacgccaaaaacaacacccgcaccaucaucuuccccuacgucgaaggcaaaacccucuacgacgccaucgucaaaguccacgucaaaaccaucgacuacgacggccaauaccacguccgcaucgucgacaaagaagccuucaccaaagccaac

SEQ ID NO: 54609 - RNA, 657 nt, Artificial Sequence
  derived and/or modified sequence opt11 from anti-IsdB_5D1X_Chain-A
gacaucgucaugacccaaucgccccucucccuccccgucacccucggccaacccgccuccaucuccugcuccuccgcccaaucccucguacacucagacggcgacucauaccuuacuugguuccaccaacgacccggucaaucaccccgucgccuaaucuacaaagucuccauacgcgacgccggcguccccgacagauucuccggcuccggauccggcaccgacuucacccucaaaaucucccgcguagaagccgaagacgucggcgucuacuacuguaugcaagccacccacuggccauacaccuucggccaaggcaccaaacucgaaaucaaacgcaccgucgcagcccccagcgucuucauauucccacccuccgacgaacaacucaaaucuggcaccgccucagucgucugccuccuaaacaacuucuacccccgcgaagcaaaaguccaguggaaagucgacaacgcccuccaauccggcaacucccaagaauccgucaccgaacaagacuccaaagacuccaccuacucccucuccucaacccucacccuauccaaagccgacuacgaaaaacacaaagucuacgccugcgaagucacccaccaaggccucucaucucccguaaccaaauccuuuaaccgcggcgaaugc

SEQ ID NO: 54610 - RNA, 777 nt, Artificial Sequence
  derived and/or modified sequence opt11 from anti-IsdB_5D1X_Chain-B
caaguccaacucguccaauccggcuccgaagucaaaaaacccggcucauccgucacacucuccugcaaagcauccggugacaccuucaacacccacaccuacucauggguccgccaagccccaggccaacgccucgaauggaucgguggcaucaugccaaucuucgccgccuccaaaucagccccacaccuccaagacagacucaccaucaccgccaacaaagccacacgaaccgcauacauggaacucaccucccucaccuccgacgacuccggcgucuacuacugcgcacgcgacggccgaggcgcucuccaguacuggggacaaggaacacuagucaccgucuccuccgccuccaccaaaggcccaagcgucuucccacucgcccccuccuccaaauccacaucaggaggcaccgccgcccuaggaugccuagucaaagacuacuuccccgaaccagucaccgucucuuggaacuccggcgcccuaaccuccggcguccacacauuccccgccguccuacaaucaucuggccuauacucccucuccucagucgucacagucccuucauccucccugggcacccaaaccuacaucugcaacgucaaccacaaacccucaaacaccaaagucgacaaaaaagucgaacccaaauccugcggcggcggcuccggccaccaccaccaccaccaccaccaccaccacggcggagacuauaaagaccacgacggagacuacaaggaccacgacaucgacuacaaagacgacgacgacaaa

SEQ ID NO: 54611 - RNA, 822 nt, Artificial Sequence
  derived and/or modified sequence opt11 from anti-IsdB_5D1X_Chain-C
gaaguccaacucgucgaauccggcggcggccucguccaacccggcggcucccucacucucuccugcgccgcauccggccucaucuucucugacucaaccaugcacuggguccgacaagccuccggccgcggccuagaaugggucgcccgcauccgcuccaaagcaaacaacuacgccaccuccucagacaaaucagccaccgcauaccucgccucuguaaaaggacgcuucaccaucucccgcgacgacucaaaagacaccaccuuccucgaaauguccucccucaaaaucgaagacaccgcugucuacuacugcaucgccucauccaccaccggaugguacguccgcgaagacuucgacuacuggggccacggcacccucgucacaguaucauccgccuccacaaaaggccccucaguauucccccucgcccccuccucaaaaucaaccuccggcggcaccgccgcccucggaugccucgucaaagacuacuucccagaacccguuaccgucuccuggaacucaggagcacucaccucaggcguacacaccuuccccgccguccuacaauccuccggccucuacucacuauccuccgucguaaccguccccucaagcucccucggcacccaaacauacaucugcaacguaaaccacaaacccuccaauaccaaagucgacaagaaagucgaacccaaauccugcggcggcggcuccggccaccaccaccaccaccaccaccaccaccacggcggcgauuacaaagaccacgacggcgacuacaaagaccacgacauagacuacaaagacgacgacgacaaa

SEQ ID NO: 54612 - RNA, 648 nt, Artificial Sequence
  derived and/or modified sequence opt11 from anti-IsdB_5D1X_Chain-D
gaaaucguccucacccaaacccccgccacacucucccuaacacccggcgaacgcgccacccucaccugccgcgccucccaaucugucuccuccuccuaccucgccugguaccaacaaaaacccggccaagccccccgccuccucaucuacggagccucaucccgcgccaccggcauccccgaccgcuucuccggcuccggcuccggaaccgacuucacccucucaaucucacgccucgaacccgaagacuucgccgucuacuacugccuccauuacggaacauccccaauguacuucuucggccgcggcaccguccucgacaucaaacgaacagucgccgcccccuccgucuucaucuucccccccucagacgaacaacucaaauccggcaccgccuccgucgucugccuccucaacaacuucuacccccgcgaagccaaaguccaauggaaagucgacaacgcccuccaauccggcaacucacaagaaagcgucaccgaacaagacucaaaagacuccacauacucccucuccuccacccucacccucuccaaagccgacuacgaaaaacacaaagucuacgccugcgaagucacccaccaaggccucucuucacccgucaccaaaucauucaaccgaggcgaaugc

SEQ ID NO: 54613 - RNA, 354 nt, Artificial Sequence
  derived and/or modified sequence opt11 from anti-IsdB_5D1X_Chain-E
aaaaugaccgaccuccaagacaccaaauacgucgucuacgaauccgucgaaaacaacgaauccaugauggacaccuucgucaaacaccccaucaaaaccggcaugcucaacggcaaaaaauacauggucauggaaaccaccaacgacgacuacuggaaagacuucauggucgaaggccaacgcguccgcaccaucuccaaagacgccaaaaacaacacccgcaccaucaucuuccccuacgucgaaggcaaaacccucuacgacgccaucgucaaaguccacgucaaaaccaucgacuacgacggccaauaccacguccgcaucgucgacaaagaagccuucaccaaagccaac

SEQ ID NO: 54614 - RNA, 792 nt, Artificial Sequence
  derived and/or modified sequence opt11 from anti-IsdB_5D1Z_Chain-B
gccgagguccagcucguagaaucaggcgggggagugguccagcccgggggaucacucaggcucucgugcgcagccucgggcuucaccuucaacaaauucuggaugaacugggugcgccaggccccgggcaagggccuagaaugggucgcagacauacaaguagacgggagcgagaaaaacuacguggacucggucaagggcagauucacaaucucccgagacaacgggaaaaacagccuguacuugcaaaugaacucgcuaagagccgaagacacaggcguauacuacugcgcgcgcgggcgcuacgacuacuggucgggcuaccuaucacccuggggccagggcacacucguaacaguaagcucggccucgaccaagggcccgagcguguucccgcucgcgcccucgagcaagagcaccagcgggggcacagcagcacucggaugccuggucaaggauuacuucccggaaccggucacggucucauggaacagcggggcccuaaccucaggcgugcacacguucccggccgugcuccagagcucgggccuguacucgcuuucgagcgucgucacggucccgagcucgagccugggcacgcaaacguacauaugcaacgucaaucacaaacccucgaacacgaaaguggacaagaaaguagaaccgaaaucaugcgggggagggagcgggcaccaccaccaccaccaccaccaccaccacggcggggacuacaaagaccacgacggcgacuacaaggaccacgacauagacuacaaagacgacgacgacaag

SEQ ID NO: 54615 - RNA, 642 nt, Artificial Sequence
  derived and/or modified sequence opt11 from anti-IsdB_5D1Z_Chain-C
gacauccaacucacccaaucacccuccuuccucuccgccuccgucgccgaccgcguuaccaucacuugccgcgccucccaagccguacgcucaucccucgccugguaccaacaaaaacccggcaaagcaccccaacuacucaucuacuccgccuccacacucgaaaacggcgucuccucccguuucucuggcuccggccccggcaccgaguucacccucaccauauccucacuccaacccgaagacgucggaaccuacuacugccaacaacucaacaccuaccccuucaccuucggccccggcaccaaagucgaaaucaaacgcaccgucgccgcccccuccgucuucauauucccacccuccgacgaacaacucaaaucaggcaccgccucagucgucugccuccucaacaacuucuacccacgcgaagccaaaguccaauggaaagucgacaacgcccuucaauccggcaacucccaagaauccgucaccgaacaagacuccaaagacuccaccuacucccucuccuccacccucacccuauccaaagcagacuacgaaaaacacaaagucuacgccugcgaaguaacacaccaaggccucuccucccccgucaccaaaucauucaaccgcggcgaaugc

SEQ ID NO: 54616 - RNA, 810 nt, Artificial Sequence
  derived and/or modified sequence opt11 from anti-IsdB_5D1Z_Chain-D
caaguccaacuccaagaauccggccccggccucgucaaacccuccgagacccuaucacuaaucugcacagucucaggaggcucaaucucauccucaucuuacuacuggggcuggauccgccaaacccccgaaagaaaccucgaauggaucggcaucaucuacuucuccggcaccaccuacuacaaccccucccuccaaucccgcgucuccaugucccucgaccgcucaaccaaccgauucucccuccgccuauccuccgucaccgccgccgacaccgccauauacuacugcgcaaaaccaaaaucccgcgaccgcggcggacccggcgacgacuacuucggaauggacgucuggggccaaggcaucauggucaccgucucaucagccagcaccaaaggcccaagcgucuucccccucgcccccuccuccaaauccacaucaggcggcaccgccgcccucggcugccuagucaaagacuacuuccccgaacccguaaccgucucauggaacuccggcgcccuaaccuccggcguccacaccuuccccgccguccuccaauccucaggccucuacucccucuccuccgucgucacaguacccucaucuucccucggaacacaaaccuacaucugcaacguaaaccacaaacccuccaacacaaaagucgacaaaaaaguagaacccaaauccugcggcggagguagcggacaccaccaccaccaccaccaccaccaccacggaggcgacuacaaagaccacgacggcgacuacaaagaccacgacaucgacuacaaagacgacgacgacaaa

SEQ ID NO: 54617 - RNA, 810 nt, Artificial Sequence
  derived and/or modified sequence opt11 from anti-IsdB_5D1Z_Chain-F
caaguccaacuccaagaaucaggccccggucuaguaaaacccuccgaaacccucagccucaucugcaccgucuccggcggauccaucuccuccucaucauacuacuggggcuggauacgccaaacacccgaacgcaaccucgaauggauaggcaucauauacuucuccggcaccaccuacuacaaccccucccuccaaucccgagucuccaugucacucgacagauccaccaaccgcuucucccuccgacuaucaucagucaccgccgcugacaccgccauauacuacugcgccaaaccuaaaucccgcgaccgcggaggccccggcgacgacuacuucggcauggacgucuggggccaaggcaucauggucaccgucuccuccgccuccaccaaaggacccuccgucuucccccucgcacccuccuccaaaucaaccuccggaggaaccgccgcccucggaugccucgucaaagacuacuuccccgaaccagucacagucuccuggaauucaggcgcccuuaccuccggaguccacacauuccccgccguccuccaauccucaggccucuacucacuuuccucagucgucaccgucccauccuccucccucggcacccaaaccuacaucugcaacgucaaccacaaaccuuccaacaccaaagucgacaaaaaaguagaacccaaauccugcggaggcggcuccggccaccaccaccaccaccaccaccaucaccacggcggcgauuacaaagaccacgacggcgacuauaaagaccacgacauagacuacaaagacgaugacgacaaa

SEQ ID NO: 54618 - RNA, 792 nt, Artificial Sequence
  derived and/or modified sequence opt11 from anti-IsdB_5D1Z_Chain-G
gcagaaguccaacuagucgaaagcggcggcggcgucguccaaccaggcggaucccucagacucuccugcgccgccucaggcuucacauucaacaaauucuggaugaacuggguacgccaagccccagguaaaggccucgaauggguagccgacauccaagucgacggauccgaaaaaaacuacguagacucagucaaaggccgcuucaccaucucacgcgacaacggcaaaaacagccuuuaccuacaaaugaacucacuccgcgccgaagacaccggcgucuacuacugcgcucgcggacgcuacgacuacugguccggcuaccuaucacccuggggccaaggaacccucgucaccgucagcuccgccucaacaaaaggccccucaguauucccacucgcacccuccagcaaaagcaccagcggcggcaccgccgcccucggcugccuggucaaagacuacuuccccgaacccgucacagucuccuggaacuccggcgcccucaccuccggaguccacaccuuccccgccguccuccaauccucaggacucuacucccucuccagcgucgucaccgucccauccagcagccucggcacccaaacauacaucugcaacgucaaccacaaaccauccaacacaaaagucgacaaaaaagucgaacccaaauccugcggaggcggcuccggccaccaccaccaccaccaccaccaccaccacggaggcgacuacaaagaccacgacggcgacuacaaagaccacgacaucgacuacaaagacgacgacgacaaa

SEQ ID NO: 54619 - RNA, 642 nt, Artificial Sequence
  derived and/or modified sequence opt11 from anti-IsdB_5D1Z_HeavyChain
gacauccaaaugacacaaucccccuccuuccucuccgcauccgucggcgaccgagugacuaucaccugccgcgccucacaaggcaucaccaccuaccucggcugguaccaacaacgccccggcaaagccccccaacuccuaaucuacgccgccucuucccuccaguccggcguccccccccgcuucucaggcuccggcuccggcaccgaauucacccuaaccaucuccucacuacaacccgaagacuucgccaccuacuacugccaacaacuaaacaccuacccauacaccuucggacccggcacccgccucgaaaucaaacgcacaguugccgcccccucagucuucaucuuccccccauccgacgaacaacuuaaauccggcaccgccuccgucguaugccuacucaacaacuucuacccccgagaagccaaaguccaauggaaagucgacaacgcccuccaauccggcaacucacaagaaagcgucacagaacaagacuccaaagacuccaccuacucccucuccuccacccuuacccuaucaaaagccgacuacgaaaaacacaaaguauacgcaugcgaagucacccaccaaggccucuccucccccgucaccaaauccuucaaccgcggcgaaugc

SEQ ID NO: 54620 - RNA, 471 nt, Artificial Sequence
  derived and/or modified sequence opt11 from anti-IsdB_5D1Z_Chain-I
ggccccgccaaagccaccaacaacaccuaccccauccucaaccaagaacuccgcgaagccaucaaaaaccccgccaucaaagacaaagaccacuccgcccccaacucccgccccaucgacuucgaaaugaaaaaaaaagacggcacccaacaauucuaccacuacgccucauccgucaaacccgcccgcgucaucuucaccgacuccaaacccgaaaucgaacucggccuccaauccggccaauucuggcgcaaauucgaagucuacgaaggcgacaaaaaacuccccaucaaacuagucuccuacgacaccgucaaagacuacgccuacauccgcuucucagucuccaacggcaccaaagccgucaaaaucgucuccuccacccacuucaacaacaaagaagaaaaauacgacuacacccucauggaauucgcccaacccaucuacaacuccgccgacaaauucaaaacc

SEQ ID NO: 54621 - RNA, 324 nt, Artificial Sequence
  derived and/or modified sequence opt11 from anti-HIV_b12_LightChain
gaaaucguccucacccaaucccccggcacccuaucccucucccccggcgaacgcgccaccuucuccugccgcuccucccacuccauccgcucccgccgcgucgccugguaccaacacaaacccggccaagccccccgccucgucauccacggcgucuccaaccgcgccuccggcaucuccgaccgcuucuccggcuccggcuccggcaccgacuucacccucaccaucacccgcgucgaacccgaagacuucgcccucuacuacugccaagucuacggcgccuccuccuacaccuucggccaaggcaccaaacucgaacgcaaa

SEQ ID NO: 54622 - RNA, 381 nt, Artificial Sequence
  derived and/or modified sequence opt11 from anti-HIV_b12_HeavyChain
caagugcaauuggaacagagcggggccgaggucaagaaaccgggcgcgagcgugaaagugagcugucaagcgagcggguacagguucucgcacuuuaccgugcacugggucaggcaagcgcccgggcaaagguucgaguggaugggauggaucaaucccuauaacgggaacaaggaauuuagcgcgaaauuucaagaucgcgugaccuuuaccgcggacacgagcgcgaacacggccuauauggagcucaggagcuugcgcucggcagauaccgcggucuauuacugugccagggucggggaauggggcugggacgauagcccguacgauaacuauuacauggacgugugggggaaagggaccacggucauagucucgagc

SEQ ID NO: 54623 - RNA, 633 nt, Artificial Sequence
  derived and/or modified sequence opt11 from anti-HIV_2G12_LightChain
gucguaaugacacaaucccccuccacccucucagccuccgucggcgacaccaucacaaucaccugccgcgccucccaauccaucgaaaccuggcucgccugguaccaacaaaaacccggcaaagcccccaaacuccucaucuacaaagccuccacccucaaaaccggcgucccaucccgcuucuccggcuccggcuccggcaccgaauucacccucaccaucuccggccuccaauucgacgacuucgccaccuaccacugccaacacuacgccggcuacuccgcaaccuucggacaaggcacccgagucgaaaucaaacgcaccgucgccgccccauccguauucaucuucccccccuccgacgaacaacuaaaauccggcaccgccuccguagucugccuccucaacaacuucuacccccgcgaagccaaaguccaauggaaagucgacaacgcccuccaauccggcaacucccaagaauccguuaccgaacaagacuccaaagacuccaccuacucccucuccuccacccucacccucucaaaagcugacuacgaaaaacacaaagucuacgccugcgaagucacccaccaaggccucuccuccccugucaccaaauccuucaaccgcggc

SEQ ID NO: 54624 - RNA, 672 nt, Artificial Sequence
  derived and/or modified sequence opt11 from anti-HIV_2G12_HeavyChain
gaaguacaacucgucgaauccggcggcggccucgucaaagcuggcggcucccucauccuauccugcggcgucuccaacuuccgcaucuccgcccacaccaugaacuggguccgccgagucccaggcggaggccuagaaugggucgcuuccaucuccaccuccuccacuuaccgagacuacgccgacgccgucaaaggccgcuucacagucucccgcgacgaccucgaagacuucgucuaccuccaaaugcacaaaaugcgcgucgaagacaccgccaucuacuacugcgccagaaaaggcuccgaccgccuauccgacaacgaccccuucgacgccuggggccccggaaccgucgucaccguaucacccgccucaaccaaaggccccuccguauucccccucgcccccuccagcaaaagcaccucaggcggcaccgccgcccucggaugccuugucaaagacuacuuccccgaacccguaaccgucuccuggaacuccggcgcccucaccucaggcguacacaccuuccccgccguccuacaaagcucaggccuauacucccucuccuccgucgucacaguccccuccuccucacugggcacccaaaccuauaucugcaacgucaaccacaaacccuccaacaccaaagucgacaaaaaagucgaacccaaa

SEQ ID NO: 54625 - RNA, 642 nt, Artificial Sequence
  derived and/or modified sequence opt11 from anti-HIV_4E10_LightChain
gaaaucguccuaacccaaucccccggcacccaaucccucucucccggcgaacgcgccacccucuccugccgagccucccaauccgucggcaacaacaaacuagccugguaucaacaacgacccggccaagccccacgccuccucaucuacggcgccucaucccgccccuccggcguagccgaccgcuucucaggauccggcuccggcaccgacuucacccuaaccaucucccgccucgaacccgaagacuucgccgucuacuacugccaacaauacggacaaucccucucaacauucggccaaggcaccaaagucgaagucaaaagaaccgucgccgcacccuccgucuucaucuucccacccuccgacgaacaacuaaaauccggcaccgccucagucgucugccuacucaacaacuucuacccccgagaagccaaaguccaauggaaagucgacaacgcccuccaauccggcaacucucaagaauccgucaccgaacaagacuccaaagacuccaccuacucacucucauccacccucacccucuccaaagccgacuacgaaaaacacaaagucuacgccugcgaagucacccaccaaggccuuuccucccccgucaccaaauccuucaaccgcggagaa

SEQ ID NO: 54626 - RNA, 684 nt, Artificial Sequence
  derived and/or modified sequence opt11 from anti-HIV_4E10_HeavyChain
caaguccagcuaguccaaucaggcgcagaaguaaaacgacccggcuccuccgucaccgucuccugcaaagccuccggcggcuccuucucaaccuacgcccucuccuggguccgccaagcccccggccgcggccucgaauggaugggcggcgucaucccccuccucaccaucaccaacuacgccccucgcuuccaaggccgcaucaccauaacagccgaccgcuccaccuccaccgccuaccucgaacucaacucacuccgccccgaagacaccgccguauacuacugcgcccgcgaaggcaccaccggcuggggcuggcucggcaaacccaucggagcauucgcccacuggggccaaggaacacucgucaccgucuccuccgccucaacaaaaggcccaucaguauucccccucgcacccucauccaaaucaaccucaggcggcaccgccgcccucggcugccuagucaaggacuacuuccccgaacccgucaccgucucauggaacuccggcgcccucaccuccggcguccacacauuccccgccguccuccaaucuuccggccucuacucccucucauccgucgucaccguccccuccucaucccucggcacccaaaccuacaucugcaacgucaaccacaaacccucaaacacaaaagucgacaagaaagucgaacccaaa

SEQ ID NO: 54627 - RNA, 312 nt, Artificial Sequence
  derived and/or modified sequence opt11 from anti-HIV_VRC01_LightChain
gaaaucguccucacccaaucccccggcacccucucccucucccccggcgaaaccgccaucaucuccugccgcaccucccaauacggcucccucgccugguaccaacaacgccccggccaagccccccgccucgucaucuacuccggcuccacccgcgccgccggcauccccgaccgcuucuccggcucccgcuggggccccgacuacaaccucaccaucuccaaccucgaauccggcgacuucggcgucuacuacugccaacaauacgaauucuucggccaaggcaccaaaguccaagucgacaucaaacgc

SEQ ID NO: 54628 - RNA, 363 nt, Artificial Sequence
  derived and/or modified sequence opt11 from anti-HIV_VRC01_HeavyChain
caggugcaguuggugcagagcggggggcagaugaagaagccgggggagagcaugaggauaagcuguagggcgagcggguaugaguuuauagacuguacgcugaauuggauaagguuggcgccggggaagaggccggaguggaugggguggcugaagccgagggggggggcggugaauuaugcgaggccguugcaggggagagugacgaugacgagggauguguauagugauacggcguuuuuggaguugaggaguuugacgguggaugauacggcgguguauuucuguacgagggggaagaauugugauuauaauugggacuuugagcauugggggagggggacgccgguaauaguaaguagc

SEQ ID NO: 54629 - RNA, 330 nt, Artificial Sequence
  derived and/or modified sequence opt11 from anti-HIV_PG9_LightChain
caauccgcccucacccaaccagccuccgucuccggcucccccggccaaucaaucaccaucuccugcaacggcaccuccaacgacgucggcggcuacgaauccgucuccugguaccaacaacaccccggcaaagcccccaaagucgucaucuacgacgucuccaaacgccccuccggcgucuccaaccgcuucuccggcuccaaauccggcaacaccgccucccuaaccaucuccggccuccaagccgaagacgaaggcgacuacuacugcaaaucccucaccuccacccgccgccgcgucuucggcaccggcaccaaacucaccguccuc

SEQ ID NO: 54630 - RNA, 408 nt, Artificial Sequence
  derived and/or modified sequence opt11 from anti-HIV_PG9_HeavyChain
cagcgccuagucgagagcggaggcggggucgugcaaccgggcucaagccugcgccugagcugcgccgcgagcggauucgacuucucacgccagggcaugcacugggucaggcaagcacccgggcaagggcucgaguggguggccuucaucaaguacgacggcucggaaaaguaccacgccgacagcguaugggggcgacuaagcauaagcagggacaacagcaaggacacacucuaccuccagaugaacagccuacgcguagaagacaccgcgaccuacuucugcgucagggaagcaggcggacccgacuacaggaacggauacaacuacuacgacuucuacgacggcuacuacaacuaccacuacauggacguaugggggaaaggaaccacggucacagucucgagc

SEQ ID NO: 54631 - RNA, 630 nt, Artificial Sequence
  derived and/or modified sequence opt11 from anti-HIV_VRC07_LightChain
gaaaucguacucacccaaucccccggcacccucucccucucccccggcgaaacagccauaaucucaugccgcaccucccaauacggcucccucgccugguaccaacaacgccccggacaagccccccgccucgucaucuacuccggcuccacccgagccgccggaauccccgaccgcuucucaggcucccgcuggggccccgacuacacccucaccaucuccaaccucgaauccggcgacuucggcgucuacuacugccaacaauacgaauucuucggccaaggaaccaaaguacaagucgacaucaaacgcaccgucgccgcccccuccguauucaucuuccccccauccgacgaacaacucaaauccggcaccgccuccgucguaugccuccucaacaacuucuacccccgcgaagccaaaguccaauggaaagucgacaacgcccuccaauccggcaacucacaagaauccguaaccgaacaagacuccaaagacucaaccuacucacuauccuccacccucacccucuccaaagcagacuacgaaaaacacaaagucuacgccugcgaagucacccaccaaggccuccgcucccccguaaccaaauccuucaaccgaggcgaaugc

SEQ ID NO: 54632 - RNA, 375 nt, Artificial Sequence
  derived and/or modified sequence opt11 from anti-HIV_VRC07_HeavyChain
cagguccagcucgugcaaucgggcgggcaaaugaaaaagcccggggaaucgaugaggaucucgugcagggccucgggcuaugaauuuaucgauugcacgcucaauuggauacgccuggccccgggcaagcgcccggaauggaugggguggcugaaaccgcgcgggggcgcgguaaauuacgcgcgaccgcuccagggcagggucacgaugacgcgagaugucuauagcgauaccgcguucuuggaauugcgaucgcucacgagcgaugacacggccguguacuuuugcacgcgcgggaaauauugcacggccagggacuauuacaauugggauuucgagcacuggggccagggcacgcccgugaucgugagcucg

SEQ ID NO: 54633 - RNA, 315 nt, Artificial Sequence
  derived and/or modified sequence opt11 from anti-HIV_3BNC117_LightChain
gacauccaaaugacccaaucccccuccucccucuccgccuccgucggcgacaccgucaccaucaccugccaagccaacggcuaccucaacugguaccaacaacgccgcggcaaagcccccaaacuccucaucuacgacggcuccaaacucgaacgcggcguccccucccgcuucuccggccgccgcuggggccaagaauacaaccucaccaucaacaaccuccaacccgaagacaucgccaccuacuucugccaagucuacgaauucgucguccccggcacccgacucgaccucaaacgcaccgucgccgccccc

SEQ ID NO: 54634 - RNA, 387 nt, Artificial Sequence
  derived and/or modified sequence opt11 from anti-HIV_3BNC117_HeavyChain
caaguacaauugcuccagagcggggccgcggucacgaaaccgggcgcgagcgugcgcgugagcugugaagcgagcggguacaauaucagggacuauuucauacacugguggaggcaagcgcccgggcaagggcuccagugggugggcuggaucaaucccaagaccgggcaaccgaacaaucccaggcaauuucaagggcgcgugagccugaccaggcacgcgagcugggacuuugacacguucucguucuauauggaucucaaggccuugcgcucggacgauaccgcggucuauuucugugccaggcaaaggagcgauuacugggacuuugacgugugggggagcgggacccaggucacggucucgagcgcgagcacgaaagggccc

SEQ ID NO: 54635 - RNA, 324 nt, Artificial Sequence
  derived and/or modified sequence opt11 from anti-HIV_10-1074_LightChain
agcuaugucaggcccuugagcguggccuugggcgagaccgcgcgcauaagcuguggcaggcaagcgcucgggagcagggccgugcaaugguaccagcacaggcccgggcaagcgcccauacucuugaucuauaacaaucaagaucgcccgagcgggaucccggaaagauucucgggcacgcccgauaucaauuucgggaccagggccacgcucacgaucucgggcguggaagcgggcgaugaagcggacuauuacugucacaugugggauagcaggagcggguucucguggucguucgggggcgcgaccaggcucacggucuug

SEQ ID NO: 54636 - RNA, 396 nt, Artificial Sequence
  derived and/or modified sequence opt11 from anti-HIV_10-1074_HeavyChain
caaguccaacuccaagaauccggccccggccucgucaaacccuccgaaacccucuccgucaccugcuccgucuccggcgacucaaugaacaacuacuacuggaccuggauccgccaaucccccggcaaaggccucgaauggaucggcuacaucuccgaccgcgaauccgccaccuacaaccccucccucaacucccgcgucgucaucucccgcgacaccuccaaaaaccaacucucccucaaacucaacuccgucacccccgccgacaccgccgucuacuacugcgccaccgcacgccgcggccaacgcaucuacggcgucgucuccuucggcgaauucuucuacuacuacuccauggacgucuggggcaaaggcaccaccgucaccgucuccucc

SEQ ID NO: 54637 - RNA, 633 nt, Artificial Sequence
  derived and/or modified sequence opt11 from anti-HIV_PGT121_LightChain
uccgacaucuccgucgccccaggcgaaaccgcccgcaucuccugcggcgaaaaaucccucggcucccgcgccguccaaugguaccaacaccgcgccggccaagcccccucccucaucaucuacaacaaccaagaccgccccucuggcaucccagaacgauucucaggcucacccgacucacccuucggcaccaccgcaacccucaccaucaccuccgucgaagccggcgacgaagcagacuauuacugccacaucugggacucccgaguccccaccaaaugggucuucggcggcggcaccacccuaaccguccucggacaaccaaaagccgcaccaucagucacccucuucccccccuccuccgaagaacuacaagccaacaaagccacccucgucugccuaaucuccgacuucuaccccggcgccgucaccgucgccuggaaagccgacuccucccccgucaaagccggcguagaaaccaccacccccuccaaacaauccaacaacaaauacgccgccuccucauaccucucccucacccccgaacaauggaaaucccacaaaucauacuccugccaagucacccacgaaggcuccaccgucgaaaaaaccgucgcccccaccgaaugcucc

SEQ ID NO: 54638 - RNA, 705 nt, Artificial Sequence
  derived and/or modified sequence opt11 from anti-HIV_PGT121_HeavyChain
caaaugcaacuccaagaauccggccccggccucgucaaacccucugaaacccucucccucacaugcuccgucuccggcgccuccaucuccgacuccuacuggucauggauccgacgcucccccggcaaaggccuagaauggaucgguuacguccacaaaucaggcgacaccaacuacucccccucccucaaaucccgcgucaaccucucccucgacaccuccaaaaaccaagucucccucucccuagucgccgcaaccgccgcagacucaggaaaauacuacugcgcccgcacccuccacggccgccgcaucuacggaaucgucgccuucaacgaaugguucaccuacuucuacauggacgucuggggcaacggcacccaagucaccguauccuccgccuccacuaaaggcccauccgucuucccccucgcccccucuuccaaauccaccuccggcggcaccgcagcccucggcugucucgucaaagacuacuuccccgaacccgucaccgucuccuggaacuccggcgcccucaccuccggaguccacaccuuccccgccguacuccaauccuccggccucuacucccuaucaucaguuguaaccguccccuccucaucccuaggcacccaaacauacaucugcaacgucaaccacaaacccuccaacaccaaaguugauaaacgcgucgaacccaaaucaugc

SEQ ID NO: 54639 - RNA, 657 nt, Artificial Sequence
  derived and/or modified sequence opt11 from anti-HIV_PGDM1400_LightChain
gacuucguccucacccaaagcccccacucacucuccguaacccccggagaauccgccuccaucuccugcaaauccucccacucccucauccacggcgaccgaaacaacuaccucgccugguacguacaaaaacccggccgcucaccccaacuccucaucuaccucgccuccucccgcgccuccggcguccccgacagauucuccggcuccggcucggacaaagacuucacccuuaaaauaucccgagucgagaccgaagacgucggcaccuacuacugcaugcaaggccgcgaaucccccuggaccuucggacaaggcaccaaagucgacaucaaacgaaccgucgccgcccccuccgucuucaucuucccacccucagacgaacaacuaaaauccggcacagcuucagucgucugccuccuaaacaacuucuacccccgcgaggccaaaguccaauggaaagucgacaacgcccuccaauccggaaacucacaagaaucaguaaccgagcaagacucaaaagacucaaccuacucccucuccuccacccucacccucagcaaagccgacuacgaaaaacacaaaguauacgcaugcgaagucacccaccaaggccucuccucacccguaaccaaauccuucaaccgaggcgaaugc

SEQ ID NO: 54640 - RNA, 735 nt, Artificial Sequence
  derived and/or modified sequence opt11 from anti-HIV_PGDM1400_HeavyChain
caagcacaacucguacaauccggccccgaaguccgaaaacccggcacaucaguaaaagucuccugcaaagcccccggcaacacccucaaaacauacgaccuccacuggguccgcuccguccccggucaaggccuccaauggaugggauggaucucccacgaaggcgacaaaaaaguaaucgucgaacgcuucaaagccaaagucaccauugacugggaccgcucaaccaacaccgccuaccuccaacucucaggccucaccucaggcgacaccgccguauauuacugcgccaaaggcuccaaacaccgccuccgcgacuacgcccucuacgacgacgacggcgcacucaacugggcagucgacgucgacuaccucucuaaccucgaauucuggggccaaggaaccgccgucaccgucucaucagccuccaccaaaggccccuccgucuucccccuagcccccuccuccaaauccaccucaggcggcaccgccgcccucggaugccuagucaaagacuacuucccagaacccgucacagucuccuggaacuccggcgcccucaccuccggaguccacacauucccagccguccuccaauccucaggccucuacucccuuuccuccguagucacaguccccuccucaucccucggcacccaaacauacaucugcaacgucaaccacaaacccuccaacacaaaagucgacaaaaaagucgaacccaaauccugcgac

SEQ ID NO: 54641 - RNA, 630 nt, Artificial Sequence
  derived and/or modified sequence opt11 from anti-HIV_N6_LightChain
uacauccacgucacccaaucccccuccucacucuccgucucuaucggcgaccgcgucaccaucaacugccaaacaucccaaggcgucggcuccgaccuccacugguaccaacacaaacccggccgcgcccccaaacuccucauccaccacacauccuccgucgaagacggaguccccucccgcuucuccggcucaggcuuccacaccuccuucaaccuaaccaucucagaccuccaagccgacgacaucgccaccuacuacugccaaguccuccaauucuucggccgcggcucccgacuccacaucaaacgcaccgucgccgcccccuccgucuucaucuucccacccucagacgaacaacucaaauccggcaccgccuccgucguaugcuuacucaacaacuucuacccccgcgaagccaaaguccaauggaaagucgacaacgcacuccaauccggcaacucccaagaauccgucaccgaacaagacuccaaagacuccaccuacucccucuccucaacccuaacccuauccaaagccgacuacgaaaaacacaaagucuacgccugcgaagucacccaccaaggccucucaucacccgucaccaaauccuucaaccgcggcgaaugc

SEQ ID NO: 54642 - RNA, 675 nt, Artificial Sequence
  derived and/or modified sequence opt11 from anti-HIV_N6_HeavyChain
cgcgcacacuugguccagagcgggacagcgaugaagaaaccgggcgcgagcgugcgcguaagcugucaaacaagcggauacacguucacggcccauauauuauucugguucaggcaagcgcccgggcgcgggcucgagugggugggauggaucaagccacaguacggggccguaaacuuuggcgggggcuuucgcgaucgagugaccuugaccagggacguguacagggaaauagcauauauggauaucaggggcuuaaaaccggacgauaccgcggucuacuacugugccagggacaggagcuauggcgauagcucgugggcgcuagacgcauggggccagggcacgaccgugguagugagcgcggccucgaccaagggcccaagcguguucccgcucgcgcccucaagcaagagcacgagcgggggcacggccgcgcucgggugccuggucaaggacuauuucccggaaccggucacggucucauggaauagcggugccuugaccucgggaguacacacguucccggccgugcuccagagcucgggcuuguacucgcucucgagcguagucacggucccgagcucgagcuugggcacacaaacguacauaugcaaugucaaucacaagcccucgaacacgaaaguggacaagaaaguggaaccgaaaucgugc

SEQ ID NO: 54643 - RNA, 1080 nt, Artificial Sequence
  derived and/or modified sequence opt11 from anti-HIV_N6_GChain
gccugggaagacgccgacaccacacucuucugcgccagcgacgccaaagcguacagcaccgaaaaacacaacguaugggcaacccacgccugcguccccacagacccggacccacaggaaaucccacucgaaaacgucaccgaaaacuucaacauguggaaaaacaacaugguagaacaaaugcacgaagacaucaucagccucugggacgaaucacuaaagcccugcgucaugcucaccggcggcagcaccaucaaacaagcaugcccaaaaguaaccuucgaacccauacccauacacuacugcgcccccgccggcuucgcaauucucaaaugccgcgacgaagacuucaacggcacaggccccuguaagaacgucucaaccguccaaugcacccacggaaucaaacccguugucagcacccaacuccuacuaaacggcucccucgcaaaaggagacaucgucauccgcuccgaaaaucuuaccaacaacgccaaaguaaucaucguccaacucaacgaacccguccaaauagucugcauccgcccaaacaacggcggcuccggaagcggcggagacauacgccaagcacacugcaacgucacccgcggcaaaugggucaacauuaccaaaaacgucaaagaacaacucuggaaaaucuucaacaaaaccacaaacaucaccuucaacaacacgaucuucaacucacccgccggcggagaccucgaaaucaccacacacuccuucaacugcggaggcgaguucuucuacugcaacaccuccgaccucuucaacgaaaccaaccucuccgccaaccacaccgacaccaacgaaaacauaacacuucaaugccgcaucaaacaaauuguccgcauguggcaacgagucggccaagccauguacgccccacccaucgcaggcaacaucacaugcauaucaaacaucacaggcuuacuacucacccgcgacggagucaacgacacccacgacaaagaaaacgaaaccuuccgcccaaccggcggugacaugagagacaacuggcgcuccgaacuauacaaauacaaaguaauaaagcucaaa

SEQ ID NO: 54644 - RNA, 645 nt, Artificial Sequence
  derived and/or modified sequence opt11 from anti-HIV_10E8_LightChain
uccuacgaacuaacacaagaaaccggcgucuccgucgcccuaggccgcacagucaccaucaccugccgcggcgacucccuccgcucccacuacgccucgugguaccaaaaaaaacccggccaagcccccauccuacucuucuacggcaaaaacaaccgcccaucaggcguacccgaccgauucucaggcuccgccuccggcaaccgcgccucacucaccaucuccggcgcccaagccgaagacgacgccgaauacuacugcuccucccgcgacaaauccggcucccgccucucagucuucggcggaggcaccaaacucaccguacucagccaacccaaagccgccccauccgucacccuauucccccccuccuccgaagaacuccaagccaacaaagccacccuagucugccucaucuccgacuucuaccccggagccgucaccgucgcauggaaagcagacuccucccccgucaaagccggcgucgaaaccaccacccccuccaaacaaucaaacaacaaauacgccgccuccucauaccucucacuuaccccagaacaauggaaaucacaccgcuccuacuccugccaagucacccacgaaggcuccaccgucgaaaaaaccgucgcccccaccgaaugcucc

SEQ ID NO: 54645 - RNA, 708 nt, Artificial Sequence
  derived and/or modified sequence opt11 from anti-HIV_10E8_HeavyChain
gaaguccaacucgucgaaucaggaggaggccuagucaaacccggcggaucccuccgccucuccugcuccgccuccggcuucgacuucgacaacgccuggaugaccuggguacgccaaccacccggcaaaggccucgaaugggucggcagaaucaccggccccggcgaaggaugguccgucgacuacgccgcccccgucgaaggccgauucaccaucucccgccucaacuccaucaacuuccuauaccucgaaaugaacaaccuaagaauggaagacuccggccucuacuucugcgcccgcaccggcaaauacuacgacuucugguccggauacccacccggagaagaauacuuccaagacuggggccgcggcacccuagucaccgucucuuccgccuccaccaaaggccccuccgucuucccccuagcucccuccuccaaauccaccucaggcggcacagcagcacucggcugccucgucaaagacuacuuccccgaacccgucaccgucucauggaacuccggcgcccucaccuccggcguccacaccuuccccgccguccuccaauccucaggccucuacucccucuccuccgucgucaccguccccuccuccucccucggcacccaaaccuacaucugcaacgucaaccacaaaccauccaacacaaaagucgacaagagagucgaacccaaauccugcgacaaa

SEQ ID NO: 54646 - RNA, 333 nt, Artificial Sequence
  derived and/or modified sequence opt11 from anti-HIV_12A12_LightChain
gacauccaaaugacccaaucccccucaucccucuccgccuccgucggcgaccgcgucaccaucaccugccaagccggccaaggcaucggcuccucccuccaaugguaccaacaaaaacccggcaaagcccccaaacuccuaguccacggcgccuccaaccuccaccgcggcguccccucccgcuucuccggcuccggcuuccacaccaccuucucccucaccaucuccggccuccaacgcgacgacuucgccaccuacuucugcgccguccucgaauucuucggccccggcaccaaagucgaaaucaaacgcaccgucgccgcccccuccguc

SEQ ID NO: 54647 - RNA, 381 nt, Artificial Sequence
  derived and/or modified sequence opt11 from anti-HIV_12A12_HeavyChain
ucgcaacaucucgugcaaucgggcacgcaagugaaaaagcccggggccucggucaggaucucgugccaggccucgggcuauagcuuuaccgauuacgugcuccauugguggcgccaggcaccgggccagggcuuggaauggaugggguggauaaaaccggucuauggcgcgcgcaauuacgcgcgcagguuccagggcaggaucaauuucgaucgagauaucuaucgcgagaucgcguucauggacuugagcgggcucaggagcgaugacacggccuuguacuuuugcgcgcgcgauggcucgggcgaugacacgagcuggcacuuggacccgugggggcaagggaccuuggucauagucucggccgcgagcacgaaaggg

SEQ ID NO: 54648 - RNA, 315 nt, Artificial Sequence
  derived and/or modified sequence opt11 from anti-HIV_12A21_LightChain
gacauccaaaugacccaaucccccuccucccucuccgccuccgucggcgaccgcgucaccaucaacugccaagccggccaaggcaucggcuccucccucaacugguaccaaaaaaaacccggccgcgcccccaaacuccucguccacggcgccuccaaccuccaacgcggcguccccucccgcuucuccggcuccggcuuccacaccaccuucacccucaccaucuccucccuccaacccgacgacgucgccaccuacuucugcgccgucuuccaaugguucggccccggcaccaaagucgacaucaaacgcacc

SEQ ID NO: 54649 - RNA, 384 nt, Artificial Sequence
  derived and/or modified sequence opt11 from anti-HIV_12A21_HeavyChain
ucccaacaccucguccaauccggcacccaagucaaaaaacccggcgccuccguccgcgucuccugccaagccucuggcuacaccuucaccaacuacauccuacacugguggcgccaagcccccggccaaggccucgaauggaugggccuaaucaaacccgucuucggcgccgucaacuacgcccgccaauuccaaggccgcauccaacuaacccgagacaucuaccgagaaaucgccuuccucgaccucucaggccuccgcucagacgacaccgccgucuacuacugcgcccgcgacgaauccggcgacgaccucaaauggcaccuacacccauggggccaaggaacccaagucaucgucucccccgccucaacaaaaggcccc

SEQ ID NO: 54650 - RNA, 648 nt, Artificial Sequence
  derived and/or modified sequence opt11 from anti-HIV_35022_LightChain
caauccguccuaacccaauccgcauccgucucaggcucacucggccaauccgucaccaucucaugcaccggccccaacuccgucugcugcucccacaaauccaucucaugguaccaauggccacccggccgcgcacccacacucaucaucuacgaagacaacgaacgcgcuccaggcaucucaccccguuucuccggcuacaaaucauacugguccgccuaccuaaccaucuccgaccuccgccccgaagacgaaacaacauacuacuguugcuccuacacccacaacuccggcugcgucuucggcaccggcacaaaagucuccguccucggccaauccaaagccaaccccucaguaacccuauucccccccuccuccgaagaacuccaagccaacaaagccacccuaguaugccucaucuccgacuucuaccccggcgccgucaccgucgccuggaaagccgacuccucacccgucaaagccggcgucgaaaccaccacacccucaaaacaauccaacaacaaauacgccgccuccuccuaccucucccucacccccgaacaauggaaaucccaccgcucauacuccugccaaguaacccacgaaggcuccaccguagaaaaaaccgucgcccccaccgaaugcucc

SEQ ID NO: 54651 - RNA, 729 nt, Artificial Sequence
  derived and/or modified sequence opt11 from anti-HIV_35022_HeavyChain
gaaggccaacucguccaauccggcgccgaacugaaaaaacccggagccuccgucaaaaucucaugcaaaaccuccggauaccgcuucaacuucuaccacaucaacuggauccgacaaaccgcaggccgaggaccggaauggaugggcuggaucucacccuacuccggcgacaaaaaccucgcccccgccuuccaagaccgcgucaucaugaccaccgacaccgaaguccccguaacauccuucaccucaaccggcgccgccuacauggaaauccgaaaccucaaauucgacgacacaggcaccuacuucugcgccaaaggccuacuacgcgacggcucauccaccuggcuccccuaccucuggggacaaggcacccuccuaaccgucucaucagccuccaccaaaggccccuccgucuucccacucgcccccuccuccaaauccaccuccggcggaaccgccgcacucggcugccuagucaaagacuacuucccagaaccagucacugucuccuggaacuccggugcccucaccucaggcguccacaccuuccccgccguccuacaauccuccggccuguacucacuauccuccgucgucacaguccccagcuccucccucggcacccaaacauacaucugcaacgucaaccacaaaccaucuaacacaaaaguagacaaacgcgucgaacccaaaucaugcgacaaaggccucgaaguacucuuccaa

SEQ ID NO: 54652 - RNA, 648 nt, Artificial Sequence
  derived and/or modified sequence opt11 from anti-HIV_3BC176_LightChain
caauccguccucacccaacccgccuccguauccgccucccccggccaauccaucaccgucuccugcaccggcucccgcaacgacgucggcggcuacgacuucgucagcugguaccaacgucaccccggcggaguacccaaacucauaaucuacgaaaucuccaaacgccccuccggaauaccacaacgauucucuggcucccgauccggcaacaccgccucacuuaccaucuccggccuccaagacgacgacgaagccgacuacuacugcugcuccuacgccuccuacgaccgccucaucuucggcggcggcacucgcgucucuguccuccgacaaccaaaagccgccccauccgucacccuauucccacccuccuccgaagaacuccaagccaacaaagccacccuugucugccuaaucuccgacuucuaccccggcgccguaaccgucgccuggaaagccgacggcuccccagucaaagccggcgucgaaaccaccaaacccuccaaacaauccaacaacaaauacgccgcauccuccuaccuaucccucacacccgaacaauggaaaucccaccgcuccuacucaugccaagucacccacgaaggcuccaccgucgaaaagaccgucgcccccacagaaugcucc

SEQ ID NO: 54653 - RNA, 699 nt, Artificial Sequence
  derived and/or modified sequence opt11 from anti-HIV_3BC176_HeavyChain
gaacaaguccaacuaaugcaauccggcgcccaacuucgcgaccccggcgacucccucaaaauauccugcaaagccuccgguuacaacuucaucgacuaccacauccacuggguccgccucgccccaggccgcggacucgaauggaugggcuggaucgacccugucggcggcaucaccaaauacgccggccaauuccaaggccgccucucccuaacacgcgacaccucuacaaacacccucuuccucgaacucucccgacucaccgccggcgacaccgccgucuacuucugcgcccgaucaaugcgccccguagaccacggaaucgacuacuccggccuauucgucuuccacuucuggggccgcggcuccgacguccucgucuccuccgccuccaccaaaggccccuccgucuucccccucgcccccuccuccaaauccaccuccggcggcaccgccgcccucggcugccucgucaaagacuacuuccccgaaccagucaccgucucauggaacucaggcgcacucaccuccggcguacacaccuucccugccguccuccaauccuccggccucuacucccuuuccuccgucgucaccgucccauccuccucccucggcacccaaaccuacaucugcaacgucaaccacaaacccuccaacacaaaagucgacaaaaaagucgaacccaaaucaugcgac

SEQ ID NO: 54654 - RNA, 621 nt, Artificial Sequence
  derived and/or modified sequence opt11 from anti-HIV_3BNC55_LightChain
gacauccaaaugacccaauccccauccucccucuccgccuccgucggcgacaaagucaccaucaccugccaaaccuccgccggauaccucaacugguaccaacaacgccgcggccgagcccccaaacuccuuauguacgacggcucacgacucgucaccggcguccccucccgauucuccggccgacgcuggggcacccaauacaaccucaccaucggcucucuacaacccgaagacaucgccaccuacuacugccaagucuacgaauucuucggcccaggcacccgccucgaccucaaacgcacagucgccgcccccuccgucuucaucuucccacccucagacgaacaacucaaauccggcacagccagcgucgucugccuccucaacaacuucuacccccgcgaagcaaaaguccaauggaaagucgacaacgcccuccaauccggaaacucccaagaauccgucaccgaacaagacuccaaagacucaacuuacucccucucauccacccucacccucuccaaagccgacuacgaaaaacacaaaguauacgcaugcgaagucacccaccaaggacucuccucccccgucaccaaauccuucaaccgaggcgaaugc

SEQ ID NO: 54655 - RNA, 675 nt, Artificial Sequence
  derived and/or modified sequence opt11 from anti-HIV_3BNC55_HeavyChain
caaguccaacuuguccaauccggcaccgccgucaaacgacccggagccuccgucagagucucaugccaagccucuggcuacaccuucaccgacuacuucaucuacugguggcgccaagcccccggccaaggccucgaauggcucggcuggaucaaccccuuaaccucccaacccuccuaccccuccagauuccaaggccgucucacacuuacacgcgacaccuuugacgaaaugcucuacauggaccuccgcggacuacgaucugacgacaccggcaucuacuucugcgcccgccgccacuccgacuacugcgacuucgacaucuggggcucuggcacccaaaucaucgucuccuccgccuccaccaaaggaccuuccgucuucccccucgcccccuccuccaaauccaccucuggcggcaccgccgcacucggcugccucgucaaagacuacuuccccgaacccgucacagucuccuggaacuccggcgcccuaaccuccggcguccacaccuuccccgccguccuccaauccucaggccucuacucccucucuuccgucgucaccguccccucaucuucccucggcacccaaaccuacaucugcaacgucaaccacaaacccuccaacaccaaagucgacaaacgcguagaacccaaauccugcgacaaaacc

SEQ ID NO: 54656 - RNA, 618 nt, Artificial Sequence
  derived and/or modified sequence opt11 from anti-HIV_3BNC60_LightChain
gacauccaaaugacccaaucccccuccucccucuccgcccgcguaggcgacaccgucaccaucaccugccaagccaacggcuaccucaacugguaccaacaacgccgcggaaaagcccccaaacuccucauauacgacggcagcaaacucgaacgcggaguccccgcccgcuucucaggccggcgcuggggccaagaauacaaccuuaccaucaacaaccuccaacccgaagacgucgccacuuacuucugccaagucuacgaauucaucguccccggcacccgucucgaccucaaacgcaccguagccgcccccuccguauucaucuucccccccuccgacgaacaacucaaauccggcaccgccucagucgucugccuccucaacaacuucuacccccgcgaagcaaaaguccaauggaaagucgacaacgcccuccaauccggcaacucccaagaauccgucaccgaacaagacagcaaagacuccaccuacucccucuccuccacccucacccucuccaaagccgacuacgaaaaacacaaagucuacgccugcgaagucacccaccaaggccucuccucccccgucaccaaaucauucaaccgcggcgaaugc

SEQ ID NO: 54657 - RNA, 687 nt, Artificial Sequence
  derived and/or modified sequence opt11 from anti-HIV_3BNC60_HeavyChain
caaguccaucucucccaaucaggcgccgccgucaccaaacccggcgcaucaguacgcgucuccugcgaagccuccggcuacaaaauaagcgaccacuucauccacugguggcgccaagccccaggccaaggccuacaaugggucggcuggaucaaccccaaaacaggccaacccaacaacccucgccaauuccaaggccgcguaucccuaacccgacaagccucaugggacuucgacaccuacuccuucuacauggaccucaaagccguccgaucagacgacaccgccaucuacuucugcgcccgccaacgcuccgacuucugggacuucgacgucuggggcucaggcacccaaguaaccgucagcuccgccuccaccaaaggccccuccgucuucccacucgccccaucauccaaauccaccagcggcggcaccgccgcccucggcugccucgucaaagacuacuuccccgaacccgucacaguauccuggaacucaggcgcccuaaccuccggcguccacaccuuccccgccguccuccaaagcuccggacucuacucacucucauccgucgucaccguacccuccuccucucuaggaacacaaaccuacaucugcaacgucaaccacaaacccucaaacacaaaagucgacaaacgcgucgaacccaaauccugcgacaaaaca

SEQ ID NO: 54658 - RNA, 687 nt, Artificial Sequence
  derived and/or modified sequence opt11 from anti-HIV_3BNC60_HeavyChain
gaaguccaccucucccaaucaggcgcagccgucaccaaacccggcgccuccguccgagucucaugcgaagccuccggcuacaaaauuucagaccacuucauccacugguggcgccaagccccaggccaaggccuccaaugggucggcuggaucaaccccaaaaccggccaacccaacaacgcccgccaauuccaaggccgcgucucccucacccgccaagccucaugggacuucgacaccuacuccuucuacauggaccucaaagccguccgcuccgacgacacagcaaucuacuucugcgcccgacaacgcuccgacuucugggacuucgacgucuggggcuccggcacccaagucaccgucuccucagccuccaccaaaggccccucagucuucccccucgcccccuccuccaaauccaccuccggcggcaccgccgcccucggcugccucgucaaagacuacuuccccgaacccgucaccgucuccuggaacuccggcgcacucaccucuggaguccacacauucccagccguccuccaauccuccggccuuuacagccucucauccgucgucaccguccccagcuccucacuaggcacacaaaccuacaucugcaacgucaaccacaaaccauccaacacaaaagucgacaaacgcgucgaaccaaaaucaugcgacaaaacc

SEQ ID NO: 54659 - RNA, 648 nt, Artificial Sequence
  derived and/or modified sequence opt11 from anti-HIV_447-52D_LightChain
caauccguccucacccaacccccauccgucuccgccgcccccggccaaaaagucacaaucuccugcucuggcuccuccuccaacaucggcaacaacuacguccucugguaccaacaauuccccggcaccgcccccaaacuacucaucuacggcaacaacaaacgccccucaggcauccccgaccgcuucuccggcucaaaauccggcacaucagccacccucggcaucaccggccuccaaaccggcgacgaagccgacuacuucugcgccacaugggacuccggccucuccgccgacugggucuucggcggaggcaccaaacucacaguccucucacaaccuaaagccgcccccuccgucacccucuucccccccuccuccgaagaacuccaagccaacaaagcaacccucgucugccucaucuccgacuuuuacccaggcgccgucaccgucgccuggaaagccgacuccucccccguuaaagccggcgucgaaaccaccaccccauccaaacaauccaacaacaaauacgcagccuccucauaccuaucccucaccccagaacaauggaaaucacaccgcuccuacuccugccaagucacacacgaaggcuccaccgucgaaaaaacagucgcccccaccgaaugc

SEQ ID NO: 54660 - RNA, 693 nt, Artificial Sequence
  derived and/or modified sequence opt11 from anti-HIV_447-52D_HeavyChain
gaaguccaacucgucgaaucaggcggcggccucgucaaaccaggcggcucccuccgccuaaccugcgucgccucaggcuucaccuucuccgacgucuggcuaaacuggguccgacaagcccccggcaaaggccucgaauggguaggccgcaucaaaucccgaaccgacggcggcaccaccgacuacgcagccuccguaaaaggccgcuucaccaucucacgcgacgacucuaaaaacacccucuaccuccaaaugaacucacucaaaaccgaagacaccgccgucuacuccugcaccaccgacggauucaucaugauccgaggcguauccgaagacuacuacuacuacuacauggacgucuggggcaaaggcaccacaguaaccgucuccuccgccuccaccaaaggccccuccguauucccccucgccccauguucccgauccaccuccggcggcaccgccgcccucggcugccucgucaaagacuacuuccccgaacccgucaccgucuccuggaacuccggcgcacucacauccggcguccauaccuuccccgccguccuccaaucaucaggacucuacucccucuccucagucgucaccguccccucauccucccucggcacccaaaccuacacaugcaaugucaaccacaaacccuccaacaccaaaguagacaaacgcgucgaacuc

SEQ ID NO: 54661 - RNA, 645 nt, Artificial Sequence
  derived and/or modified sequence opt11 from anti-HIV_447-52D_LightChain
caauccguccucacccaaccacccuccgucuccgccgcccccggccaaaaagucaccaucuccugcucaggcuccuccuccaacaucggcaacaacuacguccucugguaccaacaauuccccggaacagcccccaaacuccucaucuacggcaacaacaaacgccccuccggcauccccgaccgcuucucaggcucaaaauccggcacauccgccacccucggaaucacaggacuccaaaccggcgacgaagccgacuacuucugcgccaccugggacuccggccucuccgccgacugggucuucggcggcggcaccaaacucacaguccuaucccagcccaaagccgcccccuccgucacccucuucccacccuccuccgaagaacuccaagccaacaaagccacccuaguaugccucaucuccgacuucuacccaggcgccgucaccgucgccuggaaagccgacucaucccccgucaaagccggcgucgaaaccaccacccccuccaaacaauccaacaacaaauacgccgccucuuccuaccucucccucacacccgaacaauggaaaucacaccgcucauacuccugccaaguaacacacgaaggcucuaccgucgagaaaaccgucgcccccaccgaa

SEQ ID NO: 54662 - RNA, 705 nt, Artificial Sequence
  derived and/or modified sequence opt11 from anti-HIV_447-52D_HeavyChain
gaaguccaacucgucgaauccggcggcggccuaguaaagcccggcggcucccuacgccuaaccugcgucgccucaggcuucaccuucuccgacguauggcucaacuggguccgccaagccccaggcaaaggccucgaauggguaggccgaaucaaaucacgcaccgacggcggcaccaccgacuacgccgccucaguaaaaggccgcuucaccaucucccgcgaugacuccaaaaacacccucuaccuacaaaugaacucccucaaaacagaagacaccgccgucuacucuugcaccaccgacggcuucaucaugauccgaggcguuuccgaagacuacuacuacuacuacauggacgucugggguaaaggcaccaccgucacagucucaagcgccuccaccaaaggacccuccgucuucccccucgccccaugcucccgcucaaccuccggcggcaccgccgcccuaggcugccucgucaaagacuacuucccagaacccgucacaguauccuggaacuccggcgcccucaccuccggcguccacaccuuuccagccguccuccaauccuccggacucuacucccucuccuccgucgucaccguccccagcuccucccuaggcacacaaaccuacacaugcaacgucaaccacaaacccucaaacaccaaaguagacaaacgcgucgaacucaaaaccccaacc

SEQ ID NO: 54663 - RNA, 624 nt, Artificial Sequence
  derived and/or modified sequence opt11 from anti-HIV_5H/I1-BMV-D5_LightChain
gacauccaaaugacccaaucccccuccacccucuccgccuccaucggcgaccgcgucaccauaaccugccgcgccuccgaaggcaucuaccacuggcucgccugguaccaacaaaaacccggcaaagcccccaaacuccuaaucuacaaagcauccucccucgccuccggcgcaccaucccgcuucuccggcucaggcucaggcaccgacuucacccucaccaucuccucccuccaacccgacgacuucgccaccuacuacugccaacaauacucaaacuacccccucaccuucggcggcggaacaaaacucgaaaucaaacgcaccguagccgccccauccgucuucaucuucccacccucagacgaacaacucaaaucaggcaccgcguccgucgucugccuccucaacaacuucuacccccgcgaagccaaaguccaauggaaagucgacaacgcccuccaauccggaaacucccaagaauccgucaccgaacaagacuccaaagacuccaccuacagccucucauccacccucacccucuccaaagcagacuacgaaaaacacaaagucuacgccugcgaagucacccaccaaggccucuccucccccgucaccaaaucc

SEQ ID NO: 54664 - RNA, 651 nt, Artificial Sequence
  derived and/or modified sequence opt11 from anti-HIV_5H/I1-BMV-D5_HeavyChain
caaguccaacucguccaauccggcgccgaaguacgcaaacccggcgccucaguaaaagucuccugcaaagccuccggcgacaccuucuccuccuacgcaaucucauggguccgccaagcccccggacaaggccucgaauggaugggcggcaucaucccaaucuucggcaccgccaacuacgcccaagccuuccaaggacgcgucaccaucaccgccaacgaauccaccuccaccgcauacauggaacucucaucacuccgaucagaagacaccgccaucuacuacugcgcacgcgacaaccccacccuccucggcuccgacuacuggggugccggaacccucgucacagucuccuccgccucaaccaaaggcccauccgucuucccccuagcccccugcucccgcuccaccuccggcggcaccgccgcccucggaugccuagucaaagacuacuucccagaaccagucaccgucuccuggaacuccggcgcccucaccuccggcguccacaccuuccccgcaguccuccaauccucaggccucuacucccucuccuccgucguaaccguccccuccuccucccucggcacccaaaccuacaucugcaacgucaaccacaaacccuccaacaccaaagucgacaaacgcguc

SEQ ID NO: 54665 - RNA, 657 nt, Artificial Sequence
  derived and/or modified sequence opt11 from anti-HIV_5H/I1-BMV-D5_A-Chain
augcaacuacucucaggcaucguacaacaacaaaacaaccuccuccgcgccaucgaagcccaacaacaccuacuccaacuaaccgucuggggcauaaaacaacuccaagcccgcauccucgccggcggcuccggcggccacaccaccuggauggaaugggacagagaaaucaacaacuacaccucccuaauccacucccuaaucgaagaaucccaaaaccaacaagaaaaaaacgaacaagaacuccucgaaggcagcuccggcggacaacuccucuccggcaucguccaacaacaaaacaaccuacuccgcgccaucgaagcccaacaacaccuccuccaacuaaccgucuggggcaucaaacaacuacaagcccgcauacucgcaggcggaagcggcggccacaccacauggauggaaugggaccgcgaaaucaacaacuacacaagccucauacacagccuaaucgaagaaucccaaaaccaacaagaaaaaaacgaacaagaacuccuagaaggauccucaggcggccaacuacucagcggcaucguccaacaacaaaacaaccuccuccgcgccaucgaagcccaacaacaccuccuacaacucacagucuggggcaucaagcaacuacaagcccgcauccucgcaggcggc

SEQ ID NO: 54666 - RNA, 390 nt, Artificial Sequence
  derived and/or modified sequence opt11 from anti-HIV_8ANC195_LightChain
gacauccaaaugacccaaucccccuccacccucuccgccuccaucggcgacaccguccgcaucuccugccgcgcaucccaauccaucaccggcaacugggucgccugguaccaacaacgccccggcaaagccccccgccuccucaucuaccgcggcgccgcccuccucggcggcguccccucccgcuucuccggcuccgccgccggcaccgacuucacccucaccaucggcaaccuccaagccgaagacuucggcaccuucuacugccaacaauacgacaccuaccccggcaccuucggccaaggcaccaaagucgaagucaaacgcaccgucgccgcccccuccgucuucaucuucccccccuccgacgaacaacucaaauccggcacc

SEQ ID NO: 54667 - RNA, 423 nt, Artificial Sequence
  derived and/or modified sequence opt11 from anti-HIV_8ANC195_HeavyChain
caaauccaccucguccaauccggcaccgaagucaaaaaacccggcuccuccgucaccgucuccugcaaagccuacggcgucaacaccuucggccucuacgccgucaacuggguccgccaagcccccggccaaucccucgaauacaucggccaaaucuggcgcuggaaauccuccgccucccaccacuuccgcggccgcguccucaucuccgccgucgaccucaccggcuccuccccccccaucuccucccucgaaaucaaaaaccucaccuccgacgacaccgccgucuacuucugcaccaccaccuccaccuacgacaaaugguccggccuccaccacgacggcgucauggccuucucauccuggggccaaggcacccucaucuccgucuccgccgccuccaccaaaggacccuccgucuuc

SEQ ID NO: 54668 - RNA, 333 nt, Artificial Sequence
  derived and/or modified sequence opt11 from anti-HIV_CAP256-VRC26.01_LightChain
caauccguccucacccaaccccccucagucuccgccgcccccggccaaaaagucaccauauccugcuccggcuccuccuccaccaucggcaacaacuacgucuccugguaccgacuccuccccggcaccgcccccaaacuccucaucuacaaaaacgacaaccgccccucaggcauccccgaccgcuucuccggcuccaaauccggcaccuccgccacccucggcaucuccggccuccaaaccggcgacgaagccgacuacuacugcggcaccugggacaccucccucuccggcggcggcgucuucggcaccggcaccaaagucaccguccuc

SEQ ID NO: 54669 - RNA, 432 nt, Artificial Sequence
  derived and/or modified sequence opt11 from anti-HIV_CAP256-VRC26.01_HeavyChain
gaagugcaaguggucgagagcgggggcggggucgugcaaccgggcaggagcuugcgcuugagcuguaccgcgagcggguucacguucucgaacuuugccaugggcugggucaggcaagcgcccgggaaagggcucgaguggguggccuuuaucucgagcgauggcucgaacaagaacuauggcgauagcguaaaagggcgcuuuaccauaagcagggacaauagcaagaacacggucuuucuccagaugaauagcuugcgcguggaagauaccgcgcucuauuacugugccaaggacgugggcgauuacaagagcgaugaauggggaacggaauauuacgauaucucgaucucguacccgauccaggacccgcgcgcgauggugggcgcguucgaucucuggggccagggcacaauggugaccgugagcccg

SEQ ID NO: 54670 - RNA, 324 nt, Artificial Sequence
  derived and/or modified sequence opt11 from anti-HIV_CAP256-VRC26.02_LightChain
caauccguccucacccaaccccccuccgucuccgccgcccccggccaaaaagucaccaucuccugcuccggcuccaacuccaacaucggcaacaaagacgucuccugguaccaacaaauccccgccaccgcccccaaacuccucaucuacgaaaacaacaaacgccccuccggcaucucagaccgcuucuccggcuccaaauccggcaccuccgccacccuagccaucaccggccuccaaaccggcgacgaagccgacuacuacugcgccacaugggacggccgcgucuccgucaucggcaccggcaccaacgucaucguccuc

SEQ ID NO: 54671 - RNA, 432 nt, Artificial Sequence
  derived and/or modified sequence opt11 from anti-HIV_CAP256-VRC26.02_HeavyChain
gaagugcaauuggucgagagcgggggcggggucgugcaaccgggcaggagccugcgcuugagcugugccgcgagccaguucucguucgggaacuauggcaugcacugggucaggcaagcgcccgggaaagggcucgaguggguggccgcaaucucguucgcgggcacgaaaacgaacuaugccgauagcgugaaagggcgcuuuaccauaagcagggacaauagcaagaacacggucuaucuccagaugaauagcuugcgcgcggaagauaccgcgcuauauuucugugccaaggacauacgagaguacgagugcgaguacuggaccucggacuauuacgauuucgggcgcccgcaaccgugcauagacucgcgcggggucgugggcacguucgaugucuggggccagggcacgauggugaccgugagcuca

SEQ ID NO: 54672 - RNA, 333 nt, Artificial Sequence
  derived and/or modified sequence opt11 from anti-HIV_CAP256-VRC26.03_LightChain
caauccguccucacccaaccccccuccgucuccgccgcccccggccaaaaagucaccaucuccugcuccggcuccuccuccaacaucggcaacaacuucgucuccugguaccaacaacgccccggcaccgcccccaaaauccucaucuacgaaaacaacaaacgccccuccgaaacccccgaccgcuucuccggcuccaaauccggcaccuccgccacccucgccaucaccggccuccaaaccgccgacgaagccgaauacuacugcgccaccugguccgccucccucuccucagcccgcgucuucggcaccggcacccgcaucaccguccuc

SEQ ID NO: 54673 - RNA, 432 nt, Artificial Sequence
  derived and/or modified sequence opt11 from anti-HIV_CAP256-VRC26.03_HeavyChain
gaagugcaauuggucgagagcgggggcggggucgugcaaccgggcaagagcuugcgacugagcugugccgcgagcagguucucguucaaucgcuauggcaugcacugggucaggcaagcgcccgggaaagggcucgaguggguggccgcgaucucguacgauggcacggacaaguaccaugccgauaaagugugggggcgcuuuaccauaagcagggacaauagcaagaacacgcucuaucuccagaugaauagcuugcgcgcggaagauaccgcgcucuauuacugugccaaggacuugcgcgaggacgagugcgaggaaugguggucggacuauuacgauuucgggaaacagcucccgugcaggaaaucgcgcggggucgcgggcauauucgauggcuggggccagggcacgauggugaccgugagcuca

SEQ ID NO: 54674 - RNA, 333 nt, Artificial Sequence
  derived and/or modified sequence opt11 from anti-HIV_CAP256-VRC26.04_LightChain
caacccguccucacccaaccacccuccgucuccgccgcccccggccaaaaagucaccaucuccugcuccggcuccuccuccaacaucggcaacaacuucgucuccugguaccaacaacgccccggcaccgcccccucccuacucaucuacgaaaccaacaaacgccccuccggcauccccgaccgcuucuccggcuccaaauccgccaccuccgccacccucgccaucaccggccuccaaaccggcgacgaagccgacuacuacugcgccaccugggccgccucccucaccuccgcccgcgucuucggcaccggcaccaaagucaucgucucc

SEQ ID NO: 54675 - RNA, 432 nt, Artificial Sequence
  derived and/or modified sequence opt11 from anti-HIV_CAP256-VRC26.04_HeavyChain
gaagugcaauuggucgagagcggaggcggggucgugcaaccgggcaagagcuugcgcuugagcugugccgcgagccaguucucguucaaucgcuauggcaugcacugggucaggcaagcgcccgggaaagggcucgaguggguggccgcgaucucguacgauggaacggacaaguaccacgcagauaaagugugggggcgcuuuaccauaagcagagacaauagcaagaacacgcucuaucuccagaugaauagcuugcgcgcggaagauaccgcgcucuauuacugugccaaggacuugcgcgaggacgagugcgaggaaugguggucggacuauuacgauuucgggaaacagcucccgugcaggaaaucgcgcggggucgcgggcauauucgauaaauggggccagggcacgauggugaucgugagcucg

SEQ ID NO: 54676 - RNA, 324 nt, Artificial Sequence
  derived and/or modified sequence opt11 from anti-HIV_CAP256-VRC26.05_LightChain
cagagcgcgcucacgcaaccgcccucggucucggccgcgcccgggcaaaaggucacaaucucaugcucgggcaauaucgggaacaauuacgugagcugguaccagcaagugcccgggaccgcgcccaagcuauugaucuaugaaaauaacaagcgcccgagcgggaucccggacagguucucgggcucgaaaucgggcacgagcgcgaccuuggucauaaccgggcuccagaccggggacgaggccgauuucuauugcgggaccuggggcgggagcuugcgcacgggcggggucuugggcacgggcacgcgcgugaccgugcuc

SEQ ID NO: 54677 - RNA, 432 nt, Artificial Sequence
  derived and/or modified sequence opt11 from anti-HIV_CAP256-VRC26.05_HeavyChain
gaagugcaauuggucgagagcgggggcgggguagugcaaccgggcaggagcuugcgcuugagcugugccgcgagccauuucucgcucucgagcuauggcaugcacugggucaggcaagcgccagggaaagggcucgagugggugaccgggaucucguucgcgggcacgaaaacguacuauggagauagcgugcgcgggcgcuuuaccgugagcagggacauaagcaagaacacgcuauuucuccagaugaauagccugcgcccggacgauaccgcgauguauuacugugccagggaccagcgcuauuacgagugcgaggaaugggccucggacuauuacgauuucgggcgcgagcaaccgugcuuggacccgcgcggggucgugggcauauucgaucucuggggccagggcacgauggugaccgugagcucg

SEQ ID NO: 54678 - RNA, 324 nt, Artificial Sequence
  derived and/or modified sequence opt11 from anti-HIV_CAP256-VRC26.06_LightChain
caaucaguccucacccaaccccccucagucuccgccgcccccggccaaaaagucaccaucuccugcuccggcuccaccuccaaaaucggccaaaacuccgucuccugguaccaacaacuacccggcaccgcccccaaacuccucaucuacgaaaacgaccgccgccccuccggcacccccgaccgcuucuccggcuccaaauccggcaccuccgccacccucgccaucaccggccuccaaaccggcgacgaagccgaauacuacugcgaaaccugggacggcuccggcggcgucuucggcaccggcaccaaagucaccguccuc

SEQ ID NO: 54679 - RNA, 435 nt, Artificial Sequence
  derived and/or modified sequence opt11 from anti-HIV_CAP256-VRC26.06_HeavyChain
gaagugcaauugauagagagcgggggcggggucgugcaaccgggcaggagcuugcgauugagcuguggcgcgagcggguucucguucaauaacuauggcaugcacuggguaaggcaagcgcccgggaaagggcucgaguggguggccgggaucucguucgcgggcaucaaaaaguacuauggcacgagcguaaaagggagauuuacaauaagcagggacaauagcaagaacaauuucuaucuacagaugaauagcuugcgaguggaagauaccgcgcuauauuacugugccagggacuugcgcgagcucgagugcgaggaauggaccuuguacaauuacuaugacuuuggcucgagagggcccugugucgaucccaggggcguggccgggagcuuugacgugugggggcaagggaccauggucacggucucgagc

SEQ ID NO: 54680 - RNA, 333 nt, Artificial Sequence
  derived and/or modified sequence opt11 from anti-HIV_CAP256-VRC26.07_LightChain
caagccguccucacccaaccacccuccgucuccgccgcccccggccaaaacgucaccaucuccugcuccggcuccggcucaaacaucggcaacaacuucgucuccugguaccaacaacgccccggcaccgcccccaaacuccucaucuacgaauccaacaaacgccccuccggcauccccgaccgcuucuccggcuccaaauccggcaccuccgccacccucgccaucaccggccuacaaaccggcgacgaagccuacuacuacugcgccaccugggccgcccgccucaacuccgcccgcgucuucggcaccggaaccauggucaccguccuc

SEQ ID NO: 54681 - RNA, 432 nt, Artificial Sequence
  derived and/or modified sequence opt11 from anti-HIV_CAP256-VRC26.07_HeavyChain
gaagugcaauuggucgagagcggaggcggggucgugcaaccgggcaggagcuugcgcuugagcugugucgggagccaguucucguucaaucgcuauggcaugcacugggucaggcaagcgcccgggaaagggcucgaguggguggccgggaucucguucgauggcacggacagguaccaugccgauaacgugugggggcgcuuuacaauaagcagggacaauaguaagaacacgcucuaucuccagaugucgagcuugcgcgcggaagauaccgcgcucuauuacugugccaaggacuugcgcgaggacgagugcgaggaaugguggucggacuauuacgauuucgggaaaaagcucccgugcaggaaaucgcgcggggucgcgggcguguucgauaaauggggccagggcacgauggugaccgugagcucg

SEQ ID NO: 54682 - RNA, 333 nt, Artificial Sequence
  derived and/or modified sequence opt11 from anti-HIV_CAP256-VRC26.08_LightChain
caaucagccuugacccagcccccaagcgugagcgcggccccgggccagaaagugaccauaagcuguagcgggaacucgagcaauaucgggaacaauuucgugagcugguaccagcaagugcccgggaccgcgcccaagcucuugcucuaugaaacguacaggcgcccgagcgggaucccggacagguucucgggcucgaaaucgggcacgagcgcgaccuuggccauaaccgggcuccagaccggggacgaggccgauuacuauugcacggucuggggcgugcgaaagggcgugggcgcggucuuuggcacgggcacgaaagugaccgugcuc

SEQ ID NO: 54683 - RNA, 438 nt, Artificial Sequence
  derived and/or modified sequence opt11 from anti-HIV_CAP256-VRC26.08_HeavyChain
gaagugcaauuggucgagagcgggggcggggucgugcaaccgggcaggagcuugaccuugagcugugccgcgagccaguucacguucucgaacuauggcaugcacugggucaggcaagcgcccgggaaagggcucgaguggguggccucggucucaaacgauggcacgaaaaaguaccauggcgauagcgugugggggcgcuuuaccauaagcagggacaauagcaagaacacgcuauuucuccagaugucgagcuugcgcgcggaagauaccgcggucuauuucugugucagggaccagcgcgaggacgagugcgaggaaugguggucggacuacuacgauuucgggcgcgagcucccgugcaggaaauuucgcgggcuaggacucgcgggcauauucgauaucuggggccauggcacgauggugaccgugagcucg

SEQ ID NO: 54684 - RNA, 333 nt, Artificial Sequence
  derived and/or modified sequence opt11 from anti-HIV_CAP256-VRC26.09_LightChain
caaucggccuugacccagcccccgagcguaagcgcggccccgggccagaaagugaccauaagcuguagcgggaacucgagcaauaucgggaacaauuucgugagcugguaccagcaauugcccgggaccgcgcccaagcucuugaucuaugaaaauaacaggcgcccgagcgggaucccggacagguucucgggcucgaaaucgggcacgagcgcgaccuuggccauaagcgggcuccagaccggggacgaggccgauuacuggugcgcggucuggggcgugcgcaggggcgcaggcgcggucuuuggcgcgggcacgaaagugaccgugcuc

SEQ ID NO: 54685 - RNA, 438 nt, Artificial Sequence
  derived and/or modified sequence opt11 from anti-HIV_CAP256-VRC26.09_HeavyChain
gaagugcaauuggucgagagcgggggcggggucgugcaaccgggaaggagcuugaccuugagcugugccgcgagccaguucaauuucgcgaacuauggcaugcacugggucaggcaagcgcccgggaaagggcucgaguggguggccucgaucucgaacgauggcacgaaaaaguaccaugaagagagcgugugggggcgcuuuaccauaagcaaggacaauagcaagagcacgcucuuucuccagaugaauagcuugcgcauagaagauaccgcgcucuauuucugugucaaggaccagcgcgaggacgagugcgaggaaugguggucggacuauuacgauuucgggcgagagcucccgugcaggaaaucgcgcgggcucgggcucgcgggaauauucgauauguggggccauggcacgauggugaccgugagcucg

SEQ ID NO: 54686 - RNA, 333 nt, Artificial Sequence
  derived and/or modified sequence opt11 from anti-HIV_CAP256-VRC26.10_LightChain
caauccguccucacccaaccccccuccgucuccgccgcccccggccaaaaagucaccaucuccugcuccggcuccuccuccaacaucggcgacaacuacgucuccugguaccaacaccuccccggcaccgcccccaaacuccucaucuacgaaaacacccgccgccccuccggcauccccgaccgcuucuccggcuccaaauccggcaccuccgccacccucgccaucaccggccuccaaaccggcgacgaagccgacuacuacugcggcaccugggacguccgccccaaccgcggcgccgucuucggcaccggcaccaaagucaccguccuc

SEQ ID NO: 54687 - RNA, 432 nt, Artificial Sequence
  derived and/or modified sequence opt11 from anti-HIV_CAP256-VRC26.10_HeavyChain
caagcgaucuuggucgagagcgggggcggggucgugcaaccgggcaggagcuugcgcuugagcugugccgcgagccaguucacguucucgggccauggcuugcacugggucaggcaagcgcccgggaaagggcucgaguggguggccucgaucucguucgcgggcacgaaaauggacuaugccgauagcgugaaagggcgauuugccauaagcagggacaauagcaagaacacgcucuaucuccagaugaauagcuugcgcguggaagauaccgcgcucuauuacugugccaaggacaugcgcgaguacgagugcgaguacuggaccucggacuauuacgauuucgggcgcccgcaaccgugcauagacaggcgcggggucgugggcauauucgauauguggggccagggcacgauggugaccgugagcacg

SEQ ID NO: 54688 - RNA, 321 nt, Artificial Sequence
  derived and/or modified sequence opt11 from anti-HIV_CAP256-VRC26.11_LightChain
caauccguccucacccaaccccccuccgucuccgccgcccccggccaaaacgucaccaucuccugcuccggcccccccucccacaucgaaaaaaacgacgucuccugguaccaacgccuccccggcauggcccccaaaaugguaaucuacgaauccaaacgccgcccccucggcauccccguccgcuucuccgccucccgcuccggcuccuccgccacccucgucaucaccggccuccaaacagccgacgaagccgacuacuacugcggcaccugggacggccgcaugaacuucggcaccggcacaaccgucuccguccuc

SEQ ID NO: 54689 - RNA, 429 nt, Artificial Sequence
  derived and/or modified sequence opt11 from anti-HIV_CAP256-VRC26.11_HeavyChain
gaggugcaguugguggagagugggggggggguggugccgccggggaagaguuugacguugaguuguguggcgaguagguuuacguuuagugcguuugggaugcauugggugaggcaggcgccggggaagggguuggaguggguggcgaguauaaguuuugcggggauaaagaaguauuaugcggacagcgugaaggggagguuuaguauaaguagagauaauaguaauacguuguuuuugcagaugaauggguugaggggggaggauacgggguuguaucauugugugaaggauaugagggaguuggagugugaggagugggcgagugauuauuaugauuuugggaagccgcagccguguuuggauagaaggggggugagugggauaagugcguggugggggccagggacgauggugacggugaguagu

SEQ ID NO: 54690 - RNA, 321 nt, Artificial Sequence
  derived and/or modified sequence opt11 from anti-HIV_CAP256-VRC26.12_LightChain
caaucaguccucacccaaccccccuccgucucuaccgcccccggccaaaccgucaccgucuccugcuccggaggcaccuccaacaccggcaacaacuucgucuccugguaccaacaccuccccggcaccgcccccaaacuccucaucuacgaaaacaacaaacgcccccucggcguccccgaccgcuucuccggcgccaaauccggcaccuccgccacccucgccaucaccggccuccaaaccggcgacgaaggcgacuacuacugcgccaccugguccggcucccucaacaucggcaccggcaccaaagucuccguccuc

SEQ ID NO: 54691 - RNA, 432 nt, Artificial Sequence
  derived and/or modified sequence opt11 from anti-HIV_CAP256-VRC26.12_HeavyChain
gaagugcaauugguccagagcgggggcggggucgugcaaccgggcaggagcuugcgcuugagcugugccgcgcccuauuucgaguucgggcgcuauggcuuucacugggucaggcaagcgcccgggaaagggcucgaguggguggcaucgaucucguucgcgggcagggacuauuaccauagcccgagugugugggggcgcuuuaccauaagcagggacaauaguaagaacacgcucuaucuccagaugaauagccugcgcauagaagauaccgcgcuauauuucugugccagggacuugcgcgagagcgagugcgaggaaugggaaucggacuauuacgauuucgggaaaaagggcccgugcgugaaaccgcgcggggucgcgggcgggcucgaucucuggggccagggcacgauggugaucgugagcucg

SEQ ID NO: 54692 - RNA, 333 nt, Artificial Sequence
  derived and/or modified sequence opt11 from anti-HIV_CAP256-VRC26.I1_LightChain
caauccguccucacccaaccccccuccgucuccgcagcccccggccaaaaagucaccaucuccugcuccggcuccuccuccaacaucggcaacaacuacgucuccugguaccaacaacuccccggcaccgcccccaaacuccucaucuacaaaaacaacgaacgccccuccggcauccccgaccgauucuccggcuccaaauccggcaccuccgccacccucggcaucaccggccuccaaaccggcgacgaagccgacuacuacugcggcaccugggacaccucccucuccgccggcggcgucuucggcaccggcaccaaaguaaccguccuc

SEQ ID NO: 54693 - RNA, 432 nt, Artificial Sequence
  derived and/or modified sequence opt11 from anti-HIV_CAP256-VRC26.I1_HeavyChain
caagugcaacuggucgagagcgggggcggggucgugcaaccgggcaggagccugcgcuugagcugugccgcgagcggguucacguucucgaacuaugccauggacugggucaggcaagcgccagggaaagggcucgaguggguagccgugaucucaagcgauggcucgaacaagaacuaugccgauagcgugaaagggcgcuuuaccauaagcagggacaauagcaagaacacgcucuaucuccagaugaauagcuugcgcgcggaagauaccgcggucuauuacugugccaaggacuugggcgagaacaagaacgaugaaugggccacggacuauuacgaucucucgaucgcguacccgguccaggacccgcgcgcggucgugggcgcguucgauaucuggggccagggcacgauggugaccgugagcucg

SEQ ID NO: 54694 - RNA, 333 nt, Artificial Sequence
  derived and/or modified sequence opt11 from anti-HIV_CAP256-VRC26.I2_LightChain
caauccguccucacccaaccccccuccgucuccgccgcccccggccaaaaagucaccaucuccugcuccggcuccuccuccaccaucggcaacaacuacgucuccugguaccaacuacuccccggcaccgcccccaaacuccucaucuacaaaaacgacaaacgccccucaggcauccccgaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 54695 - RNA, 432 nt, Artificial Sequence
  derived and/or modified sequence opt11 from anti-HIV_CAP256-VRC26.I2_HeavyChain
caagugcaauuggucgagagcgggggcggggucgugcaaccgggcaggagcuugcgcuugagcugugccgcgagcggguucacguucucgaacuuugccaugggauggguaaggcaagcgcccgggaaagggcuagaguggguggccuuuaucucgagcgauggcucgaacaagaacuauggcgauagcgugaaagggcgcuuuaccauaagcagggacaauagcaagaacacgcucuuucuccagaugaauagccugcgcgcggaagauaccgcgcucuauuacugugccaaggacgugggcgaguacaagagcgaugaaugggccacggacuacuacgaucucucgaucgcguacccgauacaggacccgcgcgcgauggugggcgcguucgauaucuggggccagggcacgauggugaccgugagcucg

SEQ ID NO: 54696 - RNA, 333 nt, Artificial Sequence
  derived and/or modified sequence opt11 from anti-HIV_CAP256-VRC26.UCA_LightChain
caauccguccucacccaaccccccuccgucuccgccgcccccggccaaaaagucaccaucuccugcuccggcuccuccuccaacaucggcaacaacuacgucuccugguaccaacaacuccccggcaccgcccccaaacuccucaucuacgaaaacaacaaacgccccuccggcauccccgaccgcuucuccggcuccaaauccggcaccuccgccacccucggcaucaccggccuccaaacaggcgacgaagccgacuacuacugcggcaccugggacuccucccucuccgccggcggcgucuucggcacaggcaccaaagucaccguccuc

SEQ ID NO: 54697 - RNA, 432 nt, Artificial Sequence
  derived and/or modified sequence opt11 from anti-HIV_CAP256-VRC26.UCA_HeavyChain
caagugcaauuggucgagagcgggggcggggucgugcaaccgggcaggagcuugcgcuugagcugugccgcgagcggguucacguucucgagcuauggcaugcacugggucaggcaagcgcccgggaaagggcucgaguggguggccgugaucucguacgauggcucgaacaaguacuaugccgauagcgugaaagggcgcuuuacaauaagcagggacaauagcaagaacacgcuauaucuccagaugaauagcuugcgcgcggaagauaccgcggucuauuacugugcaaaggacuugggcgagagcgagaacgaggaaugggccacggacuauuacgauuucucgaucggguacccgggccaggacccgcgcggggucgugggcgcguucgauauauggggccagggcacgauggugaccgugagcucg

SEQ ID NO: 54698 - RNA, 324 nt, Artificial Sequence
  derived and/or modified sequence opt11 from anti-HIV_CH01_LightChain
gaaaucguacucgcacaaucacccggaacccuaagccuaagcccaggcgaacgcgcaacccuaagcugccgcgccagccacaacguacacccaaaauacuucgccugguaccaacaaaaaccaggccaaagcccacgccuacucauauacggaggcucaaccagagccgcaggcauacccggaaaauucagcggcagcggaagcggaaccgacuucacacucacaaucucacgcguagacccagaagacuucgcagucuacuacugccaacaauacggaggcucacccuacaccuucggccaaggcacaaaaguagaaauaaaa

SEQ ID NO: 54699 - RNA, 399 nt, Artificial Sequence
  derived and/or modified sequence opt11 from anti-HIV_CH01_HeavyChain
gagguccagcuaguggaaucgggcgcgaacguggucaggcccgggggcucgcucaggcucucgugcaaggccucgggcuuuauauuugaaaauuucggguucucgugggugcgacaggccccgggcaagggcuugcaaugggucgcgggcuugaacuggaacgggggcgauaccagguacgcggacucggucaagggcagguucaggaugucgcgcgauaacucgcgcaauuucguguacuuggacauggacaaggucggggucgaugacacggccuuuuacuauugcgcgcgcgggaccgauuacacgaucgaugacgcgggcauacacuaucaagggagcgggaccuuuugguauuucgaucucuggggcaggggcacgcucgugagcgugagcucg

SEQ ID NO: 54700 - RNA, 324 nt, Artificial Sequence
  derived and/or modified sequence opt11 from anti-HIV_CH02_LightChain
gaaaucguacucacacaaucacccgcaacccuaagcgucagcccaggcgaacgcgcaacccuaagcugccgcgccagccaaaacguacacccacgcuacuucgccugguaccaacaaaaacgcggccaaagcccaagacuacucauacacuccggcucaaccagagccgcaggcauagccgaccgcuucagcggcggcggauccggaaugcacuucacacucacaaucacacgcguagaaccagaagacuucgcagucuacuucugccaacaauacggaggcucacccuacaccuucggccaaggcacacgcguagaacuacgc

SEQ ID NO: 54701 - RNA, 399 nt, Artificial Sequence
  derived and/or modified sequence opt11 from anti-HIV_CH02_HeavyChain
gagguccagcucguggaaucgggcgggagcguggucaggcccgggggcucgcucaggcucucgugcagggccucgggcuuuaucuuugaaaauuacgggcucacgugggugcgccaggucccgggcaagggcuugcacugggucucgggcaugaacuggaacgggggcgauaccagguacgcggacucggucaggggcagguucucgaugucgcgcgauaacucgaacaauaucgcguacuugcaaaugaacaaucucagggucgaggacacggccuuguacuauugcgcgcgcgggaccgauuacacgaucgaugaccagggaagguucuaucaagggagcgggaccuuuugguauuucgauuucuggggcaggggcacgcucgugaccgugagcucg

SEQ ID NO: 54702 - RNA, 324 nt, Artificial Sequence
  derived and/or modified sequence opt11 from anti-HIV_CH03_LightChain
gaaaucguccucacccaaucccccgccacccucucccucucccccggcgaacgcgccacccucuccugccgcgccucccaauccguccaccccaaauacuucgccugguaccaacaaaaacccggccaauccccccgccuccucaucuacuccggcuccacccgcgccgccggcaucgccgaccgcuucuccggcggcggcuccggcauccacuucacccucaccaucacccgcgucgaacccgaagacuucgccgucuacuucugccaacaauacggcggcucccccuacaccuucggccaaggcaccaaagucgaacuacgc

SEQ ID NO: 54703 - RNA, 399 nt, Artificial Sequence
  derived and/or modified sequence opt11 from anti-HIV_CH03_HeavyChain
gaggugcaguugguggagagcgggggggggguggugaggccggggggaagccugaggcugagcugugcggcgagcggguucauauuugagaauuauggguuaacgugggugaggcaagugccggggaaggggcugcauugggugagcgggaugaauuggaaugggggggacacgagguaugcggauagcgugagggggagguuuaguaugagcagagauaauagcaauaauauagcguaucugcagaugaagaaccugaggguggacgauacggcgcuguauuacugugcgagggggacggauuauacgauagacgaucaggggauauuuuauaaggggagugggacguucugguacuuugaccugugggggagggggacguuggugacggugaguagu

SEQ ID NO: 54704 - RNA, 324 nt, Artificial Sequence
  derived and/or modified sequence opt11 from anti-HIV_CH04_LightChain
gaaaucguccucacccaaucccccgacacccuaucccucucccccggcgaacgcgccacccuauccugccgcgccucccaauccguccacucccgcuacuucgccugguaccaacacaaacccggccaacccccccgccuccucaucuacggcggcuccacccgcgccaccggcauccccaaccgcuucuccgccggcggcuccggcacccaauucacccucaccgucaaccgccucgaagccgaagacuucgccgucuacuacugccaacaauacggccgcucccccuacaccuucggccaaggcacaaaagucgaaauccgc

SEQ ID NO: 54705 - RNA, 399 nt, Artificial Sequence
  derived and/or modified sequence opt11 from anti-HIV_CH04_HeavyChain
gaggugcaguugguggagaguggggggggguugauaaggccgggggggaguuugcgguugaguuguaaggggaguggauuuauauuugagaauuuuggguuugggugggugaggcaggggccggggaagggguuggagugggugagugggacgaauuggaaugggggggauagcagguauggggauagugugaaggggagguuuacgauaaguagggauaauaguaauaauuuuguguauuugcagaugaauaguuugaggccggaggauacggcgauauauuauugugcgagggggacggauuauacgauagaugaucaggggauaagguaucaggggagcgggacguuuugguauuuugaugugugggggagggggacguuggugacggugaguagu

SEQ ID NO: 54706 - RNA, 627 nt, Artificial Sequence
  derived and/or modified sequence opt11 from anti-HIV_CH103_LightChain
uacgaacucacccaaccccccuccgucuccgucuccccuggccaaaccgccaccaucaccugcuccggcgccuccaccaacgucugcugguaccaagucaaacccggccaaucacccgaagucgucaucuucgaaaacuacaaacgccccuccggcaucccagaccgcuucucaggcuccaaauccggcuccaccgccacccucaccauccgcggaacccaagcaaucgacgaagccgacuacuacugccaagucugggacuccuucuccaccuucgucuucggauccgguacccaagucaccguccuccgccaaccaaaagccaaccccaccgucacccucuucccccccuccuccgaagaacuccaagccaacaaagccacccucgucugccuaauuuccgacuucuaccccggcgccgucaccgucgccuggaaagccgacucaucccccgucaaagccggcgucgaaaccaccacccccuccaaacaauccaacaacaaauacgccgccuccuccuaccucucccucacccccgaacaauggaaaucacaccgcuccuacuccugccaagucacacacgaaggcuccaccguagaaaaaaccguagcccccaccgaaugcuca

SEQ ID NO: 54707 - RNA, 678 nt, Artificial Sequence
  derived and/or modified sequence opt11 from anti-HIV_CH103_HeavyChain
caaguacaacuccaagaauccggccccggcgucgucaaauccucagaaacccucucccucacaugcaccguaucaggcggcucaaugggcggcaccuacugguccuggcuccgccucucacccggcaaaggccucgaauggaucggcuacaucuuccacacaggcgaaaccaacuacucacccucccucaaaggccgcgucuccauuuccgucgacaccuccgaagaccaauucucccuccgccuucgcuccguaaccgccgccgacaccgccgucuacuucugcgccucccuaccccgcggccaacucgucaacgccuacuuccgaaacuggggccgcggcucccucguuuccgucaccgcagcauccaccaaaggccccuccgucuucccccucgcccccuccuccaaauccaccuccggcggaaccgccgcccucggcugccucgucaaagacuacuuccccgaacccgucaccgucuccuggaacuccggcgcccucaccuccggcguccacaccuuccccgccguccuccaauccuccggccucuacucacucuccuccgucgucaccguccccuccucaucccucggcacacaaaccuacaucugcaacgucaaccacaaacccuccaacacuaaaguagacaaaaaagucgaacccaaaucaugcgauaaa

SEQ ID NO: 54708 - RNA, 321 nt, Artificial Sequence
  derived and/or modified sequence opt11 from anti-HIV_M66.6_LightChain
gacauccaacucacccaaucccccuccucccucuccgccuccgucggcgaccgcgucaccaucaccugccgcgccucccaauccaucggcuccuaccucaacugguaccaacaaaaacccggcaaagcccccaaacuccucaucuacgccgccuccacccuccaauccggcguacccucccgcuucuccggcuccggcuccggcaccgacuucacccucaccaucuccucccuccaacccgaagacuccgccaccuacuacugccaacaauccuacuccacccccuucaccuucggccccggcaccaaagucgacauccgc

SEQ ID NO: 54709 - RNA, 390 nt, Artificial Sequence
  derived and/or modified sequence opt11 from anti-HIV_M66.6_HeavyChain
caaguccaacucguccaauccggcgccgaagucaaaaaacccggcgaaucccuaaaaaucuccugcaaagucucaggcuacaacuucgccuccgaauggaucggcuggguccgccaaaugcccggcaaaggccucgaauggaugggcaucaucuaccccggcgacuccgacaccaaauacucccccuccuuccaaggccaagucaucaucuccgccgacaaauccaucaacaccgccuaccuccaaugguccucccucaaagccuccgacaccgccaucuacuacugcgcccgccaaaaccacuacggcuccggcuccuacuucuaccgcaccgccuacuacuacgccauggacgucuggggccaaggcaccaccgucaccgucuccucc

SEQ ID NO: 54710 - RNA, 327 nt, Artificial Sequence
  derived and/or modified sequence opt11 from anti-HIV_NIH45-46_LightChain
gaaaucguccuaacccaaucccccgccacccucucccucucccccggcgaaaccgccaucaucuccugccgcaccucccaauccggcucccucgccugguaccaacaacgccccggccaagccccccgccucgucaucuacuccggcuccacccgcgccgccggcauccccgaccgcuucucaggcucccgcuggggcgccgacuacaaccucuccaucuccaaccucgaauccggcgacuucggcgucuacuacugccaacaauacgaauucuucggccaaggcaccaaaguccaagucgacaucaaacgcaccgucgccgccccc

SEQ ID NO: 54711 - RNA, 399 nt, Artificial Sequence
  derived and/or modified sequence opt11 from anti-HIV_NIH45-46_HeavyChain
caagugcgcuugagccagagcgggggccagaugaagaaaccgggcgagagcaugcgccugagcugucgagcgagcggguacgaguuccugaacugucccauaaacuggaucaggcucgcgccagggcgcaggcccgaguggaugggauggcucaagcccaggggaggggccgugaacuaugcaaggaaauuucaagggagagugacaaugaccagggacguguacucagacacggcauuucuagagcucaggagcuugaccucggacgauacagcgguauauuucuguacaaggggcaaguacuguacggcgcgcgauuacuauaacugggacuuugaacauugggggcgcggggccccggucacggucuccagcgcgagcacgaaagggcccucggua

SEQ ID NO: 54712 - RNA, 330 nt, Artificial Sequence
  derived and/or modified sequence opt11 from anti-HIV_PG16_LightChain
caauccgcccucacccaacccgccuccgucuccggcucccccggccaaaccaucaccaucuccugcaacggcaccuccuccgacgucggcggcuucgacuccgucuccugguaccaacaaucccccggcaaagcccccaaagucauggucuucgacgucucccaccgccccuccggcaucuccaaccgcuucuccggcuccaaauccggcaacaccgccucccucaccaucuccggccuccacaucgaagacgaaggcgacuacuucugcuccucacucaccgaccgcucccaccgcaucuucggcggcggcaccaaagucaccguccuc

SEQ ID NO: 54713 - RNA, 411 nt, Artificial Sequence
  derived and/or modified sequence opt11 from anti-HIV_PG16_HeavyChain
caagagcaacuggucgagagcgggggcggggucgugcaaccgggagggagcuugcgcuugagcugucucgcgagcggguucacguuccauaaauauggcaugcacugggucaggcaagcgcccgggaaaggacucgaguggguggccuugaucucggacgauggcaugcgcaaguaccauagcgauagcaugugggggcgcgugaccauaagcagggacaauagcaagaacacgcucuaucuccaguucucgagcuugaaaguggaagauaccgcgauguuuuucugugccagggaagcgggcgggcccauauggcaugacgaugucaaguacuaugacuuuaacgauggcuauuacaacuaccauuacauggacgugugggggaaagggaccacggucacggucucgagc

SEQ ID NO: 54714 - RNA, 315 nt, Artificial Sequence
  derived and/or modified sequence opt11 from anti-HIV_PGT122_LightChain
accuucguauccgucgcccccggccaaaccgcccgaaucaccugcggcgaagaaucccucggcucccgcuccgucaucugguaccaacaacgccccggccaagcccccucccucaucaucuacaacaacaacgaccgccccuccggcauccccgaccgcuucuccggcucccccggcuccaccuucggcaccaccgccacccucaccaucaccuccgucgaagccggcgacgaagccgacuacuacugccacaucugggacucccgacgccccaccaacugggucuucggagaaggcaccacccucaucguccuc

SEQ ID NO: 54715 - RNA, 396 nt, Artificial Sequence
  derived and/or modified sequence opt11 from anti-HIV_PGT122_HeavyChain
caaguccaccuccaagaauccggccccggccucgucaaacccuccgaaacccucucccuaaccugcaacgucuccggcacccucguccgcgacaacuacugguccuggauccgccaaccccucggcaaacaacccgaauggaucggcuacguacacgacuccggcgacaccaacuacaaccccucccucaaaucccgcguccaccucucccuagacaaaucuaaaaaccuagucucccuccgccuaaccggcgucaccgccgccgacuccgccaucuacuacugcgccaccaccaaacacggccgccgcaucuacggcgucgucgccuucaaagaaugguucaccuacuucuacauggacgucuggggcaaaggcaccuccgucaccgucuccucc

SEQ ID NO: 54716 - RNA, 315 nt, Artificial Sequence
  derived and/or modified sequence opt11 from anti-HIV_PGT123_LightChain
uccuccauguccgucucccccggcgaaaccgccaaaaucuccugcggcaaagaauccaucggcucccgcgccguccaaugguaccaacaaaaacccggccaaccccccucacucaucaucuacaacaaccaagaccgccccgccggcguccccgaacgcuucuccgccucacccgacuuccgccccggcaccaccgccacccucaccaucaccaacgucgacgccgaagacgaagccgacuacuacugccacaucuacgacgcccgcggcggcaccaacugggucuucgaccgcggcaccacccucaccguccuc

SEQ ID NO: 54717 - RNA, 396 nt, Artificial Sequence
  derived and/or modified sequence opt11 from anti-HIV_PGT123_HeavyChain
caacuccaccuccaagaauccggccccggccucgucaaaccccccgaaacccucucccuaaccugcuccgucuccggcgccuccaucaacgacgccuacugguccuggauccgccaaucccccggcaaacgccccgaaugggucggcuacguccaccacuccggcgacaccaacuacaaccccucacucaaacgccgagucaccuucucccucgacaccgccaaaaacgaagucucccucaaacucgucgaccucaccgccgccgacuccgccaccuacuucugcgcccgcgcacuccacggcaaacgcaucuacggcaucgucgcccucggcgaacucuucaccuacuucuacauggacgucuggggcaaaggcaccgccgucaccgucuccucc

SEQ ID NO: 54718 - RNA, 315 nt, Artificial Sequence
  derived and/or modified sequence opt11 from anti-HIV_PGT125_LightChain
caauccgcccucacccaaccccccuccgccuccggcucccccggccaauccaucaccaucuccugcaacggcaccgccaccaacuucgucuccugguaccaacaauuccccgacaaagcccccaaacucaucaucuucggcgucgacaaacgcccccccggcguccccgaccgauucuccggcucccgcuccggcaccaccgccucccucaccgucucccgccuccaaaccgacgacgaagccgucuacuacugcggcucccucgucggcaacugggacgucaucuucggcggcggcacaacccucaccguccuc

SEQ ID NO: 54719 - RNA, 411 nt, Artificial Sequence
  derived and/or modified sequence opt11 from anti-HIV_PGT125_HeavyChain
caaucccaacuccaagaauccggcccccgccucgucgaagccuccgaaacccucucccuaaccugcaacgucuccggcgaauccaccggcgccugcaccuacuucuggggcuggguccgccaagcccccggcaaaggccucgaauggaucggcucacucucccacugccaauccuucuggggcuccggcuggaccuuccacaaccccucccucaaaucccgccucaccaucucccucgacacccccaaaaaccaagucuuccucaaacucacaucccucaccgccgccgacaccgccaccuacuacugcgcccgcuucgacggcgaaguccucgucuacaaccacuggcccaaacccgccugggucgaccucuggggacgcggcauccccgucaccgucaccgucuccucc

SEQ ID NO: 54720 - RNA, 315 nt, Artificial Sequence
  derived and/or modified sequence opt11 from anti-HIV_PGT126_LightChain
caauccgcccucacccaaccccccuccgccuccggcucccccggccaauccaucuccaucuccugcaccggcaccuccaaccgcuucgucuccugguaccaacaacaccccggcaaagcccccaaacucgucaucuacggcgucaacaaacgccccuccggcguccccgaccgcuucuccggcuccaaauccggcaacaccgccucccuaaccgucuccggccuccaaaccgacgacgaagccgucuacuacugcuccucccucgucggcaacugggacgucaucuucggcggcggcaccaaacucaccguccuc

SEQ ID NO: 54721 - RNA, 411 nt, Artificial Sequence
  derived and/or modified sequence opt11 from anti-HIV_PGT126_HeavyChain
caaccccaacuccaagaauccggccccggacucgucgaagccuccgaaacccuaucccuaaccugcaccgucuccggcgacuccaccgcagccugcgacuacuucuggggcuggguccgccaaccacccggcaaaggccucgaauggaucggcggccuaucacacugcgccggcuacuacaacaccggcuggaccuaccacaaccccucccucaaaucccgccucaccaucucccucgacacccccaaaaaccaagucuuccucaaacucaacuccgucaccgccgccgacaccgccaucuacuacugcgcccgcuucgacggcgaaguccucgucuaccacgacuggcccaaacccgccugggucgaccucuggggccgcggcacccuagucaccgucaccgucuccucc

SEQ ID NO: 54722 - RNA, 315 nt, Artificial Sequence
  derived and/or modified sequence opt11 from anti-HIV_PGT127_LightChain
caauccgcccucacccaaccccccuccgccuccggcucacccggccaauccaucaccaucuccugcaccggcaccuccaacaacuucgucuccugguaccaacaauaccccggcaaagcccccaaacucgucaucuacgaaguaaacaaacgccccuccggcguccccgaccgcuucuccggcuccaaaucaggcuccaccgccucccucaccgucuccggccuccaagccgacgacgaaggcgucuacuacugcuccucccucgucggcaacugggacgucaucuucggcggcggcaccaaacucaccguccuc

SEQ ID NO: 54723 - RNA, 405 nt, Artificial Sequence
  derived and/or modified sequence opt11 from anti-HIV_PGT127_HeavyChain
caaccccaacuccaagaauccggccccggccuagucgaagccuccgaaacccucucccucaccugcaccgucuccggcgacucaaccggccgaugcaacuacuucuggggcuggguacgccaaccccccggcaaaggccucgaauggaucggcucacucucccacugccgcuccuacuacaacaccgacuggaccuaccacaaccccucccucaaaucccgccucaccaucucccucgacacccccaaaaaccaagucuuccuccgccucacauccgucaccgccgccgacaccgccaccuacuacugcgcccgcuucggcggcgaaguccucgucuaccgcgacuggcccaaacccgccugggucgaccucuggggccgcggcacacucgucaccgucuccucc

SEQ ID NO: 54724 - RNA, 315 nt, Artificial Sequence
  derived and/or modified sequence opt11 from anti-HIV_PGT128_LightChain
caauccgcccucacccaaccccccuccgccuccggcucccccggccaauccaucaccaucuccugcaccggcaccuccaacaacuucgucuccugguaccaacaacacgccggcaaagcccccaaacucgucaucuacgacgucaacaaacgccccuccggcguccccgaccgcuucuccggcuccaaaucaggcaacaccgccucccuaaccgucuccggccuccaaaccgacgacgaagccgucuacuacugcggcucccucgucggcaacugggacgucaucuucggcggcggcaccaaacucacaguccuc

SEQ ID NO: 54725 - RNA, 405 nt, Artificial Sequence
  derived and/or modified sequence opt11 from anti-HIV_PGT128_HeavyChain
caaccccaacuccaagaauccggccccacccucgucgaagccuccgaaacccucucccuaaccugcgccgucuccggcgacuccaccgccgccugcaacucauucuggggcuggguccgccaaccccccggcaaaggccucgaaugggucggcucacuaucacacugcgccuccuacuggaaccgcggcuggaccuaccacaaccccucccucaaaucccgccucacccucgcccucgacacccccaaaaaccucgucuuccucaaacucaacuccgucaccgccgccgacaccgccaccuacuacugcgcccgauucggcggcgaaguccuccgcuacaccgacuggcccaaacccgccugggucgaccucuggggccgcggcacccucgucaccgucuccucc

SEQ ID NO: 54726 - RNA, 330 nt, Artificial Sequence
  derived and/or modified sequence opt11 from anti-HIV_PGT130_LightChain
caauccgcccucacacaaccccccuccgccuccggcucacucggccaauccgucaccaucuccugcaacggcaccuccuccgacaucggcggcuggaacuucgucuccugguaccaacaauuccccggccgcgccccccgccucaucaucuucgaagucaacaaacgccccuccggcguccccggccgcuucuccggcucaaaauccggcaacuccgccucccucaccgucuccggccuccaauccgacgacgaaggccaauacuucugcuccucccucuucggccgcugggacgucgucuucggcggcggcaccaaacucaccguccuc

SEQ ID NO: 54727 - RNA, 387 nt, Artificial Sequence
  derived and/or modified sequence opt11 from anti-HIV_PGT130_HeavyChain
caaguccaacuccaagaauccggccccggccucgucaaacccgccgaaacccucucccuaaccugcucagucuccggcgaauccaucaacaccggccacuacuacuggggauggguccgccaaguccccggcaaaggccucgaauggaucggccacauccacuacaccaccgccguccuccacaaccccucccucaaaucccgccucaccaucaaaaucuacacccuccgcaaccaaaucacccuccgccucuccaacgucaccgccgccgacacagccgucuaccacugcguccgcuccggcggcgacauccucuacuacuacgaauggcaaaaaccccacugguucucccccuggggccccggcauccacgucaccgucuccucc

SEQ ID NO: 54728 - RNA, 330 nt, Artificial Sequence
  derived and/or modified sequence opt11 from anti-HIV_PGT131_LightChain
caauccgcccucacccaaccccccucagccuccggcucccucggacaaucacucaccaucuccugcuccggcaccggcuccgacaucggcuccuggaacuucgucuccugguaccaacaauuccccggccgcgcccccaaccucaucaucuucgaagucaaccgccgccgcuccggcguccccgaccgcuucuccggcuccaaauccggcaacaccgccucccucaccgucuccggccuccgcuccgaagacgaagccgaauacuucugcuccucccucuccggccgcugggacaucgucuucggcggcggcaccaaagucaccguccuc

SEQ ID NO: 54729 - RNA, 387 nt, Artificial Sequence
  derived and/or modified sequence opt11 from anti-HIV_PGT131_HeavyChain
caaguccaacuccaagaauccggccccggccucgucaaacccuccgaaacccucucccuuaccugcaccgucuccggcgacuccaucaacaccggccaccacuacuggggcuggguccgccaaguccccggcaaaggccccgaauggaucgcccacauccacuacaacaccgccguccuccacaaccccgcccucaaaucccgcgucaccaucuccaucuucacccucaaaaaccucaucacccucucccucuccaacgucaccgccgccgacaccgccgucuacuucugcguccgcuccggcggcgacauccucuacuacaucgaauggcaaaaaccccacugguucuaccccuggggccccggcauccuagucaccgucuccucc

SEQ ID NO: 54730 - RNA, 321 nt, Artificial Sequence
  derived and/or modified sequence opt11 from anti-HIV_PGT135_LightChain
gaaaucgucaugacccaaucccccgacacccucuccgucucccccggcgaaaccgucacccucuccugccgcgccucccaaaacaucaacaaaaaccucgccugguaccaauacaaacccggccaauccccccgccucgucaucuucgaaaccuacuccaaaaucgccgccuuccccgcccgcuucgucgccuccggcuccggcaccgaauucacccucaccaucaacaacaugcaaucagaagacgucgccgucuacuacugccaacaauacgaagaauggccccgcaccuucggccaaggcaccaaagucgacaucaaa

SEQ ID NO: 54731 - RNA, 399 nt, Artificial Sequence
  derived and/or modified sequence opt11 from anti-HIV_PGT135_HeavyChain
caauugcaaaugcaagagagcgggcccgggcucgugaaaccgagcgagacccugagcuugagcuguaccgugagcggggacucgaucaggggcggggaauggggcgauaaagauuaccauugggggugggugcgccauagcgcgggcaagggcuuggaauggaucgggagcauacacuggcgcgggaccacacacuauaaagagagcuugcgaaggcgcgugagcaugagcauagacacgagcaggaacugguucucgcucaggcucgcgagcgugaccgcggcagauaccgcggucuauuucugugccaggcacaggcaccaugacguguucaugcuagugccaauagccgggugguuugacgugugggggcccgggguccaggucacggucucgagc

SEQ ID NO: 54732 - RNA, 321 nt, Artificial Sequence
  derived and/or modified sequence opt11 from anti-HIV_PGT136_LightChain
gaaaucgucaugacccaauccccccccacccucuccgucucccccggcgaaaccgccacccucuccugccgcgccucccaaaacgucaaaaacaaccucgccugguaccaacucaaacccggccaagccccccgccuccucaucuucgacgccuccucccgcgccggcggcauccccgaccgauucuccggcuccggcuacggcaccgacuucacccucaccgucaacuccguccaauccgaagacuucggcgacuacuucugccaacaauacgaagaauggccccgcaccuucggccaaggcaccaaagucgacaucaaa

SEQ ID NO: 54733 - RNA, 402 nt, Artificial Sequence
  derived and/or modified sequence opt11 from anti-HIV_PGT136_HeavyChain
caacuccaacuccaagaauccggacccggccucgucaaacccuccgaaacccucucccucacaugcaccgucuccggcggcucaaugcgcggcaccgacuggggcgaaaacgacuuccacuacggcuggauccgacaauccuccgccaaaggccucgaauggaucggcuccauccacuggcgcggccgcaccacccacuacaaaaccuccuuccgcucccgcgccacccucuccaucgacaccuccaacaaccgcuucucccucaccuucucauucgucaccgccgccgacaccgccguauacuacugcgcccgccacaaauaccacgacaucuuccgcgucguccccgucgccggcugguucgaccccuggggccaaggccuccucgucaccgucuccucc

SEQ ID NO: 54734 - RNA, 321 nt, Artificial Sequence
  derived and/or modified sequence opt11 from anti-HIV_PGT137_LightChain
gagaucaugaugacgcaaucgcccgcgaucuugagcgugagcccgggcgaucgcgcgaccuugagcugucgcgcgagccagagcgugaaaaauaaccuggccugguaccagaaaaggcccgggcaagcgcccaggcucuugaucuuugacacgagcucgcgcgcgagcgggaucccggccagguucucgggcgggggcucgggcacggaauuuaccuugaccgugaacucgaugcagagcgaggacuuugccacguacuauugccagcaauaugaagaguggccgcgcacguucgggcaagggaccaaggucgagaucaag

SEQ ID NO: 54735 - RNA, 399 nt, Artificial Sequence
  derived and/or modified sequence opt11 from anti-HIV_PGT137_HeavyChain
gaagugcacuuggaagagagcgggcccgggcucgugcgcccgagcgagaccuugagccugaccuguaccgcgagcgggggcucaaucagaggcggagaauggggcgauagcgauuaccauugggggugggugcgccauagcccggaaaagggcuuggaauggaucgggagcauacacuggcgcgggaccacgcacuauaacgcgcccuuucgcgggcgcgggcgccugagcauagacuugagcagaaaccaguucucgcucaggcucacgagcgugacagcggaagauacagcggucuauuacugugucaagcacaaguaccaugacauagucauggucgugcccauagccgggugguuugacccgugggggcaagggcuacaggucacggucucgagc

SEQ ID NO: 54736 - RNA, 336 nt, Artificial Sequence
  derived and/or modified sequence opt11 from anti-HIV_PGT141_LightChain
gacaccgucgucacccaauccccccucucccuacccgucacccccggcgaagccgccuccauguccugcuccuccacccaaucccuccgccacuccaacggcgccaacuaccucgccugguaccaacacaaacccggccaauccccccgccuccucauccgccucggcucccaacgcgccuccggcguccccgaccgcuucuccggcuccggcuccggcacccacuucacccucaaaaucucccgcgucgaagccgaagacgccgccaucuacuacugcaugcaaggccucaaccgccccuggaccuucggcaaaggcaccaaacucgaaaucaaa

SEQ ID NO: 54737 - RNA, 423 nt, Artificial Sequence
  derived and/or modified sequence opt11 from anti-HIV_PGT141_HeavyChain
caagugcaauugguccagagcgggcccgaggucaagaaaccgggcucgagcgugaaagugagcuguaaagcgagcgggaacacguucucgaaauaugacgugcacugggucaggcaagcgaccgggcaagggcucgagugggugggcuggaugucgcacgagggcgauaaaacggaaucggcacagcgauuuaaagggcgagugaccuuuaccagggacacgagcgcgagcacggccuauauggagcucaggggcuugaccucggacgauaccgcgaucuauuacuguaccaggggcucgaaacaucgauugcgcgauuacgugcucuaugacgauuacgggcucauaaacuaucaagaguggaaugacuaucucgaguucuuggacgugugggggcacgggaccgcaguaacggucucgagc

SEQ ID NO: 54738 - RNA, 336 nt, Artificial Sequence
  derived and/or modified sequence opt11 from anti-HIV_PGT142_LightChain
gacaccgucgucacccaauccccccucucccuccccgucacccccggcgaagccgccuccauguccugcuccuccacccaaucccuccgccacuccaacggcgccaacuaccucgccugguaccaacacaaacccggccaauccccccgccuccucauccgccucggcucccaacgcgccuccggcguccccgaccgcuucuccggcuccggcuccggcacccacuucacccucaaaaucucccgcgucgaagccgaagacgccgccaucuacuacugcaugcaaggccucaaccgccccuggaccuucggcaaaggcaccaaacucgaaaucaaa

SEQ ID NO: 54739 - RNA, 423 nt, Artificial Sequence
  derived and/or modified sequence opt11 from anti-HIV_PGT142_HeavyChain
caagugcaacugguccagagcgggcccgaggucaagaaaccgggcucgagcgugaaagugagcuguaaagcgagcgggaacacguucucgaaauaugacgugcacugggucaggcaagcgaccgggcaagggcucgagugggugggcuggaucucgcacgagcgcgauaaaacggaaucggcccagcgcuuuaaagggcgcgugaccuuuaccagggacacgagcgcgaccacggccuauauggagcucaggggcuugaccucggacgauaccgcgaucuauuacuguaccaggggcucgaaacaucgcuugcgcgauuacgugcucuaugacgauuacgggcucauaaacuaucaagaguggaaugacuaucucgaguucuuggacgugugggggcacgggaccgcggucacggucucgagc

SEQ ID NO: 54740 - RNA, 336 nt, Artificial Sequence
  derived and/or modified sequence opt11 from anti-HIV_PGT143_LightChain
gacaccgucgucacccaauccccccucucccuccccgucacccccggcgaagccgccuccauguccugcaccuccacccaaucccuccgccacuccaacggcgccaacuaccucgccugguaccaacacaaacccggccaauccccccgccuacucauccgccucggcucacaacgcgccuccggcguccccgaccgcuucuccggcuccggcuccggcacccacuucacccucaaaaucucccgcgucgaacccgaagacgccgccaucuacuacugcaugcaaggccucaaccgccccuggaccuucggcaaaggcaccaaacucgaaaucaaa

SEQ ID NO: 54741 - RNA, 423 nt, Artificial Sequence
  derived and/or modified sequence opt11 from anti-HIV_PGT143_HeavyChain
caagugcaauuggaacagagcggggccgaggucaagaaaccgggcucgagcgugaaagugagcuguaaagcgagcgggaacacguucucgaaauaugacgugcacugggucaggcaagcgaccgggcaagggcucgagugggugggcuggaugucgcacgagggcgauaaaacggaaucggcccagcgcuuuaaagggcgcgugaccuuuaccagggacacgagcgcgagcacggccuauauggagcucaggggcuugaccucggacgauaccgcgaucuauuacuguaccaggggcucgaaacaucgcuugcgcgauuacgugcucuaugacgauuacgggcucauaaacuaucaagaguggaaugacuaucuagaguucuuggacgugugggggcacgggaccgcggucacggucucgagc

SEQ ID NO: 54742 - RNA, 336 nt, Artificial Sequence
  derived and/or modified sequence opt11 from anti-HIV_PGT144_LightChain
gacaccgucgucacccaaucaccccucucccucuccgucacccccggcgaagccgccuccauguccugcaccuccacccaaucccuccgccacuccaacggcgccaacuaccucgccugguaccaacacaaacccggccaaucaccccgccuccucauccgccucggcucccaacgcgccuccggcguccccgaccgcuucuccggcuccggcuccggcacccacuucacccucaaaaucucccgcgucgaagccgacgacgccgccaucuacuacugcaugcaaggccucaaccgccccuggaccuucggcaaaggcaccaaacucgaaaucaaa

SEQ ID NO: 54743 - RNA, 423 nt, Artificial Sequence
  derived and/or modified sequence opt11 from anti-HIV_PGT144_HeavyChain
caagugcaauugguccagagcggggccgaggucaagaaaccgggcucgagcgugaaagugagcuguaaagcgagcgggaacacguucaggaaauaugacgugcacugggucaggcaagcgaccgggcaagggcucgagugggugggcuggaugucgcacgagggcgauaaaacggaaucggcccagcgcuuuaaagggcgcgugagcuuuaccagggacaauagcgcgagcacggccuauaucgagcucaggggcuugaccucggacgauaccgcgaucuauuacuguaccgggggcucaaaacaucgcuugcgcgauuacgugcucuaugacgauuacgggcuaauaaaccagcaagaguggaaugacuaucucgaguuccuggacgugugggggcacgggacagcggucacggucucgagc

SEQ ID NO: 54744 - RNA, 336 nt, Artificial Sequence
  derived and/or modified sequence opt11 from anti-HIV_PGT145_LightChain
gaagucguaaucacccaauccccccuauuccuccccguaacccccggcgaagccgccucccuauccugcaaaugcucccacucccuccaacacuccaccggcgccaacuaccucgccugguaccuccaacgccccggccaaaccccccgccuccucauccaccucgccacccaccgcgccuccggcguccccgaccgauucuccggcuccggcuccggcaccgacuucacccucaaaaucucccgcgucgaauccgacgacgucggcaccuacuacugcaugcaaggccuccacucccccuggaccuucggccaaggcaccaaagucgaaaucaaa

SEQ ID NO: 54745 - RNA, 420 nt, Artificial Sequence
  derived and/or modified sequence opt11 from anti-HIV_PGT145_HeavyChain
caagugcaauugguccagagcggggccgaggucaagaaaccgggcucgagcgugaaagugagcuguaaagcgagcgggaacucguucucgaaccaugacgugcacugggucaggcaagcgaccgggcaagggcucgaguggaugggcuggaugucgcacgagggcgauaaaacgggcuuggcccagaaauuucaagggcgagugaccauaaccagggacucgggcgcgagcacggucuauauggagcucaggggcuugacagcggacgacaccgcgaucuauuacugucucacaggaucgaaacaucgcuugcgcgauuacuuucucuauaacgaguacgggcccaauuacgaggaauggggcgauuacuuggccacgcucgaugucuggggccauggaacggccgugaccgugagcucg

SEQ ID NO: 54746 - RNA, 657 nt, Artificial Sequence
  derived and/or modified sequence opt11 from anti-HIV_PGT151_LightChain
gacaucgucaugacccaaacaccccucucccucuccgucacccccggccaaccagccuccaucucaugcaaauccucagaaucacuccgccaaucaaacggcaaaaccucccucuacugguaccgccaaaaacccggccaaagcccccaacuccuagucuucgaagucuccaaccgcuucuccggcgucuccgaccgcuucguaggcuccggcuccggcaccgacuucacccuccgcauaucccgagucgaagccgaagacgucggcuucuacuacugcaugcaauccaaagacuucccccuaaccuucggcggcggaaccaaagucgaccucaaacgcaccgucgccgcccccuccgucuucaucuucccacccuccgacgaacaacucaaauccggaaccgccuccgucguaugccuccucaacaacuucuacccccgcgaagccaaaguccaauggaaagucgacaacgcccuccaaucaggcaacucccaagaauccgucacugaacaagacuccaaagacuccaccuacucccuguccuccacccucacacucagcaaagcagacuacgaaaaacacaaagucuacgccugcgaaguaacccaccaaggccucucuucccccgucaccaaauccuucaaccgcggcgaaugc

SEQ ID NO: 54747 - RNA, 720 nt, Artificial Sequence
  derived and/or modified sequence opt11 from anti-HIV_PGT151_HeavyChain
agaguucaacucgucgaauccggcggcggcguaguacaacccggaaaaucaguccgacucuccugcgucgucuccgacuuccccuucuccaaauaccccauguacuggguccgacaagcccccggcaaaggccucgaaugggucgccgccaucuccggagacgccuggcacguaguauacuccaacuccguccaaggccgcuuccucgucucacgcgacaacgucaaaaacacccucuaccuagaaaugaacucccucaaaaucgaagacacugccgucuaccgaugcgcccgcauguuccaggaauccggcccuccccgccucgauagauggucaggccguaacuacuacuacuacuccggcauggacgucuggggccaaggcaccaccgucaccgucuccucugccuccaccaaaggccccuccgucuuuccccucgcccccuccagcaaauccacauccggcggcaccgcagcccucggcugccucgucaaagacuacuuccccgaacccguaacagucuccuggaacuccggagcccuaaccuccggcguccacacauuucccgccguccuccaauccuccggccucuacucacucuccucagucgucacaguccccuccuccucccucggcacacaaacauacaucugcaacgucaaccacaaacccuccaacaccaaaguagacaaacgaguagaaccaaaauccugcgacaaa

SEQ ID NO: 54748 - RNA, 657 nt, Artificial Sequence
  derived and/or modified sequence opt11 from anti-HIV_PGT152_LightChain
gacaucgucaugacccaaacaccacucucccucuccgucgaccccggccaacccgccuccaucucaugcaaauccucccaaucacucagacaauccaacggcaaaaccucccucuacugguaccaacaaaaacccggccaaucaccacaacuacucaucuucgaagucuccaaccgcuucuccggagucuccgaccgcuucgucggcucaggcuccggcaccgacuucacccuacgcauaucccgcgucgaggccgaagacgucggcuucuacuacugcaugcaaucaaaagacuucccccucaccuucggcggcggaaccaaagucgaccucaaacgcacagucgcagcccccuccguauucaucuucccacccuccgacgaacaacuaaaauccggcaccgccucagucguaugccuccucaacaacuucuacccccgcgaagccaaaguccaauggaaaguagacaacgcccuccaauccggcaacucccaagaguccgucaccgaacaagacucaaaagacuccaccuacagccucuccuccacccuaacccucuccaaggccgacuacgaaaaacacaaaguauacgccugcgaggucacccaccaaggccucuccucccccgucaccaaauccuucaaccgaggcgaaugc

SEQ ID NO: 54749 - RNA, 720 nt, Artificial Sequence
  derived and/or modified sequence opt11 from anti-HIV_PGT152_HeavyChain
cgcguccaacucgucgaauccggcggcggagucguccaacccggcaaauccguacgacucucgugcgucgucucagacuuccccuucuccaaauaccccauguacuggguccgccaagccccaggcaaaggccuagaauggguagccgccaucuccgccgacgccuggcacgucgucuacucaggcuccguccaaggacgauuccucgucucccgcgacaacuccaaaaacauccuauaccucgaaaugaacacccuaaaaauagaagacaccgcagucuaccgcugcgcacgaauguuccaagaauccggacccccacgcuucgacuccugguccggccgcaacuacuacuacuacuccggcauggacgucuggggccagggcaccaccgucaccguauccucagccucuacaaaaggccccuccgucuucccccucgcacccuccucaaaaucaaccuccggcggcaccgccgcccuaggcugccuaguaaaagacuacuucccagaacccgucaccgucuccuggaacuccggcgcccucaccuccggcguccacacauuccccgccguccuccaaucauccggccucuacucccucuccucagucgucaccguccccuccuccucccucggcacccaaaccuacaucugcaacguaaaccacaaacccucuaacaccaaagucgacaaacgagucgaacccaaauccugcgacaaa

SEQ ID NO: 54750 - RNA, 309 nt, Artificial Sequence
  derived and/or modified sequence opt11 from anti-HIV_VRC-CH30_LightChain
gacauccaaaugacccaaucccccuccucccucuccgccucccucggcgaccgcgucaccaucaccugccaagccucccgcggcaucggcaaagaccucaacugguaccaacaaaaacccggcaaagcacccaaacuccucgucuccgacgccuccauccucgaaggcggcguccccucccgcuucuccggcuccggcuuccaccaaaacuucucccucaccaucuccucccuccaacccgaagacgucgccaccuacuucugccaacaauacgaaaccuucggccaaggcaccaaagucgacaucaaa

SEQ ID NO: 54751 - RNA, 393 nt, Artificial Sequence
  derived and/or modified sequence opt11 from anti-HIV_VRC-CH30_HeavyChain
caaguccaacucguccaauccggcgccgccguccgcaaacccggcgccuccgucaccgucuccugcaaauucgccgaagacgacgacuacuccccccacugggucaaccccgcccccgaacacuacauccacuuccuccgccaagcccccggccaacaacucgaauggcucgccuggaugaaccccaccaacggcgccgucaacuacgccuggcaacuccacggccgccucaccgccacccgcgacggcuccaugaccaccgccuuccucgaaguccgcucccuccgcuccgacgacaccgccgucuacuacugcgcccgcgcccaaaaacgcggacgcuccgaaugggccuacgcccacuggggccaaggcacccccgucgccguauccucc

SEQ ID NO: 54752 - RNA, 309 nt, Artificial Sequence
  derived and/or modified sequence opt11 from anti-HIV_VRC-CH31_LightChain
gacauccaaaugacccaaucccccuccucccucuccgccucccucggcgaccgcgucaccaucaccugccaagccucccgcggcaucggcaaagaccucaacugguaccaacaaaaagccggcaaagcccccaaacuccucgucuccgacgccuccacccucgaaggcggcguccccucccgcuucuccggcuccggcuuccaccaaaacuucucccucaccaucuccucccuccaagccgaagacgucgccaccuacuucugccaacaauacgaaaccuucggccaaggcaccaaagucgacaucaaa

SEQ ID NO: 54753 - RNA, 393 nt, Artificial Sequence
  derived and/or modified sequence opt11 from anti-HIV_VRC-CH31_HeavyChain
caaguccaacucguccaauccggcgccgccguccgcaaacccggcgccuccgucaccgucuccugcaaauucgccgaagacgacgacuacucccccuacugggucaaccccgcccccgaacacuucauccacuuccuccgccaagcccccggccaacaacucgaauggcuagccuggaugaaccccaccaacggcgccgucaacuacgccugguaccucaacggccgcgucaccgccacccgcgaccgcuccaugaccaccgccuuccucgaagucaaaucccuccgcuccgacgacaccgccgucuacuacugcgcccgcgcacaaaaacgcggccgcuccgaaugggccuacgcccacuggggccaaggcacccccgucgucgucuccucc

SEQ ID NO: 54754 - RNA, 309 nt, Artificial Sequence
  derived and/or modified sequence opt11 from anti-HIV_VRC-CH32_LightChain
gacauccaaaugacccaaucccccuccucccucuccgccucccucggcgaccgcgucaccauaaccugccaagccucccgcggcaucggcaaagaccucaacugguaccaacaaaaacccggccgcgcccccaaacuccucgucuccgacgccuccauccucgaaggcggcguccccacccgcuucuccggcuccggcuuccaccaaaacuucucccucaccaucuccucccuccaagccgaagacgucgccaccuacuucugccaacaauacgaaaccuucggccaaggcaccaaagucgacaucaaa

SEQ ID NO: 54755 - RNA, 393 nt, Artificial Sequence
  derived and/or modified sequence opt11 from anti-HIV_VRC-CH32_HeavyChain
caaguccaacucguccaauccggcgccgccguccgcaaacccggcgccuccgucaccgucuccugcaaauucgccgaagacgacgacuucucaccccacugggucaaccccgcccccgaacacuacauccacuuccuccgccaagcccccggccaacaacucgaauggcucgccuggaugaaacccacaaacggcgccgucaacuacgccuggcaacuccaaggccgcgucaccgucacccgcgaccgcucccaaaccaccgccuuccucgaagucaaaaaccuccgcuccgacgacaccgccgucuacuacugcgcccgcgcccaaaaacgcggccgcuccgaaugggccuacgcccacuggggccaaggcacccccgucgucaucuccgcc

SEQ ID NO: 54756 - RNA, 309 nt, Artificial Sequence
  derived and/or modified sequence opt11 from anti-HIV_VRC-CH33_LightChain
gacauccaaaugacccaaucccccuccucccucuccgccucccucggcgaccgcgucaccaucaccugccaagccucccgcggcaucggcaaagaccucaacugguaccaacaaaaacgcggccgcgccccccgccuccucgucuccgacgccuccguccucgaaggcggcguccccucccgauucuccggcuccggcuuccaccaaaacuucucacucaccaucuccacccuccaacccgaagacgucgccaccuacuucugccaacaauacgaaaccuucggccaaggcaccaaagucgacaucaaa

SEQ ID NO: 54757 - RNA, 393 nt, Artificial Sequence
  derived and/or modified sequence opt11 from anti-HIV_VRC-CH33_HeavyChain
caaguccaacucguccaauccggcgccgccguccgcaaacccggcgccuccaucuccgucuccugcaaauucgccgacgccgacgacuacuccccccacuggaugaaccccgcccccgaacacuacauccacuuccuccgccaagcccccggccaacaacucgaauggcucgccuggaugaaccccaccaacggcgccgucaacuacgccugguaccucaacggccgcgucaccgccacccgcgaccgcuccaugaccaccgccuuccucgaaguccgcucccuccgcuccgacgacaccgccgucuacuacugcgcccgcgcccaaaaacgcgcccgcuccgaaugggccuacgcccacuggggccaaggcacccccgucgucgucuccucc

SEQ ID NO: 54758 - RNA, 309 nt, Artificial Sequence
  derived and/or modified sequence opt11 from anti-HIV_VRC-CH34_LightChain
gacauccaaaugacccaaucccccuccucccucuccgccucccucggcgaccgcgucaccaucaccugccaagccucccgcggcaucggcaaagaccucaacugguaccaacaaaaagccggcaaagcccccaaacuccucgucuccgacgccuccauccucgaaggcggcguccccucccgcuucuccggcucaggcuuccaccaaaacuucucccucaccaucuccucccuccaacccgaagacgucgccaccuacuucugccaacaauacgaaaccuucggccaaggcaccaaagucgacaucaaa

SEQ ID NO: 54759 - RNA, 393 nt, Artificial Sequence
  derived and/or modified sequence opt11 from anti-HIV_VRC-CH34_HeavyChain
caaguccaacucguccaauccggcgccgccguccgcaaacccggcgccuccgucacagucuccugcaaauucgccgaagacgacgacuggucaccccacugggucaaccccgcccccgaacacuacauccacuuccuccgacaagcccccggccaacaacuagaauggcucgccuggaugaacccaaccaacggcgccgucaacuacgccuggcaacucaacggccgccucaccgccacccgcgacaccuccaugaccaccgccuuccucgaagucaaaucccuccgcucagacgacaccgccgucuacuacugcgcccgagcccaaaaacgcggccgcuccgaaugggccuacgcccacuggggacaaggcacccccgucgucgucuccucc

SEQ ID NO: 54760 - RNA, 306 nt, Artificial Sequence
  derived and/or modified sequence opt11 from anti-HIV_VRC-PG04_LightChain
gaaaucguccucacccaaucccccggcacccucucccucucccccggcgaaaccgccucccucuccugcaccgccgccuccuacggccacaugaccugguaccaaaaaaaacccggccaaccccccaaacuacucaucuucgccaccuccaaacgcgccuccggcauccccgaccgcuucuccggcucccaauucggcaaacaauacacccucaccaucacccgcauggaacccgaagacuucgcccgcuacuacugccaacaacucgaauucuucggccaaggcacccgccucgaaauccgccgc

SEQ ID NO: 54761 - RNA, 375 nt, Artificial Sequence
  derived and/or modified sequence opt11 from anti-HIV_VRC-PG04_HeavyChain
cagguccagcucgugcaaucgggcucgggagugaaaaagcccggggccucggucaggguaucgugcuggaccucggaagauaucuuugaaaggacagagcucauacacugggucaggcaagcgcccgggcaagggcuagaguggauaggcugggucaagaccgugaccggggccgugaacuuuggcucgcccgauuucaggcaaaggguaucgcucacgcgcgaucgcgaucucuuuaccgcgcacauggacauacgcgggcucacgcaaggggacacggccacguacuuuugcgcgcgccagaaauuuuacacgggagggcaagggugguauuucgaucucuggggcaggggcacgcucauaguagugagcucg

SEQ ID NO: 54762 - RNA, 303 nt, Artificial Sequence
  derived and/or modified sequence opt11 from anti-HIV_VRC-PG04b_LightChain
gaaaucguccucacccaaucccccggcacccucucccucucccccggcgaaaccgccucccucuccugcaccgccgccuccuacggccacaugaccugguaccaaaaaaaacccggccaaccccccaaacuccucaucuucgccaccuccaaacgcgccuccggcauccccgaccgcuucuccggcucccaauucggcaaacaauacacccucaccaucacccgcauggaacccgaagacuucgccggcuacuacugccaacaagucgaauucuucggccaaggcacccgccucgaaauccga

SEQ ID NO: 54763 - RNA, 375 nt, Artificial Sequence
  derived and/or modified sequence opt11 from anti-HIV_VRC-PG04b_HeavyChain
cagguacagcucgugcaaucgggcucgggcgugaaaaagcccggggccucggucagggucucgugcuggaccucggaagauaucuuugaaaggacagagcuaauacacugggucaggcaagcgccagggcaagggcucgaguggauaggcugggucaagaccgugacaggggccgugaacuuuggcucgcccaauuucaggcacagggucucgcucacgcgcgaucgcgaucucuuuaccgcgcacauggacauaagagggcucacgcaaggggacacggcaacguacuuuugcgcacgacagaaauuugaaaggggcgggcaagggugguauuucgaucucuggggcaggggaacgcuaauagucgugagcucg

SEQ ID NO: 54764 - RNA, 612 nt, Artificial Sequence
  derived and/or modified sequence opt11 from anti-HIV_VRC-PG20_LightChain
caauccgcccucacccaacccccauccgucuccggcucccccggccaauccaucacccucuccugcaccggcgccuccacauccgucgccugguaccaacaauacgccgacaaagccccccgccucaucgucuucgacggcaacaaacgccccucagacaucuccucccgcuucuccggcucccaauccggcggcacagcaucacuuaccaucucaggccuccaauccgaagacgaagccuacuaccacugcaacgcauucgaauucuucggcggcggaaccaaacucaccguacucucccaacccaaagccgccccauccgucacacucuucccccccucauccgaagaacuccaagccaacaaagccacccuaguaugccucaucuccgacuucuacccaggcgccgucacagucgccuggaaagccgacucaucccccguaaaagccggcgucgaaaccaccacccccuccaaacaauccaacaacaaauacgccgcauccuccuaccuaucucucacccccgaacaauggaaaucccauaaauccuacuccugccaagucacccacgaaggcuccaccgucgaaaaaaccgucgccccaaccgaaugc

SEQ ID NO: 54765 - RNA, 681 nt, Artificial Sequence
  derived and/or modified sequence opt11 from anti-HIV_VRC-PG20_HeavyChain
gaaguccaccucaugcaauccggaaccgaaaugaaaaagcccggcgccuccguccgcgucacaugccaaaccuccggauacaccuucucagacuacuucauccacuggcuccgacaaguccccggccgcggcuucgaauggaugggcuggaugaacccccaauggggccaagucaacuacgcccgcaccuuccaaggccgcguaaccaugacccgcgacgucuaccgcgaagucgccuaccucgaccuacgaucacuaaccuucgccgacaccgccgucuacuucugcgcccgccgcaugcgcucccaagaccgcgaaugggacuuccaacacuggggccaaggcacccgcaucaucgucuccuccgccuccaccaaaggacccucagucuuuccccucgcaccaucaucaaaaagcaccagcggcggcaccgccgcccucggcugccucgucaaagacuacuuccccgaacccgucaccgucuccuggaacuccggcgcccucaccucuggcguacacaccuuccccgccguccuccaaagcuccggccucuacucccucuccuccguagucacagucccuuccuccucccuaggcacccaaacauacaucugcaacgucaaccacaaacccuccaacacaaaagucgacaaaaaaguagaacccaaauccugcgacaaa

SEQ ID NO: 54766 - RNA, 1059 nt, Artificial Sequence
  derived and/or modified sequence opt11 from anti-HIV_VRC-PG20_G-Chain
gucuggaaagacgccgacaccacacucuucugcgcaagcgacgccaaagcccacgaaaccgaaguccacaacguaugggccacccacgccugcguacccaccgacccgaacccccaagaaauccaccuagaaaacgucaccgaaaacuucaacauguggaaaaacaacaugguggaacaaaugcaagaagacgucauaucucucugggaccagagccuccaacccugcguaaaacucaccggaggcucagucaucaaacaagccugcccaaaaaucagcuucgaccccauccccauccacuacugcacaccagcagguuacguuauacuaaaaugcaacgacaaaaacuucaacggaacaggacccugcaagaacgucuccuccguccaaugcacacacggaauaaaacccgucguauccacccaacuccuccuaaacggcucccuugccgaggaagaaaucaucauccgcagcgaaaaccuaaccaacaacgccaaaaccaucauaguccaccucaacaaauccgucgaaaucaacugcacacgaccauccaacggcggcuccggcuccggcggcgacauccgaaaagccuacugcgagaucaacggcacaaaauggaacaaaguacucaaacaaguaaccgaaaaacuuaaagaacacuucaacaacaaaacaaucaucuuccaaccacccuccgguggcgaucuagaaaucacaaugcaccacuuuaacugccgcggagaguucuucuacugcaacaccacccaacuauucaacaacacaugcaucggcaacgaaaccaugaaaggcugcaacggcacaauaacccuccccugcaaaaucaaacaaaucaucaacauguggcaaggcaccggacaagccauguacgcaccucccaucgacggaaaaaucaacugcgucucaaacaucaccggcauccuccuaacccgagacggcggcgccaacaacaccucaaacgaaaccuuccgccccggcggcggcaacaucaaagacaacuggcgcuccgaacucuacaaauacaaagucguacaaauagaa

SEQ ID NO: 54767 - RNA, 312 nt, Artificial Sequence
  derived and/or modified sequence opt11 from anti-HIV_VRC02_LightChain
gaaaucguccucacccaaucccccggcacccucucccucucccccggcgaaaccgccaucaucuccugccgcaccucucaauacggcucccucgccugguaccaacaacgccccggccaagccccccgccucgucaucuacuccggcuccacccgcgccgccggcauccccgaccgauucuccggcucccgcuggggccccgacuacaaccucaccauccgcaaccucgaauccggcgacuucggccucuacuacugccaacaauacgaauucuucggccaaggcaccaaaguccaagucgacaucaaacgc

SEQ ID NO: 54768 - RNA, 363 nt, Artificial Sequence
  derived and/or modified sequence opt11 from anti-HIV_VRC02_HeavyChain
cagguccagcucgugcaaucgggcgggcaaaugaaaaagcccggggaaucgaugaggaucucgugccaggccucgggcuaugaauuuaucgauugcacgcucaauugggugcgcuuggccccgggcaggcgcccggaauggauggggugguugaaaccgcgcgggggcgcggucaauuacgcgcgcccgcuccagggcagggucacgaugacgcgcgaugucuauagcgauaccgcguucuuggaauugcgcucgcucacggccgaugacacggccguguacuauugcacgcgcgggaaaaauugcgauuacaauugggauuucgagcacuggggcaggggcacgcccgugaccgugagcucg

SEQ ID NO: 54769 - RNA, 309 nt, Artificial Sequence
  derived and/or modified sequence opt11 from anti-HIV_VRC03_LightChain
gaaaucguccucacccaaucccccggcauccucucccucucccccggcgaaaccgccacccucuucugcaaagccucccaaggcggcaacgccaugaccugguaccaaaaacgccgcggccaagucccccgccuccucaucuacgacaccucccgccgcgccuccggcguccccgaccgcuucgucggcuccggcuccggcaccgacuucuuccucaccaucaacaaacucgaccgcgaagacuucgccgucuacuacugccaacaauucgaauucuucggccucggcuccgaacucgaaguccaccgc

SEQ ID NO: 54770 - RNA, 390 nt, Artificial Sequence
  derived and/or modified sequence opt11 from anti-HIV_VRC03_HeavyChain
caagugcaauugguccagagcggggccgugaucaagaccccgggcucgagcgugaaaauaagcugucgcgcgagcggguacaauuucagggacuauagcauacacugggucaggcucauacccgauaaaggguucgaguggauaggcuggaucaagcccuuguggggcgccgugagcuaugccaggcaacugcaagggcgagugagcaugaccaggcaauugagccaggacccggacgaucccgauuggggcgucgcguacauggaauuuagcgggcucacgcccgcggacacggccgaguacuucugcguacgcagagggucgugcgauuacuguggggauuucccguggcaguacuggggccagggcacggucguggucgugagcucg

SEQ ID NO: 54771 - RNA, 630 nt, Artificial Sequence
  derived and/or modified sequence opt11 from anti-HIV_VRC23_LightChain
gaaaucguaaugacccaaucccccgucaccgucagcguaucccgcggaggaaccgccacccucuccugccgcgcaagccaaggcgucggcuccgacgucgccugguaccaacacaaacccggacaaacaccccgccuccucaucuacggcgccuccacccgcgccuccggcguccccgaacgauucuccggcuccggcuuccacgucgacuucacacuaucaaucuccggccuccaacccgaagacgucgccauauacuacugccaacaauacgaaaccuucggccaaggaaccaaggucgaaauaaaacgcaccgucgccgcccccagcgucuucaucuucccacccuccgacgaacaacucaaauccggcacagccucagucgucugccuccucaacaacuucuacccccgcgaggccaaaguccaauggaaagucgacaacgcacuccaaagcggcaacucccaagaauccgucaccgaacaagacagcaaagacucaaccuacagccuaagcucuacccuaacccuauccaaagccgacuacgaaaaacacaaaguauacgccugcgaagucacccaccaaggccuauccucccccgucaccaaauccuucaaccgcggcgaaugc

SEQ ID NO: 54772 - RNA, 672 nt, Artificial Sequence
  derived and/or modified sequence opt11 from anti-HIV_VRC23_HeavyChain
gaaguacaauucguacaauccggcgccgaagucaaaaaacccggagcauccgucagagucuccugcgaagccucaggcuacucauucacagacuacguccuacaauggauccgccaagcccccggccaacgccccgaauggaugggcuggaucaaacccgaacgcggcgccgucuccuacgccccccaauuccaaggacgacucacccucacccgagaccuauacaccgaaaccgccuacaugcacuucaaaaaccuccgcucagacgacaccgccaucuacuacugcgcacgcggcguccgacgcgacgcauccugguggcuccaguucuggggccaaggcacacucgucaccgucuccuccgccucaaccaaaggccccuccgucuucccccucgcccccuccuccaaaagcacauccggaggcaccgccgcccucggcugccucgucaaagacuacuuccccgaaccagucaccgucuccuggaacuccggcgcccuuaccuccggcguacacacauuccccgccguacuccaauccuccggccucuacucccucucauccgucgucacagucccauccuccucccucggcacccaaaccuacaucugcaacgucaaccacaaacccuccaacaccaaagucgacaaaaaagucgaaccaaaaucaugc

SEQ ID NO: 54773 - RNA, 1077 nt, Artificial Sequence
  derived and/or modified sequence opt11 from anti-HIV_VRC23_G-Chain
gucuggcgcgacgcagacaccacacucuucugcgccagcgacgcaaaagccuacgaaacagaaaagcacaacgucugggccacccacgccugcguccccacagaccccaacccccaagaaauccaccuagacaacgucaccgaaaaauucaacauguggaaaaacaacauggucgaacaaaugcacacagauaucaucagccuaugggaccaaucacucaaacccugcgucaaacucaccggaggcucagccaucacccaggccugccccaaagucuccuucgaaccaauaccaauucacuacugcacacccgccggauucgccauccucaaaugcaaagacgaaggauucaacggaaccggacucugcaaaaacgucuccaccguccaaugcacccacggcauaaaacccguagucucaacccagcuacuccucaacggcucacucgccgaaaagaacauuaccauccgcuccgaaaacaucaccaacaacgccaaaauaauaaucguacaacucguccaacccgucaccaucaaaugcauccgacccaacaacggcggcucaggaucgggcggggacauacgccaagcccauugcaacgucacacgauccagauggaacaaaacccuccaagaaguagccgaaaaacuccgcaccuacuucggaaacaaaacaaucaucuucgcgaacagcuccggcggagaccuugaaauaaccacccacagcuucaacugcggcggcgaguucuucuacugcaacacaucaggccuauucaacuccacaugguacgucaacuccacauggaacgacaccgacuccacccaagaaucaaacgacacaauaacacuccccugccgaaucaaacaaaucaucaacauguggcaacgcgccggccaagcaauguacgccccacccauccccggcgucaucaaaugcgaauccaacaucacuggccuccuccucacccgcgacggcggaaaagacaacaacguaaacgaaaccuuccgacccggcggcggcgacaugcgcgacaacuggcgcucagaacucuacaaauacaaagucgucgaaaucgaa

SEQ ID NO: 54774 - RNA, 648 nt, Artificial Sequence
  derived and/or modified sequence opt11 from anti-HIV_5CCK_LightChain
caauccgcccucacccaacccgccuccguauccgccucacccggccaauccaucacaaucuccugcuccggcacccgcuccgacguaggcggcuacgacuucgucuccugguaccaacaacaccccggcaaaguccccaaacuuaucauauacgaaguuaccaaacgccccuccggaaucccccaacgcuucuccggcuccaaaucaggcaacaccgccucccuuaccaucuccggacuacaagccgacgacgaagccgacuacuacugcugcuccuacgccaacuacgacaaacuaauccucggcggcggcacaaaacucaccguccucggccaaccaaaagccaaccccaccgucacccucuucccacccuccuccgaagaacuacaagccaacaaagccacccucgucugccuaaucuccgacuucuaccccggcgcagucaccgucgccuggaaagccgacggcucccccgucaaagccggcgucgaaacaaccaaaccauccaaacaauccaacaacaaauacgccgccuccucuuaccucucgcucacacccgaacaauggaaaucccaccgauccuacuccugccaagucacccacgaaggcucaaccgucgaaaaaaccgucgcccccaccgaaugcucc

SEQ ID NO: 54775 - RNA, 696 nt, Artificial Sequence
  derived and/or modified sequence opt11 from anti-HIV_5CCK_HeavyChain
caagugcaacugguacagagcggggccgaaaugaaggacccgggcgcgagcguaaaagugagcugccgcgcgagcggcuacaaguucacggacuacuacaugcacugggucagacaagcgcccggacaagggcucgaguggguaggaugggucaacaccaauggaggguucacaaaauacggcgcgaaauuccaagggcgcgugaccgugaccagggacacgaguacgaacacggucuuccucgagcuaucacgccugaccuucggcgauaccgcgauguacuucugcgcacggcccaugcgcccggucucgcacgggaucgacuacucgggcuuguucguauuccaguucuggggcagaggaacgauggugaccguaagcucggccucgaccaagggcccgagcguauucccgcucgcgcccucgagcaagagcacgagcggaggcaccgccgcgcucggaugccuggucaaggacuauuucccggaaccggucacggucucguggaacagcggagcccuaacaucaggcguacacacguucccggccgugcuacagagcucgggacuguacucacucucgagcguagucacggucccgagcucgagccuaggcacgcaaacguacauaugcaacgucaaccacaagcccucgaacacaaaaguggacaagaaaguggaaccgaaaucaugcgac

SEQ ID NO: 54776 - RNA, 648 nt, Artificial Sequence
  derived and/or modified sequence opt11 from anti-HIV_5AWN_LightChain
caauccguacucacccaacccgccucugucuccgccucccccggccaaucaaucaccgucuccugcaccggcucccgaaacgacgucggcggcuacgacuucgucucaugguaccaacgccacccuggcggcguccccaaacucaucaucuaugaaaucuccaaacgacccucaggcaucccccaacgcuucucaggcucccgcucaggcaacaccgccucacucaccaucagcggccuccaagacgacgacgaagccgacuacuacugcugcuccuacgcauccuacgaccgccucaucuucggcggaggcacacgagucuccguccuccgccaacccaaagccgcccccucagucacccuauucccacccuccuccgaagaacugcaagcaaacaaagccacacucgucugccucaucuccgacuucuacccaggcgccgucaccgucgccuggaaagccgacggcucccccgucaaagccggagucgaaaccaccaaacccuccaaacaauccaacaacaaauacgccgccucauccuaccucucccucacucccgaacaauggaaaucccaccgcuccuacucuugccaagucacccacgaaggcuccaccgucgaaaaaaccgucgcccccaccgaaugcucc

SEQ ID NO: 54777 - RNA, 696 nt, Artificial Sequence
  derived and/or modified sequence opt11 from anti-HIV_5AWN_HeavyChain
caaguccaacuaaugcaauccggcgcccaacuccgcgaccccggcgacucccucaaaaucuccugcaaagcauccggcuacaacuucaucgacuaccacauccacuggguccgccucgcccccggccguggccuagaauggaugggcuggaucgaccccgucggcggcaucaccaaauacgccggccaauuccaaggccgacuaucccuaacccgcgacaccuccaccaacacccucuuccuugaacucucccgccuaaccgccggcgacaccgccgucuacuucugcgcccgcuccaugcgccccgucgaccacggcaucgacuacuccggccuauucguauuccacuucuggggccgcggcucagacguccucgucuccuccgccucuaccaaaggccccuccgucuucccccucgcccccuccucaaaauccaccuccggcggcaccgccgcccuaggcugccuagucaaagacuacuucccagaacccgucaccgucuccuggaacucaggcgcccucaccuccggcguccacacauucccagccguccuccaauccuccggccucuacucccucuccuccgucgucaccguccccuccuccucccuaggcacccaaaccuacaucugcaacgucaaccacaaacccucgaacacaaaagucgacaagaaagucgaacccaaauccugcgau

SEQ ID NO: 54778 - RNA, 645 nt, Artificial Sequence
  derived and/or modified sequence opt11 from anti-HIV_3QEG_LightChain
gaaaucguaaugaugcaaucacccggcacccuaucccucucccccggcgaacgcgccacacucucaugccgcgcaucccaauccgucuccagcuccuaccucgccugguaccaacaaaaacccggccaagcaccacgccuccucaucuacggcgccuccucccgcgccaccggcauccccgaccgcuucucaggaucaggcuccggcacagacuucacccucaccauaucucgccucgaacccgaagacuucgccguauacuacugccaacaauacggcuccucccccgaaacauucggacaaggcaccaaagucgaaaucaaacgcaccgucgcagcccccuccgucuucaucuucccacccuccgacgaacaacucaaauccggcaccgccuccguagucugccuacucaacaacuucuacccacgcgaagcaaaaguccaauggaaagucgacaacgcacuccaauccggcaacucccaagaaucugucaccgaacaagacuccaaagacucaacauacucccucuccuccacccucacccuauccaaagcugacuacgaaaaacacaaagucuacgccugcgaagucacccaccaaggccuaucuucccccgucaccaaauccuucaaccgcggcgaaugc

SEQ ID NO: 54779 - RNA, 717 nt, Artificial Sequence
  derived and/or modified sequence opt11 from anti-HIV_3QEG_HeavyChain
caaguccaacuuguccaauccggcgccgaagucaaaaaacccggcucauccgucaaagucucaugccgagccucccgcggcaccuucuccuccuacggcaucaccuggguccgccaagcacccggccaaggccuagaauggaugggcggcaucaucccaaucuucgacgucaccaacuacgcacaaaacuuccaaggccgaguagcaaucaccaccgacgccgaaauguccaccgccuacauggaacuccgcucccucaaauccgaagacucagccgucuacuacugcgccuccgacucccgagacuucuccuacuacgaacccggcaccuccuacucccacuacuacaacaucauggacgucuggggacaaggcaccaccgucacugucuccuccgccuccacaaaaggaccauccgucuucccccucgcccccuccucaaaauccaccuccggcggaaccgcagcacucggcugccuaguaaaagacuacuuccccgaacccguaaccgucucauggaacuccggcgcccuaaccucaggcguacacaccuuccccgccguccuccaauccuccggccucuacucccucucuucagucgucaccguccccuccuccucccucggcacccaaaccuacaucugcaacgucaaccacaaacccuccaacaccaaagucgacaaacgagucgaaccaaaauccugcgacaaaacccac

SEQ ID NO: 54780 - RNA, 690 nt, Artificial Sequence
  derived and/or modified sequence opt11 from anti-HIV_1N0X_K-Chain
caaguccaacuaguccaauccggcgccgaagucaaaaaacccggcgccuccgucaaagucuccugccaagccuccggauaccgcuucuccaacuucgucauccacuggguccgccaagcccccggccaacgauucgaauggaugggcuggaucaaccccuacaacggcaacaaagaauucuccgccaaauuccaagaccguguaacauucaccgccgacaccuccgccaacaccgccuacauggaacuccgaucccuccgcuccgccgacaccgccgucuacuacugcgcccgcgucggccccuacuccugggacgacuccccccaagacaacuacuacauggacgucuggggcaaaggaaccaccguaaucgucuccuccgccuccaccaaagguccuuccguauucccccucgcccccuccuccaaaucaaccuccggcggcaccgccgcccucggaugccucgucaaagauuacuuccccgaacccgucaccgucuccuggaacuccggcgcccuaaccuccggcguccacaccuuccccgccguccuccaauccuccggccucuacucccucuccuccgucgucaccguccccuccucaucccucggcacacaaacauacaucugcaacgucaaccacaaacccuccaacaccaaaguagacaaaaaagucgaacccaaauccugc

SEQ ID NO: 54781 - RNA, 645 nt, Artificial Sequence
  derived and/or modified sequence opt11 from anti-HIV_1N0X_M-Chain
gaaaucguccucacccaaucccccggcacccuaucacucucacccggagaacgcgccaccuucuccugccgcucaucccacuccauccgaucccgccgcguagcaugguaccaacacaaacccggccaagcaccccgccucguaauccacggcguauccaaccgcgccuccggcaucucagacagauucuccggcucgggcucaggcaccgacuucacccuaaccaucacccgcgucgaacccgaagacuucgcccucuacuacugccaagucuacggcgcauccuccuacaccuucggccaaggcaccaaacucgaacgaaaacgaaccgucgcagcccccagcgucuucaucuucccacccuccgacgaacaacucaaauccggcaccgccucagucgucugccuccucaacaacuucuacccccgcgaagccaaaguacaauggaaagucgacaacgcccuccaauccggcaacucccaagaauccgucaccgaacaagauuccaaagacuccaccuacucccuauccuccacccuaacccucuccaaagccgacuacgaaaaacacaaagucuacgccugcgaagucacccaccaaggccugcgaucacccguaaccaaauccuucaaccgcggcgaaugc

SEQ ID NO: 54782 - RNA, 654 nt, Artificial Sequence
  derived and/or modified sequence opt11 from anti-HIV_3QEH_HeavyChain
gacaucgucaugacacaauccccccucucccuacccgucacccccggcgaagccgccuccaucuccugccgcuccucccaaucccuacuccacaccaacggcuuccaauaccucgacugguaccuccaaaaacccggccaauccccucaacuccucaucuaccucggcuccaacagggccacaggagucccccaccgcuucucaggcuccggcuccggcaccgaauucacccucaaaaucucccgcgucgaagccgaagacgucggcgucuacuacugcaugcaagccaaagaaucccccacauucggacaaggcaccaaagucgaaauaaaacgcaccgucgccgcccccuccgucuucaucuucccccccuccgacgaacaacucaaauccggcaccgccuccgucgucugccuccucaacaacuucuacccccgcgaagccaaaguccaauggaaagucgacaacgcacuccaaucuggcaacucccaagaauccgucaccgaacaagacuccaaagacuccaccuacucccucuccuccacccuaacccucuccaaagccgacuacgaaaaacacaaagucuacgccugcgaagucacccaccaaggccucagcucccccgucaccaaauccuucaaccgcggagaaugc

SEQ ID NO: 54783 - RNA, 696 nt, Artificial Sequence
  derived and/or modified sequence opt11 from anti-HIV_3QEH_G-Chain
caaguccaacucguccaauccggagccgaaguccgcaaacccggcgccuccgucacagucucaugcaaaaccucaggcuacaccuucgucaacuucuacaucgucuggguccgccaagcaccaggccaaggccucgaauggaugggcguaaucaaccccuuccgcggcgacaccuacuucgcccaaaaauucaaaggccgcgucacacucacacgcgacaccuccaccucuaccgucuucauggaacucuccucccuacgcuccgacgacaccgccaucuacuacugcgcacgcgaccucgaaaugcgcgacggcaacaaccacggaucacaccucgaauuuuggggccaaggcacccucgucaccgucuccuccgccuccaccaaaggcccaucaguuuucccccuagcccccuccuccaaauccacauccggcggcaccgccgcccucggaugccuagucaaagacuacuuccccgaacccgucaccgucucauggaacuccggcgcccuaacuuccggcguacacacauuccccgccguccuccaauccucaggacucuauucacucucauccgucgucaccguccccuccuccucccucggcacccaaacauacaucugcaacguaaaccacaaacccuccaacacaaaagucgacaaacgcgucgaaccaaaauccugcgauaaaacacac

SEQ ID NO: 54784 - RNA, 678 nt, Artificial Sequence
  derived and/or modified sequence opt11 from anti-HIV_2B1H_HeavyChain
gaaauccaacucgaacaauccggcgccgaagucaaaaaaucaggagaaucccucaaaaucuccugccaaaccucaggauacuccuucucugacuacuggauaggcuggguacgccaaaugcccggcaaaggccucgaauggaugggcauauucuaccccggcgacuccgacucacgcuacucccccuccuucgaaggccaagucaccauguccgccgaccgauccaccaacaccgcccaccuccaaugguccucccucaaacccuccgacaccgcccucuacuacugcgcccgccuaggcggcgacuacgaagacucaggcgcagacgccuucgacuucuggggccaaggcacacucgucaccgucucauccgccuccacaaaaggccccuccgucuucccucucgcacccucaucaaaauccaccuccggcggcaccgccgcccucggcugccucgucaaagacuacuuccccgaacccguaaccguaucauggaacuccggcgcccuaaccuccggcguccacaccuucccagccguccuccaauccuccggccuauacucacucuccuccguagucaccgucccaucauccucucucggaacacaaaccuacaucugcaacgucaaccacaaacccucaaauaccaaagucgacaaaaaagucgaacccaaauca

SEQ ID NO: 54785 - RNA, 645 nt, Artificial Sequence
  derived and/or modified sequence opt11 from anti-HIV_2B1H_LightChain
caauccguccucacccaaccaccaucagccuccggcacccccggccaacgcaucuccaucuccugcucaggaaccuccuccaacgucgaaaacaacuacgucuacugguaccaacaccuacccggcaccgcccccaaacuccucaucuaccgaaacgaccaccgcucauccggcaucccagaccgcuucuccgccuccaaauccggcaccuccgccucccuagccaucucaggccuccgcccagaagacgaaggcgacuacuacugcgccgccugggacgacucccgcggcggcccagacuggguauucggcggcggaaccaaacucaccguccucgcacaacccaaagcagcccccuccguaacccucuucccccccuccuccgaagaacuacaagccaacaaagccacccucgucugccuaaucuccgacuucuaccccggcgccgucaccgucgccuggaaagccgacuccucccccgucaaagccggcgucgaaaccacaacccccuccaaacaauccaacaacaaauacgccgccagcuccuaccucucccuaacccccgaacaauggaaaucccacaaaucauacuccugccaaguaacccacgaaggcucaaccgucgaaaaaacagucgcccccaca

SEQ ID NO: 54786 - RNA, 648 nt, Artificial Sequence
  derived and/or modified sequence opt11 from anti-HIV_3TNM_B-Chain
caauccguccuaacccaaccccccuccgccucaggcuccccuggccaauccguaaccaucuccugcaccggcaccuccuccgacgucggcggcuacaacuacgucuccugguaccaacaccacccaggcaaagcccccaaacucaucaucuccgaagucaacaaccgccccagcggaguccccgaccgcuucucaggcucaaaauccggcaacacagccucccucaccgucuccggccuccaagccgaagacgaagcagaauacuacugcuccuccuacaccgacauccacaacuucgucuucggaggcggcaccaaacucacaguccucggccaacccaaagcagcccccuccgucacccuauucccccccucaucagaagaacuccaagcaaacaaagcaacacucgucugccucaucuccgacuucuaccccggcgccgucacagucgccuggaaagccgacuccucccccgucaaagccggcgucgaaaccaccacucccuccaaacaauccaacaacaaauacgccgccucauccuaccucucccucacccccgaacaauggaaaucccaccgcuccuacuccugccaagucacacacgaaggcuccaccgucgaaaaaaccgucgcccccaccgaaugcucc

SEQ ID NO: 54787 - RNA, 693 nt, Artificial Sequence
  derived and/or modified sequence opt11 from anti-HIV_3TNM_A-Chain
caaguccaacuccaagaaucaggccccggccucgucaaacccucacaaacccucucccucuccugcaccgucuccggcggcuccucuuccuccggcgcacacuacugguccuggauacgccaauaccccggcaaaggacucgaauggaucggcuacauccacuacuccggaaacaccuacuacaaccccucccucaaaucccgcaucaccauaucccaacacaccucagaaaaccaauucucccucaaacucaacuccgucaccgucgccgacaccgccgucuacuacugcgcccgcggcacacgacuacgcacccuccgaaacgcauucgacaucuggggccaaggcaccaugguaaccgucuccuccgccuccaccaaaggccccuccgucuucccacucgcccccuccucaaaaucaaccuccggcggcacagccgcccucggaugccuagucaaagacuacuuccccgaacccgucaccgucuccuggaacagcggcgcccucaccucaggcguacacaccuuccccgccguccuccaauccuccggccucuacucucucuccucaguagucaccguccccuccuccucacucggaacccaaaccuacaucugcaacgucaaccacaaacccuccaacaccaaaguagacaaacgcgucgaaccaaaaucaugcgacaaaacacacacc

SEQ ID NO: 54788 - RNA, 690 nt, Artificial Sequence
  derived and/or modified sequence opt11 from anti-HIV_3UJJ_HeavyChain
gaaguccaacuaguccaauccggcgccgaagucaaaaaacccggcgaaucacucaaaaucucaugcaaagccucaggcuacuccuucucaucuuacuggaucgccuggguccgccaaaugcccggcaaaggccucgaauggaugggauucaucuaccccgccgacucugacacccgcuacucccccagcuuccaaggccaaggaaccaucuccgccgacaaauccaucuccaccgccuaccuccaaugguccucccuaaaagccuccgacaccgccauguacuacugcgccauccuaggcuucuggggagccaaccgcggcggcggcggcauggacgucuggggccaaggaaccaccgucaucguaucauccgccuccaccaaaggccccucagucuucccacucgcccccuccucaaaauccaccuccggcggcacagccgcccuaggcugccucgucaaagacuacuuccccgaacccgucacagucuccuggaauuccggcgcccuuacauccggaguacacaccuuccccgccguacuacaauccuccggccuauacucccucucuuccgucgucaccguccccuccuccucccucggcacccaaaccuacaucugcaacgucaaccauaaacccucaaacaccaaagucgacaaaaaagucgaaccaaaauccugcgacaaaaca

SEQ ID NO: 54789 - RNA, 639 nt, Artificial Sequence
  derived and/or modified sequence opt11 from anti-HIV_3UJJ_LightChain
uccuacgaacucacccaaccccccuccgucucagucagccccggccaaaccgcccgcaucacuugcuccggcgacgcccuccccgaaaaauacgcauacugguaccaacaaaaauccggccaagcccccguccuaaucaucuacgaagacuccaaacgccccuccggaauccccgaacgcuucuccggaucccgcucaggcaccauggccacccucaccaucucuggcgcccaagucgacgacgaagccgacuacuacugcuacuccacaaacuccggcggcaccuucuucgucuucggcaccggcaccaaagucacaguacucggccaacccaaagccaaccccaccgucacacucuucccccccuccucagaagaacuccaagccaacaaagccacccucgucugccuuaucucagacuucuaccccggcgccgucacugucgccuggaaagccgacuccucaccagucaaagccggagucgaaaccaccaccccauccaaacaauccaacaacaaauacgccgccuccuccuaccuaucccucaccccagaacaauggaaaucccaccgcucauacuccugccaagucacccacgaaggcuccaccgucgaaaaaacaguagcccccaccgaaugc

SEQ ID NO: 54790 - RNA, 669 nt, Artificial Sequence
  derived and/or modified sequence opt11 from anti-HIV_3UJI_HeavyChain
caaguccaacuaguccaauccgccgcggaagucaaaaaacccggcgaagcccucaaaauauccugcaaaggcuccggcuacuccuucuccaacuacuggaucgccuggguccgccaaaugcccggcaaaggccuagaauggaugggcaucgucuaccccgacgacuccgacuccuccuacaacuccuccuuccaaggccaaaucaccuucucagccgacaaauccaucuccacagccuaccuccacuggaccucacuccaagccuccgacaccgccauguacuacugcgcccgccuaggauucgaaggcgacuacuccggcuccuucuucgacuacuggggccaaggcacccuccuaaucguauccucagccuccaccaaaggccccuccguauucccacuagcccccuccuccaaauccaccuccggcggcaccgcagcccucggcugccucgucaaagacuacuuccccgaacccgucaccgucuccuggaacuccggcgcccucaccuccggcguccacacauuccccgccguccuccaaagcuccggccuauacucccucuccuccgucgucaccguccccuccuccucccucggcacacaaaccuacaucugcaacgucaaccacaaacccuccaacaccaaagucgauaaaaaaguagaaccc

SEQ ID NO: 54791 - RNA, 627 nt, Artificial Sequence
  derived and/or modified sequence opt11 from anti-HIV_3UJI_LightChain
ucuuacgaacucacccaaccccccuccgucuccgucucccccggccaaaccgccucaaucaccugcuccggagacauccucggagacaaauacgucuccugguaccaacaaaaauccggacaauccccccuccucgucaucuacgaagacaccaaacgccccuccggcauccccgaccgcuucuccggcuccaaauccggcaacaccgcaacccucaccaucuccggaacccaagccauggacgaagccgacuacuacugccaagccugggacuccacccuaggcgucgucuucggcggcggcacaaaaguaaccguccucggacaacccaaagccgcccccuccgucacccucuucccccccuccuccgaagaacuccaagccaauaaagccacccucgucugccucaucuccgacuucuaccccggagccgucacagucgccuggaaagccgacuccuccccagucaaagccggcguagaaaccaccacccccucaaaacaauccaacaacaaauacgccgccuccuccuaccuuucccucacacccgaacaauggaaaucccacaaaucauacucaugccaaguaacccacgaaggcuccaccgucgaaaagacagucgccccc

SEQ ID NO: 54792 - RNA, 666 nt, Artificial Sequence
  derived and/or modified sequence opt11 from anti-HIV_2QSC_HeavyChain
caaguucaacuuguccaguccggcggcggccucguccaaccaggcggcucucuccgccucucaugcgccgcauucggcuucaacuucuccucuuacgucaugcacuggguccgccaagcccccggccaaggccucgaauaccucuccgccaucuccuccgacggagaaacuacauaccacgccaacucagucaaaggccgcuucaccuccucccgcgacaacuccaaaaacacccucuuccuacaaaugggaucacuccgaaccgaagacgucgccgucuacuacugcgcacgagaccgcuacuacgaaaccuccggcuccaacgccuucgacguauggggccaaggcaccaugguagucguaucauccgccucuaccaaaggacccuccgucuucccccuagcccccugcucccgaucaaccuccgaauccaccgccgcacuaggcugccuagucaaagacuacuuccccgaacccgucaccgucucauggaacucaggcgcccuuaccuccggcguccacacauuccccgccguccuccaauccuccggccucuacucccucuccuccgucgucaccguccccuccucaaacuucggcacccaaaccuacacaugcaacgucgaccacaaacccuccaacaccaaagucgacaaaaccgucgaa

SEQ ID NO: 54793 - RNA, 645 nt, Artificial Sequence
  derived and/or modified sequence opt11 from anti-HIV_2QSC_LightChain
aacuccguccucacccaauccccuuccucccucuccgccuccgucggcgaccgcguaacaaucacaugccaagccagccaagacaucuccaacuaccuuaacugguaccaacacaaacccggcaaagcccccaaacuccucaucuacaccgccuccaaccucgaaaccggcguccccucccgcuucuccggcggaggcuccggcacccacuucuccuuuaccaucaccucccuccaacccgaagacgccgccaccuacuucugccaacaauacgacaaccucggcgaccucuccuucggcggaggcaccaaagucgaaaucaaacgcacaguagccgcccccucaguuuucaucuucccacccuccgacgaacaacucaaauccggcaccgccuccgucgucugccuacucaacaacuucuacccccgagaagccaaaguccaauggaaagucgacaacgcccuccaauccggcaacucccaagaauccgucaccgaacaagacuccaaagacuccaccuacucacucuccuccacccucacccucuccaaagccgacuacgaaaagcacaaagucuacgccugcgaagucacccaccaaggccucuccucccccgucaccaaauccuucaaccgcggcgaaugc

SEQ ID NO: 54794 - RNA, 690 nt, Artificial Sequence
  derived and/or modified sequence opt11 from anti-HIV_3MLZ_HeavyChain
caaguccaacuccaagaauccggcccaggccucgucaaacccucagaaacccucucacucaccugcacagucuccggcggcuccaucuccggauuccacuggucauggauccgucaaccccccggaaaaggccuagaauacauuggcuacaucuacuacuccggcuccaccucauacaaccccucccucaaaucccgagucuccauguccgucgacaccucccgcaaccaauucucccucgaacuauccucaguaaccgccgccgacaccgcagucuacuacugcgcccgcgacuucggcgaauaccacuacgacggccgcggcuuccaaugcgaaggcuucgaccucuggggccaaggaacccucgucacagucucuuccgccucaaccaaaggccccuccgucuucccccucgcccccucauccaaauccaccucaggcggcaccgcagcacucggcugccucgucaaagacuacuuccccgaacccgucaccgucuccuggaacuccggagcccucaccuccggcguacacaccuuccccgccguacuccaaucaucaggccucuacucccuaucauccgucgucaccgucccauccucaucacuaggcacccaaaccuacaucugcaacgucaaccacaaacccuccaacaccaaagucgacaaaaaagucgaacccaaauccugc

SEQ ID NO: 54795 - RNA, 642 nt, Artificial Sequence
  derived and/or modified sequence opt11 from anti-HIV_3MLZ_LightChain
caauccguccucacacaaccccccucagucuccgccgcccccggccaaaaagucaccaucuccugcuccggcuccuccuccaacaucggcaacaacauggucuccugguaccaacaacaccccggcaccgcacccaaacuccucaucuacgaaaacuccaaacgccccuccggcauccccgaccgcuucucaggcucacgauccggaaccuccgcaacccucggcaucaucggccuccaaaccggcgacgaagcagaauacuacugcgccaccugggacgggucccuacgcaccgucuucggcggcggcaccaaacucaccguccucucccaacccaaagccgcccccuccgucacacucuucccccccuccuccgaagaacuccaggccaacaaagccacccucgucugccucaucuccgacuucuaccccggcgccgucaccguagccuggaaagccgacuccucacccguccgcgccggcgucgaaaccaccacccccuccaaacaauccaacaacaaauacgccgccucauccuaccucucccucacccccgaacaauggaaaucccaccgcucauacucuugccaagucacccacgaaggcuccaccgucgaaaaaaccguagcccccaccgaaugc

SEQ ID NO: 54796 - RNA, 684 nt, Artificial Sequence
  derived and/or modified sequence opt11 from anti-HIV_3MLX_I-Chain
caaguccaacuccaagaaucaggccccggccuagucaaacccuccgaaacccucucccucaccugcaccgucuccggcggauccaucuccggcuuccacugguccuggauccgccaaccccccggcaaaggccucgaauacaucggauacauauacuacuccggcuccaccuccuacaaccccucccucaaaucccgcgucuccaugucagucgacaccucucgcaaccaauucucccucgaacuauccucagucaccgccgcagacaccgccgucuacuacugcgcccgagacuucggcgaauaccacuacgacggacgcggcuuccaaugcgagggcuucgaccucuggggccaaggcacccuaguaaccgucuccuccgccuccaccaaaggccccuccguauucccccucgcccccucauccaaauccacauccggcggcaccgccgcccuaggcugccucgucaaagacuacuuccccgaacccgucaccgucuccuggaacuccggcgcccucaccuccggcguccauaccuuccccgccguccuucaauccucaggccucuacucacucucauccgucguuaccguccccucauccucccuuggcacccaaaccuacaucugcaacgucaaccacaaacccuccaacacaaaaguagacaaaaaagucgaacccaaa

SEQ ID NO: 54797 - RNA, 633 nt, Artificial Sequence
  derived and/or modified sequence opt11 from anti-HIV_3MLX_M-Chain
uccguccucacccaaccccccuccgucucagccgccccaggccaaaaaguaaccauauccugcuccggcuccuccuccaacaucggcaacaacauggucuccugguaccaacaacaccccggcaccgcccccaaacuacuuaucuacgaaaacagcaaacgccccuccggcauccccgaccgcuucuccggcucacgcuccggcacauccgccacccucggcaucaucggccuccaaaccggagacgaagccgaauacuacugcgcaaccugggacggcucccuccgcaccgucuucggcggcggcaccaaauuaaccguccucucccaacccaaagcagcccccagcgucacccuauucccccccuccuccgaagaacuucaagccaacaaagccacccucgucugccucaucucagacuucuaccccggcgccgucaccgucgccuggaaagccgacuccucccccguccgcgccggcgucgaaacuaccacccccuccaaacaauccaacaacaaauacgccgccuccucuuaccucucccucacccccgaacaauggaaaucccaccgcuccuacucuugccaagucacccacgaaggcuccaccgucgaaaaaacagucgcccccacc

SEQ ID NO: 54798 - RNA, 684 nt, Artificial Sequence
  derived and/or modified sequence opt11 from anti-HIV_3MLW_I-Chain
caaguccaacuaguccaauccggcgccgaagucaaaaaagccggcgaaucccuagaaaucucaugcaaaggcucuggcuacaccuucaccgaccacuggauagccuggguccgccaaguccccggaaaaggccucgaauggaugggcaugaucuacccaggcgacuccgacacccgcuacucccccucccuccaaggccgcguaaccauguccgccgacaaaacccucucaaccgcauaccuccaauggucccgccucgaagccucugacaccgccauguacuacugcgcccgacuccacuacuccgaccgauccggcuccuacuucaacgacgucuuccacauguggggccaaggcaccaccgucaccguaucauccgccuccaccaaaggcccauccguauucccccucgcccccuccuccaaaucaaccuccggcggcaccgccgcccucggcugccucgucaaagacuacuuccccgaacccgucacagucuccuggaacuccggcgcccucaccucaggcguccacacauuccccgccguccuccaauccuccggccucuacucacucuccuccguaguaaccguccccuccuccucacuaggaacccaaacauacaucugcaacgucaaccacaaacccuccaacacaaaaguagacaaaaaagucgaaccaaaaucc

SEQ ID NO: 54799 - RNA, 645 nt, Artificial Sequence
  derived and/or modified sequence opt11 from anti-HIV_3MLW_M-Chain
caauccguccucacccaaccccccuccgccuccggaacccccggccaacgcgucaccaucuccugcuccggcaacuccucaaacaucgaaaacaacuacgucuacugguaccaacaacucccaggcuccacacccaaacuccucaucuuccgcgacgaccaacgcccauccggcguccccgaccgauucuccggcuccaaaucaggcaccucagccucccucgcaaucucaggccuacgauccgaagacgaagccgacuacuacugcgccuccugggacgacuccagaggcggccccgacuacguauucggcaccggcaccaaagucaccguccucggccaacccaaagccaaccccaccgucacccuauuccccccauccuccgaagaacuucaagccaacaaagccacccucgucugccuaaucucagacuucuaccccggagccgucaccgucgcuuggaaagccgacggaucccccgucaaagccggcgucgaaaccaccaaacccuccaaacaaucaaacaacaaauacgccgccuccuccuaccucucccuuacacccgaacaauggaaaucccaccgcuccuacuccugccaagucacccacgaaggcuccacuguagaaaaaaccgucgcccccacc

SEQ ID NO: 54800 - RNA, 678 nt, Artificial Sequence
  derived and/or modified sequence opt11 from anti-HIV_3MLV_N-Chain
gaaguccaacucgucgaaucaggcggagaagucaaacaacccggccaaucccucaaaaucuccugcaaaucaucagguuacaacuuccucgacuccuggaucggcuggguccgccaaauacccggcaaaggccuagaauggaucggcaucaucuaccccgacgacuccgacgcccacuacucccccuccuucgaaggacaagucaccauguccgucgacaaauccaucuccaccgccuaccuccaauggaccacucuacaagccuccgacaccggcaaauacuucugcacacgccucuaccucuucgaaggcgcccaauccucaaacgccuucgaccucuggggccaaggcaccaugauacucgucuccuccggcaccaccaaaggcccauccgucuucccccuagcccccagcuccaaaucaaccuccggcggcacagccgcccucggcugccuagucaaagacuacuuccccgaacccgucaccgucuccuggaacuccggcgcacucaccagcggaguccacaccuuccccgccguccuccaauccuccggccucuacucccuauccucagucgucaccguccccucauccucccucggcacccaaaccuacaucugcaacgucaaccacaaacccuccaacaccaaagucgacaaaaaagucgaacccaaauca

SEQ ID NO: 54801 - RNA, 657 nt, Artificial Sequence
  derived and/or modified sequence opt11 from anti-HIV_3MLV_M-Chain
uccuaccuccuaacccaaccccccucagucuccguaucccccggccaaaccgccuccaucuccugcucaggcgacaaacucgacgacaaauacgucuccugguacuaccaacgccccggccaaucacccguccuccucauguaccaagacuucaaacgacccuccggaauccccgaacgccucuccggcucaaaauccggcaaaaccgccacccucaccaucuccggcacacaaucccucgacgaaggcgacuacuacugccaagccugggacgcauccaccggcgucuccggcggcggcacaaaacucaccguccucuucggcgaaggcacccgccucaccguacucgcccaacccaaagccgcccccuccgucacccucuucccccccuccuccgaagaacuccaagcuaacaaagccacccucgucugccucaucuccgacuucuaccccggcgcagucaccgucgccuggaaagcugacuccucccccguaaaagccggcgucgaaaccaccaccccauccaaacaauccaacaacaaauacgccgccuccuccuaccucucccucacccccgaacaauggaaaucccacaaauccuacucaugccaagucacccacgaaggcuccaccguagaaaaaaccgucgcccccacc

SEQ ID NO: 54802 - RNA, 654 nt, Artificial Sequence
  derived and/or modified sequence opt11 from anti-HIV_3MLU_LightChain
uaccuacucacccaacccccaucagucuccgucucccccggccaaacagccucaaucuccugcuccggcgacaaacucgacgacaaauacgucuccugguacuaccagcgccccggccaauccccaguccuccucauguaccaagacuucaaacgccccuccggcauccccgaacgccucucaggcucaaaauccggaaaaaccgccacccucaccaucuccggaacacaaucccuagacgaaggcgacuacuacugccaagccugggacgccuccacaggcgucuccggcggcggcaccaaacucaccguacucuucggcgaaggcacccgccucaccguccuagcccaacccaaagccgccccauccgucacccucuucccccccuccuccgaagaacuccaagccaacaaagccacccucgucugccuuaucuccgacuucuaccccggcgccgucacagucgccuggaaagccgacuccucccccguuaaagccggcgucgaaaccaccaccccauccaaacaauccaacaacaaauacgccgccuccuccuaccucucccucacucccgaacaauggaaaucccacaaaucauacuccugccaagucacccacgaaggcuccaccgucgaaaaaaccgucgcacccacc

SEQ ID NO: 54803 - RNA, 657 nt, Artificial Sequence
  derived and/or modified sequence opt11 from anti-HIV_3MLT_G-Chain
uccuacgaccuuacccaaccacccuccgucuccgucuccccaggccaaacagccuccaucuccugcuccggcgacaaacucgacgacaaauacgucuccugguacuaucaacgcccaggccaaucacccguccuccucauguaccaagacuucaaacgccccuccggcauccccgaacgccucuccggcuccaaaucaggcaaaaccgccacccucaccaucuccggaacccaaucccucgacgaaggcgacuacuacugccaagccugggacgccuccaccggcgucuccggcggcggcaccaaacucaccguacucuucggagacggcacccgacucaccguccucggacaacccaaagccgcccccuccguuacccuauucccacccucauccgaagaacuacaagcuaacaaagccacccuagucugccuaaucucagacuucuaccccggcgccgucaccgucgccuggaaagcagacuccucccccgucaaagccggcgucgaaaccacaacacccucaaaacaaucaaacaacaaauacgccgccuccuccuaccucucccuaacacccgaacaauggaaaucccacaaauccuacucaugccaagucacccacgaaggcucaacugucgaaaaaaccgucgcccccacc

SEQ ID NO: 54804 - RNA, 666 nt, Artificial Sequence
  derived and/or modified sequence opt11 from anti-HIV_3GO1_HeavyChain
gaaguccaacuacaagaauccggccccggccucgucaaacccucagaaacacucucccucacaugcaccgucuccggcggcccaaucaacaacgccuacuggaccuggauccgccaaccacccggcaaaggacucgaauaccucggcuacguuuaccacaccggcgucaccaacuacaaccccucccucaaaucccgacucaccaucaccaucgauaccucacgaaaacaacucucacucucccucaaauucgucaccgcagccgacuccgccgucuacuacugcgcccgcgaaugggccgaagacggagacuucggcaacgccuuccacguauggggccaaggaacaauggucgccguauccuccgccucaaccaaaggccccuccgucuucccccuagcccccuccagcaaaucaaccuccggcggaaccgccgcccucggcugccuaguaaaagacuacuuccccgaacccgucaccgucuccuggaacuccggcgcccuaaccuccggcguccacacauuccccgccguccuccaauccuccggccucuacucacucuccuccgucgucaccguccccuccucaucccucggcacccaaaccuacaucugcaacgucaaccacaaacccuccaacaccaaagucgacaaacgcgucgaaccc

SEQ ID NO: 54805 - RNA, 627 nt, Artificial Sequence
  derived and/or modified sequence opt11 from anti-HIV_3GO1_LightChain
ucuuacguacucacccaaccacccuccgucucagucucccccggucaaaccgcccgcaucaccugcuccgcagaagcccucuccaaccaauacgcauacugguaccgccaacgccccggccaagccccccuccuaaucaucuacaaagacaccaaacgccccuccggcauccccgaacgcuucuccggauccaccuccggcaccaccgucacucucaccaucuccggcguccaagccgaagacgaagccgacuacuacugccaauccgccgacuccuccggcgacuacgucuucggcggcggcaccaaaguaaccguccucggccaacccaaagccaaccccaccgucacccucuucccccccucauccgaagaacuccaagccaacaaagccacccucgucugccucaucuccgacuuuuaccccggcgcagucacagucgccuggaaagccgacggcucccccgucaaagccggcgucgaaaccaccaaacccucaaaacaauccaacaacaaauacgccgccuccuccuaccucucccucacccccgaacaauggaaaucccaccgcucauacuccugucaagucacccacgaaggcucaaccguagaaaaaaccgucgccccc

SEQ ID NO: 54806 - RNA, 690 nt, Artificial Sequence
  derived and/or modified sequence opt11 from anti-HIV_4XCY_J-Chain
caaguccaacucguacaauccggcgccgaagucaaacgccccggcuccuccgucaccgucuccugcaaagccuccggcggcuccuucucaacuuacgcccucuccuggguacgccaagcccccggccgcggccuagaauggauggguggcgucaucccccuucucacaaucaccaacuacgccccccgcuuccaaggccgcaucacaauaaccgccgaccgcucaaccuccaccgcuuaccucgaacucaacucccuacgcccagaagacaccgccgucuacuacugcgcccgcgaaggcaccaccggcuggggcuggcucggcaaacccaucggcgccuucgcccauuggggccaaggaacccucguuaccgucuccucagccuccaccaaaggcccauccgucuucccccucgcccccucauccaaauccacaucaggcggcaccgccgcacucggcugccucgucaaagacuacuuccccgaacccgucaccgucuccuggaacuccggcgcccucaccucaggaguccacaccuuccccgccguccuccaauccucaggccucuacucacucuccuccguagucaccguacccucuuccucacucggcacccaaaccuacaucugcaacgucaaccacaaacccuccaacaccaaagucgacaaaaaagucgaacccaaauccugc

SEQ ID NO: 54807 - RNA, 645 nt, Artificial Sequence
  derived and/or modified sequence opt11 from anti-HIV_4XCY_K-Chain
gaaaucguccucacccaaucccccggcacccaaucccucucacccggcgaacgagccacccuaucaugccgcgcaucccaauccguaggcaacaacaaacuagcaugguaccaacaacgacccggccaagccccacgacuccucaucuacggcgccuccucccgcccaucaggcgucgccgaccgauucuccggcuccggcucaggcaccgacuucacccuaaccaucucgcgacucgaacccgaagacuucgccgucuacuacugccaacaauacggccaaucacuauccaccuucggccaaggcaccaaagucgaaguaaaacgcaccgucgccgccccaagcgucuucaucuucccacccucagacgaacaacuaaaauccggcacagccuccgucgucugccuccuaaacaacuucuacccccgcgaagccaaaguccaauggaaagucgacaacgcccuccaauccggcaacucccaagaauccgucaccgaacaagacucaaaagacuccaccuacucccucucauccacccucacccucuccaaagccgacuacgaaaaacacaaagucuacgcaugcgaaguaacccaccaaggccucagcuccccagucaccaaauccuucaaccgcggcgaaugc

SEQ ID NO: 54808 - RNA, 630 nt, Artificial Sequence
  derived and/or modified sequence opt11 from anti-HIV_4YBL_C-Chain
guccucacccaaccccccuccgccuccggcucccccggccaaucagucaccaucuccugcaccggcaccuccuccgacgucggcggcuacaacuacgucuccugguaccaacaccaccccggcaaagcccccaaacucaucaucuccgaaguaaacaaccgccccuccggcgucccagaccgcuucucaggcuccaaauccggcaacaccgccucccucacaguauccggccuccaagccgaagacgaagccgaauacuacugcuccuccuacaccgacauccacaacuucgucuucggcggcggcaccaaacuaaccguccuaggccaacccaaagccgcacccuccgucacccucuucccccccuccuccgaagaacuccaagccaacaaagccacccucgucugccucaucucugacuucuacccaggagccgucaccgucgcauggaaagccgacucaucacccgucaaagccggcguagaaaccaccacccccucaaaacaauccaacaacaaauacgccgccuccuccuaccuuucccuaacucccgaacaauggaaaucccaccgcucauacuccugccaagucacccacgaaggcucuaccguagaaaaaaccgucgcaccc

SEQ ID NO: 54809 - RNA, 672 nt, Artificial Sequence
  derived and/or modified sequence opt11 from anti-HIV_4YBL_B-Chain
caaguccaacuccaagaauccggcccaggccucgucaaaccaucccaaacucucucccucucuugcacagucuccgguggcucauccuccucaggcgcccacuacugguccuggauccgacaauaccccggcaaaggccucgaauggaucggauacauccacuacucaggcaacaccuacuacaacccaucccucaaaucccgcaucacaaucucacaacacacauccgaaaaccaauucucccucaaacucaacuccgucaccgucgccgacaccgccguauacuacugcgcccgaggaacccgccuacgcacccuccgcaacgccuucgacauauggggccaaggcaccauggucaccgucuccuccgccucuaccaaaggccccuccgucuucccacucgcccccuccuccaaauccaccuccggcggcaccgccgcccucggcugccucgucaaagacuacuucccagaacccgucaccguuuccuggaacuccggcgcccucaccuccggcguccacaccuuccccgccguccuccaaucauccggccucuacucccuaucgucagucgucaccgucccauccuccucacucggcacccaaaccuacaucugcaacgucaaccauaaacccuccaacaccaaaguagacaaacgcgucgaacccaaa

SEQ ID NO: 54810 - RNA, 630 nt, Artificial Sequence
  derived and/or modified sequence opt11 from anti-HIV_4R4N_X-Chain
gacauccaaaugacacaaucccccuccuucgucuccgccuccgucggcgaccgcgucaccaucaccugccgcgccucccaaggcaucuccuccuaccucgccugguaccaacaaaaacccggcaaagcccccaaacuagucaucuacgccgccuccacccuccaaucaggaguacccucccgcuucuccggcuccggcucaggcaccgaauucacccucaccaucuccucccuccaacccgaagacuucgcaaccuacuacugccaacaccucaucggccuacgcuccuucggccaaggcaccaaacucgaaaucaaacgcaccgucgccgcccccuccguauucaucuucccacccuccgacgaacaacuuaaaucaggcaccgccucaguagucugccuccucaacaacuucuacccccgcgaagccaaaguccaauggaaagucgacaacgcccuccaaucaggcaacucccaagaauccgucaccgaacaagacucuaaagacuccaccuacucccucuccuccacccucacccuauccaaagccgacuacgaaaaacacaaagucuacgccugcgaagucacccaccaaggccucuccucacccgucaccaaauccuucaaccgc

SEQ ID NO: 54811 - RNA, 660 nt, Artificial Sequence
  derived and/or modified sequence opt11 from anti-HIV_4R4B_F-Chain
caaguccaacuacaacaauggggcgccggccuccucaaacccucugaaacccuaucacuaaccugcggcgucuacggcgaaucccucucuggucacuacuggucauggguccgacaaccacccggcaaacgccuagaauggaucggcgaaauaaaacacaacggcucccccaacuaccaccccucccucaaaucccgcgucaccaucucacucgacauguccaaaaaccaauucucccucaaccucacauccgucaccgccgccgacaccgccgucuacuucugcgcccgccgauccaacuggcccuaccuccccuucgaccccuggggccaaggcacccucgucaccgucuccucagccuccaccaaaggcccaucagucuucccccucgcaccuuccuccaaaucuaccuccggcggcacagccgcccucggcugccucgucaaagacuacuuccccgaaccagucaccgucuccuggaacuccggcgcccucaccuccggcguccacacauuccccgccguacuccaauccuccggccucuacucccucuccuccgucgucaccguccccuccuccucccucggcacccaaaccuacaucugcaacgucaaccacaaaccuuccaacaccaaaguagacaaaaaagucgaacccaaa

SEQ ID NO: 54812 - RNA, 750 nt, Artificial Sequence
  derived and/or modified sequence opt11 from anti-HIV_3JUY_D-Chain
caagugcaacugguacagagcggggcagagguaaagaaaccgggagcgagcgugaaaguaagcugccaagcgagcggauacagguucagccacuucacgguacacuggguaaggcaagcaccagggcagagguucgaguggaugggauggauaaacccguacaacgggaacaaggaguuuagcgcgaaguuccaggacagagugacauucacagcggacacgagcgcgaacacggcauacauggagcuaagaagccugaggagcgcagacacggcgguauacuacugcgcaaggguaggagaauggggaugggacgacagcccguacgacaacuacuacauggacgugugggggaaagggacaacgguaauaguaagcagcggaggagggggaagugggggaggagggagcggaggaggagggagcgagauaguguugacccaggcaccggggacgcuaagccuaagccccggggaaagggcgacguucagcugccgaagcagccacagcauaaggagcaggagaguggcaugguaccagcacaagccagggcaagcgccaaggcuaguaauacacggggugagcaacagagcaagcgggauaucagacagauucagcgggagcgggagcgggacggacuucacacugacgaucacaagaguagaaccggaggacuucgcacuguacuacugccagguauacggagcaagcagcuacacguucgggcaagggacaaagcuggaaagaaag

SEQ ID NO: 54813 - RNA, 369 nt, Artificial Sequence
  derived and/or modified sequence opt11 from anti-HIV_4KG5_HeavyChain
caacucguccaauccggccccgaagccaaacgccccggcuccuccgucaaagucuccugcaaagccucccgcgacaccuucaacaacuacguacucaacuggguccgacaagcccccggccaaggccucgaauggaugggcggcaucggccccaucaucgaaaccgccgacuacgccgaaaaauuccgcggccgccucuccaucaccgccgacgaauccaccacaaccgccuacauggaacucuccucccucaccuccgacgacaccgccgucuacuacugcgcccgcucccccuacuccucccucaccgacaccuacuacuacuacauggaccucuggggcaaaggcaccaccgucaccgucuccuca

SEQ ID NO: 54814 - RNA, 336 nt, Artificial Sequence
  derived and/or modified sequence opt11 from anti-HIV_4KG5_LightChain
cucacccaaucccccgacucccucgccgucucccucggcgaacgcgccaccaucaacugcaaauccucccaauccauacucgacuccuccaacaaccgcaacuaccucaccugguaccaacaaaaacccggccaaccccccaaacuccucaucuacugggccuccacccgcgaauccggcguccccgaccgcuucuccggcuccggcuccuccaccgacuucacccucaccaucuccucccuccaagccgaagacgucgccgucuacuacugccaacaauacuucuccacccccggcaucaccuucggccaaggcacccgccucgaaaucaaacgc

SEQ ID NO: 54815 - RNA, 309 nt, Artificial Sequence
  derived and/or modified sequence opt11 from anti-HIV-1_LightChain
gaaaucguccucacccaaucccccgccacacucucccucucccccggcgaacgcgccacccucuccugccgcgccucccaauccgucuacaccaaacucgccugguaccaacaaaaacccggccaacccccccgccuccucaucuacgacgccuccaaccgcgccgccggcauccccgcccgcuucuccggcuccggcuccggcaccgaauucacccucaccaucaaacgcauggaacgcgaagacuucgccgucuacuacugccaaauccucgaauucuucggccaaggcaccaccaucgacaugaac

SEQ ID NO: 54816 - RNA, 312 nt, Artificial Sequence
  derived and/or modified sequence opt11 from anti-HIV-1_LightChain
gacauccaaaugacccaaucccccucauccgucuccgccuccgucggcgaccgcgucaccaucaccugccgcgccucccaaggcauccucucaucccaacucgccuggcaccaacaacgccgcggccaacccccccgccuacucaucuacggcggcuccaaccgcgcccccggcauccccgaacgcuucaccggcucuggcuccggcaccgacuucguccucaccaucaaacgccuccaacgcgacgacuucgccgucuacuacugccaaauccucgaauucuucggccgcggcacccgcgucgaaaugaac

SEQ ID NO: 54817 - RNA, 312 nt, Artificial Sequence
  derived and/or modified sequence opt11 from anti-HIV-1_LightChain
ggccuccuccucacccaaucccccggccccgucuccuucuuccccggcgaacgcgccaccgucuccugccgcgccucacacuccgucaacuccgccgccaucaacugguaccaacaaaaacgcggccaacccccccgccuaaucaucgucgacggcuccacccgagccaccgccguccccgaacgcuucuccgccaccggcuccggcaccgaauucacccucgucaucucccgccucgaacccgaagacuucgccgucuacuucugccaacaccuccaauucuucggccucggcaccaaagucgacaucaaa

SEQ ID NO: 54818 - RNA, 312 nt, Artificial Sequence
  derived and/or modified sequence opt11 from anti-HIV-1_LightChain
gccuucgucaugacccaaucccccggcacccucgcccucucccccggcgaacgcgccacccucuccugccgcaccucccaagaaauccucuccaaccaacucgccuggcaccaacaacgccgcggccaacccccccgccuccucaucuacggcggcuccaaccgcgcccccggcauccccgaacgcuucaccggcuccggcuccggcaccgacuucguccucaccaucaaccgccucgaacgcgacgacuucgccgucuacuacugccaaauccucgaauucuucggccgaggcacccgcgucgaaaugaac

SEQ ID NO: 54819 - RNA, 312 nt, Artificial Sequence
  derived and/or modified sequence opt11 from anti-HIV-1_LightChain
ggcaucguccucacccaaucccccgacacccucucccucucccccggcgaccgcgccacccucuccugcaaaacaucccaauccaucgccuccgaacaccucgccugguaccaacaacgccccggccaacccccccgccuccucaucuucggcgccuccaaccgcgccuccggcauccccacccgcuucuccggcuccggcuccggcgccgacuucacccucuccaucacccgccucgaacccgaagacuucgccgucuacuacugccaauucuccgaauucuucggccgcggcgcccgagucgaagucaaa

SEQ ID NO: 54820 - RNA, 312 nt, Artificial Sequence
  derived and/or modified sequence opt11 from anti-HIV-1_LightChain
caauucguaaugacacaaucacccgcaacccugagcucgagcccaggcggaaccgcaacccuaagcugccgcacaagccacagcauacucaacagccaacucgcauggcaccaacaacgcagaggccaaccccuacgccuacucauauacggagccucaaacagagccccaggcauacccgaacgcuucagcgcaagcgggagcggaaccgaauucguacucacaaucaaacgcauggaaagagaagacuucgcagucuacuacugccaaauacucgaauucuucggccaaggcacaaccauagacaugaac

SEQ ID NO: 54821 - RNA, 354 nt, Artificial Sequence
  derived and/or modified sequence opt11 from anti-HIV-1_HeavyChain
cgcgugcacuugguccagagcgggacccaggucaagaaaccgggcgcgagcgugaaagugagcugugaaacgagcggguucaaguucuuggacucgcucauacacugggucagacaagcgcccgggcaagggcucuauuggaugggcuggaucaagcccuaucgcgggagcgugaacuaugacggguacuuucgcgggcgcgugagcaugaccagggacauauacacggacacggccuaucucgagcucucgggcuugcgcucggacgauaccgcgaucuauuacugugccuuuggcgcgggcgauggcugggacuuggucuggggccagggcacgcucgugaucgugagcucg

SEQ ID NO: 54822 - RNA, 354 nt, Artificial Sequence
  derived and/or modified sequence opt11 from anti-HIV-1_HeavyChain
cgagugcacuugguccagagcgggacccaggucaagaaaccgggcgcgagcgugaaagugagcugugaaacgagcggguucaaguucuuggacucgcuaauacacugggucaggcaagcgcccgggcaagggcucuauuggaugggcuggaucaagcccuuucgcgggagcgugaacuaugacggguacuuucgcgggcgcgugagcaugaccagggacauauacacggacacggccuauauggagcucucgggcuugcgcucggacgauaccgcgaucuauuacugugccuuuggcgcgggcgauggcugggacuuggucuggggccagggcacgcucgugaucgugagcucg

SEQ ID NO: 54823 - RNA, 354 nt, Artificial Sequence
  derived and/or modified sequence opt11 from anti-HIV-1_HeavyChain
caagugcacuugguccagagcgggacccaggucaagaaaccgggcgcgagcgugcgcgugagcugugaaacgagcggguucaaguucuuggacucgaucauacacugguucaggcaagcgcccggggaagggcucuuuuggaugggcuggaucaagcccuauaccgggagcgugaacuaugucaggcgcuaucaagggcgcgugagcaugaccagggacguguacucggacacggccuauauggaucucucgggcuugaacucggacgauaccgcggucuauuucuguaccuauggcgcgggcgauggcuggaacuuggucuggggccagggcacgcuagugaucgugagcgcg

SEQ ID NO: 54824 - RNA, 363 nt, Artificial Sequence
  derived and/or modified sequence opt11 from anti-HIV-1_HeavyChain
caggucaggcucgugcaaucgggcaaucaagugcgcaagcccggggccucggucaggaucucgugcgaggccucgggcuauaaauuuaucgaucacuuuauccauugggugcgccaggucccgggccauggcuuggaauggcucggguggauaaacccgcgcgggggcggggucaauuacucgcgcggguuccagggcaagcucucgaugacgaugacgcgcgauaacuuugaagagaccgcguacuuggacuugagcaggcucaaucccggggacacggccguguacuauugcgcgcgcggguucgcgggcuaugaauggagcuuucucuggggccagggcacgcucgugaucgugagcucg

SEQ ID NO: 54825 - RNA, 357 nt, Artificial Sequence
  derived and/or modified sequence opt11 from anti-HIV-1_HeavyChain
caggucucgcucgugcaaucgggcaaucaauugaaaaagcccggggccucggucagaaucucgugcgagaccucgggcuauaacuuucucaaucacuuuauccauugggugcgccaggucccgggccauggauuggaauggcucggguggauaaacccgcgcgggggcggggucaauuacucgcgcaauuuccagggcaaggucucgcucacgcgcaauaucgauauggagaccguguacuuggacgugcgcgggcucacgcccggggacacggccguguacuauugcgcgcgcggguucgggggcucggacuggaacuuugucuggggccagggcacgcgcauaaccgugagcgcg

SEQ ID NO: 54826 - RNA, 357 nt, Artificial Sequence
  derived and/or modified sequence opt11 from anti-HIV-1_HeavyChain
aggauaaauuugcaucagagugggagucaggugaagaggaguggggcgagugugaggauaaguugugagacgaguggguuuaaguuuauggauagucauuugcauugggugaggcagguggcggggcagggguuugaguggaugggguggauauuuacgaguggggggggggugaauuaugcgaggcaguuucaggggagguugacguugacgagggauguguuuacggauacgguguuuauggauuugaguggggugaaugugggggauacgggaguguauuauugugugaaggggacgggggggaaugaguggggguuuaguugggggcaggggacgguggugguggugaguccg

SEQ ID NO: 54827 - RNA, 357 nt, Artificial Sequence
  derived and/or modified sequence opt11 from anti-HIV-1_HeavyChain
aggauaaauuuggaucagagugggagucaggugaagaagaguggggcgagugugaggauaaguugugagacgaguggguuuaaguuuauggauagucauuugcauugggugaggcagguggcggggcaaccguuugaguggaugggguggauauuuacgagcggggggggggugaauuaugcgaggcaguuucaggggagguugacguugacgagggauguguuuagugagacgguguuuauggauuugaguggguugaaugcgggggauacggggguguauuuuugugugaaggggacgggggggaaugaguggggguuugugugggggcaggggacgguggugguggugaguccg

SEQ ID NO: 54828 - RNA, 357 nt, Artificial Sequence
  derived and/or modified sequence opt11 from anti-HIV-1_HeavyChain
aggaucgagcuccaucaaucgggcucgcaagugaaaaagagcggggccucggucaggaucucgugcgagaccucgggcuuuaaauuuauggauagccaucuccauugggugcgacaggucgcgggacagcgcuuugaauggaugggguggauauucacgagcgggggaggggucaauuacgcgcgccaguuccagggcaggcucaggcucacgcgagaugucuuuagcgagagcguguucauggacuugagcgggcucaauagcggggacacgggcguguacuauugcgugaaagggaccgggggcaaugaauggggcuuugucuggggccagggcucgcucguggucgugagcccg

SEQ ID NO: 54829 - RNA, 372 nt, Artificial Sequence
  derived and/or modified sequence opt11 from anti-HIV-1_HeavyChain
caagcccuaguccaaagcggaagccaaaugaaaaaaccaggcgacagcguacgccuaagcugccaaacaagcgacagcgcaaucacaaaauacuucauacacuggaucagacaagcacccggaaaaggacucgaauggauagccuggaucucacccuacggcggacgcguaaacuacggcuggcaaguacgcgaccgcgcaacccuaaccagaaacauacacauggaaacagucuacauggaccucagaggccuacgcccagacgacaccgcaaccuacuacugcgccaugcgcgacuacugccgcgacgacaacugcaaccgcugggaccuaggccacuggggacaaggaagccugaucguagucucagcc

SEQ ID NO: 54830 - RNA, 357 nt, Artificial Sequence
  derived and/or modified sequence opt11 from anti-HIV-1_HeavyChain
caagugacccuaguccagagcgggaaccagcucaagcgcccgggcgcgagcgugcgcauaagcugcgaaacgagcggauacaacuucauggaccacuucauacacugggucaggcaagugcccggacacgggcccgaguggcuaggcugggucaaccccaggggcgggggcgugaacuacagcaggaaauuccaaggacgcuucagcaugaccagagacguguacauggaaacggccuaccucgacgucacgggcuugagcccggccgacaccgcggucuacuacugcgccaggggcuucggcggaagcgacuggucguuccuguggggacaagggacccuaaucauagucucaagc

SEQ ID NO: 54831 - RNA, 324 nt, Artificial Sequence
  derived and/or modified sequence opt11 from anti-HIV-1_LightChain
gaaaucguccucacccaaucccccggcacccucucccucuccgccggcgaacgcgccucccucuccugccgcgccucccaaacccucaacuccaacuucuucgccugguaccaccaaaaacccggccaagcaccccgccuccucaucuacggcgccuccaaccgcgccaccggcauccccgaccgcuucuccggcuccggcuccggcuccgacuucacccucaccaucucccgccucgaacccgaagacuucggcaaauacuacugcgaacaauacgacgucucaccccgcaccuucggacaaggcaccaaagucgaaaucaaa

SEQ ID NO: 54832 - RNA, 324 nt, Artificial Sequence
  derived and/or modified sequence opt11 from anti-HIV-1_LightChain
gaagucguccucacccaaucccccggaacccucucccucucccccggcgaacgcgccacccucuccugccgcgccucccaauccaucaacuccaacuucuucgccugguaccaccaaaaacccggccaagccccccgccuccucaucuacggcgccuccucccgcgccaccggcauccccgaccgcaucuccggaaccggcuccggcgccgacuucacccucaccaucaccggccucgaacccgaagacuucggccucuacuacugccaacaauacgacuucuccccccgcaccuucggccaaggcacccgcgucgaaaucaaa

SEQ ID NO: 54833 - RNA, 324 nt, Artificial Sequence
  derived and/or modified sequence opt11 from anti-HIV-1_LightChain
gaagucguccucacccaaucacccggcacccucucccucucccccggcgaacgcgccacccucuccugccgcgccucccaaaccaucaacuccaacuucuucgccugguaccaccaaaaacccggccaagccccccgccuccucaucuacggcgccuccucccgcgccaccggcauccccgaccgcaucuccggcuccggcuccggcaccgacuucacccucaccaucaccggccucgaacccgaagacuucggccucuacuacugccaacaauucgacuucuccccccgaaccuucggccaaggcacccgcgucgaaaucaaa

SEQ ID NO: 54834 - RNA, 324 nt, Artificial Sequence
  derived and/or modified sequence opt11 from anti-HIV-1_LightChain
gaaaucguccucacccaaucccccggcacccuaucccucgcccccggcgaacgagccacccucuccugccgcgccucccaauccaucuccaccaccuaccucgccugguaccaacaaaaacccggccaagccccccgccuacucaucuacgaaaccuccucccgcgccuccgacauccccgaccgcuucuccggcuccggcuccggcaccgacuucacccucaccaucucccgccucgaacccgaagacuucgccgucuacuacugccaccaauacgaccgcuccccccgcaccuucggccaaggcaccaaagucgaaaucaaa

SEQ ID NO: 54835 - RNA, 336 nt, Artificial Sequence
  derived and/or modified sequence opt11 from anti-HIV-1_LightChain
gacaucguaaugacacaaucacccgcaagccugagcguaaccccgggcgagaccgcaagcauaagcugcaaaugcagcagaagccuacgcgaagaaguaggcuacaacuaccucgacugguaccuccagcgcccaggcaaaagcccacaacuacucauauacguaggcucauucagggccccaggcguaagcgaacgcuuccgcggaagcggagaacacaaagacuucacacuaaaaaucgcacgcguagaaccgggcgacgccggaaucuacuacugcaugcagggcauagacacgcccaggaccuucggccaaggcacaacccuggaaauaaac

SEQ ID NO: 54836 - RNA, 321 nt, Artificial Sequence
  derived and/or modified sequence opt11 from anti-HIV-1_LightChain
gacauccaaaugacccaaucccccuccucccucuccgccuccgucggcgaccgcgucaccaucaccugccgcgccucccaagccuuccgcaacgaccucggcugguaccaacacaaacccggcaaagcccccgaacgacucaucuacgccaccuccacccucgaauccggcguccccucccgcuucuccggcuccggcuccggcaccaacuucacccucaccaucuccucccuccaagccgaagacuucgccaccuacuacugccuccaauacaacaccuucccccgcaccuucggccaaggcaccaaagucgaaaucaaa

SEQ ID NO: 54837 - RNA, 333 nt, Artificial Sequence
  derived and/or modified sequence opt11 from anti-HIV-1_LightChain
aacuucaugcuaacccaaccccacuccgucuccgaaucccccggcaaaaccgucaccauauccugcgcccgcacccgcggcggcaucgacuccgccuacguccacugguaccaacaacgccccggcuccguccccaccaccgucaucuucgaagacaaccgccgcccccccggcguccccgaccgcuucuccggcuccaucgacaccuccuccaacaccgccucccucaccaucuccggccuaaaaaccgaagacgaagccgacuacuacugccaauccuacgacgacaccuacuucugggucuucggcggcggcaccaaacucaccguccuc

SEQ ID NO: 54838 - RNA, 333 nt, Artificial Sequence
  derived and/or modified sequence opt11 from anti-HIV-1_LightChain
aacuucaugcucacccaaccccacuccgucuccgaaucccccggcaaaaccgucaccaucuccugcgcccgcaccagaggcaccaucgacucagccuacguccacugguaccaacaacgccccggcgccguccccaccaccgucaucuucgaagacgaccgccgccccuccggcguccccgaccgauucuccggcuccaucgacuccuccuccaacuccgccucccucaccaucuccggccucaaaaccgaagacgaagccgacuacuacugccaauccuacgacuccaacuacuacugggucuucggcggcggcaccaaacucaccguccuc

SEQ ID NO: 54839 - RNA, 396 nt, Artificial Sequence
  derived and/or modified sequence opt11 from anti-HIV-1_HeavyChain
caaguccaacuccaacaauccggccccgcccucgucaaacccuccgaaacccucucccucaccugcuccgucuccuccggccgagucuccuccuacuacugguccuggauccgccaaucccccggcaaaggccucgaauggaucggcuacauccacuacgaccccgacaccaacaccaacuaccgcacccacuaccaccccucccuccgcggccgcgucgucaucuccgucgacuccuccaaaucccaagucucccucaaaguccgcuccgucaccgccgccgacuccgcccucuacuacugcgcccgccaccgcuacgaccccugguccaaaggcuacgacauccgcucccccuucgacuucuggggccaaggcacccucgucaccgucuccucc

SEQ ID NO: 54840 - RNA, 396 nt, Artificial Sequence
  derived and/or modified sequence opt11 from anti-HIV-1_HeavyChain
caaguccaccuccaacaauccggccccggccucgucaaacccuccgaaacccucucccuaaccugcacagucuccggcggccgcgucuccuccuacuacugguccuggauccgccaaucccccggcaaaggccucgaauggaucggcuacauccacuacgaccccgacaccucaaccaacuaccgcacccacuaccaccccucccuccgcggccgcgucgucaucucagucgacaccuccaaaaaccaagucucccucaccguccgcuccgucaccgccgccgacuccgcccucuacuacugcgcccgccaccgcuacgacgucugguccaacggcuacgacauccgcucccccuacgacuucuggggccgaggcacccucgucaccgucuccucc

SEQ ID NO: 54841 - RNA, 396 nt, Artificial Sequence
  derived and/or modified sequence opt11 from anti-HIV-1_HeavyChain
caaguccaccucgaacaauccggccccgcccucgucaaacccuccgaaacccucucccucaccugcaccgucuccggcggccgcgucuccuccuacuacugguccuggauccgccaaucccccggcaaaggccucgaauggaucggcuacauccacuacgaccccgacaccuccaccaacuaccgcacccacuaccaccccucccuccgcggccgcgucgucaucuccgucgacuccuccaaaaaccaagucucccucaaaguccgcuccgucaccgccgccgacuccgcccucuacuacugcgcccgccaccgcuacgacgucugguccaaaggcuacgacauccgcuccccauucgacuucuggggccgcggcacccucgucaccgucuccucc

SEQ ID NO: 54842 - RNA, 390 nt, Artificial Sequence
  derived and/or modified sequence opt11 from anti-HIV-1_HeavyChain
caagucgucuuccaaaaacccggccccggcgucgucaaacccuccgaaacccucucccucaccugcaccgucuccggcggccgaguccgcuccuacuacugguccuggauccgacucccccccggccaaggccucgaauggaucggcuacauccacuacgacgaaaccacagaauacaaacgcuccuacaaccccucccucaaaucccgcaucaccaucuccauggacaccuccaaaaaccaaguaucccucaaacucuccuccgucaccgccgccgacgccgccgucuacuacugcgcccgccaccgcuacgaccgcuggucagacuccuacgacauccgcucccccuucgacaucuggggccaaggaaccguagucaccgucuccgcc
